United States Patent 7,868,149 (PLANT GENOME SEQUENCE AND USES THEREOF) - sequence listing, part 54

SEQ ID NO: 29261 - DNA, 668 bp, Oryza sativa
  unsure (1)..(668): unsure at all n locations
ctataggcgaattcgagctcggtacccggtggctaacaaacgaggcaaattatcataagaagcttcaaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccctcaattacctcgttctccttatactcccagggtacatgatcaccctctgatataacaagtccagagaagtcctcatttgcccaatcagtggccattatatcaccttcctcatcggatgatgcgnnnnnnnnnnnnnnnnnnnnnnnnnnnnnnnnnnnnnnnnnnnnnnnnnnnnnnnnnnnnnnnnnnn

SEQ ID NO: 29262 - DNA, 1084 bp, Oryza sativa
ttgtccaaacatccaaatagaagctacaatagttggcaacatagtattaaacatttacaataaaagagcatcgaaacctccaaatagaagatacaataattggcaagtgcaactacaaggcgatgcttctatattttgtgtgtgtgtgtttttgtgttatccatatggagcacaatgacagaagaccatcacaaggataataaaatagatcatgtacacatatatatagtccactcatgagtgggtaggccacgatagtgaatcaaaaggaagtgcaacttcctgaatccacaggttctcttcacaaattttattgcattcagatttaatgtgacgaattagggatacggctattcgacatctttagggaccatctaaggtgcaactattctgatgaagtcttaaaaagacctaattgaaacatcttaagttggccaatagcaatatagcatccaagaagaccatgacagcaatatgtgtgtttgatcaaagtagtatcaagtaaatcatcatacacattcatcaagatataaaaagtacaatagaactggcatgtttaatattatgggatccacaatggtttagtaatcctatcttctaggttacaaaattgtgaagagaaaaaaacaaaaacaaatgctccttgcacctacctccaagggaaaagagagaagagggacatggaggatggggagcaagggagtttaggactaacctgtggcggggaagagtggggttgcggatcgacggcggcaagcaccaccggtggcttgtgccgacgcctggcacacagtcaaggcagtttggacggaggcggcggcatcgggatcggcatcggaggagaggacagcgatggcggcggcggcggcggtgactgagagcgtgagagggcagggcggggcgagcccacgttgaaggtgtaaagaagtgaggagaagagggcgaggagagctagagagaggagaggaacagagcggaggaggccaaggcgaaggagccaccacttttgtcatgtggcatcgggagcaagggcggcggccgcagagggacacggcggcggccggagcagcacggtagaggagaa

SEQ ID NO: 29263 - DNA, 7010 bp, Oryza sativa
  unsure (1)..(7010): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagtagcatctatatttatcactgatgctaggtagttgtgatactatacagaactttgcttgttcgaattctgaaaatgctccaacacaaatatttccattctaaggaagaaatgaatgagcgtatggttggattggaaactgtaacctgaactctacatatatacaacacagctaattttgtagtactcaaaaaagctagcaatatgctaaagtgggtgagaatacttgttgtttctatactggctttacctcaatgcaaaatagaatgtagtggtcggagaagctttctgggatggttcagcatggtagagaagtgtcacttttatcctgccatcactccttggtggactattgaaagtcacctatgccaaggaggaagaaatttggtgtggggtcccaaaactaatgattcggaaaccgacatgtttagactgtatcaagccctggatcagtagattgatacatgttcaacgatctggatcttcattgcatacatttgatcaaggtttcaaaggagataatattacaaaatataagggtatttacaagcttgtggctaactattacagcagaagctatatgatgactcaactctagtgttttgctatagacttaaaccatctatctaatctatacttgagaactaagttaaaatgagattaacttatatgattgaactcccggcttcagtaagaacatcaaacggactgaaaaaaatgtggggttgaagcaagggtgagtacaacgtactcagcaagctattatattaatcaacaatgaatgcatgaaataataatattcgagtagggttagatttacttgcagaaagcagagaatatagaaggaaagtctataatgttttaaatgcaacagtatttaataaagtttgaaattatgtttctaaccaagatgacattgtgagtcccaatgcccgataaccgcaagcatggctattcaaatagttttaataatattcatactgcagtagatatacgctttacccgcaatccatgacgtgccaaacacattagccttgtcatggcaaagcttttcggtcactaacatcaatggtacctgttccatgaactctagtccccacacgctctgaacgtaacgttatcagcagcgagaggagttctggtgttcccggggtttttagagagaactggttgagagaccctcgtcatctcaatcaggttttcataattcacacacacagctcacgagataattaagatatttacctgcgcctcggtaaatatcacaatcgccctgctcggcgtaagtttgcctcctgtgcgaggacttaagaagaaccactatacagaggtaccgcctttgctagataacttaatcagctaggtctatgcccatacgagaattgcggtcgtactcgtatgttcttcacatgtacttggtagtcttatgtcggttggaacagtactagccacccggaaatcaaccatttctaccgtactgtcccaatctaagtttattatattttatgcataatctaactaggcatggctaagcaaaatctagcatatatctggtttgctatatattcaggttatgcatttaaaatcatgtatggctaatgcagaagatactggagatatagaatataggattattatgctcaaaggagagaaataataacttgccttgctccaacgcaaataaatccgaaataggcaacctgattatttgatgcttgaaataccataggttgctatccatataaaatagactctactgaagaagaggaagatccaaattcaataaaagccataaaatagcaagaaagagataaacagttaggaggactagggtttaggttatctcttttatgcaggtatatggattactgggctgatattttatgtgcaggttctaaagggttgggggctaaggtggataggagattaagcaacaattgtcgcttatatttcttgtgtgggttttggtttcttggagagtaggagatataccgaataatctaactggttaagtggatatgtggctagtattggtcgaggttgggctttggtagaagaatggctaggatttagttgttctcgagtcgatgctgaaataggatagcatatcggctcgtaattcatgcataggctatgggtagtaggcaggtaaatggttgtgattatagctggtggggagtctagaaaataagttgactaaggtttcagttgtctaagccgatatcgaggtaagataaatatcgactagggtttgggtgttcgctagtcgtcgctaaagcatgacgactaggtttggtatcttctctagccggtgtcgatagacaatataacggctagagggatgggaggtttgtgcaggtttagcgaggcggaagtgttactccaacaaccatgagtggcgggggagcggctaggatcacacagagctcaagagctaactgtgcgaggtcgagggaatagtgaagctccgaccgttgtacgcatcaaggcgtggggtgccaggagcagcacttcgaccttgggtttggttttgccgggctttacaaccaacggttcgacgtcggggccaatagaccgcaaacgtccccatggaaggcgtaaagttccaaccggcggctttttagtggctaaagggtatttggggtaaaagaaaatatttgaaaaaggcaaatataaattcaattgatatttgaataaattcaaataaaattataaaataacaaattaggcatcaaaatgaagcatttgaatttagatgaatttaggtctaggtttcactgagatcggatctacggtttaggatatataggcttctaaagattggaatttgaattaaatagagtaaattgcgaaagtatactgttcatgggcccacctgtcagggattcctttttctttttctttttctcctcttcttcttcttcttcttcttcttcccgtctctttcttctttttctcctcggtcgaacagagaggaggaggagagggggcgccgggctccggtggcgaggaggcggtgacgccggcggccagtggtgttcccgactgcaacgcacctagggatggcagtggccggcaaagggagtaagggaaatagccggaacggcggatggaaggtcgtgaaccgggaggagagagagagctccggtgaggtttgattcagaggtggaggaagaggggaaaggggaaaaatggattcctctcatcgaggcaagctcgatggcgcgagggattggccggtattgctccggtgagggagatcggccgacgacagtgatagccggccatggcaaggagagagaaaagagaggagggcttcaagctcggtttgtgggggataaacagagggggttcatcctcttatataggcgatgagaggcggttcgaagaggagtaagacaagggagaatcggcgacggcgatggcgtggaaagaaggatgacggcgccgacttgattccttagcggcgacggttgcggcggcgtgcgccgtgcacggcacgcgcactgggaggagggaggcggctgggttgtgggccgaactgggccggctcggcttagctgggccggcagcccaagaggaaagaggaaaatagaaagaaaaaggattgggccaaaaggaagaaagaacggagtttcggctcgatgacaaaaagaaagaagtctaatttgtatacttgatttggataacgttgttttgcgaagaatttgaattaggagagaattcagaaaaggagattttctaatttatttgagtgcaatatttagaggtggagtttgagggaatttatttggaagcactcaaataggaaagtaaattaatagtattcctcaaaatatttttgggaatgtggtaggaaaataggtggaggcaaaaggataggatttgaatcctaaaatatatggcatgggtttcaaggaattgtttgaggctaaaaggaaatttaggtgacaaggatataatttattttcttagcacaacagcaattattcacaatatttgtaataatatttttcttgtgccgagaaggaaatcaagccacaggaattaaattagcggctagatcaaaaggaagaatttagatatttggcgataaataagaataggtttggaatcaaaggataggtttaaaatcaaaggatgggtcgacaattaaatccaattggaattgtttggtttaggttctaggacaatagtggagaatttcttggaccataattcataaaaatagaaaggggttttcaaactaaatttgaataaaagaaattttaatcaaaagaaggttttaaaccaaatcaagaaatacctcaatttaaccaaatatatatttttaaatgaaaaacacaaaagagattaaataacagagaggttttgtgcgagttagttctaggaggtccctctaattatattatcctaggtttaggaagttattaagatcataataatcggcatgatgcaggattagaaaatgacgcattttcaggatgttacatttgggggggggggggggggaattgcatatgtaccattgcaaaagaatgacttcgctagaatgtcattcttaaaacaggcttcggtaaaataccacgttcaacgaagacggcttcgccgaaatgccatcctggacgatattacccttggctccacttcttcctcctccatgagccggaggagctcaccggcgacgactatgtgccatggccaacactagctgtagcattggagaggagatgcagccacgacgtaaaccacgatggtcagcagccaattcattgaggacaagcagagccaattcgtccttctcaaccagcaagcaaacaagcagaacaagcagcctcaaacagtcacaggtcaaccacgacgccatcgacggctccgccgcctcgtcgtccatcacggcaatttttcgctgtcttccgcagtggctccaagtctgggtccccgcatcaccagctactaccgctcgccgccgtctcattgtcctccatcgtcaattgcagcgctgcccttccgtcgtggtcctcacccgccgctcatcctcacccgccagcaccagatctggtagcatgcctcgacggtgatggcagcggtggtcgttgtcatcgcgcgcgcccgcggctggcgagagcacgtggtgggcgtgcatgcacaacgcgactgcgcacggcctcgtctcctccgcttcccgagtccgaccttgccccgagccggagtcgcctcctcctcgcgcgcagcgcacggccggtgccaagcaggttttggaccgagggcggacggacgcgggcacggaacttgctccctccactagcatatgtacctgctgctgcaataggcgggtgccatggccgccggtgagctacaggaagatggaagaggtgccgaagggtggaagaagatgcccaagggcaaattagtccagtagggcattcgggcgaagccatcttcgttgaacgtggtattttaccgaagcctgttttaaggatggtattctagtgaatccattcttttgcaatggtacatatacaattttctcttgggggggggagggtgatgtacagctgacctggagacgggaaggccgggcagcaaatcatcaggtaacgatggcggctgcgatgaacctgtgccagtgacctacaacagtctaaatgcatatcatagacaaaaaggggcgcaagctagtgtatattatagccgaaccatcacctgatactggatatttgcaacataaacatttatttaatgaaagattaaaaaaccaattcaaggtaaaaccataaacatttattcaataaagattgaaagaaaacaattctttcaaggtaaacctgtgagaaaaaaaatgatttaacagggtcaagtctgattcattctaccctagcacaatatagttaaaatctagagacatctgtagacacttaagactcttttaatttgcattcagtgagacattatcaatggatcgtaggccctcctagctagtatgtcttactatacctctagctaagaggaagaaccaaattaaggtacacaagaatttaatatgcacctcatgcaaggtggtgtaaaaaaaaaaagtcccatggctttaacataggccaatgatagctaaaatttcagttctaaataggtcatgatgactttataattttatatgttgttttaaaaagtaattgattcttatggaggaaaaacagaactcacatatacatgtcacacttcatatgcaggggagggataccataagcttaaaaagcagtaataaaaaacagtagggcatttatattatgatcctaaaggctttgagatggatccacactatttatgtttctaagtgtacatcttatgcaggcaaaaaagaagcacaaatattaatctcaaagcagtctaaaaaggaaatttaccttggcaagcaaagagaatcattgcatacatttgaaaggtatcctaggcttgattaaatgcaggaaagccccaactgcaagcagggaaccacatgggggcgtccttgttggcactgcaaaagaagggttgccgattggaaggaaatctttggcaaaagagatgaggtaagggccagagaagaaattggaggtaccaggaagcgacgccgtgagcacggccttgccagcgtcgacctcattgtccaaacatccaaatagaagctacaatagttggcaacatagtattaaacatttacaataaaagagcatcgaaacctccaaatagaagatacaataattggcaagtgcaactacaaggcgatgcttttatattt

SEQ ID NO: 29264 - DNA, 1513 bp, Oryza sativa
agggtttgtaccggttcgcgaaatccaggccgtccgtccacaatccgacgatcacacgggcgtggaaggcccggcacagcgggacacgtggacggccagatcgaccctacggcgagatcggacggtggacagcagcggggaccagtccataattaaccgaaaggggaagggtttttttgcaaaaatcgctgacgtggcgcccctaatcttccggcgttcccacgatgtttaagtaaacctatatttgatgccgctgatgccaattgtagccatagaaaggtctgtccgtctgtgtttggtacaatggaaaagtgttttaaatttctgcggggatgtcccattatttttttcaagagaaaaaaaacaccatataaatagttaccaaaaattctcaaacaaaacaacattcataccatatacataaaataaactattttaaacaatcaagtcaaaacttaactcacacattgagaaataaaaaaaaacagcatatgaatggtattggtactattcactcctggatgtcttctttgtttctcaatatatagataaaatttgaatataatttttgatgaagaggtagatgctaccatactatattgccaaattgttttagaatttttcataatcacctctattgaatttgagagaaaaagttaggcgagaggatagaggtattagaatcctctcccagattaccaaacgcagcagtgaaatggtttactcagggcaagtactataatgcttcatatgttgcccctacaagtgccacattagattgagtgatgaggtggaggagaaaagtgaagagagagatgatgagccacccctaaatcaagaggcaacctccacacaaatttcaaaaaggatgtgagagtattagatatattggtatttgtgaactcgaggtgatatattgtatgggttgcctcttgcttcataagtgaataaaatagataaatttggaggtagtagtcacatctaccatagcactttccctcgtacaacagttgcatcagcaaaaaagttgtatttgatacaaaccccaagggcaatcatgcgacggtaggattatttgatacaggaactgcccggggctaaaataaggacataactaatggattaatctagaagaaacagtgtgaagaacaaatctcaaaccgttgactaatccataactacaaagtattatacaacatctccattaaaataggagcagcctccttggcaaacttgaagaccctgtccaccaacctcaactttaaagcagcgaaaactatgcgactccagctctgcaatgactttctccagaactaagttggatagcactgatattcatgttaaggaaacatcatgcatcactaaaagataggcataaatcccaacagaagaggagtcacatagcttagtgtcagtatgtggactctgtgacgaagctagaagtacaataaagatctaataagcattcttaaaccagaacaagggcattgaacgtagtaaaaatgcatatcta

SEQ ID NO: 29265 - DNA, 7543 bp, Oryza sativa
ccctcgtacaacagttgcatcagcaaaaaagttgcatttgatacaaacccttgggcaatcatgccaccgtaggattatttgatacaggaactgcccggggctaaaataaggacataactaatggattaatctagaagaaacagtgtgaagaacaaatctcaaaccgttgactaatccataactacaaagtattatacaacatctccattaaaataggagcagcctccttggcaaacttgaagaccctgtccaccaacctcaactttaaagcagcgaaaactatgcgactccagctctgcaatgactttctccagaactaagttggatagcactgatattcatgttaaggaaacatcatgcatcactaaaagataggcataaatcccaacagaagaggagtcacatagcttagtgtcagtatgtggactctgtgacgaagctagaagtacaataaagatctaataagcattcttaaaccagaacaagggcattgaacgtagtaaaaatgcatatctaacaggactaaacatcaatgagtgaatatatatcagaagccagatatgaagaaattgagtatttaaattgtaaagaaatatgagaatctttagattgcaatatgtcatttatgttccgcttctctacactatgacatttcataacaatgtatactgatttgatccatagcaatttcagaatcattcttttgtagtcattattgtagttctgaaatttagcttgctaaattcagaaccactaaatgtccaaaaagaacaaaagttgttgaaagttgagttattagatataaaatcatatataggtggcgtggtattttcacaatagagaagtcatgaatgaaagtctgtaaaatgttaggcataaaaaggatactagttggtatcagggtcaaaacacaaccaccacctccagctcctgttaacttggagaccaagttgaatttcaatgttgtccgcagtacagtttctattgaagaatggctaacacccatgcactgaagcaaaccttggttcatctccatgagttccgccagcttttcctcctttgaggtgatagctatctcatcattagctgctaactcaacaatgcttgacacctcttcactaatggagttcactgcgttgaatacagaagccatagcatctgaatgcctggaggctctttcagagacaccagcaaccagagcctttgtgttcctaccaactcttgtatccgtaataagcattttcactgggttgctagatttaaggtttgtcaattcccctttcttgaatttgatcatgcttcctaacaatcaggaacagatttaattagtatatgcaaaaccaaggaaaacaaataacaagtaaagggaggtttagattcctggaaataactggaactagcacaacatgcatggctggtacctaaacttaacacggtaatgataatgaatctaaaataggatatgtcactttatttgatgactgtaacaatattatctgtatttgcatcatctcattcattcaactaagtgtcacttggatgtccaacagagccggcatctaaaagtactaaatcgaaagactttccatgaaaaagaggagagcataccgaaagtgctgacagcattgtcgatgccagaaggcttcccatggataatcttctccccctggaaagcccaccggttaactagctcaagatcatccttcccgaccaactcccaccccatgccctcgccgctgatgccgccgactgcagtaaccacgccggcagctgtcagcaacacccccgacatcgacacgcagaaggcggccgatgacccaagccccgaccccatgggcaggtccgagctcaccgtcaccttcccgggtctacacctacaatgtggcccaaagtcctccatacccattaggaggtttcatgattacgtcaaggattgctttcaggatagaggcagagcaagcgaaccaaccccaatatggaggtgtagaggaagaggaaggcagagagaccggcggagagccagatcttggcctcagggatctcgtgctcctccaagagcctggcaatggaggccagccggtccggggagcatggcctcgcctcccgtgcccccgccgcctcatctgtcagcagcacctcgcggaggcgcccgcacggccacgagaaggtgaggccaggatccttgaggtccagctccaacgtggcggccgcctcgtcgtcagcgaggggcatgaggcagagggagcagcgcgtgtagaggtcgatggcggcggcgacggcggctgagccatggacgacggcgtgctcgccggcaaggataatcttgcctggggcgcgggcggcgcaaacctccattagtgatctgacgaacccttcctgctctcatgtcgaatcgaattgatcaatgctaatgtatgctataagcttattaaattggaattcgatattaccgaagtttggtactccaagcaacaacccaaaggccgctgcttttaatcccctggatacagttcttctgactcactttgaaccctcgggttttatggcctgcacaatgcaaactacacggatgattatcgctatatatgctattggcaagtatcagccacaccacccataatgaaggctacactttcgtgtttttgtgcttcagcttttgaatatctgtgtcagtacttaaaagattgagatcacattatacatcagttgaatctatttatgaaatttaaacccctctacagagccagaaactgaaatatccaggggcctatatcatgaaacacaattaacagctgttccttcagtcaccagcctatccaagggcctatatcatcaaggatcaccccttcttctgtgatataataaaatgcatgttcttgaatatatatagtaccttcttatcacccttgattagtaaaaaaaaccattattgtgtttctgtttagtatatgcaccagaaagcatccataatacatagtggacagaagaagaatgtcaatttaatttctaggcagaaataagggataccaaaaaggaactcagagaaataaaactttgaggaaataatgcaaatgtgaagaatagcagtatataaatgataacatcaatttttaaccttttcgaaaagttcaaacactattcacagagtttttccaacatctcaattctcataattgcttgtggagtaggtaagggttttcaaaaagcaagcctggactcctggggcccctggactggttggttggttgcctacaatctgttacatcaaacagttcacactgcgataatctgaaaacgattatattctgggattgacatgtagggaaaaacattttgcgctaaataaactctgtgtgatgaacagaatgcaaatcctgaattacaatcttttggtgacagatagttaaggtttcttttttatgtggagaaaattgttgatggtgactatctgtatggtctatggggcaaataattgatgttgaaaaattctgaatgaatatgcatctatagcatggtttattgtttcaaactataattagtagtataagattgaaacaaataatatgcaaatagctgaagcgaacaaatcattcattctttatggatatgaaagagccaatcaatatatatgctatttcagctgcacaagtgtctagatttacaaagtttcatgttaaatgtccatcaaatgctgcattattatgtaaaaaaagactcttatgcatatgtttgcttccaagcaatttactttcagaataaatacaagctgtaaaaagttacccacgctggaagaaaaagaaccgagttcggtgtaataaatattgatatgaattcacgcgtcagggtcaggccactatatgtggtcgaattgtggcctctataccatcaccaaataaaatgcacatagctgaagcgacctaaaaatcacctgatagtgacgacaacgttggtgtggagactaactctgaaatgtgtgtgatctgcagcatattataggaaaagaaaaactacattaaagatcagtgggatctatttcttgaagctgaacccctctgcacaaacaaacaaatgtaaaacagaatgccgaaggtcaaacttgcgaaactcagagactgaaagccaattgaggacagcatacgattgctgaagttcagaaccagataaaaaatttgctcgcattcatttattcatatcagtgagtttgtggttgtcggttaggtgattgaggtagtcaacacacaatacagaccatggtgctgcttaaactgacagtattcaacattgcagtagttgataactctttcagcaagctagaatatatgccactgcaatttagttcaatttctgcacattgacagctccattttaaaacagatttgatcaggttgagttagcagcagattgtgaagcaagttctccacaaaataaaataacatatcatttcaccccacaaaaaaaaaaagcagaattcatatgaattcattagcgcagccaaatttaatagtgaagcttagggcattggtcccaagtccatattggagattaaagaaatgaagttgccgcgattgacatcgggcgagaggtatttgctgtcctctccaaccttcaatccaagattcatcaaatcagtcgaacttatcattgaaaaaagaaaaaaatccaatcacctgtcggcacggtcgcgatccactagtggcggcgacggggttaggcggaggccaccagtggagaaggcgagttgctttcgaggggaaggtggaggcgcgacggcggagcgcgcgcagctatgatggatcgaggcagcaggatgatggatcggcgcagcggcggtggaggtggggaagtgagggggccgcgacggcggggataggcggaagacggcgaggggcgggagggaggcggaggcggagggcggcgaggcgaggcgagaccgcaggatcggcggcagcggcggttgaggtgggggcagtgcgggagacggcggccggatcggcggaagtgggcgtcgattgtgcgagcgggaggggattggagtggccgttttgttttgtttgttttttttttactgtcgatgtgtcagttgagtgaaatttttgtgactgcacttcaattttttatcagcttctttttttttttatgcttacaatagattgttactagaacggaggagtactaataaacaaaaatctaaaacttttaaccttaaatttaagttgattttaaagttttttcatcgtagtttatttttcagatcgttaatagcacatatataaaagttttatttataaattattttttatttgtaaatatgcaatttggaataatccaagcgatggactccacagtcctctccacgccgctgcgcgtgaacacgtgcatctgcccctgcctccctggccttactgggttgaatcaatttctgcagtcagttttgtacagttctaaaaaaaaaaagggggcagttttgtagtattctcagatcagatcacgtgaagctgaacagagagggcttagccaggtcacaaaaataagaggaagcaatgttgaaattataagcacataataatttaatttattccataaataaatcatgacattgcagatgtaaactagattgaacgcatcattagatctacacatgtaaactaagcagtaaaacatgaacagatcaaatatgcgcaacatgtcgaacacgtaccgagatggcggaaagaccggttgctcgctaggaactactcgcggttgcgagcgtcgacgaaggcgcgaagcacgcgagcggagaggaagccgagccgtcacgaacgaacagggagcagtcgagcgaagcgcttcccaaaaaccttattgccgccttctcccggtgcaggacgtcgaaggcagaggttccggagacctgctctcccgatcgccggtgcatgccggcgagcgggatggagtagtctacgagcgacgcgcggtacagagtaggaggcaaaccctagattgatttcgcgtgtgatgtgtgaaggcggcggctcggtttatatagagataggtcgcctgatcagggcgcccgcgtaaaccgaaccggataagtcgcgcgtaacctatccggactccacgccgtttttcacgcaccggatttttcgaaatgtttccaaaacaaaacaaattcaaatttcccgcagcaaaacaaaactgcaaaaggaagctgcatctgcgcaagggtgaggagccaattttgcggaccattcgatgcgtacgtcgtgcacgtgcaccgcctgccctgccaggcgaggcgaggcgagcgagcgcgcgcgtgtgtttcccctcttttctccaccacacatgcttcaagtgactaggatggcatcctcccttttaaggaggtccccctctcgtaaaataagtaaggtgatactaaactccacatgcatgtcatcccatgaggtgggcttttgtgattttccaaagaattaatcttcgaatgggccttagcccatctattaattccaacaatcccccaccaaatctcaaaatcccactgagatttgccttttccaatgtactgtttatataccagcggttcgatggagaccgattaaggttgaacatccacctagatctccaagctacacttactcacaacttgaacaatggactacgccttgaattgtaagtcttgtgtaagcaagtttcactcagagtcttatctggtattagaccgtctatagactacccctcgggtggagcgtataagtcatactcctaggtcattagtaagcttcctagaagattcacccaaaatctccatagactgcgaccaacagtcaagcttacaaaagtgagttctttcaagaatgctctgcaggacaacatcttcgctaattaaagccaacagaactcattaaggcatagccaatctgccttgcagctcacgagagtacatgcatcttcacttagagagggtatagataagtactctcctctagtttactaatggtttgttcttcccaggttctaattcacgggatctccgatcacatagactgggttaccaccatagtataactcacatgggtctcaaacccatctccttcgatgcattatctatcatatttcgtgatagttccttcgtgaagggatctgccaggtttctagctgtttgcatgtaatccaacgttataactctggagtttctcaatttcctgacagacttcaatcatcttttcacatgtctagacaatttcatattatccttagaactattcactttgacaattaccgtttgattgtcacatttcataaggatagccggcaccggtttttcaacaataggcagatccattaatagatcacgcagccattctgcctcaacagtagcagtatttagtgccgtcagttttgcttccatggttgacctcgtcaaaatggtctgtttgcaagaccttcacgaaacagcaccaccacccagtgtgaagacatatccactagtggctttgatctcatccacatcagagatccagttagaatcactataaccctccaataccgcaggatacca

SEQ ID NO: 29266 - DNA, 2239 bp, Oryza sativa
ccattctgcctcaacagtaccagtatttagtgccgtcagttttgcttccatggttgacctcgtcaaaatggtctgtttgcaagaccttcacgaaacagcaccaccacccagtgtgaagacatatccactagtggctttgatctcatccacatcagagatccagttagaatcactataaccctccaataccgcaggataccaatatagtgaagccccaattccatagtacctttcagatagcgcattactcgctcaagcgcacgccagtgatcatctcccggattagaggtaaaccggctcaacttgctcacagcaaaggagatatcaagcctagttgcactagccaggtacatcagcgagccaatgatttgtgagtattccagttgattcctagcaattctcttgttcttgcgaagcaacaagctaggatcataaggtgttggagagggcttactatcaatgtagccaaaacgattcaaaatcttctccacataatgggactgcaagagtgtaattccattctcacctctaattagcttaatgtttaagataacatcaactactcccaaatccttcatatcaaaattttgagacaagaatgatttaacctcatttatcacctcaaggtttgtcccaaatatcagtacgtcatcaacatacaagcacagaataactccctcacccccaccatggcgatagtacacacatttatctgcctcattgactgcaaagcctgcagatgtcaatgttttgtcaaatttctcatgccattgcttaggagcttgtttcagaccatataaagacttcaacaatttgcacactttgccttcttgaccttcaactacaaacccattaggttgatccatatagatctcctcatccagctctccattaagaaaagctgtcttaacgtccatttgatgaacgagaagaccatgtgaggctgctagggaaagtagcacacgaattgtggtcaatccagcaataggtgagtaagtgtcaaagaaatcttcgccttctttctgagtatagcctttagcaacaagccgagccttgtactttttaatagtaccgtcaggcctaagcttctttttgaacacccacttgcaccccacaggtttacacccacagggtcgctctgtcacctcccaagtcccgttagtgataatggaatccatttcactacggacagcctccttccagtagtctgcatcaggagatgcatatgcttctgaaattgacttaggagtgtcatccatgaggtacacagtgaaatcatcaccaaaggacttagccgtcctttgtctcttactccttcgaggagcttcactgacatcctcgtcaatgacatgttcatgtgtatgttcagtttgttctggtggtgtattgaactgggaattacttcagagggttggctcgaactactatgtatatccttcattgggaaaaagctctcaaagaaggtagcatcacgagactccataattgtaccaatatgcatgttaggtacctcaaatttaactattaaaaatctataggcaatgctgtgatgagcatatcccagaaagacacaatccacagtcttaggtcccagtttgcgcttcttcgttattggtacattgactttcgccaagcacccccatgtgcgcaaatacgaaagtgatgttttctcccaatccatatctcatatggtgttttatccttatttctgttaggaactctgtttaacacatgattcgaggtcaacaatgcctccccccaccatgccttaggtagtcccgcggtgtccaacatggcattcaccaagtcagtcagtgtgcggttcttcctttcagcaatcccattagactcgggagaatagagagacgtcctctcatgtatgataccatgttcctcacagaataagtcaaactcgtttgagaaaaactctccaccacgatcagacctaagcctttttatctttctatcaagttgattttcaacttctgccttataaattttaaaatagtctagagcctcgtcttttgatttcaacaagtacacagagcaaaatctagtagcatcatcaatcaacgtcatgaaatatcgttttccacccttcgtaaacaccccattcatttcacaaagatctgaatgtaggagttctagtggtgccaagtttctctccttggcagccttgtgaggtttgcgaggttgcttcgattgcacacaactatggcacttagaacctttcacaatg

SEQ ID NO: 29267 - DNA, 692 bp, Oryza sativa
  unsure (1)..(692): unsure at all n locations
nnnnnnnnnnnnnnnnnnnnnnnnnnnnnnnnnnnnnnnnnnnnnnnnnnnnntttttaataaatgatttaagtgaaaaccaatgatttattttgttcataaaatttcaaattattattttgctaattattaagatgtaacacatagcgacttaaaatttttccttcaattcttccttctaatttttaagatgtaatacctaattagaaaaataattacccctcttttgagatgagttaggccgggaatattacttcttttgttctttgctttaacttcccaacttattcctctttttttttttctagggcacacttttcaaattgctaaacggtatgtttttttttaaaaaattctatacgaaagttgctttataaaaatcatattaatcattttttttaaaaaatagctaatattaaattaattatgcgctaatgagtcgcttcttctggtgctctagagattaggtcgtaacccatggaatgaacacagcctagttatgttcattttactcttagaaatgtagatctaaattaattatcgtgaagttatgtaggatgataaatatttattattattggtttttatatttcttctaatagtttgaaatgcatgcaaaagttaaaaaatatagcccaaaagtaacatatttattttcatattttagtaataggggaatttggtctttaacc

SEQ ID NO: 29268 - DNA, 607 bp, Oryza sativa
aaaaaaaattccacatgccgattccgattattatttgcatttattaactagggaattagctcttggttaattaagataatttcttcgggcaatttatttaaccaatttttaaagcaagcaaaggggggaaaacttcagggcgtgacaggacacttcctagccagatgaccaggttgcccacacacaaagcaagtcctctcatcctggttaggattgttgttgttcttcttctgcttcttgaagttggtggtctgttgagctttgtatttccccttgctcttgttctgggccttgtgcacaacattggcactagactgcccaccatcgcccttagacgcggcgtatttttcccgagttttctcctcaacatcaagagacgctatcaacccctcaacggagtattcctgtctcttgtgtttgagtgcagtaccgaaacttctccatgatggaggtagtttcgcaataatgcacccgtccacaaatttgtcgggtaagacacacttaaggagttcgagtttcttagccatggtttgtatctcatgagcctgttcgactacagaatgggtgtcagccatcttgtagtcatgaaactgctccatgatataca

SEQ ID NO: 29269 - DNA, 399 bp, Oryza sativa
  unsure (1)..(399): unsure at all n locations
cgagctcggtaccctgcttcacgccttcgtcgacgctcgtaaccgcgagtagttcctgccgagcaaccggtctttccgccacctcggtacgtgttcgacatgttgcgcatatttgatctgttcatgttttactgcttagtttacatgtgtagatctaatgatgcgttcaatctagtttacatctgcaatatcatgatttatttatggaataaattaaatcattatgtgcttataatttcaacaatccaaaaaccttattataggcgccgtgattttactatggctggttttgccgatgcactgaggccggataaattcaccggtgtgcactttaagagaaggcagatcagggtcactctatnnnnnnnnnnnnnnnnnnnnnnnnnnnnnnnnnnnnnn

SEQ ID NO: 29270 - DNA, 1237 bp, Oryza sativa
  unsure (1)..(1237): unsure at all n locations
nnnnnnnnnnnnnnnnnnnnnnnnnnnnnnnnnnnnnnnnnnnnnnnnnnnnnnnnnnnnnntatccgaatcttccctctccatttcatcaacaattataccgactctcttcccctcatccgccatgcccatagcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcatcagtgctgtccatcggcattagttcccaaaaataaccttctgttgcacgactcactacaactgacactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccttaagttacattctctacaatattgttctctaaatttctaaaattacgttacattctccagatcaaactaaactacatcttacaattaacactactgtctatgtctcaattcatactattatattctatgctctggatctacacatatgtgctgtgtgctacagatgtgctaaaatatatggaactaaaactaaaacgcaacatatatactcaaacataacatattagtacaaatgcaaaagatgtatgggagcatacctgtgatgaattgagcgaaccagcagggcttcgccgctccccttctgctgccctcccctctctctctttcgttttttttggatttttagtgaatataatgaaatttcacagaggagggactgggctttatagggggagaggcaaaaatcgccctcccccagggcggcaagggggccccctgcaaaattccatgccccctcgccgcccatttgcaggccgccccccccacagtacaaaatcgccctagcggagggcggcaaggggggccgcctgcaaaatttcatgccccccctcgccgcccatttgcaggcggccccccgcacaatataaaatcgcccttaccgatgg

SEQ ID NO: 29271 - DNA, 6048 bp, Oryza sativa
ggaggccggcaagggggccgcctgcaaaattccatgccccccctcgccgcccatttgcaggcggccccccgcacagtataaaatcgccctagcgaagggcggcaagggggccgcctgcaaatttcgttgacggccgtcgcccgagagcgaacggccgtctgccaggtcattttcgccgccctctgaaagggcgattgggcggtaggcgactacttccgtcaattttcaaaatggaaaattatttttgtaaaacttttaataaaaaaaattataaataaaaaaaattccaaaggagaccatatgacccacaaaagaatttgggcttcaaatcaaacaaaaccaaatggcctgaaagcccagttcccaaaaacagcagcttaacaagcccaaatttgaaccaatggcatgtgggccaagctagtagatgccccacaaatcagtaatatggatccacccagtccatatcccctgatataccacgctgagctttatcatgcatgccggagcagatcactgttctgctcaacaaattacctgcacatgatctaaaggactgattgttccaggataggagcatccgacagtaatttcgttttgaagttatatatatataactgagattttgaggaattttatcagtgattttttgggattactagatttgtaacacagtttgcattgcgttgaatgttatgatactatttcattaggcaggtgggaaagtgcttttattcatcgacatccacttgttttctacatgttacctaaatatttattaatgttttttaaaaaaatgacaaaatagattaatatgaaatatatatctcttcacaagcatgtaattttaaatttaacttctacaagctgtaacaaaaattaaaaaaaaatacaactctgaatgtttgtgtactagttttagtttaatttattgttctgttacaacttctagaaatcaaatatgacctacacgtttgtggagtatatctcttattaatgaggaaaatttcttgtgtgcctccttaaatttcaaccaatcccttctatgtttacgagttttgctcactcctttttatactcctgaattttgatttggattctctccacaccatttccatctgccgactgtttaattcctataaaattatccatttttcctttagtcatggaagaaagtgatcatagagaatatcgttggagtctagtataacaaacttatgaatattatagtcacacaacaaagattttgacaaacttcttcattccttgcgtgcccaaggtaaatttgattttttatataaccactaaaggtcatgtaacgaaaattgtatagaagagatcaaaagcaaaattttggggtatacaaggaattgagaaaaactcaagtacgtagaagagattgacttaaactaaaatcttgttaatgctttttaacttttttatgactatttagatgatatgtaagaaatggtgagatgtctactcgagggataaaaatccatctccacacacagatcacatgttgttccaaaccaaattttgacaaattagttgaaacaggtaaataaaacgctgcagtgtcgtccttatggtaatatggtgcggcatttttctcgaagaagaatacagtacgcaaatttgaactctttgatatggatattcccgatgagtgtgacatgcgaaacgtaaatagcggattatttcctgcctatctttatttaaagattttcctgcctatctcgaaaaactctgtgttcggccctcctcccagcacgcaaaataaagctagtattattgcatgattaattaagtattaactatttttttgaaaaatgaatcaatatgattttttaaaataacatttatatagaaagtttttgcataaatcacaccgtttagcagtttgaaaagcatgcgcgcgaaaaacgagagaggtgggttgggaaaataggggaaagaacacagccttaatagtctttagtctatctacaaataaaattattttgtagcaattccatcacattaaatccaaagttccacttgttctaggcttctagcagcctttcaagctcacttttcatcatgcagttactacaagtttgctagaccaggatatgtgtccactacaagcttttttttgaaacctatgtccactacaagctgacaaaaacaagggttggcaagatgtcaacactatgtaacatgatgtcaacactgtgacacttcaaggtccaaaaagagagtacatggatgatctttttccttctcctagatcatgtttatgccctatatataaattctctccaaccatcttcttgtgttcatgactcttctcaatctaaccatatgcatcaacaatactagcctaatggagaagctggcagtaaccactgacattatctgaagaaattacttgccggttacagcaatgaagagaagctgaacccagaggagtggtactgagaacacaggtgccaatacaatgtatggtgagctactgtataatggagtaattctgtaactgtgttctcaggtcacccctttgggtttcttctcatgattctttgtccaatttgagatagtggtatacttgaatgattagattggtttatcttgattcatgagcaaggatatgtctatatactagggttagacatttcggaccgaaattcccctccgatacgatattattccggctgaatttctttaatttttcaaaattttcataaatttgggtaatatttattcaaattcaactaaattttgctcaaaatttcgaaatttcggaccgaaatttccaaaatttcgggatttcggtgacccccgatataaaagcacaaaccgataaagcaaaccctgctatatactatggaaacgtctagaggaagttccttttttttttcctcatgtattttctcttttgttccaagaattttttttttctgttcttcattccggtaagtgttgccgcaccaacattttatttacatgttttttcttgcagcaaatctgttttgtatggatattgctgtaattggaagaacaaataactgaaggtagtctgtagatgtttgtttggaaaagcgtttccctactcgatgggtgtatatcatctaagtagttagaaacaataacaatatagattgatttgtatcactccataaacattgcacattcaaattcgattgctataagttgaacaaagtatttgtatacaagttttaatttaattttttgtttttttataactggtttttacaacttatacaagtcgaatttcagcatgcatacttatggattgatatatctcatactaatctattttttgttacttttttatttatttataactatttaagttacaagcgatctatgagtaactgtgtcatccacgggctgttttcataattccagcatcatttgactgttcgttgtgaaatttatgtcaaaatctagtgaattttctatatgcttaacaaactaattccacggcaataacatacaacaaggttgttagaacagaaagatttacactctaataagtaataacatggccactgttcttccattcgtaagcagctttcatcagtttgaagccagctgctgccgttgcatcctcttcatcaccaaaaatgtaatcgaagaactcctcgcatcctcctcctccgccattgccgtcggcgaggagactcctcttcctcttcacccttctcggcgtcttcttctcgaccggctccacctctccgaggtcgccgaacgcggcctccttcgccagccattgttggagaagcatcgcccttgcctccttcatggcgggatcatcagcgcatcccctgaagtgttcgtccgctcttcggcatacggcgcggcacctccggacccgctcggccttctccgccgcgttcccggcgatggcggcgccgccggagcacgccgtggcctcgaactcggcgtagctcacccacacgttgaggtgttgtgttttgccgagaagcctctcgtagagctgcctcgctctgtcgagctcgccggcgtcgatctcgaactggatgtagtccgtccacactagctccggggcgtccagcgccggctgagagacggcgaggtcgtatacggatcgggcgcggtcggtctcgcccagcttcttctccaacgcggcgtagcttctccatacgtggctgctgctcggagcgtgctcgatgaacttctgggacagaatccggcaccggccgacgttgccgagctggagctcgatctcgatgtacctcctggatagcttcggccggggcgcgacgccgatcgcgttgccgaggagccgccgcgccgcggcgaggttcttgtcacggatctcgagctccgccgccatgacgcagatattggagaaggagaacttcttgtgtgggatcgtcctgaggcactcccggtacacgccgcgggcgcgcgccacgtcctccgcgtcgagctcctcgaagagggcgtagttgatccagaggtagatgtaccgccgccaatgccgcttctccgccgccgccgccgccggtggaacgttggcgacggcgcgcctgtagaggtccctgatccggttcgcgtcgccggtgttggcgctctcctccagcctgatgaggtcgaaccacgcgtcgtagcacagcgggttcgtggtcaccgcgcgctcgtactgggacctccgcttggtgacgatgctgtcctcgacgccatggcggtcgccgaaccgcttctcgagagagaggagcttctcgcgcagctcctcggcgcggggctcgggcggctcgccacggagcgcgtgctggtatattgcacgcgctcggtccggctccccgcaccgctcctcgaagtcggcgaacgcggcgagcagcacggcggtgtcgtcgttgtcgccggcggcggcgagcaggctcccggcgtgctcgtacacgcggggcgcgcggtccaggttcttcagtttcgtctcgaactcggcgaaaaggatgaacgcgtcggcgcacgggagagcagcaacatgccgctcgtgcacggctctggcacggtccagctcgccgtggcggagctcgaacgcggcgtacgcggcccaggcatcggcgccggggcgccaagacgtccacctatcgaacactacgcgggcgttgtctgtggcgccgaggagatcctccatgcggaggtactccgaccagatgcggtcagcgcgcgggaggatcgccacggcgcggtcaagtacgttgcgcgcgtgcccgacgcggccgccacgagcctcgaactgcgcatactttatccacacaccatggtcgcggtacgccggcgcgccgccggccagcgcgcgctcgtacacggatcgcgcgcgggcggggtcgccgccgccgccgccggggaactcctcccaccgcgcgtacctcatccactccgacgacgcgtcgccgcatcctccgcgaccgctgccggctcggcggacgatggcctcgaaccgtgcgcgtcgctcgagccggtgctcggcgagctcgtcggcatcgacgatcctcctcttcttggactccgccggcaggcagacggtcaccgatccatcgccgtgcagttcgcgggcctcacggatgagatgctcggccgtgagctgcacgggcgccggtgctttgttcttgacgcggcggggggtcggcagcatcgccaataactggaactggatacaggtggagaagtgccgatgagttgtggtgtcctattattataggccgccgaggaaggccaggccggtacacaatggaaatacgaatcgggcccggtcctttgttcctttggatttttttcgtttttagatttttttttaatatttacagaaataatctatcgaccaaaaatattgcagaaatagcccctgccgctctaatggtgggcggcaagctgacgtggcagacggcgggtcgaccgcgccgtctgccgccgtcgaccaaaattgcgattaggcccttgccgcctatacagagggcggcaaggggctaattgtaattttggccgcccataaagagcttgcggccgtactttttc

SEQ ID NO: 29272 - DNA, 3370 bp, Oryza sativa
tgaaaaaagtacggccaaaagatttttctatgttatgttaataataaataaagaagtatttattggtaaaacttgttaatattgttataaaaatgtattgaagttggttgttgcgcaatttcatatgttaagtgaggtattattttgtaccttattcgacgtattagtactcggataatttatataggcctatcgcagtctgggtcgtagaaacattatatggacttaaacaagaagaattatgtaacatgaagaaatagtagtacaatttaaacatgatacgactatttgcattgcggttacatagatgatattagattcgaactaggagggaggtagtgcaatagttgaacacaacgacgatgtagtaatgggacaaggaagcatgacagtagaaatttcaatatgacaagttgtccgataatagctaacccctacgtgaggatccctctcctctctcaaaccgcgctttagtaactctgtattgctctggtagttcaagctgcacaacacggctaggtgaagttagaacccttctggtgtctatccattctctgtattgacatctccttggtggttcctgggaggaaagaattgatgtaaagcaagcaaagttagtaaatgttgtgagaaaataaggattcatgtaatcaaaatattcttaccatgaaatcgtcgtcaagaatatttggacaaacaaagaaccttcgacccaatgttgtaggatttatggaacgaagaacctggcaacgatcaccacacctgcatcttggacgggcttcccatggagggagtgccgtagttaacacccgccagtcgctctgttgttcacgacattgtcgttcataagccgcttttctctgtaagtattgctcagtactttcggatgcgaaataccagcgaccttcttgtaaacaagtggttaggtcgagaacgggattttctgtatcgacccactcgatgtatgcgcaagacgtagtgcgggtctgccgaatagagtagtgttacgaagaataaagcgattgcccatacggaatgaataagcatatgcagataataaaatacctcacggttataggtagggcacctaaaaaagcgccttcctcgaatatcaggattcctcgaagccattagttggcatcgatcaccacataggcagagaggacgctggcaccaaggtggtagtaggtatacacaaggatcgctacgccagtttggatcctcaacaccccggcgtctagccattgacgaaagccggtcggatttgtaatgaagcaagtggggaagagagtactgaatatgactgagttctgaaagattgggaggcctcactcgttaaggcgacttatataggcgcaaaaaatcgagtgatacccctgacatgtgaacgtggtggggtatggtgggtacgcctgattggcgccgaaagatacatgcatgatcggcgcccaaagttacattggtcgtatgcgccaaatggcgggcaaatactcgtatcacacgcgaataaaggaggctacatggtgcggaagaaagtagtcgtgcatgcgccgaaaggtatcgtgtatgcgccgaaaggtatcgtgcacatataacaataacgtagtcattacacaagcatacagtactggaaagtgaagcaagtaaacaaagagaagactgctctactggccctgccccgcgccgcgaccacgcttggtcctccgggcctgtgctcgcacgtggtcctgggagtaggtgaaacgatccggtggcacagcacgggtagcacgagtgtcccgcggaggagtggcctgcgcctggtcctgcgtctgcaccggcgatgcgcctcccagctgtgaggggccaatgacgtcctctgtcgagcctgaagcgaagtcgaagtcagtgatgtccaagagcaaggtggaaggcagcaagcggtccgacgaggtcccagcatggtctagtggtggaccctgactcgacgtgccggctgcctgtgacgaagtcccggtgtactgccagaactgcgctgagtgcgaggtcgacacagctgcctgagacgctgaccctgcagcctgggagaagtgggcggcgtgcgtcatagcgaactgggcgaaacctacacatcgacaacgggacccttgtaagctaagacataaaatgtatgtaaattgattgtcaaagtaatgttgtttttttaagtacctgtggggggcacaacagaaggcctagccaaggaaggcggggtgctgaacggtgcacgaaaccctgaagcaatcggcaagtgaaacggctcacttatatatgtgcgaggtatgtacagaaatagtaataaaaatacttacctccgtgcggagggggagtcggcctaggaacgtgcgcagctggacggggaccagtcggtacgggtggccgctgtacagctgcgtctgcccgagcaacgttgtctgcacgacaggtgagcactcggagaatcgagcgcatcgactccaccatccgcgtgtacgtcgtcaggtgatcctctacgggtaccggaatccccgcgcctaaacgttggatcgtcgttgaaccgtcaacgacgacccggttgatgtcgtcgacctacatggttaatttgttcgtaaatattcgtaaaatttgacgaagagaaagatatgaaaacataaaggaatggtgcgatgcagggtactcacagcacaagcgaagtcctggtcgcggtgcttggcatagaggtctctagtgctcgcaacgtggggctgctgctccaagggagcgaaggtgaccctagtacaggtgcgtggctggtaccagcgtaggtaggcctggtacgactcctcagtgtgtggctctccctcgtggtccacgacctcctcggttgcgagcaaccagtcctcaataaaagtcgccaacttggcgggccagtcgccagctgagtactgacccttgcgcgagtacctgcgaattaatgtgtaatattagtgtgaaacgacagatgttacaaattattgtgaacaggcagattttaatgcaacaacggaaagcgtagtgcaagatcttaccggtgaacagcagctgggacggtgctcggaaacggtactggaaagggctgacggaagccgaactgccgcatcacgcggaaaggggcgtgaggctcaacgcagatgtcgaagaccatcggaaccgtagtcatccagtacgcctggtccctggtgcagagtgtggacagacccaacggcgcacgagcctgggtagccgctgcactgtagggctcccacacgacgtcagtcggcagaaggcggtcgaactccatacaaactcaggatacgaccgcctaacctggacgtgagcccatcggcgctgcaatacgagacgatcgatgtgatgt

SEQ ID NO: 29273 - DNA, 2249 bp, Oryza sativa
gtaggagtactcgtcggcctccgcctgtagctgctcaccctgcaagccgtcgataaaatgttaggcaccttaactgcggactaaatatgtaatacgattgtcatttcggtacaaaaacactcacggtgaactgaagcagccacctcttcgtaggtccggtgttgcggtggtgtgccaacggctagagcgggaggtgcggtgcgcgctgtactagtgcgaaacgtgccgtcagatcgtcctgccagtccacagccgtggtcactggcccaacagcgtctcccgcgagcggtagccccaacaagtacgatacgtcctgtagggtaggggctacctcaccgcacggcaagtgaaaagtgtgtgtctctggcctccatcgatcgaccaaagctgctaggagggacctgtccacagtccatcgtctggccgggtccgcgtcgccggccgcagcctccaccagccgacacatcagtaggaggccggcctcacgtagcctgcaataacaaattaatatgtcattataaaaaatattacagtgcaactaacttgtagtagaacactgttcgtacctctcgacaaaggagtcgtgaaccgtgagtagctcaccgcacgtccgtgcccggaacgtcccaagctgagccccctgcaccgcagtaaggtgagaccggtgtcggtgatctatcgccgggtccaacaactgaggtgtatcctgacgtgccatctctgaaaaatatagtgtttcgtgttagaacaattcaaaaaatagtaatgtaaaacaaaagataacttgcaaaattataaaatagtaataaaatcatgagattaattatgtacaacaagagtacaggctatttaaatatagcaaacgttactaatggtacataacgatgacgtgcaatttaacatatatgtagagttcaataatataacataacattacgtgtcgaagtccgacatacatcagcatacctaaagacgttaggcgccttagtctgacgttacatcacgagacctaaagacatgacatgccgaagtctgacattacacgacgaaacataaacacatcgataagttcgaaccgaattgcaagcaaatccccatgccgacatagaacataagaactacgccacgtagccagacgtggcacgacgacgcctaggacgtggtcgagtggaggtagtgccttcacctgtagggcgagctccatctgctgctgatcctgatagtcctgcctccgccgcacttggtttctccttgtctttaggacaatgcttgtaggtgtgcccatgttcatcacatttgctgcaacgcttcaccctgccagcctccgactcgtccatatcgttgtggatgcgacgagtcctcctccttccagccttgcctcggagcttcgatgggtcaagaatattaagtacttcatcgttagtctctgtgaactccccagctatgccgaacctataaatctcgccgctccatgtatgatatattgtttgcttactgaagtactgtgacacatatactgcatctggtatgccacactccgctgcagcagcaatgacatgggtgcatggcctgtggagcagcttcggctttgcacaagagcaatgacatgtgccgtcgactttgagaacacactcctgcttcactctcttgcggtagatacccctgcctgccttatcttgatatagtatctcaaacctgtgctgttgggtaccttgcactacagctcgatgtttcatggcctttttacgcaactcctctagctttttctgcatgaaagctccaaacaaaatgctgttgttcggcatagagggaagaactgcctggaaccgatccctaaaatacctgcatgtcccatgtaaaatgaactccactatgccaactagtggcagtccacggacaccgcgtatcacccagttgtaaacttctgccaaatttgttgtcattattccatatctagcactacctgtgtcatacgccttggcccatttctcttttggttcatgcagaatccactgagaaaatttccgaatctccaatccagtttttctaaccaatgttggactatccattgggagaggtccaagagcttgagaagggtcagcaaccgcggtcgatggagccgctgcacgctgatcacttgttttggctgtcaactcatctaatctcttccaaagctcaattgaatttttttcttcctgggtctgattgcacagcctctttgaacatgttcatgaactcttttgttcttg

SEQ ID NO: 29274 - DNA, 3631 bp, Oryza sativa
ctgattgcacagcctcttgaacatgttcatgagctctttgttcttgaattgcttgaagaaattagctcccatatgacgcatgcacacctactctgtacatcttcccaaacaccggggtatcctcgttccatactcccaaactgcaactcttctatcgctcgcagaatgccagcgtgcctatcatgtatcaggcacacatttggcctcataccaacaacttttgttttaaccaatttcaggaaccagtaccagctgtcggtattctcactctcaacaaaagcaaatgccaagggcaatacctgattgttcccatctacccctattgctgttagtatctggccccgatactttcctgtcaagaatgtcccatcaatgcagagaacaggacgacagttcacgaatgccatcttgcatgcatgtagagctaagaacgccctttgcagcacactcttgctaggatgttcaattgaggggaatttcttcacttcgtaagagctcccagggtttctttcctcgataacaccaagcaggcgtggcaaattgtcatacgaggcttcgtaagttccaaatctcatctctattattttctgtttggccctccaggccttggcatagctaatagtatacttgtatgtctcttcgatgtgtcggattattgaccttggttcatatgtgagattatcgatgacatgcgcatacatctcagatgcaacaaatgcacaagtaatgttcctgtggtatttctgaacaccaggtagaaaacatgtatgcttggtaacaactgacactgtccaataatccttccatttccccttatacacgtgcactctccagggacaaccatctttttccttaacacaccgaacttcatattgcgaccggttcgacttggcaacccaaaactctctatgaagtgacactgcaaaatgttttacctactccttcatatcttctgctctactataaatcgctccctgaataacctcattttctttgtactcccatctcacactatcctcttcagagatgatcagcccagaaaaatcctcactagcccattctgctggattaatatccgtctcatcatctgacgaatcaccttcctctacacgctcgttgtcagaatcctccctctccatttcatccacaatggcaccgacagtctccccctcgtcggccactccacctggttgaatgccaactggagctactacgcccccgtcctctcgtgcgttgacctcctccacagaagtctcgtttacttcagcacttgatccctcgccatcatccatgttcatctgcacacctggatccttcgggtgaacaaacggaaccaaagctagaggccacccgcgttgcaatgcattttccaaataccatctccacactcgagagttttgaactggcattagttcccaataaaaccctcagttgcccgacttactataacattgattgttatgtcacttgtctgtggatcaactctcaagcccttcattaaccatccttttatagaaggtacactcctctcagccggtctatcaattcccctttctgatacaataaaatctgacagatctacctcagttggcccgtaacggacatttcctggtccatggtaaacttggaatatttgtttgttcgacatatctgtcaatgaaataactagatcatattactctttcatgcaataaacatctacaacgtaatatcttcttgtgtaagccaatgcaacggtaatgtattgattccaaactagcagatctacgtagttaccgatatctacaatacgcacttctagattagtacaactaaaaccctaaaaatataatgcatttattcaaacaaatttttaaagaatacacactatttaactcaatagttatatataggatctatgaatattacctgaaattggcgtctgaatccggcagggcttcgccccttcttctcttctcctctcctctcttctttttttttttcactggaattgaggagagaagaatgagggctgggggctgggcaggaggccttttataggcagcgaggcctgccgcccggccagagggcggcaagggttttccagcaaaaaaccctccctccgtcaccgcccgttcctcccctgtttgccacgtcagcttgccgccccataggtgggcggcagggtctattttttgtaatttttttggccgatagattatttctgtaaatattttttaaaaaaaatctaaaaccgaaaaaaattcttgttcctttcctattctgatttctgatgcaagcggatcggacgcacggaaggaaaaaaagaaatcaagcgcccataggccatagctaactccccgcagacatgcatgtttccacctgatgtcggtgtggctaattggcgcgcgccagctggcgccgcctcccccgcctgatttttttttcttttctttatctttccttttggcgcttttttcgattatttttttaatctttagcacacatatttttaaatgttttgagttgaaaatttttaaattttgatttgtacattttcgaatcttagcttaaaaattttcaaatctggactcgaaagtttttaaatctcgagttgtaagttttcaaatctgagttaaaagtttttaatttttaaatcttaatttaaaaattttcaaatctggacttgaaagttttcaaattggagttgaaagtttttaaattttcttgcaaatttaaatttcgagtagaaaattttcaaagtgagaaagttttcaaaatttgtcttcaaagtttaaatcttaagttgaaagttttaaaatctaacttgaaagatttcaatttgttagtaaaaaaatctcccaaaaaaagaaaattgttccctaattactgtcattatccttaactaaccgtcagtgagttagttacgtgaacacgcgcaaaacacacgctagcggcacacgcgccagctagcttttccgcctgatgtctgcaccgtgctacatgcaacccctcatctctcctatctcatgtataagtactaagtgctacaccaataacaactatacgaaatatttagtcccaacgagtgaaacatcaaagaaataatatgaaatgtacaatattttgcaaatacatgatattgtgaaatatttttatatctcacatgaaacatagcatgtaaaatatcataaaatgtttgctaaaacataaaaaacacactgtgcaacatttacaaataaactagtgaaacattaggaaatacttgttgaaacatacaaataatatgatgtatcaacattttaaaaagatcgatcacaacataagaaaaaaaattagaatcaatataatcatgtgagatcttattttaaaagattagattatgaagaatacaacaatgcgatcgaattattgattggataagtgatttaaaagaaaaaatcattcaaaatttgctaaaaaaatattcacacctacaaaaatggagagagaggagtaaagaaaaagaagttggggcacctcgcctgcatgcatgtaatgaatatttgtgattccatgtgtatggaggaggccgatatttgtgggatttgttggtcgaccaattggaagtaattcccaaaaaactagagaaaaaaaggagagaagatggtgg

SEQ ID NO: 29275 - DNA, 32243 bp, Oryza sativa
cgccgcagcagccaccaccgcctcgctggccgccccgcgccacagctgccaccgccgacagcgccgcccaacgtcgccgccgccgaagctctccagatccaatggcggcggggccggatctgccgccgcctagccatgatacctcgccgtcaccactcccgctgccggcgaacgccacctcccctgcgcctgagagggggcgccaccgcagttcataattgttcaattgtacctttatccatgcaagagtatttgcacccttagcaacaacgggagactgcaaacaaatcaagaagttagtacacctggtcccttcacagatgaaacaggatgtgaaaaaaaaatcgctttaaaccatgtgtttttttttaaaattcagtcatatattcagatccaacttatatattgccaaaactgatagctatgttggatcgaacttagaaaatgcagctattgacattccaatctttctaaactaatttgttagtacagaacagcatatcaaaacaatgtacaaatcaccacaattatttgtcctgtgacgttttataaaaaaactagaaagaaagcctgtgcattcgtgcaggcatctttattatttttctaggacgatctattaaagtagtccataaattttgattactaattatctcattattgtagaaaacatgaaagtaatatatatgctgtcaaatgtataggtcacgaagattgaacttggatctatcaaatatcaaataataagaatgcatatgatattcacttataaatcacggttgttgctcctacttgtatgcaaacattgcaccaccaagctactcacatacacaacaatcaaggccctcacattggctcacctcattttttttccaataccttgaagtcaaggctccaacatatataaacataacagcttcaccatcaccaggcttctcactttaccatttacatgcccacttaggcttaccatatataaacaattaaagggctctcgcattcgctcgtctcagtgagaatcaccgttaaagcaccttgttggtatttcttaacaatattactagaaatataattatcatcaatgacgcaaaaatactcctgctatattatgattacaaagtccatccgcaagcacacggatataccattgtagcatttcaccagagagtattccaagggtatcgtatttatttaatcccgtgagaagattataattgtcacagcctgaatttcgtttcagaatttataaattatttaataaattattcttagattttttattaaaagttcattaatttacaagtgaagttaaatgtggaaaatcaaaatttctaaatataaagcatggttggatttaatttgtattaaattctccatgattaattatactctctgaaattttctcagatttttcagagctcaattcctaattttaataatacaaagaacattccagtaattattcacattttaaattaatcattaaatgagctggtttcaattttattaaatacttagagtgtccaactatgttcaacaattttattggaattatttgagcattggaattatttttaaaaattgaaagatcatttcagtgattaatttaattgggaaaagtaattaaatttccttttccttttcgggccgaaacaggaaaagttcaatttcatgccatccttccttcctctctctggtcggccttttctttccaaagtctagcttgtgtccctcctttaatcgggccaaggaatagaagcccagccgaaagtctgctttgcatcccttccgctacagtgcatcttcaacctctagacagatccgagccagccgggtgcacggctgccgccgcctcctccttccaaatccgatctccccgttgtcctctttccatattagttgcgggaatggaatcctctcaatctgctctacaatttccccaagaaatccccaaaattttctatggaaatccattccaatttcgcgaatcaatctttccttacaccggcgaagatcctaaacttttccggagcttttcccgtcgatgtgggctcgatcccggactcccatggctatatatagagccccctacctctcctttttgggccgccacctcttccctctctccgccgtcggcggaaaccttctccccgcgagcgcctactctctccgtcgccggtagccgctccagccgccatgcgctgccgcctcggtcgtcgccgctttgcgccgccacctccctcggctccgcaaagtcgagttctaccccggccgctggttattttgcgccaaaatccaccggagctccatcgtcgccgtcaacccgaagttcaccgtcgcgttttgatctccggcgaggccctgctgctcctcccgtcatcgccaagcttcaccgccacctttgttggattcgcagctgcgaggagaagcccgtccgtcatctgtcatccaccgaagatcgccggaaagtcgtcgccttcgttgaccagaacctcgccgcccttcggagctcatcgccggtcatctccttcgctgtccgtcgtcgcataagtgttggtaagaatcgccgtcaccttctctacctcccggtgccctccatttgcgttattgtgccgtggttcgccggtaaccgctcccatgccgttcaccggtgaggtttttccctaggaacttaatccaatctaaccaatccgttgtctatctagcattgtcgtcgtctccgtgtgttgccgccgggtcgccgtcgtcatctctccctctccgatcgctttggtttggtgagatttctatctgtgttccctcggtttaggttttaatctcttgtttgtgtcgtcgagtagccgcgttgtcgctaccacgccgccgtgccacgcttagctgctgccctagcgtcgccgctgcgctagccctctagccgccgccgtgccgctccctgccacagccgtgctgctgtgctgtgcgttgccgcttgccgctagctgccgtttggccgctgctcgtgcgtgccaagtcgctgtgtcccgctactgcagctaccaagccacttgctgttgtgccgtgtcgtcgctgctgtgccgtgttgtagccgtgtgacgcttaaacctagccgccgctttagcccgttgctcggtagtcgagttatctagctataggtgcaaccctaggttcctaccggcctatcgtttgccgtaccagggctttaccgttaatcgtgtctagctcactagtttagccgcagctgttgttgagtcgttcgcttgtttgttcgaacgaggtgttccccgtgcttcgttcgttcgtccgtgtggagtcgtcctttagtttagagccgttcagagccgtcgttccgttcgccggtttcggttgatcgtttgggtgatcccgtgtcacgtagaatttactccttgagtcggtatcttgcgtggctcgcttgccagatcaatccaagccatctgatcttggtcgactcggtcaaaattaatctcagccgtccaaaatcaatataaatcctgttatcccttttcaatggcatattagttctttttactataagtcgtctactaaattcgttccaataatttccagaggatgatttagtcttatatctcagttataaattatttgtaaattgtttaattaatttcgaatattcttttctttaataggctttaattggaattaatcttataaaattcataataattcatatgaagtcggaattaagtggttcaagtctctaaattcatctaaattcatgatctacatgtttgtttactttatatgtactttttatttggtgtttattagtctttttcctcgttttgcgtgttagcttgtcgtttccgtcatttcgaagattcgcaagtgcgtcggaagtgttccagaagattaattgaagaccgattattgcaaagcaagtcacacagatcccaaacacaattcctttgagcatgttgatcttatatttaaattctctatttatttcaactatgcatttattttcgaatgtcaccgggtggtgtgaacctattcctttgttatggccaatttgcattgatcaccctatttcttgattaccttgggttaaaatttgactagttggatttatgtattggttcaactagatgtattagatataattgcttagccatgcttagaaacattagcatatgattgggataactaatgtttcactattacctaatggtggatatctaatggtagctcacgatggtcaatcgtgattggttaattaattaattgccaattaaaacttgataatggtgggttgtgagaacatggttttgatggtcgtgctcatgacaattaaggaccggttcacgagttttggttgtgaaacattaaccgtgccaaccacaagccagcatgagcaacagctttaccttttgtatagcatggtttattgcggggcaccagactgagaagtggcggagataaccccacgggggtcaccgaggagtccatgccttattttataaggaggtgattatgatccaggaatggtgcgctgtggtggattgtgttatgcgaggggtactgtcacagctcctttccgaggtactgtggtggtatcgcggcgcatggtgacatgtcgtggggccgtgtcttgtgggtacagacatctctggccagagtaaaattattcgaatagccgtgcccgcggtcatgggcgggtctaacaatgtctttcgtgattagtctcacacctctcacaataattattgatgctataattggtaataatttgcttagctcctggtttggaatggtacattcctaatttggagatagagctgtacaatcgggtatggttgttcaggtttggttgggcctgtgcagcatgtgtgtcatgttcagtgttgattaatagtgatgattaattactttactgttttacaattcttaaatgtttattaaatgctgcttttgcaaatgagcctatattataccatcctttggtatccttgtgcacttgtatatttgctatgtggcttgcggagtattccatgtactcaccttgtaataatcaatcaaacctcagttgaagaaaagttgcgaagaagaagacgtttggcttataccccagttgagctgcctgtgggagtggagccggagcttcgctagaccgtaattccaatgttgtttacttttcttttgtaagtatgtaatgttattattttgatgaatctgtatattaaattgtcagtttgtgtatcttggctgattcctggacgaggattttatcaaacaagttagttcagaaattactagtgaattcctgggcgtggcaataatagagagatccatactaataatttaaatattacttgtaataaccaaagtctaggcatggattaatataattcgagggtagagtgacactaagcagaagtatttatactcattcataattatctaagctaagtggatagaaaatagaaagatcctattcctatacttgtagtatacatacatattatacatacatcctagtcatatgattacttagctaatatataccctctttccgatgcccttttggtgcttcgagaaaccacccctgattgcggagttccttacgataatccgtcatgaccatccaactggggctaaatacggaggagtaccctcaccaggaaattaacttacgactatatacacgcgcggaggaatacccgtactgagctgtcaccatcagtggcccatcttgcttccacagcatataaccccaaataatgatatccagtaatctaaataccacgcttaaattaccaaatactactctaatatcatcgtcatgacatagagtcatagtaaatacaatcattatacccacaccattgcatctcccagataagctagcatcataataaatataacttggatatataataaagttggtattcatatactcggaaagtaatacaataccaaagtagtataaagaagaatattctaaagaaagtacaagtcttaaaagagatagaaaagctactagagccatacccgaattcttccgaagactccgaggactgaagattctattctaattctattccactatactctagagactatactaaacttgagagatgtatgaagcttcttgcttgagctgtgtgggaaaagtgaggaggtgaaggctttttatagctctccaatgacggttatgacgattggaatggccagaattgccctccaaccgtcattggggagtgatccaagccgtccagaagaagccctgcatccaacggcggcacggcgggttcagccgaaccatgggctgggaccagcctggcccaaattcggcaggtggcatcctcttttgctcctctccgcagacttatgaattttggcccaattggttgtgtcatttttgagttctttgcccattcattgataagtctaattcttgacatcgcccgattgattgatcgcctgttttgatgtcgattctcctccattttatattcattctctgcaagaggttaataatcctagtgctagtggaatatttattatttaaacataaatatgtattgcaagcatacctagttctcctctatttaggtaatattgacgggcgaaactaattgctaacgactatcaacacacctatccttctcaatttgtttttaattttataaagattagatctaattgttggaaataacgggtcgaccgatttaagtaacaatcaagagccagatgttcttatttttccttataatttctataatctattagtgctacatggtggttcagaagcatttgtagtcccacgtgatggcttgagagcgtttgtagcaagtttaatggaattttagtatataatagatccgtgaatatttaaatttgggtgatttttacttggctttttaatcatattttaaacttatgatccttctctcaaaaatctatttgggattgttttgaaaattggttatgattttgttcatgacgatccttaaaacacataaattctaaatttataatcgattaaaattgaggattcttgaatttacgacaaaattatttttcaacagtagagttggttcctatgcaattctttgttagtacagaatagatcgagttgatgttttggcaatttcattgccctgatttcctagcttgcacaacccctgccatgctcggacttttctctaatttgttagtcttatgtcattctttgttagtacaaaatagagttgatgtttaggcaatttcattatcgggattccttggcttgcacaattccgtgcattctcactatggcccattgtgatcagacttgttctctaatttgttagggcctcgaaagaaatcttaggagagctaaggatattactgttgtcgatagtattgaccatattagataaagttatgttataataacatagtgcaaagcaatgttgagataagcatttgagttaaagtttaaatcatctagatgatcatcattagcccacctttacatgttatttctcatgcaaggtcgtcttttcatggtatgatattagacacgctctctctactagataacaattcttttcatatgaattttttattaattgttgtttccatcgccgacaacgtgtagccttggaaatatcctaatggaacattctagtagtctcattggttcatgtagaatagttttcataccacataagttaaaaatctaatgcttggcacctgagttaattaattattgaggattgccctacctcatgttttcgttagtatgcttatacactccaacgatatctttattcatttactatatttttataattttataatataaagatggtgccttgtaaatccatgtgaggaggaggggtagtgggatgatactctgtttttttttagttttttaaagattgatctagtgggtgaaataatagttttaatgaggtcggatgcttcattcttttagaatttatatgatttttattaatttttaagatgtgatatgtagtggcttatgaatgtagaatgatagatctaatgactgaaaataatgggtctaccgatttgagtgcaaaatgatgatggttagatattttttttatagaatttaaacaacatttcttaatttttaagatgtgatgggtgatggcttgcgcctagaagatatttaatgtacaaatttatatatgtagaatgatttaagatgacataactgttgtcaaaatttttctatgttcaatattttattttttacctagcaaaataaatgtaatacggattttaaagtatttatttaattacaaataaaaacagtatagataactgaaaactgtatataaattgagaatcatgatgatttagctaattttaaattattttatattgagctgttagaaaatagctacgagaaaagggaagagcaaaaaaagaaaaagaaatacgtgagcacatatgcacggtgtgcacgtacggcaggggaagagaagagaaaacgaattcattgagattgatctaataggccgacaggttggtttaagttatctattcccaaaaattgatctaatggttaaaaataatgaggccactgatttaagtgaaaaccaatggtgagatgtttttctttttttcaaaatttctatgattttttctattttattagggcgccacgtggcatcgtaggagcgtttttagagcaccacatggcggcatgagagcgtttataggaagattaatgaacttttagtatataataatagatagatagatagattttgaacatgagcaggtctgccaatgccaggttttcgtcctctttgttttgttttgttttgttttcgtccactgatatgtttgttaaaatcttcttttgtttcttactgtgactggaagaacattagtagagctttcagattggtctcctgaaaggatctaaatatattttgaggaagcacgtgaagctggatcaattggagtgaattgaaccttgggtgattatttgggagactttcggtaaataatcttgtattgctgttgatgttataatgtttgcttaatgttcactagctgcatggctttcaatgtgacacttctacctgcatggcttgtgccaagtttttacaagatgttattttgttgcacataatgtgtaattcaatggatagatatcctcatcgtcttcaagtaatcagtgcgtttcagctgtctcttttacttgtgagcatgatgaagccctttaactacattacccttttactattcagaagaaataatacaatatggtctagcccctatctttcttctttgtatcaaggacatgcagtacgtacatttacatgttcttgaagaacaagtgtaaaacacatcaattctgtaatttcagggaaacctccgtacattgaattttggtcagtttgcaaacaacgataaatggtcaatctctggtttacaacaggaactcttgcattatactattagattttgtttctaatagctgaacaattattgtcctaaatatcagcacctgtatctaaagctttagtagttaagaaggctcaactaattattctgttgtatgtgacgtggaatatatcttttttccgtgcggctatttatttgtaaccgtatttattgggaaagagtttcagcttgcatggattgctttatcgatctgcttcaatcaaagatccatctacccaagttgcatatgaaccaaagatttcatttgtgatttgcattgtctgtaactgaaataaaccataggttgctgatccacaccaaaaggcactaatgtgatgaaatatagaattttctcggagatagattctaattaatcactcgagtggatgtccacccgtatagtgatgtcaactaaatgatcttgaaaaaatttcaaaaaaaattacaagatagattgatatataatatattactccacaaacatgcaagttaaaattcaatttttataagtcgtaacaaaaatcagatttaactgtaaatatacgtatactatttagagtttgatttgctatttttgttacatcttgtaaaagtcaaatttgaacttacatgtttgtggggtgatacatctatcttgtcaaattttttgaatttttttcatacccatttagttgacgtgcaataaatgggtggatgtccacataggtgattaaaagtgtttcccaattttctcaactattttcagcactgtatatctgtcaccaactgagatattgcccatgcatgatttcgtgggcatcaaagacagaatctgctttccatggtgagttgataaagtgtaaaatgaattattcatttcgggaaggattgattgctgtttgggtaaactaatgcatttctcttatctggtgtgttttaccctttacctgttgccggatggtccctttggaatgttcttaatcattgtttttatgtgaatcatatatccatctcattgtatgtttaattgttaaaacataaattgtattttaactgtttaatttgtatcatcaccaaatatggccatagcaatagcacgcgcatgttactaggtaggattggtactaaaatcttgtaagagcccggtaggtgctttgaacaaagagtgataaggagtgcatgtattcacaatgcatgtcaacacatttggactccagtgtgctctccctctttttttttcatgacgcgctccgatatgcatttttcatgactataagtttggtgaaatgctcacgaaaagaaaagaaaaaaatactatggcaccaaaataattccacgacaaatctagtggtactacggatcgactagtctgaacatccatcaggctcgtcagaactactattgctgcatactgtccgggaaatacatatggtcaccacagagcaactcgtcatcgacactgaattcgcacgtatccaaatcaaacgacgagaacgtgtcccatccgtcgtccaccaccatcgacgacgacggtgttggcggcgccgacgaccgcatctgcctgagtccatcaacgacggcgcggaacatcgacagccgccgtgccggcggcgcagaacggatggccgccggcggctgctcccgctcgtcgtcgctcatcgtcattgacagctgcgcctgggcccccgccgccatcgtagccgccgcaggctgccactgctgacgatgcactgcattattggccgtgtggccgccggcagtggagctgaacctgaacaacaccgcgtggtgtacttccgctttggccggcggtggctcggtgaagacatgggccggcgtcggggccggcggcgatgggttgcaggtgtgcgggtgaatgtaggtgaccctgtagagtggcgggtcggcgtcgttctcctgctgcaccaccttggtcgccatgcaattcctgtcgtcccggtaagagcatcggtagtatagcctgtagatcgcgacagttttacaccaacgtctgaaagattggtttattcgtgacagattaattaatacacacgtcaggtaaattaattttctgccctgggggctattcgagtttttggtagtagactagtaggtacgagtaccaaacatactaaatacaggtacataatctagattgatgaaatgtgcaattagtacgtgcaccaaagattagaaaatattattttttctttaaaaacattgtgatataggtgtgatagtgtcatgcctcatgatactcgcggtccatccacaccaaaattaacccaaattgaaatcccggactacacaattatggctgtgtgcattcttagtgtagagatcaaaagatatactaattaataaagatgtggttcatacctgggtgatgacaaagattggtacagaatgaaacttatgtatatttagtgaaaacaaatacttatatatatttggtgaatggtgatacataaaagtaagaaatttcattccggagattataatatcctactcaattctttttgtatatattacttcaatgccacttttctcatacgggcggcctctcaattgtttagggtttagttttaactcggataacacaatgggcattatgattatacgtgagttaggattgtaatataggggatgttgaaaatttccaaaacgtaccttgggaacgatgagttcttgattttcttctctccatacttcctccagagatggccatctgtatgtggtataggcgtaaggttgacacatgttggatgcccttcctgcatcctgtaatagtattacggaaatatgaaaacattatctaaaactagaaaggtagcccgcacgttgcgcgggcatatattatagattatgtttgaagaaaacttaaaatgagtgttgctttagataaatttttcaatctatttgttagcttttaaaatatataatatttaatacattcctataaacaattttgtaccatctcttcattatctataaaggagtttgatttaatttgtttggtgacatgtggtgttttgtcttgtttaatagaatgtttaggagctttcttttttttagcaaatcctaaataactattattgttaatgaatatgttttatgtgtaccaagctagtcctcctagttggttcatattgacgcaattttttacatatttacatataaatttcaaaagttattttgtagacctccatccctgatatatgcgtgatctatagtatcttttttttaaaaaaatgttatggcaatggaacatgtaatggttgttccaattttaatgaaaagtaggaaacaatgttcctattaatattttctatttattgttttattttatactacccttattttaagtttcaaacataggcgttatgaatagagcaatttatattagaaataaaatgtgtggcttaaaaattatttctccttttagtttgatagctataaaaatatcgatgaggggcagaggggaaagtgcgaaccgaggagtgaggagacgggtagtgttgtgtttgtgcgcatgtgaggagaggatgtttttggggagggggttctctcctttttttttaataaatgatttaagtgaaaaccaatgatttattttgttcataaaatttcaaattattattttgctaattattaagatgtaacacatagcgacttaaaatttttccttcaattcttccttctaatttttaagatgtaatacctaattagaaaaataattacccctcttttgagatgagttaggccgggaatattacttcttttgttctttgctttaacttcccaacttattcctctttttttttttctagggcacacttttcaaattgctaaacggtatgtttttttttaaaaaattctatacgaaagttgctttataaaaatcatattaatcattttttttaaaaaatagctaatattaaattaattatgcgctaatgagtcgcttcttctggtgctctagagattaggtcgtaacccatggaatgaacacagcctagttatgttcattttactcttagaaatgtagatctaaattaattatcgtgaagttatgtaggatgataaatatttattattattgttttttatatttcttctaatagtttgaaatgcatgcaaaagttaaaaaatatagcccaaaagtaacatatttattttcatattttagtaatagtgtaatttggtctttaaccgtgaatttggtcataaagacatcgatggataaaaaaactattatatgatttagatatcttagatagttaatattttaacaaataaagcatgaagatggagaaagaattaatggaaaagagaaaaagggagaaggcgtacgtacgtatgtacttaactacctaatgctgggtgggccgagttcaggagatgatatttttttaaaaaaaaaatccaatggttgtaaataatgggtccaccaaatttaatagaaatcaacggttatttgttaaagtgctatgtggcagtttaggagcgtttataggataccacatggcggcttaggagtgtttatagaaagtttaatggacttttagtatataatagaagataatagattttcatatgctagcacaacttttggaatttgtactaagatatgtatacggtacaagtacgtactgtcgtttatattgtagaactgtacacgtttatatgatacttgttcaatatttgttcaccatccaaacaaggaataagtaatgtcaatgaaatcatggaaaaaaaaaagaaatcttggtgatatgtatgcatgtacacctcctatgaagtgattattcatatatagataagggtacattttatttgacaaataatggacccacgttatataattttactctaaagtaattaactacttcaaaagaaattcataaattgtaaattaggctcagaggatggtaaatttgaaaaggttgtggaatataatgggcctactctcgtttatatatagttatgtgagggcatgcacaataataatataatgcacacctttcgtgtcaaaataataataataataataatgcacaccactctaaatatatcctcaaatatgtcatatcaaacaatttgccatataaaaacgggctgaaacaaaagggttttataggaaaactagaacacatatagaagacaagccagatatatactaaccaagttgctagaaggccagtgaggtaagagcaaggacttaatcttaaagacgaaacaatgcgtataacacgatagtagatgtttattcaatgtgtgttgaataaattcatcgcaaatagttttaagcaaggatttcatgtatataattaaatatgttgataaggttttaggcccagcgtcctccaccttcctcttttgttatatttttctatcttaacatcttttacgatggtctcactagctagtatatatatatatatttagataatggaatataaagctagtatatatatatatatatatatatatatatatatatatatatagtagaaatgatctacatatttcatcatttcctatcttattatagtaatcccccactaactccttaagcttaacatgcaaagatgtcacatcatcatccactaatccactaattaacaagatgccacatcatcatccactaacaatcatcacatttaaacatcatgcaaacatgctatgtctttatagtttttataatttaagagcttttcaaatacaaacatgttaaattatcatccaatataattcacataatgtttcaatatacatcttattatgttttatgataccctatatacttatatagttcatcctcacttagttagtgattaaatgattaatctatggtccagattatctttctccttttttcctctaattaagtcatatcccatcaattgtttttatcctttagatgattaatctacagtccacacacccaaactatctccctatttttcttcttctataaagtcataccaccttactttttacgtttgaatcaccattctacatactatttaaatttaaattatcataaaccacattaatttacttaatatggtgttatctagctatcatagctatcttacacgttattttttttattgttatcatactaaattcccgcagcaatgtgcgggatttcacctagttttctttatctcaaaaaaacccacgtgaatcaatagctctggttaatgtttctactaccatttctcctgcctactccctccgtccccaaaaaaaaaaacaaaccttgatttccatgcccaacgtttgaccgtccgtcttatttgaaaaaattatgaaaaaaattaaaaaaacaagtcacgtataaaatattaatcatgttttatcatctaataacaatgaaaatatgaattataaaaaaatttcatataagacggacagtcaaagttggacaaggaaatctaggtttgccttttttggacggagggagcagtacgtagatctactttataaatttgttgaccactctattgtcgcacactaattaatggtggtgtatatagaccgtcatatttctccagtagtccagctgcacagcgatcatcacatctgttccattagcagtccagcttttgatatcatcatctgttccattagcagcttagcaacgtatcctaattaagcagtttctctatgtaggcaaacttatcaaaatctcgattatgtcatacgattttacagcttgacagtacgtctaagtgcctaattttatggttcagtacacataggtagaaaaatcgacgatttacaatttttatttgctcctacttagaacttcctatttcgatgtagtatcacgattttaacaacataccccctctgtcacgtaaagaatcaaatcttgggaacagattcatccccagaatttaattctttatgggatagagagagtagatgtacagaaggcaaaaccatcacatatactagttatccggccccttcacaacagcttgtggtcctccctcttaattacgttctacatgtagttagagcaaggataatagtagagttcactttctattattagcctatcttaaagccaacatatataggttggctacaattttcttctcctctctccatttctcacttatacatttaatatatttgttttggagcttgtgataagctagctcttgcatgatattttatattatatctcttctccacgtaagcttacagtagagttatatctcagtattatacttgctcttattagccagcacatatacttagatctgtgtgtatatatatttcaaaatactctaattttatgtagattgctgctattagtagtggagaattaaatatttaattactttgaatactgtgccatataatatgatttggaagatctaagccaacagtataatcacatcatttatgcaacgtgcaacacgtactgtcctgagaggttatatgtctccatatatatactgtgggataccagctcctcatgcacaccaagagccaaagtactcatatataactgaaaattacactgtctgtatagataattgccacttgcctctccatatataccacttggggtgagttgagtttgaattagaatgatatatatatatatcatatgtgggggcctaattatttagtgctaaaattatccggagcacgctgtagatgcaatgtatcggacataatttgttttctgtactcattaaaaaaaaggactatagtagtttgtaaaattgtaaggtcaaggcacacagacttcactctttcagcatattcaacttggacaaactattgaattataatcgctgctgtccagcaactaatatgccctacgtcacagattaaatattgtgcccctaataactccagcgggagagggagaacctgatttatttccctgagagatgttaggtgtgtttagttcacgccaaaattggaagtttggttgaaattggaatgatgtgatgaaaaagttgaaaatttatatgtgtagaaaagttttgatatgatggaaaagttggaagtttgaaaaaaaagtttggaactaaacaaggccttagttgaataatattatagtgcctcctcattgttgaatattttggagcttcagcgttgcgggactcttcagcttgaagattctgttaataaggtcctcgcatcgagaacacactttgcagtggtaatttatgtagtgttagatctgcagcgcattgaggttatgggtgtgcatgacttcatccatgcatcaagattcaagattatgtactcaccggctatatgtttcactaggaaattttaacgtccatagattttctatcatggtctctatatctagtgagttagtgtaagtaaatatgtgtattcatggataagtgttttagaacatatatgggagtttttattaaactcggctaattaattatacgtatagtattaagatgatacaatcgcattgatcaaagatcagtcttaacacagctgcatagctaagatatgcacaaaaccaatatgcatatgtatatgttttctcgtataattaggacgacgaaaagaaatagggaaggaaacgaacggcattgctgctcgatatgcatgcagaagacagctgatcatcagagaaaatcctcaaattattaccttggcttccgcgaggagaacggcgacgacatgggcgtcggcggcggctggccatggacgccgccgccgaccggacgtgggctgcgagatgccgggtccgtgaactgcatcgtctgcagctggtgacgcgaggccattgtcctcgcgtgcagactgcagagactattttcaggtaaatccctgcacctaagacgatggagagcaacggcaggtctatatgtaggtgaagaacaggagttgctttgatcgatgcacatgaggaagagtgatggaggtgtcaccagccatatattaatgttgcaaacggaggatataatattatcagtcctctaacctgattcttgttcacatattgcattagctagcatatgaggtgtatgcttacatggtaaaaaaaaatagaatagtacaggaagatggtatctgctcccatgattgtgtgttaaatttatgacatatgcacatctgaaaataagaagtctctatccatatattgcattatcttgttaaaacaaacaacttgattggggtgcgtatttaggactatatatgcatgtcatcatgtcgtgaattattattgctacaggatctacaacatggccaacaagtctgctctcctcttcttgatcttctttatttaaaaaaaatacaataaaaaaccgttaacatttggttgttcttcctcttggagtgtgggatttcaaggagagagagcgagaatggcaatttattgttgggtcagaccactccatggtacacatggctaaagccatgatggcaaagtttatgagaatgagatcgaagagcctgggaaaaaggaaaaaaataaagtctatgagaggacagaaaacgtagttgagcagtcatgtcgattgatcgaactaagcaatgctccgagtggatttagacattatctcgaatttcctatgtttgttgttgatctgatctagctagatgctactatatattgaggtagtcttaaataagacattattaattaattaacatatatcttaattaatctaggcacacaaggattgggaagaggcaagcaaaactatggataagggttagtgataccatggagattatatatggtggagatggaggtcctacttcatagaagttcatcaaagccctggtggaaagggagaaagtgtagtataattttttttaaaaaaaacactggaggggaggcctccgctgttaaattaaactttcttgagaaagaaaagaaaaacaaactagtctaaatatacaaaattacattaaccgaatccaagtcttgactacatcctaagcaacaaaagagagaagtctcccctaaagaagctgcctccaagaaagtaaagagggtgacttgttattaagaaaaataaaaccatttctttgcttacatatgttccaagcccctacaagaattttttccataaagcatcgaccttgatagttgtttctggcctccatcatcatattgtccatgttcaaagaggtatcccaaaatataccgactctgattgatagcatagaacactgtgaagtgtatttcaatcctccccaaataaaaatccatttatcactttctagtgactgatcaacctcacttatcatatctgataacgactgaagttcatcatatgcttgcggggagggagagagagagagagggggggggatagatgaaagttattctcaaattgaattgacaaagaacactggactgaaacattcctattaaacaagaacctagataattaaaaggcaattaaagaaccaaagccaaaaacacttgccaacatttgagccttatcctcactgacatttattagaatcaaacaagatttatggtaattaaccttgagcccggtcccttgtgcaaaagtctgaagtccggtcccttgagcaaaagtttgaagtaaagcttttagagtgaataactcctttccacagactttagaggtggaattgtgagacaatatttatttatgttttcacaatggaaggcctgcaatatatataaaaagttatgttgttttcgttgcccattgctttcggttgagggtttcaatatagtctaactataattttataaggcagtggttgacacatggccttggagatatagtactagcaacaggtgtcattatatattttgtattcattagagtgtgcacctagttgaaaggaaaattaatatacatatatccaatggacaatagttaaatacaagaaaacaaaacatatttatccatgttatgatgtttgtgatatatttttcaactttttgtattgcgcatttattttgtatataagcctttagttgcaaattagacgatgctctgtcatatgtgtttagcggcgatattgtatagaaataattaaaataaatactaaaaataggtaattgagatccctagagaaagaaacaagatatagaatgtttttttactctcgactatgcattaaacatatgtgtgaggagaggatggaagaaagacagcgacacatcgttaaatgcacatgacatccaaatgagctcaaggccatcagattcagtcgattagaccttaaggctgccacacttgtccactataaggagagatggaagcaagacgttgtcaaatgcacatgacatccaaacgagctcaaggccatcatatccgatcgattaggccttaaggctgccacacccgaccactataaccatgaggccaatgcattcaaactgctctctgtgtgttttagatgaatgtggagatggcggggcagatttgatggcacattcggaagtgatcataaatgataccggcttatacttgaagattttttttagagagaaggcaattttcattacccagctttggggagaaagccaaaagttacataggtctgaaaaaactagaaggaaaaacaggactaggagacccaaccggaacttccaatttccaaaggtgcaataaaacaggaggatcaggccccaaccccacacatttcagagtgcttcccatagcacaaagctacaactattacaacctgaaaagaaaaagagctaaatggtattccctctttccctaaatgattgacgccattgactttttaaaatatgtttgaccgttcgtcttattcaaaaacttttgtgaaatatataaaactatatgtatacataaaagtatatttaacaataaattaaatggtagggaaagaattaataattgcttaaatttttttgaataagacgaacggtcaaatatgtttaaaaaagtcaacggcgtcaaacaattagagatgaagggagtatcatccagtaggctatagaagctcgtagctgcgacaccttcatcatccgcctagcttgctccattcgtactagaagatatttttgtgcaggtttacctatactttatttcacgcgtgcaaacgagactattttatgattttttaggtcatctactaatttgaaaaatgaactacagtttcactataggaccatattgtgatttcgatgccacatcacctaaaaacacaatgaatatagactaagtttgaaatgtgaacaggtgtttatagtggaaaaggttgagtaataacgtcgtctggtttggaagttctagttgctttacatttttttgaaagaaatagttgctttattacatagtagtttccctgctacatagcactatatacgacggttcacctagacccagtttatctcaggtgtttcttcccacctatccaatacgtttgttcctttctctcatttttcatacacacgcttcccaaattgctaaacaatattttttttcaaaattttactatataaaacttatttaaaaaatcatattaatttatttttttcaaaaattatctaagacttaattaatcacacgctaatgagtcatttcattttttttagggtttagctcccaaaactaattgagaagagactaaaacgtgttttagggattagctcccaaaaataaactaattgagaagagaccgaagataagaaataaagtgccggtattaaacaaaggcacataatagttgagaagagaccgaagataagaaataaagtacgtgctttgttgctatataaggcaaattttaatttttgagctactgaagacgagtccgttgggaaaaaagagcgaaagtcactaaaatattagcatgcaaaatggctaaaaccctcaatagtttagctagctaaagggttgctcgatcggaatctaaggccctatttagttcccagaactagcattttcacgctgtcacactgaatgtttagacacatgtgtggaatataacatgtagacaaaaggaaaaaccaattacatatattgcgtgtaaattacgagacgaatcttttaagcctaattgcgccatgatttaacaatatggtgctacagtaaatatttgctaatgacggattaattaggcttaataaattcgtctcgcagtttcctggcggaaactgtaatttgttttcttattggaatacatttaatacttcaaatgtgtgtttgtatatccgatgtgacaaccaaacctaaaaattttccccaactaaacaaggcctaacaacggtgatatatatatatatatatatatatatatatatatagcgccatagtccttgtcacttcacatgcccttgtcattaattgtggtcattggtatatatattgcctctttcttttatgattgtcaccttgtgtggtggttcacatcatcatgagatgaggatattgtcacttgcaccatatatatactccctccgtcccataaagctttatttttgaatttctatatccaacatttgaccatatgtcttatttaaaaatttataaaaaaaatataaaaaaattaatcatgcataaagtatcatatatattttatcattaaaaacaataaaaaaatactaatcatataaaatttttaaataagacgaagatttaaatattatataaaaactgaaaaataccatcttcgtgggacggaaggattagttgttagtgcttacccttccggtggatatatactactcccgccgtttcatattgcaagactttatagcattgcacatattcttatagaagttaataaatctagacacatatatatgtctagattcattagcatttatatgaatataaataatgctagaaagtcttacgttgtgaaacactcatgaatgcttgctcggtgaggtgagtcattaattgctgtcgtgtttgcttcctatgcaacacgtagcatatatttaccaaaattattgcggttctatatcacactcttctatttcctccatgttgaaatatatatgattttgtataatttcactattttaattaattagtccaagggcattgctacgagaaagtgagttgagaagagaccgcatcctatatagtaatgatccactaaaaaattctaaaactcaaaatacaaaaaatgtcacatcattatttactaacaattattatatttaaacatcaggcaaacatgtcatattatctataattttataatttactaaattttatagctttaaaatgcaaacatgttaaatcatcttcccacataattcacataatattttcatatatccctccatcatttcttgtagtatcctatatatatatatatatctatatagttcattcttatttagttgatgttatttctcttttctctcattaagccatatcacacaattgtttttagtctgtagatgatctatggtccaaattatctccctcattttaatttcttccatatcatctcaattctttttaacccttagatgattaatcttgacccaaattatctcccaaattttcttctcacataaaaccacaccactttacttttacatttgaatcaacattctatatattattgaaatttaaattatcataaaccacttcaacttatgtaagctttttacttattgttatcgcactaaacttccatcgcaacgcgcgaggtttcacctactataagaaagagtttctggcaagggggtttccatctaaaatctaatcttaaataatgtggggtgcacaaatatgtgcgcactcaaaagtgtatacataatgcttacttcgatgcatgcacaatcataaatatttctgtaatgcttaccaagcacgtaatattatttctttacatttaactatggtcttctatgccctccatgatataattactgagataaaattgatgtgtttttgcactcaatccttgcatattgggttttgcttcaacccttatgtgccccacctaattaggttctcattttttgtggcctatatgcacattacactggttgaacataagttaatcatgctattttctttgaaaatatccatattgcccttgtagagcacaatgctaaatgctaaccatattgcccttgaatataactagtgagtaaggtccccatatagagcacgatgctaaatttttgaatcaccagaagtcacattatttttaagctggctttgaaaataaaatttgaaatttaccaaatcacaaaagattttgacttttaccatttatttgaacacaaagattttatttttcaatgaatttgaacaaaatttggttaaattccattggaaggtttagaatttggttaaaatttgttgaaaattcattaatttggcttggcctaatttaacaaaagttcacatctctaatattataaaaattcaaggtgtttttatcaaaaatatttcgtacgtcgtcggcttttgcttgtctctcgatccgattatgtttctatttgcttgttccgttcattaccgagaaggaaaaaaaaagatattacaggtagcggatagactggcataacggatagaagcgggatgacatcctcaaggcctgtatgggccacgacccaggtaatgtgtgtatatatatattttcgcgaggaaggtaacgtgtaaagaccggccataatcttccaaatgtgataggtcatagagtaagttttattaggtaataaatagttatagttattactaaatctatttatacctatatcttaactacttaaaaaatttgtaactttccattcgtcacatcaaatttccgtccgtaacaataattttccgtccataaatccaatcgaaatccaatcagacaatccaaacaaagagaaaaagaacgggaaaattaataaaaagtgcacaaatcttatctcaatctcgcgggaagccatcgacacagccgaatccgcccgtgggaagtcgccgttgctgccggatccgcttgcgggaagtcgctgatgtcatcagatccacccgcgggaagccacacgacgccaccagatccacccgtggaagccagtggaggatgccatcgctcgtggtggggggagggggctgccgctgcccatgctaagggagggcgccgccgccgccgccactcgcagtggggaacgacgtcgccaccgttgctcgcggtatgggagggagccgccaccgccactcgcgtgtcgccgccgttgctcgcagtatgggagggcactgccacggctgctcgcacaccaccgccgtggctcgcggtgggggaggctcacgctcgtcgccgggagagaggatcgggagagagaaggataaagtgtgagggttagggttagggttttctcccgtccgcatcttcagcggcgcagaggcgatccaagccgtgcatcaaatcgcctttgcatcgggctgcctccatcgctgggccacatcactgttgggccacgcacgtttgatgggccaagggcaagccggtgggtccaacacaacgcagcgaggaggagttgggggagacaaattagacttgagttgcggactgagaaagtaaatgtgctgaaaatggcccagagagaaattgggatttttatttaaataaatgctaaaatgatgtttttattgtaaaatttgcaattaagcttcaaaaattccaacaaaatttcaaagactgttattaatcatggttaatttaataaaaattaaatccatccatatcatattattttgccaccgccgtcgctcacgatgggagagaactagggttagatatagatttaattcattgtttatgtccagaagtatctcatataactcctatggaactataaataactataatcattattataatattattttttttcctgttgcaatgcacgggtattttttctagtgtaaccaaaagtttttcctgacgaaatatatatcaatccggagagaaaatctaagagttgctaacagaatctatataaaggctattaaaattaaaattcaaagtcatataagatgaagcaaccactgctgcacaaaccctctttaaccccggtttacaaccccctttagtcctgggtagcaaactatggctacaaatcctggactaaagatagcgatctttagtcgcagttaaaataaccgggtctaaaaacgttactaaaaatcagccatctttagtcccggttggcagactaaagattttttttcctttttttcattgtttttttgctatttgcatattaatttcaaatcaaactcaacaacaaacatccacattcacaaaaacatcacaaaatcttccacaaatttacagatcgaatgaacatactcagattaacatcacaaatttaccattcacatcacaaaattacagatctaaacatcacaaatcaacaaaacatcacagataaaaatccccgcgtggccacctgccctcccgctctgccacctgcgccagagtcggcaccgccgcgcccctcgctggtgccagccgccgccgcgcgcgggccaccgaagccgccgccgcccccacctttgctttctcccactgctgctacatgcctacgaaagagaggaaactttaaagaaaaggacaagagatcagagaggaaaaaggagaggataagaaaggaaagagagaggaaagggaggagaaggaagttaaaatgagaaggagaggatacgtgtgagggattatatactacgtgttgatttttagtcctggttggtagtaggggaccagacgctattttaatcgggactaaagatcatataatggcgttgggcttttcaaccggggttaaagagtcctggtttttagtaaaaccaggactaatgtaatttttgggcaacccggcaaagatgatttctccagtagtaaacgtttacgtgcatatactgattcaacgaaaactctagaaatatgtagtattctcaataatccaagcaaagttgagcaagtactaatataaacagacgctctataatggattgcagatatatatggtgattgtggtcatcactcatctgtttcatttgtttcaatgtttttatcctcttaggacccctttgaatcttagggttgaaaaaatgttttctaagagatggaactcttgctaaatttactctaaaattcacatgcaatgtgtcattccatagaaatttcatgagatttgaaaagcttcaatcatttaaatcaaaggaccaaataggtaaattttctatagaatttaaatcttatgaaattcctacgtaaatcctttgattcaaagagacccttgtttctttgacgcaccaaatttatatgtggaatttttgaaatactactacatgacaacctgacggtcaactacacaacttcggtacggtgggacagcactgtgcgttgggtgcatgcacctgctgcagtgtaggtttttttttttaactgtttgcttagcaaaattaattgcaatgtctgattgaaaaatattcatagtccacctgtccaggaatccacttggcagttaatgaattattttttcctgtctttgaattaactagccattgatatatcaagtttatcaattgatatggagcatatgtggataacaaattataaataagtaatattgtcggatggtggaagaaggacctggaacgagatctaaggtgtatcacgtgtactttcccaatacgggtggcatcgctcgtcaattcctagctggccaagttgctgtgtcagtgtggatactattttggttttctaggaggaagtcggcaaagtcatctagccagccattaattagttggctaataagtacgtgtggttgccaattaattaagttgattccaaggtctggtgatgtagtactatcctaaattacatataatacctgattattctcgttgtttggttctgcgtgcatgcatggatggggattggatcggagataacatgacttcagaagttcagattaaattaaattgcaaatggttatttgtagttctctacgggcaagtgtttgttttctaagctcaattggctgacttttttccgtcgcaatttggcaattgtttgagttctctatgacttaccgaatacatctgatgcataggctagacagattttattactgagaaaatgtaactatagtttttccaatccagcaatctagatttgtaactagttaagagttcttgaatgcctctggtcctctagtacattaaagatataagatgttaacgtccgtgaaccttcttattcgatattggctttgtgatggaatatgctatggatcacctttctagggattacgcttacacaaagaagagttttggaaagcgtcccgtagaaaaaagatattggacatggctaattagaacatccatttgattttctagatatgatgtttatgtctgttggaggtaggttgtgaggctttccgccaagcagccgaagcaatcaagattgtgcggtgaagcatgatgaaacaaccagagccacttaggtaagcaccacagcggaaaaaggatgaagtagatgaagccacatgagtaaggaagcatgatgagatgttgaagagtcgctgaagtggcaaaagcaacaggacgacaaaaggataacaagtgtggtggagccacaaacacatgagtgtactcactggggcagtcaagtagtaggcctcctccagcgtaaacacccaattaagacctaaggtcagcccatgaagaccacctaaaacagacatgccaagaaatatgacaagaatgcccctcagatgtccctatcactgttaagggatagttgcgtaaaaaaaaattaatatcactaagagttttattttatgatgactcgaaatatgcacatacataaaccactaatttggtaattagtgacatggaaaacttttgtttaacacttccagaaagaccacctatctatttgttcgtttagcaggttcaccacgtccttaatatttatacaaaaaaaacaaacgttatcggtggtaagtttcttgttaaatttatatcgaaagcacacttaagtgaacgttaatttctgggcttgcgattttatctctattgaatgaattttccgttcacaggttagtttgctatacagggacttgccgcaccactagactcggtctagctaaactgcaaatagatgaccgcgtttgttatactctagatagcacaaactcgtcaatattaaattttctcaagcatcattgatagtcaattttcgcattcagatcgttggcatcagggcttcctctcggtggcggttctcccctcttatctaattaagtactttcgttttgtaatatatgatgccatcgacttttaagatacgtttaactattcatcttgtaatatatgacgctgttgacttttgagatacatttaaccattcatcttatttaaaaaaaattatataattattatttattttatcgtgactttatttaccgtcaaatgttctttaagcatgacttaaattttttatatttaaaaataattttgaatatgaagaatggtcaaacgtttgttaaaaaatcgacaacgtcatatattgaaaaaatgaaggtagtatcattatatcatacttcgtcagtatacgaaaggcaccaatcatatagacacatagcttcttgcgttggtctatccatgaagaaaagtggaaggcaaccaaaaacagctaagaggctttattaaggcaatcctcgtaaagtagaatacaagttgtgttgaaggaagagccaagttacggtgtgcccataaattactattgaagcaaacaacacacttatggcttgtttagtaactcgatgtaaggggattgtgagtttacgtaagagaaatgatgataggattaaaatgagaatttgatttttaattctaatatcttgtttggtagaggtgatggaaattgataggaagtttagttggagattatgtcattaataaaaacggatggcttaaaattgtttagaaaaagtaaaggaggaattccctcctaattacctgccactacctaggtattgaaaagaagggagtttcttcctcaattctccatccccatcccaccaaaattcccatgtctcccaatcaaacaaaacacttaatagcctcatccctttaaactcccaatctcttctaaaatctccctccaaccaaatgggccgcaacaaggctagaatatgggaatgggagtatataatgtagacctcttgtcagttctgctagctaaattacatataagaataataatttagttttcttgctagttggctgcctataggttttcatctagatgtattctgagtaggtaaagctagctatatacttcctctgtttcacaatgtaagtcattctagtatttcccatatttatattgatgatgtctagattcattaacatcaatatgaatatgagaaatgctagaatgacttatattgtgaaacggagggagtatatttagctgtttgcaaaaagtattggtgctggcttcgataattttgaatggtataaatccatattattgaccttcacagcctttatctaaaaagcactcaattcatatgatcccccataaaaaataaaaatcctcactcaattcgccttggttttttttaaaaaaaacacatcacactttattaaacgacaacatttaggggaattgaattccccaatacatcgcccaggataaacctaagagttggaccatctttaacaagagagaggtcaactgaaaaaagaaagcaaacttcctaatgaaactaagcagcaatgaaggagccaatcaacagggtactgcggcaatgccgcgacgattgcatccaagggcctctattgatgtgtactccgcttgacgaaccggtaaaccccttcggctgcctccccgggaatgacacatatgagaggtttggtgcgaagccgtagattttggtgtgagcatcaccggaatccgcaaaagatttccacggagttcatcgttgaatctgaggagcacggactgtaaacctgcaaaccaaggttgcaaatccaatctgggctcaacccgaacgataaaccctgcatggttattactgccaagagacagagaggaagaatttctccaaatccagccaaccaaagactcaatccgaagatggtggcgaagaacttgctgtcttggtaactcgatggagaaggttgaagaagaggagatcatccgagccgcatccacgccgccattgcaagacacatccacaccaccgacaccgtcacggcctgcatcggcgcagccgtcgccgtcgcgggtagcaacggcgcggccgtcgccgccgcgggccacatccacacggccgccgccgcgggcagcatcgccgcggccgctgtcgccgcgggcagcatcggcgcggccgccaccgccgcgggtcgcatctgcgcgtctgccccggccacgggtcgcatccgtgaggccgccaccgcagctgaccatatccgagtcgccattgccaccacaaactgcatcggagccgctgtagctgccgcatgtcgcatccgagccgccgccaccaccgcggaacagatccacgccgctgccgtcgtctcaggtcgattccgcgtcgccttcgccatcacaagctgcatccgcgtcgaatccaccaccatctccaacttccataccacaccaacgaggagaaaacgggaagaacccgacctaacgagactagcccggctacttagctatactaggggaggggggacgacccctctccctcccgccgccggcgatgaggccgccggaatcgaggaggaagaggggtcgagagagggtgatttactgtagcaagggaggtttcaagagagagcaggaaggtttgatgaact

SEQ ID NO: 29276 - DNA, 660 bp, Oryza sativa
gtagtccagaaatgggagtgttacacaagttattgtttttcatcaggcacaatgtcaagtaaggtcacatttcagatagttcacggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtgtcagttgtagtgagtcgtgcaacagaaggttatttttgggaactaatgccgatggacagcactgatgcttggagacggtatgtggaaatggcttttgaacggtcatggcccctcgttatatttgtgtcggtacaagagaaagatataaatgtttcaatgcaaaccgaagatgtagagggtcctatcaatgcaggggatgttgttggaccatcgatgcaaaatgaggaaaatcaaccaagggaggagcaggctatgggcatggcggatgaggggaagagagtcggtataattgttgatgaaatggagagggaagattcggataatgaggaagtggacgacgacgcatcatccgatgaggaaggtgatataatggccactgattgggcaaatgaggacttctctggacttggtata

SEQ ID NO: 29277 - DNA, 769 bp, Oryza sativa
caacttccataccacaccaacgaggagaaaacgggaagaacccgacctaacgagactagcccggctacttagctatactaggggaggggggacgacccctctccctcccgccgccggcgatgaggccgccggaatcgaggaggaagaggggtcgagagagggtgatttactgtagcaagggaggtttcaagagagagcaggaaggttagcaagaggggtcgagatttcactcagttcgccttggttaggtggggatacaaacaagggcatatggaactgataacattcctgatgcagcagttgggcgcaagagatttttaggtggttgagcataaccaccctctctatttatatcataatatttatagtttctactttgaattcctaatttcactagaactcaaaccatcaatttccaaattcatccaaaaagaaatcctagacaaatctcatgctgtgtttaattccacaccaaaattaaaagtttgattataattgaaagtttaaataaaaaagttgaaagtttatgtgtgtagaaaagttttaatgtgatgaaaaagtttaaagtttaaagaaaaagttggactaaactcggcttcagtcacgcaagcaatccgactccgtgatcagactggctctcctggccggcctgtcaccgagccgctctgcacaaacaccaagctggcctataggcgccactgctgctgcccggacctgcacacctgcatacatcgataccacattcatccaagaactgcgtgcagcgtgc

SEQ ID NO: 29278 - DNA, 603 bp, Oryza sativa
atttaattcaaattccaatctttagaagcctatatatcctaaaccgtagatccgatctcagtgaaacctagacctaaattcatctaaattcaaatgcttcattttgatgcctaatttgttattttataattttatttgaatttattcaaatatcaattgaatttatatttgcctttttcaaatattttcttttaccccaaaataccctttagccactaaaaagccgccggttggaactttacgccttccatggggacgtttgcggtctattggccccgacgtcgaaccgttggttgtaaagcccggcaaaaccaaacccaaggtcgaagtgctgctcctggcaccccacgccttgatgcgtacaacggtcggagcttcactattccctcgacctcgcacagttagctcttgagctctgtgtgatcctagccgctcccccgccacttatggttgttggagtaacacttccgcctcgctaaacctgcacaaaccttccattcctttagacgtttattggctatcgcaccggctagagaagatccaaacctaatcgttatgctttaacgacgactagcgaacaccccaacccctaattgatattta

SEQ ID NO: 29279 - DNA, 631 bp, Oryza sativa
tgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccctcaattacctcgttctccttatactcccagggtacatgatcaccctctgatataacaagtccagagaagtcctcatttgcccaatcagtggccattatatcacctttctcatcggatgatgcgtcgtcgtccactttctcattatccgaatcttccctctccatttcattaacaattataccgacttttttcccttattcgcatgcccatagcctgctccttccttggttgattttcctcattttgcatcgatggtccaacaacattccc

SEQ ID NO: 29280 - DNA, 450 bp, Oryza sativa
cctttaccaataaaatatccatgtttagacacgactactttattagactcaaaaaccaacttaaatccgtctctagtcagacgggagccactaacaagattcatgtggatagaagggacatgctgtccgttcttcagctgcacgatctttcccgaattaaacttcagatctaccgtgccaacaccatgaacagaagcatgtgacccattccctattaggacggtggaacgccgtgcgacctgttaagaagaaaacaatgagatgtcagcacaaacatgtacattggccccagtatcaacccacaaattagtagactgattaactgaaaaaacagtaggtaaattaccatacccgcttccatttccagtgctgccaatggtcacattagcagacttagaagtctgccctgcaggtgacttcatccccttgtgctgtggacatgttacgccc

SEQ ID NO: 29281 - DNA, 326 bp, Oryza sativa
gaagaaaaatttggcactaacaatccaaatatgccctaaaacttaataaaatatttgtacggtaacaaaatatttgtacggttacaatccaaatatgccctaaaaaataataaaattgtattttaccagtcttggagattttaatcttgtatagttttcaatataaaaagatttgataactattgatatttatacaaaaatatagagcacagtacaaaatcgtcctcccccagggcggcaagggggccgcctgcaaaattccatgccccctcgccgcccatttgcaggcgcccccccgcacagtacaaaatcgccctcgtggaggg

SEQ ID NO: 29282 - DNA, 1113 bp, Oryza sativa
aggtcttttaattccttgttttcgggtacacacaatctttcccccatccagattgttccttgttcatcctcaacaaaacctcgggcttttccaactctcatgttctttttgagctctgctatttcaggatcacttgcctgagctatgcgaacctgctccaccagtgtgggctgtgcctctagggcagccacgaatccgtgctcaactataccaaggttcaaatgttccaaatcacgttgaacctcacaacatagttgctctacccatgcaacattgcagtagctcttcctgctcaaggcatccgcaaccacattagccttgccgggatgataatgtattcccatatcataatccttgatcagctccaaccatcttcgctgtctgagattcaaatcaggttgagtaaagatgtactttagacttttgtgatctgtatatacctcacaacggttaccgatgagatagtgccgccaaatctttaaagcatgaacaactgcggctaattccagatcatgcgtcgggtagttgccttcatgaggacgcaactgccgtgaagcataagaaaccactttgccatcctgcatcaacacacatcctagcccctggcgagatgcatcacaatagacctgaaaatctttcgtctgatcaggcaggattaagactggtgcagacaccaaccgtcgtttgagttcttcaaaactcctattgcattcagcagaccagatgaacttttcttccttcttcaatagctgtgtcatcggcttagcaattttagagaagttctcaatgaaccggcggtaatagcccgcaagccctaagaaactccgaacctgagtgactgtccttggtggggtccacttggtaaccgactccacatttgctggatccaccgctactccttgagcattcacgatgtgaccgagaaactgaacttccttaagccagaagtcacacttgctgaacttggcatatagctgatgctcctttaacttttcaagtaccagtcgaagatgctgctcatgttcttcctcggacttggagtagataagtatgtcatcaatgaaaaccacgacaaacttgtctagaaattccataaacaccttgttcatcaaa

SEQ ID NO: 29283 - DNA, 1991 bp, Oryza sativa
atattgtgacatgtggaacccaaaaaaaaattccacatgccgattccgattattatttgcatttattaactagggaattagctctaggttaattaagataatttcttcgggcaatttatttaaccaatttttaaagcaagcaaaggggggaaaacttcagggcgtgacaaacctaccccccttaaacggaatctcgaccccgagattcggaagagctggcgaagaggtgcgggtgggtggccttcaactcatcttctctttcccaagtggcctcttcctctgagtggtggctccactgaaccttgcagatcttattactttgtttcttgtccttctctcgctggtttcgaggatacgagtcggcttctccacatacgtcagatcttcctgaatttcgatgtgatccggacttgcctgttcctcaggaactctcaaacatttcttcaactgagagacgtggaacacgttgtggatgccaagcatgttggagggaagctcgagctggtaagcaacttcacctctacgttccaagatcctgtatggtcccacaaagcgtggtgccaactttcctttggtttggaagtgatgtactcccctgagcggagtgacacggagatacacataatcccctgtttcgaaagcgagctcccttcggcggttgtctgcatagcttttctgccgagactgcgcgattctcaatctttccctaacagctctgactttctcttctgcctcatttaaaacttctgtaccaaacaattggcgttcccctgtctgatcccagaagagcggagtacgacaccttcgtccatacagtgcttcaaatggtgccatctgcagactagcttggtaacctgtggtgtacgagaactcagcatacggtaagcttttgtcccatgctccaccaaagttaagcgcacatgctctcaacatatcctctagtatttgattgactcggtcagtccggccatctgtctgtggatggtaagcagcgctgaaattcaaaccgggtcccaattcttcttgtaatttctgccagaactttgaagtgaatcggcttcctcgatcagactcgatcttattaggtacaccatgtaacacataattcttgccagatagagttctgctaatttcttccctgagtaggtagtgtgcaccggaatgaagtgagccactttggtgagtcggtcaacgactacccaaatagaatcatgccccgatgatgtcctgggcaaaccggtgatgaaatccattccgatttcttcccacttccattctggaatctgaagtggctgtagcaaacctgctggcctttggtgttctgcctttactcgttgacagacgtcacatagtgctacgaactcagctatttcccttctcatgctgacccaccaaaacttctctttgaggtcttggtacattttggtactgccgggatgaatggaatattgagtttgatgagcctcggttagtatcaggtcttttaattccttgttttcgggtacacacaatctttctcccatccagattgttccttgttcatcctcaacaaaacctcgggcttttccaactctcatgttctttttgagctctgctatttcaggatcacttgcctgagctatgcgaacctgctccaccagtgtgggctgtgcctctagggcagccacgaatccgtgctcaactataccaaggttcaaatgttccaaatcacgttgaacctcacaacatagttgctctacccatgcaacattgcagtagctcttcctgctcaaggcatccgcaaccacattagccttgccgggatgataatgtattcccatatcataatccttgatcagctccaaccatcttcgctgtctgagattcaaatcaggttgagtaaagatgtactttagacttttgtgatctgtatatacctcacaacggttaccgatgagatagtgccggcaaatttttaaagcatgaacaactgcggctaatttcagatcatg

SEQ ID NO: 29284 - DNA, 14542 bp, Oryza sativa
ggcggtaatagcccgcaagccctaagaaactccgaacctgagtgactgtccttggtggggtccacttggtaaccgactccacatttgctggatccaccgctactccttgagcattcacgatgtgaccgagaaactgaacttccttaagccagaagtcacacttgctgaacttggcatatagctgatgctcctttaacttttcaagtaccagtcgaagatgctgctcatgttcttcctcggacttggagtagataagtatgtcatcaatgaaaaccacgacaaacttgtctagaaattccataaacaccttgttcatcaaattcatgaagaaggcaggtgcattagtgagtccgaaagacataactgtgcattcgaacaacccgtaccgagtgatgaatgctgtctttggaatatcctcttcgcggatcctcaactggtgataacctgatcgcaggtctatcttagagaacacagtagctcctttcaactgatcaaacagatcatcaatccttggcaaaggatacttgttcttgatggtgacctcattgagtgcgcggtagtcaacgcacatcctcttggttttgtctttcttctccacaaagataatcggagcaccccaaggcgacgtgctcggacggatgtatcccttctgtaactgttcatcgacttgcttcttgacttccgccaactcgctggctcccattctgtaaggcctcttgtggatcgatgcagttccaggtaccaagtctatccggaactcgatatccctttttggtggcattgttgtcagatcgtccggaaaaacctctggatactctctgactatgggaatatcctccagcttcttagtggttttctccactgctacctcttgtccttcaccagcagcctggtttaaactaatccctggcttctgcggcactggagactggaagattaccacctctccttttgcattggtcaacttgatggtgcggctggcgcaatcaatcactcctctgtgccttgtcaaccaatccattccaagtatgacatctaggtccttggattcgagaagaatgaggttggctggaaaaatcaacccttgaatttcaactgtcacagatgggcagtagtgagttgtggtcatgccacctccaggagtatgcactcgcattggtatcttaagcttcactaaagataacccatgtgcaccagcaaaacgcttggaaatgaaggaatgggttgcaccagaatcaaacaatattactgccggtgtcgagttgacggggaatgtgcccaatataacctctggtgctgactgcgcctcctctgcagatgcatgattgacacgggcctgaacgaacttgggtccagcacgtcttggcttcgggcactttccaaccgtgtgtccgggtttggtacaattgaagcagagttcgggtttttctcccaacctcttgggctgttctggcagaactggctgaactgattgagctggaatctttagtgaactcggggtagggttgagactgtgctgctcactgttgttgtgactatcactatggtgggtcttattgaagctacccgggtggtagggacggtgctgtcggataatcatggtgaaaggtccaccgtgacgtcccatcgtgtaacgaggcttctgacacttcccctggggagtcctgaactgggctgccttcctcttacggttcattttgttacactgctcctcttgacgaatagccttgtccacaagcttctcaaagtcctaatagtctatagagatcaactggttggtcaattcatcatcaagaccagacataaacttctcctgcttctcggcatcggtacgcacgtcctcaggggcgtagcgcgcgaggcggttgaactcatgcaaatactctataactgttttggttccttgttgcagggaacggaactctctcttcttttgtcccacaattccctcgggaacctgtgctttattgaaactatgacgaaactctgtccaagtaacctctgccccagttggacgggtcaccatgtagttgtcccaccaaatagaagcgggaccttgtagctggtgtgtagcaaaagcaaccttctcctgctcgttgcattgcaaaagattcagcttcttctcaatggcatgaagccagtcgtgggcctcgattgggttggtggtgcttgagaaggtgggcggcttgacacgaagaaattctaacagtttggactgaggaggcggaggaccaaattgcgggttctgctgctgctgctgtgcttgctgttgcacctgctgcaacacctgatggtactgtcgctgcatctgttgcatcatcattgtcatcatctgagtctgattgtccaacacctgagcaattgttgggttctcaggtggtggggacggactgttgtcagatgcaccgttggcacgtgctccattgatcggctcttcgctgccactggcgttgttcgagtcgcgtgaaccattccttgtctccatctgaggggataggtagaaatatgagaaaaggaagaaaacaggggctcagaaactaatcttgcttatgaatttaagtgcaattatcttaatcttgattaaaacactgaaaaagaggcacgaaactcctaattgaggcagtcataccactgacacatgatatcgaccgccgactaacccacaagcaacaaacctaaacacgaaaactagcaagcaaacagactaagaaggcgataaagctaagggcggcgactctgaagctcgaggcggcgcttgcaaacgagggataggactgacatctaaagtagacaagggataggaaccaactcatgctcaaatccaaattaaacaaagcaaaagaagactcaaataaataaccgagcatgatgatttttatgcatagaacatttttcatgaactcaaataaagacactaatgcaactaaacaataaattaatgcatagactagttgcatggaaaatgatgcgcataacattgcccccatcgaatatagacacgacctaatgcataacccccaataaattcccgactgactgtcgaataaactccaactaaaatttttctaaagccctagactgagctcattttttaaaaaaaaatccgatccgaaagaacgaccaagatttttcccgcaaaccaaaggggcaaaactccaaatttttcccgaaacaattccaggtgcaaaaaggcatatgcagatgaaaaaggggttcagagggctcttagggtttccagttggcttgtcctacggtcaaggtcggctctgataccaacttgtcacgcccagaaattctcaaaccagaatttctaagctgaatgtgcattaaatccctgtccaggaccagccagggtacacaaacgacaattgttgacatacagatccacgtcttacaaaaatagaaaagattacaaatgcagcggaaaagaataaaagcgagctaaaccgggaagcttgacttcagcagcgggcgactccactccacaggcaatccttgacggcagcgacgaaaccaactttgacaaaacagctccaactaggaagatctccagctctggtgtgggggaaaaagagagcaagactgagtactacccactgtactcagcaagtcataccggaagaggaggtatgatgcaggatataaccaaaggaagctaggggttcttttgcataaagcaggcatttcaaagcagtagttgaaagcagtaaaacagctgtagtaattaatcaatattaaccaaacactgtccaacgctacaccacgttgcaacaggcccaaccaaccacctgaactacaccagttcattaagctaaactagggatgagactaatcacggtgaatctggttgatcgcccataaccgcgggcacggctattcgaatagttttactctggctagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaaccgccatgggtgcgaccagcaaaaccatgcacccacagcccaccattcagtgtattttaattaactcacaccattgcggtggcaccaatctaaagctatgccaaaagacagagtctatgtaataatgtgatccccatttgtgtactagttgaactaagcatggctaagcatttcctaaaccaacatctaatcattttgatacccaggttatcaatggcatatggtaaacaataaatggctgagtaataggacccatcccacatgatattgtaaaagaatgcaacatttaatagaaatacgggatatttgtaaattgggtacaatatgatcaaacgtattgcatgacttgccttgctctcgcactgatgagatcacagcaacgtcttcgagaaactgcggatcgacgaaacggccgaaacctacgcgacaaacaaagcacacaagcaaaacatgctataagactacagaaacaggaaacaaaaccatttttaatggattctttgcatttttcttgatttactgagacttgaatggacttaaacggagctcggatgaattacttatgaattttagaagataaactgtgtttttactaataaagaaaagtccttaatcaatttattgcgcaataaagcccagggctgacgtcagcgaggggagggggtatcgccgacaggcgggccccactggtcagcggcactaagggggggagagggggcggctggcaagcgggccccactggcagcggcacaaggggaaaggagagggaggcgccggcatgtgggccccacgggcagtggctcaagggggagggagtgggcggcgacatgctcggcacggctcaagccggccggccatggcgaggcgacgacggcgcacgaccgccggcggtgaccggcggcgcggggagacggcggcggccggcgcgaaggcggcggcggcagccgaagacgacggcgcacgcgcggagggcggcggcgctcacgggggagaggaaaggaaggaggaaaggggattcctcaccgaggcgatggcggcgaccggcgtgggaagagacgagcggcgatgaccggcgacgcggaggcacggacgggcggcggcgacaccctaggagaagatggagaggcgttaggagaggagacgacgaccacggcggcttgaattgccggccggagatggaggggagggaaaaactcaccggctcgcgaggggagaggtgctccggtgggattccggcgacgcgaggcggcggccgggaaagctcttgcggcggcgaagctaacagcggcggcggtttggcgcggcggcgactctagcggcggcggctcgcggccaaaggcggcggcaagcggcggcgctagcaacaagcggcgcgagcgcgataggaggcacgggagagcgcggcgagtgcgaaaaacgagagaggaagacgcggggagcgatttataggtgcgggagggggcggacgtggccggggaggtggccgatttggccggcgacgtggggagtggagggagagtgagagaggtggattcgaaatcgaatcccgccctctcgagtgcgcgcgcgggccgggagatgcgggggaagaggcggcgacgtgggggggacgcgggagcggcgcggcgtgggcgcgggaagagcggaggaggcggcggcgtggcggattcggcggcggttgccgtcggaggcgggtggctggaggaaggggacgacctgacaggtgggccccacctgtcagcgtcccggagagagggggaaggagaacgggccggcccacaaggggaggccgagcgcgggcgacgggtggactgggccgacggcccaagaagaggaaaaaaaaaggaggaaaaaggaaaaagaaaaagaagaaaggattttcctgggattaaaattgcactttggtgatttttaattggtaaaaattatttccaaggctctaaaaattccactaaaaatcctgttaatatattgtgacatgtggaacccaaaaaaaaattccacatgccgattccgattattatttgcatttattaactagggaattagctcttggttaattaagataatttcttcgggcaatttatttaaccaatttttaaagcaagcaaaggggggaaaacttcagggcgtgacaggacacttcctagccagatgaccaggttgcccacacacaaagcaagtcctctcatcctggttaggattgttgttgttcttcttctgcttcttgaagttggtggtctgttgagctttgtatttccccttgctcttgttctgggccttgtgcacaacattggcactagactgcccaccatcgcccttagacgcggcgtatttttcccgagttttctcctcaacatcaagagacgctatcaacccctcaacggagtattcctgtctcttgtgtttgagtgcagtaccgaaacttctccatgatggaggtagtttcgcaataatgcacccgtccacaaatttgtcgggtaagacacacttaaggagttcgagtttcttagccatggtttgtatctcatgagcctgttcgactacagaatggttgtcagccatcttgtagtcatgaaactgctccatgatatacagatcattgctagcatcagtagcaccgaatttagtatgcagtgcatcccacaactccttagcgtcggtcatatgcatatacacctcgaccagacgatcgccaagaacaccaagaatgcatcccacaaagagagtagtggcttcctcgaattgcttctgctgatcagcagtaagaattccttcaggtttgccagtactcacccagaagcatttcatagccgtcagccatagagtgaccctgatctgccttctcttaaagtgcacaccggtgaatttatccggcctcagtgcatcggcaaaaccagccatagtaaaatcacggcgcctataataaggtttttggattgttgaaattataagcacataatgatttaatttattccataaataaatcatgatattgcagatgtaaactagattgaacgcatcattagatctacacatgtaaactaagcagtaaaacatgaacagatcaaatatgcgcaacatgtcgaacacgtaccgaggtggcggaaagaccggttgctcggcaggaactactcgcggttacgagcgtcgacgaaggcgtgaagcacgcgagcggagaggaaggcgagccgtcgcggacgaatagggagcagtcgcgcaaagcgcttcccaaaaaccttattgccgccttctcccggtgcaggacgtcaaaggcagaggttctggagacctgctctcccgatcaccggtgcacgccggcgagcgggatggagtagtctacgagcgacggcgcggtacatagtaggaggtaaaccctagattgatttcgcgtgtgttgcatgaaggcggcggctcggtttatatagagataggtcgcctgatcacggcgcccgcgtaaaccgaaccggacaagtcgcgcgtaacctatccggactccacgccgtttttcacgcaccggatttttcggaatgtttccaaaacaaaacaaatccgattttcccgtagcaaaacaaaactgtaaaaggaggctgcatctgcgcaagggtgaggagtcaattttgcggaccaccggcgagcgggatggagtagtctacgagcgactgcgcagtacagagtaggaggcaaaccctagattgatttcgcgtgtgttgcataaaggcggcggctcggtttatatagagataggtcgcctgatcagggcgcccgcgtaaaccgaaccggataagtcgcgcgtaacctatccggactccacgccgtttttcacgcaccagatttttcagaatgtttccaaaacaaaacaaatccgaatttcccgcggcaaaataaaactgcaaaaggaggctgcatctgcgcaagggtgaggagccaattttgtggaccattcgatgcgtacatcgtgcacgcgcaccgcctgccctgccaggcgagcgagcgctcgcgtgtgtttcccctcttctctccaccacacaggcttcaagtggctaggagggcatcctcccttttaaggaggtccccctctcctagaataagcaaggtggtactaaactccacatgcatgccatcccatgaggtgggcttttgtgattttccaaagaattaatcttcgaatgggccttagcccatctattaattccaacaagcaatacacagaaaattgcaacttggtactccatatcaaagaatataggcatgtgtttgattcaatggttggaatgggttggattggattgaattgaacacctttcataggtgagatgagatggtccttaatagaaaatactacatccgtcctaaaataagtgcagcagtggatatttgtgcccaacatttgactgtccgtgttatttgaaaaatttgtgaaaaatttgaaaatatttagtcacacataaagtactattcatgttttatcttctaatagcaatagaaatactaatcaaataagatgaacggtcaaacgttgaacgtgaatagtgcaaaaatgcacttattttaggacggagggagtatttcccttagatttgagttaccttatcccttaaaaactggcaaaccagtccaacctatttttttctctcactgatacgtgggtcatcattttttcttaaaaaaacaaagaattgaaggattggtttcaggatagaaacaaagaaccaactccaagttgaaagtgtagagaaagagcaaagcaaagaggctggcagagagccatatctcatgctcctccaagagcctggcgatagaggccagctggtctagggagcatggccttggttattgtgcccctgcctcctccattagcagcgcttcgcgaaggcgcgcacatggctacgagaaggtgagcctggggtccttgatgtccagctccaatggggcggtgcctgcctcattgtcattgaggggtaggagacgaaggtagcaactcgtgtagaggttgatggcggcagcaacggtggctaagctgtggaaggtggcatgctcgccgacgaggttgatcttacctaggccgtggcacaaaccatcattggtgatatgacaaatcctttctgctagtgtcgaatcaaattgatcgatgttgatgtatgcgataagcttattaaattgggactcaatattaccgaagtttggtactccaagcaacaacaacccaaaggcaaccgcttttaatccctttggatacactccttctgactcactttgaactctcgggttttagggcctaaactatgcaaactacacggatgtgtatccctatatatgctattcggcacgtataggccacaccacccatagtgaagggcacactttggtgttttttgcgcttcagcttttgattatttgtgtatcagtacataaaaatggtttttgttttgagacatgggagcaacaaataaaacattaacataggttaaaaggggccacatacttgttttgttgccatgcaaaacgaatgcaatgtgcaacaattatgctcaacactcacgtactcataaagttgtatgacatatacttcttgctggcttggtggcctacagtatatgaagaaaggcatgctaaataaaagaaaacaagttaatacaacataggcttacgacacaattaatttggtcgattcataaataaggaagattcgcaagaaattaattgatcaatagcaaagattttattattgattgcacctgaggtagttgctagatttgtttattcatcaccagcaagaatcatgttgccatatcaatattttacttgttgattcttctttcccctgtatattcaagtaaacggaaaacactagataatactcgtattagataaacaattctatccatgatctgaaaaaaatcaaaatatgccatagtctacatttcattgtagaaaaaaaaggatacaaaggattttttttattttctgaacctttttaatatttaattttagaaataaacctatcgaaattttattttcaagatcttttggccacgctaaccaaactggcgtggcaaaataatactgtcacgcctgccatgatagcgttatttggtcacatggcaaaactgtcacgtccgctataggtggcgtgccagtgttgttttgtcacgccagacaggttgtcatgaccaaaaggttcagattttagaaataagttttgaaaaggcttagttttaaaattaaaaattaaaaaggttcaaaaaaatacactaattcccaaagaagaaccgggtctgtaatatgatgttcttaacttgattttggtcttgaagacactggaagaacatacaaacagaagagtataaattagatagtacatgttggaattaatggacgggccttagcccactcgaagattaattctttggaacatcacaaaagtccacctcatgggatgacatgcatggggagtttagtatcaccttgcttatttaggagagggggacctccttaaaagggaggatgccctcctagccacttgaagcatatgagccacacgcacgcgctcgcctcgcctagccagggcaggcggcgtacgcgtcgaatggtcagtcaaaattaattcctcacccttgcacaaatgcaacctcctatccggttcggttacacagagtggagatcgtgtcccttgcgcagatgcaacctcctatccggttcgattatacagagtggagatcgtgcggacaccctctgtgctgcaccggcgatcgggtcgctcgtagatattactccatcccgctcgccggcgtgcaccggcgatagggagagcagtgcgcgccttcgtcgtcgcccgcaaccgcgagtaattcctgctaaacaaccgatctttcagcaacctcggtacgtgctcaacatgttgcgcatatttgatatattcatgttttactgcctaatttacatgtgtagatccaatgatgcattcatgctagtttacatctgcaatatcatgatttatttatggaataaattaaatcattatgtgcttataatttcaacaatcaaaaactttattataggcattgtgattttactatggctggttttgcaaatgcactgaggccggataaattcatcggtgtgcattttaagacaaggcaaatcagggtcactctgtggctgacagctatgaaatgcttctaggtgagtactgacaaacctatgggagttcttactgctgaccagcagaaagaattcgatgaggccactactctctttgtgggatgcattcttagcgttcttggcaatcgtctagttgaggtgtatatgcatatgagtcgaggtgtatagagccagatatttttttttgaacccggcaaaagctttgtcatttatattaatagagtaggaaaaatggtttacatacagggggttactaaaattcccctcctgcaagaggttttgggctgcagactacgtgatctctcctaaaatatgcaatcctccaagagcaaccgccccagccttgacctaggttcttgcctcttttattttcgccactatcgctgcagtagttgaggcgtggtggcggaagattcttgcattacgctcacaccaaacctcccagcacattagaattatcatcgacttcaaggtctttgtcgaggtgggagtgcacgataggaggaagtgacaccaatcggtccccgaggtaagcctaccccaatcatgcatgagcaggtcccaactttcccatcattggatttcttcccagattctgcaggttactctacaagaagtcaataggtgcacggcagattcctgggtgactcgacataggggacatagttgctgattctgccatcctctcttctgcaatctatccaccgtccatatacagatttggatgaccagccatgcaaaaaatttacattttggaggggcccaacacttccatatggtttcattgaaggtagatcttgtggcgccgatgaattgcagccgatatgccaattttgtcgtgtatactccgttggctgtcagtttccatatgatggtgtcttcatgctcattgaaggccggtggctgaagtagtctaacccaaaggtctacgtattggcgaagatgttccgacgtggagagttcctctgtgcggataacggagatccatactcctgcgtccacggcttccctcacagacctattttttcgtcttgaagcttggaagattagtggcgctaaagacttcggcgttcgaccatcactcaagtgagagtgccagaagctcgccttctttctgtcaccaatagtgctggttgttgccacagcgaacagatctctatcctgattgtcacagggtaccggtgttcctatccatggcttatcgggggctgtccattcgtaccatagccagcggactctgagagcctttgcgaatttgtgcagttccaagatgcctaggctgcccaagtcctttggcctgcagaccctttcccagttgactttacattttcctcctgagatgttctcgccccccgcccataggaatttccatcatagtttgtcaatttcgtgtagtgtgttttcagggatctttagagcagtaaggtgatagattggttgcgccattaggactgactttgttagtgacgttcttcctgttgccctcatgagtttcccttgctagggtgctaactttgttacgatcttgtcgagtatcggctggacgtggatcttttttagcctagagacagtgaggggtagtcctaggtatttcaaagggaaagtagcaaccctcgccgggaacgcaaggaagatgtcatgtagatcgagattcccgcaacggatcgccgctatcctgagggtttaccttcagcctggtgacctttccaaacattgaaaggaattttgaaagatttgtcatatctctggtggttggtgaaatgaagttagcggcatcgtcggcgtaaagtgaggttctcaatctcgccgcccttccattgagagccagatctttggccttggggatctcgtgctcctttaggaacctggcgatggagctggttcaaggagcatggcattggctcccgtgccccggccgccgtctcctcttgcggaaaaaactcccctgagttgcttcacttttctagaccttgaagcccaactcttgcattgcagctgcatgcccacctaagtacctattactgtacaataattcaactttgttatcaaatataattgtttgcataggagtacagaatatttgaacctttgtttctctgtggttctaaaagaaaggacaccaaattcgtcgcaaactattctcagccaaaaagggaaaacgactagtttagatatgattattcatttacgagtacgggttttcagtctttataaactaactggaactgtttgagatcgcttaatcactgacaattatcatgcaaccctatgtgatatgttattaactaggaatatatctctaacattaacactgctaagactagtagcatctaccgattgagggaccaagttggttagtagatgattggaaaaagtacactgaaggtccctcaacttgtcatcgaattacaaaatcatcctccaaccgcaaaaccagatataggacatccctcaacttacaaaaccgttcactttaggtccttcggtggttttgatcccggtttcgtccgatgtggcggctgagtcagcgtgggacccacgtgggtcccacatgtaagggtgtacagtcagcacctctcccttcccccttctcccccttcctcttctctctctatttctctctctctctcttcccctctgcaggatgcccggcgggtggggagctcgtcggggcgaggtgggagaggacatccggcgggccgtcgatgcggcggcggcggcggcggcgtctacgatgcgggagaagggagagcgtcacaggctcaccgcgcgtgcgacctcggggtcgggccgtcagagaggcccgggcggtggcggcgaggacgccaaggcgcgggactccggatggtggcggcggcatacgacgcgctgcgggcgccagtttgggaccaatattagaggagcagagaaaattagggccaggccgtcatctcccgacgatggcggcgaggcagaggaagggcggcgcggcgaggagggctcgacgaagaagatgaggagcgtggtgctgcgggaggccatggcggggctcccggagcacggcgacagtcgcgtgaggtacgacgacacgtggtgacgggcaagcgagggcggcgaaggcgagcccacagcggtgg

SEQ ID NO: 29285 - DNA, 10248 bp, Oryza sativa
gcggcttcgggtgggggcgccgcgccgccggcttctcgtcgcttgccatggcgctggaacgggggaggacggccggagtggcggctcgttggggacggcctcgcggaagagcaacggccggaaggacaacggcggcgacaacacgtcggccggccaactccctcctcgccgtctccatccctacttccctcccgctgtcgccgtctccgtcttccgctcctccctcgccccggatgggagtttcgtcggagcggcatcctcctcctccacctctccactgccattcccctcaagctcccccttcgctctgcccctgtggtctcgccaccgacgctcctccccgctcgcgtgcgccgacctcgtcgaccggggtgacttcaacggggcacgccgcgacgggacactgtgctcgccgccgccgacctcgtcgagcggggtgacttcgacggggacaagagaggccatggcgatgcccgaccgtggcatgctcctctgcaccagcgaccgcgcccgcgcccgccgcaccgtcctgccgcgccgccctggctgctcttcgccggccaccgcccatggagagggaaggagagaggaagtgagttgatggggagggtaagaagtggtgacgtggacagtctaacatgtgagtcccacgctgactcagccgccacgtcggacaataccagggtcaaaaccaccgaaggacctaaattgtaactcgatgacaagttgacggaccttcggtgcactttttcctagatgatttggtcctgcactaccaatttcttattaggatttttagcggtaaaaaaatgagttgttatatatgagctgcagacagcagcacaaaaactggtgttccactattagtttgacttggccgacagagagaggaacacacattctttttagcgagatgatggaaggaacacacattctttttagttggaatggcagtttgcaacacactggattgaagaatcagtagctgtagagatgttcgttatcttaaccaatcatggagttaggtaatctattagaatattcagcttattctgccgcggatgcagatcgtgattgctgttttgttttcgtgggaggtcgtatttatatgtaggctaaacggggtaaggaaatttgagaattacagagtaaagtctatcaccggtccctaaacttgtaccgttgtatcattccggtccctaaactcgcaaatcgaccgttcaggtcctcaaacttattcgactgtgtcatctcggtccctaaacttgcatatcacttgtttaggtcctccaacttgttcagctatgtcaccctggtccctaaacaggatggtctaaaaactttatatcaaaaaataattcataaatttttcatgtgaactctaatgaagacgaactttatatcaaaattatagctctcgacacgacctacaactttgtagttgaaaagtttttgaattaaaactgtttagggtcccaaaatattattgcatgtttatagattttgaaattttaattttaaaattacattttgggacaaaaaatgacttaaaataaaaaaaaatcaactacaaagttgtagatcgcatcgagggctacaagtttgatataaagtttgtcttcattagagtttacatgaaaaatttataaattatttttaaatataaagtctttagaccgtcctatttgacccagatgatattcaaatccaagtttagggaccggggtgatacaactgaataagttggatgacctaaacgagtgatctgcaagtttagggaccggaatgatacagtcgaacaaatttgaggacctgaacggtcgatttgcgagtttagggaccgggatgacgcagcggtacaagtttagagaccggtgaaggactttactctagaatacactagactagagtctagagtatacatagacatgctgcatagtaccatgtaagtggccaatttttttttttggttggcaaaacagattatgtgatatcgccccacaaacgtgcaagcacaagttatatatttgccatcaaacctgcaagcacaagctcaactctagatattgagaaaaatacatatatccggctaataatgtagctacgctttgtgtaattatgatttttcgccactgatgttataactcatgaacagatagattctacataataaatattgtctctttatctaactagatgaaactccgcgcgttgcaaaagtttagtatgataagagcaaataaaaataatatttaagatagctaaacaacataagtttacgtaagttgatgtggtttatataatgatgattcaaaagtaaaagtaagaagatgtagctttataacagaagaaaaggaggcagataatttggactatacatttacgatcaaagggctaaaaataattaaggttatatggtttaatgagagaagaaaacgaggaagataatttggaccatagattaatcatccaaaaactaaaaataattgtgatatggcttaatgagagaagagataaataacatgaactaagtgaggatgaactatatagatatataggatattataaaaaatgatggagagatttaaaatattatgtgatttatgtgacatgatgatttaacatgcttacattttaaagctctaaaatttaataattataaaataagtaatataacattctgtacagatgttcaaatgtaatagttgctagtggaagatgatgtgaccttctttttgcatgttgagttttagattttagtgggttgtaactttatataggataattaataaatattacctatcttcattaacaaattattattattattattattattatcatcatcattatcgtatacaaaacaaatatattcacatataccagtcacattaaaacttactgaaaaaagagtagtgggagcccaatcataccagagctggaatagtctagttttttttctttttttaaaaaaaaagagagagacggagaaagagaattcaaatgacaagctggattggaggcccatcatatcacgcttaaaaacctctcctcaccctcgcgctcacttcctactccatctgctcccgccatcgcagtatcgcaccaatctcaaagcacaccaccatggcgcgacgtcgcatcctacccctcctcctcgtcctcctcctcaccgtcgccgtggcaacgtcgtcggcgtccgcctacggcgccgatgatggcgtgaccgtgatgaggcgcgttctggacaccgccgcgcctgcaccggccccgggccccgcccccggcggcgccatggcgaacacgacgacgagcgggtacatcagctacgacgccctgttcgcggaccgcgtgccgtgctcgctgcgcggcgcgtcgtactacaactgccatcccggcgcggaggccaacccctacacgcgcggctgctccgccatcacgcagtgccgcggctagctagcttaattagataggccgccgcactgccggcgagatcgtctcgtcgcgccatccttttcttctctcctgcagtcaattgttctttctgttggatctgatttggtgattgattcatgatttatcggtgtaatgttgtatacttgtcaaattgttggaaagatatatatatatatatatatatatatatatatatatatatatatatatatatatatcttaattaagacactcctaattcaaattgtgagtgatgttaatttgtgcgcatcagcgcagttaacagagagtgaatgtgaagttggtgccagtatttgaataatggatcaaaaatgctagtaattaatacttccaggcggtcataatccagctttgttctaacatttacggtttaacctggtttaaccatagtccatggttgtaatgagctgttcgggactttggattttattcatgcaattttttctttctggttttgtaatcaaggattttgtattacctctcctgtatgtttgatcagaaccgttgtgcaccaatgcaatcttcggtttattttggcaatcttcaacaattcgttgatcgtaaccactgcagatgatgagaaagcctgacagcgaacgaataatgtatattataatctgggatccttggatgtaaatgtaatttccagagtaaccgacaaaatcatgtgctgcccttcctccaacctctgcgtggttgtcatgctcaaaaaatcacggcagaagaagcggagagagatcagataaaactgtgtagttgttgccacgtttctgcaacgcagaatcaactcctctgacttcatctattcaggtcaatttagacatataaattatgttggtatgacagctgcagaaggaaacatgagtagtggtgatccgtgatcaaagaggagatgcatgcacgctgcccactaattcaacaagatgatgatggcgggaacatgcaaacattctcttagttttttttatatatttttaagaatggcattcttttatttggaatggcagtttgcaacacatggaattgaattgaagaatcagtgtagtgtacattatcaatctatcataatccaatcatatcgattgatggcccattgggatcttcagggaagaagtctcatgtggatgcagtcctagttgacctcaggctttccgtaatccaaacaggagaatttcctcacctggttggtactggagctcaaaggagacgaattttttttatttttaattttttttattaaaagttttacaaaaataattttccattttgaaaattgacggaagtagtcgcctaccgccctctgggaaggcgatttttaaaaatcgccctcccagagggcggcgaaaatgacgtggcagacggccgttcgctctcgggcgacggccgtcaacgaaatttgcaggcggcccccttgccgccctccgcgagggcgattttgtactgtgcggggggccgcctgcaaatgggcggcgagggggggcatggaaatttgcaggcggcccccttgccgccctccgcgagggcgattttgtactgtgcgggggggcgcctgcaaatgggcggcgagggggcatggaattttgcaggcggcccccttgccgccctgggggagggcgattttgtactgtgctctatatttttgtataaatatcaatagttatcaaatctttttatattgaaaactatacaagattaaaatctccaagactggtaaaatacaattttattattttttagggcatatttggattgttaccgtacaaatattttgttaccgtacaaatattttattaagttttagggcatatttggattgttagtgccaaatttttcttcacgaccaaatatttggtaaggtaaaattgcatttgatcatatttggtttgctgccaaaatgtaaaattgtagtgaagaatgttctacataatctcaaatctagattacgtattaccaatgaataggcttccattttcgtgtgttgtgttctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtaaacaggcagcgccgaaagttgatagtgataactcgagctgccgcttttcatgtgtgctgttgtggactgtgcgcgctactggatctgacactaccgtgcagcgccgaaagtgtgttgtcatgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccgtgggagtacgtgagtcggtccgggggtacggcacggccaacccgtcctgcctgtacaggtgtgacctctggctgctcctgagtgtgcgcctctggagctcctccaagctgagaggagcctagtacgtcgtggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtacaggtatttaacagtattaataaaaagtaaagtaccgtgtgggcgagggatcgacgctccgtgagaggaagagctggcgaacgcgcccgaagaggtggcgaacgcccctgcggagctcgtggaagcgccggtcgtgcctgcgaacgcgctcgaaggcagacgaggtcctgcgatgaggaaacgtgcagttaaaacatggtgacataatcgtgcaaaagctgaaacaaaaatgaactaatatctgggctgaactgtaccgtgcgaaaccggtgctgtaggtcgcactgctccgaagctaggggcgttcgaaggcaaacgaggtcctgcgaggatggaacatcaagttacgacggggtgatgttttcgtacaaaaacagaaacaaaacttaagaaacctctgggctgagcagtaccgtgcgaaataggtgccgtaggtcgaggtcctgctccgacggtaggcgcgcgaggccgtggttgtaccggaccagctggaggtacgacgtccacggcgctgcgacaggagaagacgcgcatgaccgcacgcatcttctcctgcatccggtcgaaggtcgtcctctgctcaacgtcagtcaagtgcaaacctctgttcaaccttacttggactgcggtgatatcggcactgatatcccgtgcggcatcagcctatgcaagatggaaataacaaattcagtagttgtcctatattatgcaagataaatgaaataattgtaagaagtaatacaaattggacgtaccgccacgaagtagtcccggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgttgtgggaagagctcgttgatcacctcctctttagctaacacccagtcgtcaacgtactgctgtacacgtggagcccaaagtgctcctgctagctgtccccgtcgagtcaacctgtgaagagaggtaaattatatggctcgatgaagtaattatcataaaaagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggacgtgatcgtaacgacgctgcaataaacatgatcggaattagacatgttatgtgaagaaaaaaaaaagacgactgataaacttataacgcagcgaagttgcactaaccccacgtcgacaccagtaagtccccatcgtgggaccgtcctctggccactgcgcgctgcgaccaaccccgtagggtgcgctgtccaccactggtcaacctatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgcagaaggtccgcctacaattaagaatgaaatgttagtacaaaacactcattcggtcgcaaataagcacgtatgataataacaacttatttacttacagtgaactggagcaaccaagccttgctaggcccgactgtagagtacggaggaagggtggtggtcggtcctaggtgtggaaggcgcatcacctgctcgaagcgcgcagtgatatcctccttccacccaaaaacaccgtccacgggaccaactgctgctcccgccagcggtagcccgagcaggtacgacacgtcctgcagtgtcggagccatctccccacagggaaggtggaacgtgtgcgtctcaggtctccagcggtctacaagagcggcaaggagtgaccggtctgcatcccaccgcttcgctgggtcacggtcgtccgccgcagcctcaacaagcctacaaagtggtagaaggcctggcgcacgcaacctgtatagagcaaacttcaaacataagtacaacacaaagcaaagttgagttgaaatgagaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaataggttgatcagaaacatataaataattagttcaacataagtaataaatgttcataagcgaattactaacacatattaaacaagagtacaaacaaacaaaagtgtttagtccgaacactcatcacgataacattatgatacaacaccgaatagttcgcaatactactagtacaacaatagtcggaggtactcattacaacaacattgaattgaaattacacgatagaagtatttagtccgaacactcattacatcacaacagcattttattttctaaatcgaaagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttctgcattcttcgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaatataaaaaacttgggcactcagcattgtgtaagatcctgagatcccgaacccatatatctcctcactccatgtatgaaagattgcttctttcctgaaataatttgagacgtacacattgggagatatgccacaatcactggcagcagtaagaacgtgtgagcaagaaaggtgatgaagcttcggcttcatacaactgcaggtacatccaccatccgccttcaagacacattcctgcacggcttgcttgcgatagataccacgtctgctcctatcaacacacattatttcataccgatgcacttgtgtgccttgagcaacaactcgatgtctccgtgcctttttgattttatcttccatgtactttgtcactacgttgccaaacactatgttgttatcggccatggacggaccaattttcttgtatcgatccctaaagtaggcttgcgtgccgtgaaggatgaattcaacaatagcaaccaatggaagtacccgaactcctcgcattacccagttgtacacctctgccaaattggttgtcattatgccataccgagatccatcggtgtcgaacaatagagaccacttctccttaggctcattctcaatccactgagtgaaatttctgatggacgaccctgacctccttctcattgttggtgggtcatcatgtaatgcaccaagaggtatgggaggctcgtcaccttcaactagtggtctgcgagattgcttatctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaacatc

SEQ ID NO: 29286 - DNA, 418 bp, Oryza sativa
acgacgtcgccaccgttgctcgcggtatgggagggagccgccaccgccactcgcgtgtcgccgccgttgctcgcagtatgggagggcactgccacggctgctcgcacaccaccgccgtggctcgcggtgggggaggctcacgctcgtcgccgggagagaggatcgggagagagaaggataaagtgtgagggttagggttagggttttctcccgtccgcatcttcagcggcgcagaggcgatccaagccgtgcatcaaatcgcctttgcatcgggctgcctccatcgctgggccacatcactgttgggccacgcacgtttgatgggccaagggcaagccggtgggtccaacacaacgcagcgaggaggagttgggggagacaaattagacttgagttgcggactgagaaagtaaatgtg

SEQ ID NO: 29287 - DNA, 915 bp, Oryza sativa
tgccgctcgcattacgcatctaccacctgcagcttccccttaatttgcctcttgctcctactactacttccacactgtcaagctagctatccttgcacttgcttattagtatcactttgaaatgaaaaatgggaggaaccaaagtggtgatgtggatcaaatcgggcgaatggtttgggacaacacaaagtttatataggctttgcataaagcatctgggagagatcgagtgattagagaagcatggggcccaacgtgatataaagatggtcagatgattctgttgatgagaggagagttagcagaagaagcattaaacagtggttaaattagttgtttgattgtgaggcaaaggaggcatgccctgtctcaagttacttgcattacgaggtaagcctatatgcgtttcatcacctggggttttggtataattctcttacttcgattttctcatcatctcatcaccgccgatagctagctttaatttgacagtatatatgatcatccagctagtggtagtacgtaacatatctagcagatcgagagcatcttctgaccattatgattttggttacttgcataagtaggtcaaagaacacgctatcatgcagcaacaatgtcggaatagaatcagaacatagaatcagaacatgaatcagaaaatgggcttgcgaaatgggcccccggttagagaaatagtcaaataggccgaatatggagttattaggcccggttacagaataagcccaacatagagtaataaacttctgggccatcaacattttgtgctatatatctgggctaattttcaagtgggctatattgttgcgcaattagtctatttgggcctcactgggccctacattctcagcccacttgcgaaaagctttattgaacctcaagtcctcttttgtc

SEQ ID NO: 29288 - DNA, 802 bp, Oryza sativa
  unsure (1)..(802): unsure at all n locations
gttttagaaaaggagggtcaaacaagcccacttcaaaaagtagggtcaaattggtagttagggtttaaaacggggtcaaataagcaattgcccatatatatatatatatatatatatatatatatatatatatatatatatatatatatatatatatatatatatatatatatatatatatcttttcaggttctcaaattaattggtcatcgtttcagctgagtcaaagttcagccaaagttttgtgacatgcatgccacagaaaccgtgagccattaaaccattgacatataaagtcaaaacatatgccatgccatccgagaaaacaaattcaagcatgactaaatgaaggaacaagcgaccagctgatcaccgcaccaattaggtccagagatttgtttaaacatatattagttctttaattattactaactacagctgcatcggccaaagaggaggctggctttggcgtatctatccagtgtgtgttgggaggtctcgaggagaggaggatgaaggcaaaccttcccacacccaagaaagccaaaactgcctccaattagatctatacttttaatatttgctttctttgttatgcaagcaatgcagagtcctctctgaccacatggaccaaacgattcccacaccgtggtcaccacgcgccaattgcttattttatgcaggggaatggttcaataaactttctatatagcacagtgacgtgtttgatgggcatgcaccagctgttattatatgatctaattnnnnnnnnnnnnnnnnnnnnnnnnnnnnnnnnnnnnnn

SEQ ID NO: 29289 - DNA, 660 bp, Oryza sativa
tctgcatatccaccattaattctcacatggagtagctagcagagtggcaggcaggcagcaatgggggcactcaccagtatggctccgaccggatccatccaccatttgtaccggacggcgaggagcgcgctgacgaggccgaccgagttggtgatcacgtcgaagaaatggtcctgcgcgtaggctctcacgatctcgttcttgaacgaccggcagtagagcatcaggaagaacttcaccactgcgactgaggacatgctgccgatcatccacagctccttcctgtggtcgaacacttggtgctcctgtaaggccattgcatataatagattaagctagtgtcagctgataaatcacataaataatggattatgaatttgacgaagagtgttcgtgggtacatttgtgataagctgacgcccggattcaattagcacttggaagccaagtgtacccattacagatgcaaatactattatgccctgaaaataacaggttattcagttagctccaatagttgtcatgaagcaataagaagcaggtaatctgaaatctgaaaactctggaattttgtctagatcattttagtatctctagcataaaagcacagcttaagttcggagtaatgcaaaactgataaaagagaacagattttaatta

SEQ ID NO: 29290 - DNA, 756 bp, Oryza sativa
taatgggctaggcccaattaaatcctaataaattccattggcccacattaagtgctatgggtaataataccaccttggaaatctaagtgaagaggtctcaacttaaatacggagctagtggagagtctctgttgaccggttgagatggtgcgcaaacaaccaggcggggcgaggcgaggcgaggcagacagcagctgctgctgcactctctcgttttgtaacggacggtaataaacacggagaattgatttcgtatcaataaacacgtcggttacggaattaaacgtcatgaattgattccgtcggatacggaattaaacgccgtgaattgattccgtattaacgagcacgtcggttacgaaattaaacaccgcggttgatgactccgaacgttactctcgcgctcgcatatatatactccacagcaaccagaaggacgaacgaagttcttcacgactcttgcacttcgagttcctcctcctctgttcctgagctgcagaatccttccccggttctgttcacctgcgcgcacagatgtacgggatgagcaggtgcctccggaactccgtccgcttgagaacttgcacgggtaggtgggcgatcaagtttttgggtagcgcttcaagcgcgactgctcttgttcttcgcggctactgctactgcatcggcaccttcaccaagatgtcaacggagattggagacaagaagatgaacaacatcaacggaggcaatactgcctcaaaatccagcggtggg

SEQ ID NO: 29291 - DNA, 830 bp, Oryza sativa
tgctaggtcgatatcttggcaattagtgtgaaatagtccctgacaagcaagtcactaatttctgggccagggcagctagctgaatgtcagcacggtatataccatggagtagtataacgacaagtagtttgttcgcttgatcagatgggccgtgcaccacctaattaaacccgattgagaccagccaggactactgctatctgatttttttacttgactttattcattttttcgatgtgattgccacattcattctatatgattttctagttacccggaacctcctgtccctgaactccggatgtttcgggctgcctgccaggaagttccgggccctgtttaaatttgaccgccgcgattatttttagtgtttttcagttaagcctactcaccctccccccctctctaggttacatcttcagcttttatgtctggcagcggtgagtacggtgtcagtgagcgtggatggctcttcctcctcgccccgactccatgcgactccgggatagtggtaacgttggccatctccttgctctagcggcatagcagggcttgggtcagccttcccctttcgaccatggcacgggagcaagcaggtgctctgcagcagagcaagaggacgaagctgggttgggagggtgaggtggtgcggcggtggagataggggcaggtacgtacttttatcgctatttctctctccatttcctcctaatataataaaataataccgcaggtgtccagcaaataattaccttttttttgcggtgtcctctagcagaaacacgttcttgtggtatcctctagcaaagagagccattgagtgttgagta

SEQ ID NO: 29292 - DNA, 596 bp, Oryza sativa
acctaacctttttgtgcttctccttgatgacctggcattatctttctgaaggtagcagacgtttctgaagcagtacggcaatatgctgatgccgtaatgttatcggcagagtcagctataggtgcatatccccagaaagctctagcagtcctccgtgctgctagtgagaggatggaatcatggagccgtgaggaaaacatgcagaaacttcttccacaacatcagcttgcaatagctttgcctgataggatctcagagcaaatttgcaccagtgctgcagaaatgggtatttttctaattttcttgtttatacatcctttccagatatccactacctttttctttcgataagcaaatatatattacctttttataatatcatctgatattcgctcatggttactctccctgcagcaaacaaccttgcggtggatgccatctttgtttacacaaagtatggtcacatggcgtcgcttctttcgcgcaaccggcccaaccctcccatttttgctttcactgataatgccaactcaagaaagagcatgaacctcttatggggagtaattccacttcagctaccactgtcaaataacatg

SEQ ID NO: 29293 - DNA, 456 bp, Oryza sativa
gccatagccagaagacaagctgctgctatacatcgaagcgccggagccgccgccgaatctctcggtttcatctgccacaggaggagtctgaagctgtgaacccttcacacgaagatgaccctcgctgctccccgaaccagatagggtcttctcgacaaccggttcagcttgatcagctggtgcctcagcggcagcatttgcgacagcctgatcttgcttcttgctcatgaggaggaaggccagtgcagctggaacaatgacggcagccagagctgcgccagcagcagcaggctttgagattttgtccaggtagcttggccacatccccaattctgacttcattccatgatccgcctctgggctctcctctccgtcggcagcacgatcaccctcagaatcatcagtctgaacatcctgcttcaaggaagaagtgctagtttcaatgttctctagtgg

SEQ ID NO: 29294 - DNA, 456 bp, Oryza sativa
ttatactcattgttgccttgttggctctttgaggtcagaaagggacaattgaaaggcctcgattgaacaaacgttaggacatgatgcgcttctatataaattcaaggaacaaaaaagcaagctaattaaggttttgtgttctgcataattaatccattaagtatagtgagatctgaggtgaggagaggattaattaagacaaaatctagccaaacttgtgtgaatctccctctaatccatatgcatgatcccccccctcttgctttgcaaatactgtgagcttaattaattccatgtctctctctaattctgcttttgatgttgcaagttgcaagaagcttcacctctcctagggtttatacaagcagcggcatggacgactcgagcctcttcttgcattgggcggtgagcacgctgcagcaccagcacccggcggccgtcgcagtcgtggccgac

SEQ ID NO: 29295 - DNA, 657 bp, Oryza sativa
cacttgatttgggagaaataaaaaagaaaaaaaaaagaaaaaggggatcatctcactgccgcaaccctctctttaatcccggttggtgttactaaccaggactaaagatctatttttagtcccgggtatttgaaccgggactaaagatagcgatctttagtcccggattactacagagggttgcgaaccgtgactaaaaagcatttctccaccagtggcatcaccctttgcactcctaactgtgctcttcgtcttatcctactccgggcattccactgccactaccgcattcgctactgaggaggccaaggatgtcggatctgccgatcccagccttaccactgatggattcggctggctgtagtaagggcgcatgcggttcatagctcggatggcaacacgctcattgcagctcagaagctgacgacactcatctccaagtcgccttcccttcgtccaatcctggcttcgccccattgtcgttgccccggtgtcgcttctgtctcctccttcgctctcctgtgttctcatcgtctggagatgaggggcaagagatttggtgggtgggcaatggcaagggaaagagcggcagcctccccccccccccccttcggacagaagatgacgacgaccatgctagaggaggtggatctggtg

SEQ ID NO: 29296 - DNA, 682 bp, Oryza sativa
cttcgtctacaagaaccacctcctcctcgctgctggtggtggtggtggtggtgacggtttcctcgctgctctcggaggcgaacccgtcctcgagccgcctcacgccaccgctgctgccttgccggtacagatcgatgcgggggttgggcttgtagtgcagaaaccgaggcctcggcgacaggtagttcgtcctgggatcgtacggagccgcaccctggtccgcctccgcggaagcagcgtcgtcgaaggccgtggcgtggtggtggttcttgcacgggggattctccaccctccgctcctcctccccgccgaacgagtgcctggagccggccgccgcggtgaccggcgtggatgcggcgggtggggcagtattgggcgccccatcgaacgagagccggaggcgtcgcggggcgcccgcctcggacgccatgggcttgacgggggacgaggccacggggtagagctgctgctgctcgttgcgctccccgagcaccttcttccttggcgaggccttggacgccgcggagatggtcggcgccatgaagttcttcgcggcgccggccgcggggcgagcgggcttgggcgccgccgccgccctcgccgccgcgtcgcgctgcccgctgttctccttctccgcgcaccacgacgcccgcggcgacgcgttcctgcacaccacggagct

SEQ ID NO: 29297 - DNA, 241 bp, Oryza sativa
tcgcgcttgggctcgagaagggcgaagccacagcccgaggccacgcgttggcggagccggagccccgtgcgttgcctcgtccggtcgcatcgccgccaccgttgctcctcgccgccgacgctcgtgaagaagggagggggagaggaaccgccgccgttgtggccctcgccgccagatccggcgagcctgcacctggatccggcgagcccgccatcgatgagctcttccgcgtcgtcgtggg

SEQ ID NO: 29298 - DNA, 728 bp, Oryza sativa
cctacaatttgggttccaattaatggccacagcaagatagacacctaagataaagcatgtatgattgcgacctattgctcccagacttgcgagatatttcaccacttctagaatggaacaatgaagagaaaacctccaaatttttcattctttcaggcagcgtgttctattagcacgaataaacaagaaattgacccaattgatggccctaacaaagtcaacagctggattataccactaagattcgttctagttctggaccacataaacgagagagagagagaagtccaagccgcagaaccattacagtgtgcgtacacatctggccaagaaattcttgtgaaaacaaccaagcagcataggagccaccaaagcctgaaacgtcacattcgaacaggaaaaaaacacatccatgttcttgacaacccaaatgctaacctccatgaaacccaaatagatcccctgtaaactgtaaaaaaaaatccgctaaaaaatctgcaatttaacactgactgacgtgtacccagcgagtagaataaactgcatgctccaatccaacccagtcaagaagaactcctcacccgtcgagtcgccaacgctatggccaggtccctgcacccatggagattgattcgcgcagagacaccgtgaggccaagcagacaggagatcgagaggagcagagaaggagagtcgcgaaggctaaccggaggcggagaaggcgaggtg

SEQ ID NO: 29299 - DNA, 452 bp, Oryza sativa
gaaaaagctgttgatgctgcatttgaaaaagttgagcacagagaatgcatgaggcatctctatgctaacttcatgaagaagtttcaaggtcctgccttcactgatcacctgtatccaactgcaagaagttatactgaggatggatttaggtggtacatgcaacaaatataccaagtgaggtctgatgcaatagagtatcttgagaagcatcactcaaggatttggtacagatgtggcttttctgagtctagcaagtgtgactacctcacaaacaatgtttctgaaagtttcaataaccagatcaagaagcttaaaggtctgttgttgcatgaacttgtggatgggatcagggagatgatcattgagaagatggccctcacgagagaagttggtaaaaagcttgtggatggcattctggccaatgtaatgaaagaattgaatgatgcaactgt

SEQ ID NO: 29300 - DNA, 644 bp, Oryza sativa
  unsure (1)..(644): unsure at all n locations
nnnnnnnnnnnnnnnnnnnnnnnnnnnnnnnnntatgttctttcaactaacaaaattgtggagacttgtgaagtcacttttgatgaggctagcccaggagctagaccagaaatttcaggtgttctagatgaaagcatctttgtggatgaggattcagatgatgatgacgatgattccattcctccacctctagacagtacaccaccagtgcaagaaaccggttctccttcgactacatcaccttcaggagatgcaccaactacatcatcttcagcagctgaggagattgatggtggcacatcaggaccgacagctccccgacacatccagaaccgacatccgcctgactcgatgatcggaggcctgggtgaaagggtaactagaaatcggtcttatgatcttgtcaattcagcgtttgttgcctcttttgagcccaaaaatgtttgtcatgctttatctgatgagaattgggttaatgccatgcatgaagagttagaaaattttgaaagaaacaaagtttggtctttggtagaaccacccttgggttttaatgtgattggaacaaaatgggttttcaaaaacaaactagnnnnnnnnnnnnnnnnnnnnnnnnnnnnnnnnnnnnnnnnnnnnnnnnnnnnnnn

SEQ ID NO: 29301 - DNA, 462 bp, Oryza sativa
aaattatcagactaggttggtctgtgatgtaaaaacccaaacttgtttattttgctgcttgtagatggccatttggacttgttagatattggccatggtaatgggctccaaacctgaaatgttctgtcttttgtgtgctgcatgttggtctatgctacactcctgaacaagttatgtcagttgctacacttctgaacaagtttatgtcagttatgtgagcaagttatgtcatttatgtcagtaagtttatgtcatttatgtcagcaaatttatttcagtcaccattgcacataaacagcttctatgttaggcagcagattatttgcaccagattccaaaatatagcccttgcattgcattccccaacttgcacaaacataaatacacacaccagatttcacacacctaagggacaatacaatatttcacacaccagacatcacacaaaacattttctaaacc

SEQ ID NO: 29302 - DNA, 652 bp, Oryza sativa
acacacaatggggctcacacaacaaaaaatatttacagaaagtttactgatcagttgcgtttgctggaacggttaatttgcagagtcgtacaggtcgataaagtatcagccgcgatcggtgtcggagcggatcgtgcagaagctgacgccgaagccgcggccggcgatcgggctgagggacccgtacccggagctggagcgggtgtacgtggcgcagatctgcctcacctgggaggcgctcaactggaactacgccagcttccgccgccacgccggcgacatcgcggcgaggtgctgcccggcgcgcgtcgcgcaggagttccagcaattccaagttcttcttcaccggttcatcgagaacgagccctacgagtacggactccgcccggaggtgtacgcccggatgaagaactcatcccccaagcttctcctcgtcccagagttcagaggtaactaactaatttctctgatggaattgaccaaactttattgttttgttagctgatttagagtagctgagaattgagtagtgcgttgttaatttttgaaaatattgcagatgaggaggacgagaaggacgatctgatatcggcggtgcagttcttgtacatactggaggagtcgatcagaacgttcatggcgttcctgcgtg

SEQ ID NO: 29303 - DNA, 813 bp, Oryza sativa
cccttccaaatcatctctctgcaaaagtctattttgcctcccccttggtcgttgggccgattcttccttccttggccgatctcctccctcagcctcgcacgtgcgttgcacgcgccgagccgagccgagagagagctctctcgctctctcgttctctctctctctcgatgctttctctctctcacgcgccgacgtcgatttcccgccggcatcgctcaaacctccaccgccttcgctcgttcccgcgcgcgctcccgccgtggtggccgaccgccctcggtcaccgtccgccctggcccgcctgcgccgcgcagccgcccgtgcccactctgccgctgcccccacctctgcgccgcagcgcgcgtgtgtccaagacgcggaggcagcgcctctctctcccacgcgctctctcctccctcagctcgcccaaaatcggcaaggagccgagctcctttctccctccccctttttgctttttccccgaccggcgccaccgtcacctcctttgccacccgtgaccgcctctgtcacagcttgaccgcgaatccgccaccgcctctccttgatcgcccgtgctcggttccttcccctcgaagctccacatcccgcgcctataaaaccacagccgagcccctcccctccatctctctcgttttcgccccccaccgcgccattgcagccgaacaaccgtcgccgccctgttgccgctcgactcgatctcgtcgtcgccgtccgccgccgagcaccggaggaaccggtgcgtgcgtgggcgcgtgacgaggagctacgggcgccacctctcctctattcctc

SEQ ID NO: 29304 - DNA, 627 bp, Oryza sativa
catctaaaatcccttatattttgcgatggagggagtacatgcttgttctaaaatttaagcaaccttaaatatagagccatatacgtataagcatttggatttcaaatatattaattgaaggaatgaataacctgaaaattctttttcgcatcaatccatgctagatttgttccatcattcaaattgattcttaaatttcatcacatgttcaactttttactcacctgcctgagaagtgtgaatttctgctgccgtgaccttcactctatgtagggggtgaaaacggtacggaaatggacggaaaccatctttatcgttttcgttttcattttttttttcggaatcggaattggaaaccctggttacgaaaatggaatcgaatattatcgaaaccgaaaacggagcgaaaacgaactggcgcgaatacggtaacgaaaatttatcggaataaaaaacccctcaaactgataaatccaattgaataaattatctatgtttaaaagagtaaggttgttgataaatcctaatgcaggacaaaaaaatattcttatgtaattttagatttgcataacaaatatttttttaaaaaaaataatagccaaacacaatagtattcactatttagtg

SEQ ID NO: 29305 - DNA, 670 bp, Oryza sativa
agctttcagactgatgcatcttcccttggcaaagggcacaagatatcatcgcaggtgagaggcttcgttggtttgtttgaacgatgtctctgcataacaatattgccacattcctctcagtatcctctttggtatgcatgacaattttgtgatgaacatcatgtgttttttttcaacagatgagagatagcctgaagaaattcacaggtttagttgatgagggtggcgacacagaggccatgtcactggccttgacagagattgaaagcatccaggatgagcaagacatgtacatacagcagcttgagcgggagaaagcggctttgttgcgtaaaatacaagagcttggttctgaaatcgtcagaacatcctctggtccggcaaggatgccctactagttaacaaccaatacacaggaacaaagaatagccttcacagttgtattcattggcaaagacctgaattatttacatagaactatactctagtgcagatatgtttttgaacgaaccggcacagagtgtgccaatttcattgaatatagcatagtgcagatatgttaccatgtaagtagatacacagcaagcaaaccacaaactcaagactcagtgcagtatattttgtagtgctgaaagaccaatcagtccatgtaacttactctataatctat

SEQ ID NO: 29306 - DNA, 700 bp, Oryza sativa
ttagtattagcttttaagttactaagaacacacatatacagaagttttatgcattaattaatttttttttgcgaatcgaatgtagcttaactgattagattcttttggtgaaaccagcccacccaaattcaaatcctagattatttgacatgggttctcacatttacgtctaattattattttttaatggtacttgcgtttgtaatgttaaaaaaattatttttaagtcgctgataatcaggccaaacgatatagcactactacaagcttgttcgagcctatttatagaataaattcatcgatatgtgtatccttaaaataacagacaacttctaaaaccaccagtagtacgcgccgcgggaggatgtgcttaactaccgagattgcatgtgattcgatccgtttaagattcccgagccctcattagttgggtattttaggtcatcacaccgtgaatccaaaccttgatgaaggctccatcagcaaagaaattgctagtttaattttgttgtacgacacaagaacaagtggtcgatcgattagattattagcacacatatcagagacaatgaaccaagagtgtagtacgtacgtagtacacctcatattgacccggcgatgtttttgtggtactagtactgcatcccattaaatttgccacttgctcatatacaaattaaagattaattaacaaggaagt

SEQ ID NO: 29307 - DNA, 1336 bp, Oryza sativa
  unsure (1)..(1336): unsure at all n locations
nnnnnnnnnnnnnnnnnnnnnnnnnnnnnnnnnnnnnnnnnnnnnnnnnnnnnnnctaggattcaaatttgaattaatccgagaaattgcgaaaagctactgttcataaatgatttatttttaatccaagacatatccacagccttgtaccaactgacaagtgggaccccgggtttatttctttttcctaccgaattattttctaaagggaaataggaagagctaatgacaagtggggcccacatgtcatagactcgagaccataaaacttctataattagatttttaaccacccggacctacatgtaatagacactactaataaagattaagaagggggttactattcaccaattacgtggggcccactctaatctctcctctccttcctctctctttcttcttttatctctttctctccctcccggcttcttctccctcctctctccctcggctctctggcgacggcgaccgagcaaggggaggaggcggcggcttactgacggcggcggcggcgacggcggcgcaaggcggcgacgcacggcgcggcggcttcgaggcgacggcgcggcggcacgaaggcggcggcgcggtggagagaaagggggaaagaaaggaggggaaggagggggggtgatgtgggatggaagggcgaccggaggggatttatagggcgcgggggaggggcggccggctccatgaatactcaagcttgcatgacggcgctcggcgcgtggggcgccccgaggcgcgaggcgtgacggcgacgggcgcgcggctcgggacggctcggggctcggcgggcggtgatggcgacgggcgacgcgacggcgacgggcgacgcgacggcgacggcggagcgtcgacgggacggcgacgctgcgatgggacggcgcggcgcggcgcggggcttggcgcgcggcgatggcggcacgacggcgacgggcgacgcgatagtgacggggcgtgacgcgcggaggggtggggctcgaggcgatgcgaccggagacggcgacggcgcgcggcacgacgagacgcgagggggcgcggcagtggcgcgcgcggcaacggcgaagtgacggcgcgcggcggctcgaggcgcgaggcgcgcgcgggaggggagatgggacgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 29308 - DNA, 704 bp, Oryza sativa
  unsure (1)..(704): unsure at all n locations
nnnnnnnnnnnnnnnnnnnnnnnnnnnnnnnnnnnnnnnnnnnnntactggtactgtacttgcacaacatttgcaagaatgattaacagaaaacataagcacgtaattgcaaaaccggaataagaaaataaatgaatggcggcaagacacgtagtaaccggcattggagacgagaatcgcgactggaacggatagcgagaggctgagagcactggactgcacgcgacatgggcacgcaccttatcatctctgccataatatcttgccggattggcggaccacggcggccagccgcgtgcccggccgtgtcctccatcccttttgttcactcaacatcagctcatcaaccatcatcatcagctgcagatcctgtaagtggtgtagcgagaggatcatgaatgataggaggagtattttgattgaatgccgcacgcatgcacgcacatgcgattgtgctcgcgtgaatcgatcgagcaaattaagcggaacgacgcacacagtgaagcaagcaatcggcgcgcatgggcaactgacagcccatgcgtgaatgatgcttcactcatcgacgattgacttgctctcgctggcaatggcattcagctaagctatagagagatgttaaatttgacggatcaaaaatggacaaggatcctccaagcgcgctgcgtgttccagaaacgcggtacaaggtgacaaagctggaa

SEQ ID NO: 29309 - DNA, 348 bp, Oryza sativa
cttttcaaaaacgaagctacggtctgaccctattctgataagggcatctaacggtgttgactgaagcacaaaatgtcttttctgcccttactcatttgaccgtattacatgtggaacccacccgtcagttctcttctcctctcctctcttctctcttctctacggattgaccacagggagaggtggccaaaggcgagacggcgagccgacgccggccttggtgatgacgtcgacgacgacgagtggcgacagcgtgttcttgtcctctcctccacgtatccaccacagggagaggcgacaaaaggcgagacggcgccggccctggtgacgacgatgacgaggagtggc

SEQ ID NO: 29310 - DNA, 759 bp, Oryza sativa
  unsure (1)..(759): unsure at all n locations
nnnnnnnnnnnnnnnnnnnnnnnnnnnnnnnnnnnnnnnnnnnnnnnnnnnnnnnnnnntctggtgttcctctgctttgtgataatacaagtgcaatcaatattgcaaaaaatccagttcaacactccaggaccaagcacattgagatacggtaccactttctccgagacaatgttgagaaaggtaccattgtgctagaatttgttgaatctgaaaaacaattggcagacatttttacaaaaccacttgatcgctctcgttttgagttcttgcggagtgagttaggggtgatccacccctatggcttgatttgagggggagttgtttttcttttgcatgcatttgtaacatattgcatcatgtttactttatgcattgtattatacactcttcaattgagctttgcttgttatctcttggtcatcactatgctatgcatgtatcactcttttgctagtttgatctcttgtctagctttcatttgcttaagtagcttgtgtgatcatgttatgctgttcaagcttgttgaaacctgcttaaattgactattcatttgaacttaatcaatgtgcaatgcttgctctagaagtttgtttaaattgaagtatccctctcatactcatgccatgtttacattctttttgcaataactgtcagtacatgcttatgaatgctcatgcttatgcgtccatactttggatcaatcatgctttacaagctttatctctgtttttgtccgggctactgagtgcgtttacg

SEQ ID NO: 29311 - DNA, 1625 bp, Oryza sativa
cacgctcttcttgtgtccctccacgtcgcggtgcccgtgcagctccgcctcggcacctgcaaagtacggcctcgacgttgcaatggcggtggcgttcgcgccatcgacatggacggcgaggtccctgcctgttccctccagtccgagcacggacagcttctcgatgaggagccccttctgcaagctgtagctgcctagctccacctccgacctcaccgtcaccgccttgccgcgcaccgtcgcgtagaagcggacgtacgtcgcctgcccctccgcgagcaccatctccggccgctcgtcgtcgtcgacgtacacggcgccctcggcctccgcctcggtggcgccgaacgggaacgcgaccaccagcgtgaacggcgtcgcgcgggcctccttggagatcgtcccgccgcgctgcatcgggaggatcgtgttctggaacacgtgcacgttgatctcgttgagcggcgcgtccagcttcacggcgccctcgcccctggacaccaccaccttggtcgtgtcgaacaggttgtaccagcttcccggcgggaacatggcgctcaccgaggtggcgccctgctcgagcaccggcgacaccatgacgctcgcgccgagcaggtactgcgtgctcagcccgtagcacggcgtgaagtccgggaacgagaagaacaccggccgcgccaccggagcgccggtgagatgcgcctggtagttgatcgtgtacaggtaagggagcagcctgtaccgcatgccgagcgcgttccgagccgacttggccacggactcccacacatacagctcctgcctaggcgacgcgaagttggcatggtccctggagaacgggtagaacgcgccgagctcgatccaccggttgcagagctcctccgtcggctgcgggtagaacccgcagatgtcggcgccgaccatcggcatgccgaagatgccgaagttgagcatggtggagatggagtagcggagattctcccaggtgcccttgttgtcgccggtccagtgcgcggcgtaggcgcccgacccgacgaacgtagagcgcgtcaggatgaacggccgcttgccctggagcccctgcagcgcctggtgcgtcgcgatggcctgcgagaatccatacaggctgtgcgcattgtactccaggatgccattgtagtgcgtcgcgctggtggcgatggtgttgaagccgagccgcgccgtctggccggaggcgttgatcttgtacggcggctcgtcccacctggtgttcgtcaggttcttgcagtccaagcagcacacccatggcgtcgtcgtgttgggcagagggcacaggtgcgtcgtcgggatctcgcatttcccggtgcagaagttggatgcctcgttcatgtcgatccagaggccatccacgggcacaaggtcatgaaacctcctcacctcgtcgatccaccacgagacgccattggggttgaggaagtccgggaagtagacggggccgggccacacctgcgccaggtatggcttcccgtccagcttgatgaagacgtcgccctgcatgccgcgctggtacacgccataggtgttgttcacggcgatgccggggtcgatgaggacaatgtactttatgcccttggcatggatcttgt

SEQ ID NO: 29312 - DNA, 36098 bp, Oryza sativa
  unsure (1)..(36098): unsure at all n locations
nnnnnnnnnnnnnnnnnnnnnnnnnnnnnnnnnnnnnnnnnnnnnnnnnnnnnnnnnnnnnnnnnntgggcagagggcacaggtgcgtcgtcgggatctcgcatttcccggtgcagaagttggatgcctcgttcatgtcgatccagaggccatccacgggcacaaggtcatgaaacctcctcacctcgtcgatccaccacgagacgccattggggttgaggaagtccgggaagtagacggggccgggccacacctgcgccaggtatggcttcccgtccagcttgatgaagacgtcgccctgcatgccgcgctggtacacgccataggtgttgttcacggcgatgccggggtcgatgaggacaatgtacttcatgccctgtgcatggatcttgtcaaggaattccagcagcttgggacgcgggtagttcacgggatcaagggtgaaatccttcgcggcgtccatgtgatcgtcgtcgttccagatcacgtcgagggggatttgcgcgttccggtagccctccacgacgccctcgaccactgacaagttcttgtatccccatctgcattggtggaaccctgagaacaagcatgtgagaagaacattagagagtcgcatcgttatctgaaacgaattatttggtatttgcatatttgttttgcagtacaatttagagcaccgactctgcatttttttttgttggttaattactgtcttgatctgatcctgtgcagcgggagccatattttatcgatgtgctgacagttaaagttagtacttatgatctgcatctggcaatatgtgcatctaaacagtgtttactgtcgtgataacaagggagtactactttgttgaaagcaaaatgacaacacatggtattgcaggaaatgcctaggcaagacaactgatgtgttgctgattgtttctctcgtctctgatcattttgagtgagctgggtagatcagtagggcactagtataacttatgaaaaacattgtcagtgtcatattctacagagtaacaatgcaactccagaaactattcctagcagctggcatgacttcattctggagtagcatctattggaactactaaaccctgcaggggaatattgcatctattggaaaccagttactaattgcaatcaactactacaggtgaaaaatgccatattgcatagtaagaattgactgaagacaaatgaacccacaatcaaactgcccccctgctgtccccaaattccaaaaagcctaaattagcgtgtgccatgtgaccaacatcccatacccctgctgtctccaaatattggagatttggagtatctcatcattgaatctggatggtactactataaaattagctaatcatagtactaataaatatactccagtattgatggatggatcaaactatacagacaaaacaaaactaataaaactaccagacaaaacgtaattaaaggacaccagaactcatccaaaaatgatgaaaaaacaaagaaaatgaagttgggcagtagttaccaaatgcccagtacggcattggggctggtcgtccgatcatggacgtgtactgatccaccacggccaacggcgtcggcccggagaagaggtagaaatcgaggaggccaccgatgaccttgtacgtcagcgacgtccccctgtagaacacgtccatgccgttgctgttcagcagcagcacggcgtgcgcgacgccatggccgccacggctcctgaggtccacgtacaccgggtgcgagccgtagaggtcggtgttgaggttgatcgccgagatgtccgtggtgtagatggtgtacgggtcgttggggcgcagccggatgccgcccggctgcgtgttctcgccgaggccgtacagcgccgcgtccctgggcagcgacgtcgacgcctcgatgtactggtccttgaacaccagcgcgccgcagctggtgttgaagagcgcctcgcggctggacttccggtgcaccgcgaaccagaacgggtcgcggccgtaggtgaacacgagctcctcacccgggtactcgccggcggcgaagggcacgccggtgatcctcccgccggtgacgggcggggctggctccctctggagaaggttgtaggggacctcccacctcggcttgtctgcgtccgtgatctggactcgtatcctgtccttggtctcgtgcctgcgcagcattgcaatttcgccattagagcgctagcgttgaatatgactcagtaatctttagaacatatggaaatcatgctgtgaagcagcaggagcacgatgagtacattgtaacataatatataaaaaaaattgagcaaagcatcgaacttttgtggtccaatcttacttcttcgagcagtagttcaatcgagcttgattatgatatgcaagatcagaaatgcaagtcgttctttattactattgaagaaaagatgcaactaaactatcaattgttacagccacgaacattctcctcaaatgtaagtactatcacttactctattagataacaattgggagggagccaaatcaatggaacatgtatagaacactgtgcacagaaagatcaaggcatgtggaatcgaacaacaagtgatcactagtcgcataaaaaagattttactctgttcttacttgacatagagcctgaggagagggatgtccgggccgtaggtggaggtgcgctgcttcacctgcaggtatccaacgagagctcctccctcggggtgctcgaccagggacacaagcttgtacccggacccaaccttgggtggtgctgcggcaaacacgccattgctgctcgccaaggtcaggaagaggagacacaacgggatgcaggagatggccgcacgggacgaagaagagagagacgccagcatttctcgcatttcttctccctccttcctctgttaatttcctctcaccctctccctttgtacagagagagcagtagactgtgtcacacacacagctcacagctcatctgtgagcctggagataggagaggagaggagtgtgtgttgtgctgtgcatacgagtaaatgtgcagggagagggacgctgagcagtgtcagtactcctcctctactgcactgcatgcattgagtggcatgcatgttcattggatggggcgctttttttctctgttttataggccccatatccaatcggagtgctctgtcgctatgactgacagggggtccagctgagtgatactgtgatactagcgcatcaccaatcggggtattagatttaaataaatcaacttttattataacaatcctcgcaatatatatatatatatatatacaaagtagtattaggcaaaaaagaaaagaaaagtagatatagataatattgtttactttatatgggtatcttttattatttctcttacataatattattagatggctgaataaaatattactcgctctatcggtcccaaaatataacaaattttagcccttacggtttatcccaaaatataacaatttattcaccaacattattttctcaatcaattacaaccctccactgttcaatcttcttacctacctccccttctctaccaagcataatattctctcatttaattctacgtactttcttataactcttgtccaaccctaaaaaaatccttacattttggggcggatggagtattacctatgtactatttttgcaccacattgttaatgacataagggaataaacaactcttcctgctaacgtgtgacctcgctcagccacgttggcgaagagttgacgtggaggagagagggaaaaaagcgaatggcttgcaaaggtttctcgtgtcttatagaaggcatgatagcctcgacacatacacgtagtgagtagagacatggcctgagcatcttgttgtgtagcttcgtcgctttgccacgtgttccacaattgcgccaacgaccgaacaaattggatctaactatagtttcgaagaagagaggagtatgtaacaattggaaggcataccaggatgaccgagaggaccttaccacagtcgccatcaccattgggattgctggcaagagctcatggcttgatgtttctccaccctactcatataaactggagctcctcaccttttcccgtcgcattcgtcatttttttttcacaaattgtatggtattctcacatgattcaaaaggggattatgaagtcaggtctagggctcaaactgccgatgccttgtgccatcattgagtgggaggatggattgcactagaatgtgaagaaattttaaaaataggttactgatggggcaattggtcctctggaatgtcgttaaatgttgaacggttgatgcatatacttaattataaatggaaaagattcttttatatatgttaggagtgaaaaattgtaagaataaaaaatcaacatcagttataatgctaaatcattaattatagtagtatgttatactactattaacatactactatatatgagttatttgcatgatgattacgtagacactagacatgcaagcgggccaacccgtgaacccgcttataggtaaaattagtgagtaacccgcgggttgacttgagggttacctactaattttgacctataaataagtttatgggttaattcatttgcatctctatgacgtggcaagtcgagctatgatatgaaaacccacgaattatttagcatacactccctccgtttcacaatataagtcattctaacattttccaaatcatattgatgttaatgaatctagacatatatctatctagattcattaacatcaatataaatatggaaaatactagaatgacttacattgtgaaacggatgaagtaagtagattcgctggtcggcccacttgcatccctactatacttgtgaaccactgatcatgcttttagcagtgccaatgttgcaacggtggagtacatctgctgatctgcatgcatccacctggctcaagttaagccaagcacaagattgattaaacaaatggatcgaaagctgtgtttctttagctgtaaagataaaaaagaatggtgtcaggcacgctactcaacgatagattggagaatcaccgaaaaacagaataggccccagatcgcaacaaatgtctatgtgggcatgttcgtcctcgaggtgctacaaccctagtacaaccttgggcacagcaacacgtcagctttcacaactcactactactagtactggtactgtacttgcacaacatttgcaagaatgattaacagaaaacataagcacgtaattgcaaaaccggaataagaaaataaatgaatggcggcaagacacgtagtaaccggcattggagacgagaatcgcgactggaacggatagcgagaggctgagagcactggactgcacgcgacatgggcacgcaccttatcatctctgccataatatcttgccggattggcggaccacggcggccagccgcgtgcccggccgtgtcctccatcccttttgttcactcaacatcagctcatcaaccatcatcatcagctgcagatcctgtaagtggtgtagcgagaggatcatgaatgataggaggagtattttgattgaatgccgcacgcatgcacgcacatgcgattgtgctcgcgtgaatcgatcgagcaaattaagcggaacgacgcacacagtgaagcaagcaatcggcgcgcatgggcaactgacagcccatgcgtgaatgatgcttcactcatcgacgattgacttgctctcgctggcaatggcattcagctaagctatagagagatgttaaatttgacggatcaaaaatggacaaggatcctccaagcgcgctgcgtgtccgagaaacgcggtacaaggtgacaaagctggaaccaccgctggctcgtcgcatgcgcccacatcacccggcacgcacggccaagttaatttggacccccccatcttcaccaaacacacatcacccctttaatcttcacatgaaccatggacaaaattccaagttataaaggggttgcaaggtttgaacaagcacacgtacgcaagaggttgctgctacggtagcgatctagcgttgagaatacgttgaaaagatcccgttccggaagaggcgcttattacgtttgtaagttggtgatcacgcggaaggatgtgtgggacaagtggtggcgtggcaagagcgatcgcttgcctgtgcgggtatggaccagataattaggcggatggcccctactggctactagttgtagtacagtttttctctttgtccattgcggcgtctgcctgccacgaccgggccggacacgacgcactgctgcctcccaaatcccaaaggccaaagctcacatgtggcgtgcgagaccaccgctcacgagacggcttggggttggacgcacgctgcacgtggccgtgctgctgcccactgtaccgctctctcctcactgtgccatctatgggggcatatatgcgagatttcagaggcgaccacctgtgtgtgtaccccggcaattggcccagccaattcggcctagcaacatgtaaaaggagagcagggggcagcccatctgtagcgggccgcgacgacgaaatctgggctggcgcctcgcaggcccagacggttggattctcccactatggatgaaaacggtccaaaaacgatatcatttctatggaaaactgtctcggcatggttgaggatttttcatatttatcaatttaaatatctagttgttccatacgatgcatatatagacttttttaaaaaattatacatagtgaattacaaacagttggaaacagtcacacttctacgaaaatggtctggaattgctttaccaaattcaagtgtccctctagccaaaagataacatatcaaatttgatatgtttcaaatcagaattttaattttaacgtcgatgtatataaatatctacatttgatgcatagggatcatattataagatttatcttgaaaatactacctttataaacttatagactatatcaggtgtcaaatattttgcattcgaagttaggctgtgtttagttcacgctgaaatttgaaaatttaattgaaattggtacgatgttatagaaaagttgtatgtgtataaaatgtttgatgtgatggaaaattggaagtttggaaaaaaacttcggaactaaacagagccatagtggtaaagttatggaaactatttgagagacgatataatgtacaaaggtcatttattattttttaaaacgaataggtcaattattttttgttagaggaagtaataatctacatccatgtggacctacaaaatctaccctttattctccataattgtaccttaaagctaaaaaacgcactcattcggttctagtacgaagctggtccaattaatcagaaaatgaatgagttattttttctgaagtcaaaatgtcactcgaggccaaggtggaaagaggacatgacaactaatggaagccatggttttccccctcttttcggtagttttcacttcagcctttagatgattttcttttgactagctaaatgctcattctttgcaacataattaaaaaataaatcacattattaccttttcaaatgttaatagaaaaattcatattttcgttggaattctatgtgaattgttgatgctgatccaaatggctcactgtttaatataaagtggtagatgacggattcacttatttgaatttcaagcacaaccgtgattacactgacaacatgtatccgcataagttagcaccattgagattttttaaaggagtatccgtaaaaaaaggtataatcttaactataaatctggacattctacttgtccagatatatagttaggattggattttttagatgaagcatttagtaaattacatcaccaccatcaaacacagaaccaatattttttttaatatgtaatacaaaacaaagggtagttaaatatttccatgactatctttatatataaaaaacacctgaaagcctaaaatagccaaaaatgtaagcgaccctttgcaaccgatttcaaaggcataacaatattgtatgcaatatatttttagaagcacagtacaaacgcggacactcataacgtgttcacactcctataaatgtagcacacgcatcctacccctatgaacacttctggaaaaattgagtgccgtattttgagattaacaaagtcaccacaaatatttacatcgtctatcaatgaaataaattaattagtcgtaaatacgagcacccatgttaagtatagtactctccatgtagtattgtagtagcattgtatagcaatattagagcaaactaaaaacataaacataatatgtatggtgttagatagttttgtatcaataaaatcaattttctcagtctatgcagtcctagatctaattacttttttttttggtatttctagcattttcgagagggagaatattaaaagcaaagaaaacacctcaccggaaaaaaaactagcaacttgccacgtaaagatagaagtaaaatctattcagagaggcctctcgtttttgtcttaaccagcgacacctaaattttgagaaaacgtggagtactcgtactatatgcatgcattttcttaatagacatgcatgtatttttcctcttcaaacaaaattttctctcaaagtacttatctgatctacaatccgattacaccattgtattcgttacaattaaatcttcgtaacaagatcttacatgattatattatgatgaaaaaatatttatattcataaattacttttattatatatctaacttacttttatcatatatatataagttacttttagatttaactaaattacttcttagacatactacctctgtttttcaatagatgacgtcgttaactttttctcacatgtttgaccattcatcttattcaaaaattttatgcaaatgtataagatataaatcacacttaaagtactatgagtgataaaacaactcataacaaaataaattataattatgtaaattttttaaataagacgaatggtcaaacatgtgagaaaaagtcaacgacatcatctattaaaaacggagggagtataaaagtaaattcaataaagtctaaaagtaatgtacatatattataaaagtaacttaaaacaaaacggaagtaagtttgtcatgacactataagtaaattcgttgtagggataaaaatatgacttcacgtccaataaaaagaggcattcattaaagttactatctttttattataagttacttctataatatatgtaaattacttttagactttattgaatttacttttatatgtctaagaagtaatttagtgaaatctaaaagtaatttataatttttcatcaaaatataatcatgtaagatcttgttataaagatttaattgttacgaacacaacggtgcaatcggattatagatcggatgagtagtttaagagaaaattgcatttaaagtatataagtggatagtatcttctcttagatggagtgatagctggtttagacaaaacagctactactactgtgtagtcacgtttaaagatagaggttgaatggtctctttgttaacttttagatgataaattacatcatgatcgttttcatcggattaggtctcaccataagagacatctcttgcccttacgtctagaaaagaatcatttccttgcttgatttccccgtttatggacgtggtgctccggcaattgtgcaccgcaaatgccgttcatcgttgtgcacgatagcgacgaaacaaattaatatccgtgcaattatgtgttgatacaatcatggtgggcagacgaagaaaaactcgttgtgatggctactagcacgtacgatagcttcactccatcgatttcagccaacgggaaagttgatcgatagcagaaaaaaaaattaagtcacaaaattgttactatatactagtatgagattatacagtttcatcctataacttttgtttcgctcgggttctaaacttaaggcctcactgcagctgaaaacatcgtaaaagtcgaagaagtgcgatgagatgcagcagatccattcatcggttcatcagtcatcatcatgtcacgaactctcgacgaaggccactgcgatagagctccacgccggcgttgtcctccctctttgtttttctcttagaaaaatgtttgacggttgacgccggcaaacttttctccattgatgcgtacatgctgattttgtaactgctgctatattccgaaatataattattttagttaaacacatgtattaaaaagtaaatgaagtaaaaataattgtagaaaaattgtaaataagaaaagaaattagataagtaatgattgtgatttgttgagataagtgggtaagttaataaatacttcctccgtcccaaactaagtacagctttgcactatttatctccaacgtttgattgtttgttttatttaaaacttttttataattaatatttttattatcattagatataaaatataaatagtaggttatgtgcgacttttttttaaatttttcaaataagattgacggtcaaacgttagatatattaatagttgcctttatttttgggatagaggtagtacctttattttacaaaggagtgaatagccaattagaaagcggttagctttagcacaacagcagcacgtcgtgttgggttgcagaacagtacacttttggctaagctggagcattattagccccaaaatataccattacagaagcatacagcgaaattaacgaattgaccgatccgtccggtcgcttgcttggtgtctgtagatatacagttttatttaaggagaccttgacctggccggccatggctctcatccctagtcaaggtcacctcgagcaagttcaataggagccaactactagctccaattcatctatagctaatctaatagctcattcatacaatagttatatactacactattaatatctggtcccatctgtcatgcatacattgtgtcttggattctgtgctacagctggctataaatctgtagcccgctgcccttctctctcctcatttatctctttaaaatatgtttgcagctagcttatagcctgctattatacctgctctcacgagccagcatttgctgcgacccagtggacctgggaacaaggaaatgtcagtgatgtcataccaaagcaattggcttgacgtcacatctctgaatgtaagcaggtgaggtcagtacgtatggcctccattcctgattcttcagagaaaggtcgtcgctattgcggatattttctttgccggagagaaggcaaagccaaaccattctgctccaccaatgccctgggaaataaacgctcgggttgttaattttagtttcattccattatttgtacatgattaatttgatattagctattataagtttaaaaaatggttttaaaaagcacatcgtttagccgtgaaaacgtgaagtagctcatccaaagaacgaaaccaaatggagcgttggtcaaagaaaagagtcaagtgtctttacttatatattttttgtcattaaataatgtgttagttgaaaggcatacacccaagtgcccaacaccgtgaaaatcacacgccaaaacgagggtgcaatgtacacccaatctaacaaacgagcatttgatacgattatagttattgtgattgacaccaagcaagccggagtacttttttttttcttgagtttctccttgaggtaatgatcctcaactactaggaagatttctctgaaatcagataaaagatctctgatgcattagctcctttccttcattttttctattgtttcaagctcggctcttttggttcaacagaacaacttttctttgccggcccaaagatagttggccaaatgcccattttttttgttcatagagaaagcacggcagtagaggagtaacaaccaccaagtttggcaaatcgagaggctattattatctgtttattggcttagaagacaaatgcaaaattttactacttaattgtgtggttgtatttttaatttttctttcattagctaaatgcccgtgcttgcaatggattattgaaaataacaaaattaagtccttgcaaaaaaatatttttagttattgaaacaagatctttcatcttgctatgcttagaaaattaaagagatgcaacctacatgatacaaatagcaaacagaatattaatggcccacatctccgttgtggttgtgggtggcagactcaccatcacagttttataatagtaatatagattgtggtatatatttttcaatatctacttttagtccattattaatatatcaacataaaagttttatttataaattatagtatttgttactttgttcattttcctgcggtttatcaatcgaagctaatgcacatgcaatctctgctcttcatccctctttcccccgccgtgtcaatcaccattcacgattgctccttgccactcatgttgttgcttacagacacaaccgggtcgcattaggaaaacgctccgtgaagatcagtttcaccgcctctttgtcttggaatctaggcacataatatcgacgtggatggtacagttgcgctgttttgtcgcggtgaaaaggaaattcgtagtgggctggtggtcgacaaattaattggttcagcattggttggtttgagggtatgtgtgacctaagaataaaggattgggaccccagtcttgaagcatcttacagtaattatgaaagcaatttgcttaagctgcatcattcatatacagtgactccatcgtctctgcatctcatactgtaacaaacagtgctagaaattcattgctttaccaatagacaatttcatgcttgcaagttactactagtagttgcgaatctatcactagaatttaattatctactagttaccttttatccagttgatgatatgatttccaaagctcatagattcgcactttagcaagcccaagtgcaccaccagctttactgttttttctctctctcacgagttgtccacaaaagctgcacgcttgagtacaatcgtatcagtggattcgaagaagaaatatgaagggaacaaccatattgattaagctaagaagactatcatggagtctcgttttctaaagatgttcagttccaaaccagcttgtagaatagtactaaccactcgctatgcgatttgtcaatttctttgtgcttgtggacagggcatagctaagacttttcaaacctcttcttctagcttttctctcccctgatgacgcctagcaactgaactgttatacgtcagctttgtgacgacacgaaactgtttaggtgctggagtactcgtttttaatttatacgtattgagcacatactgactttacgtgacagtatattaatactagtactgaccaagacttcaaagttcaaagtcccctctttctccaaaaaaagaaaaagacctcatagtccaaatctcttaagtccttctatagattatactagtagtaataaacaaactcagtgacaccagctatcttttattatttttctttactgttacacccttctcagtacattctcacttgtagtatattgctatatcattctcatgaaaaataaacattttttaacttgtaatagtaactctagcacaatgaggttaatgtcctgctggttgcactccagatcatacattcacatactactattccagagtgatggccagagtagaagggtagctaatgatcgatcaatattttgggggtactgcaccctattcaattcgattcgattggggctcatcaatttctgatcaaatctgcagaatggtccctaacgctgagatatgttcatctagctagcagtacatggagccatggaggtaaacacaaataactccttcggttctaaaataagttactccctcatttcttattgtaagttgtttaacatttttatctgtcaaatttatttaaatttgataaagtttatagcaaaataaagtaacactttcaatacaaaacaaacatgataatgacactaattctataccgtagatatatattgctaactttttctataaatttggttaaacataaaaaaatttgactaagaaaaaaattcaaacgacttataatatgaaacatacgaagtagtttttatacatgtatatgaaggtagtgggacatagggagtatcaaagttcatcgtacagtacggattgacattcactccggttatccaattatacggagtaatacgttctacgcataggagtatcagatacgatcgagtatggtcctgctcgtgcttaagataccacatgacaaaggatatgagcatagatatcacacccaccatgcatatcatgcttgctaattaacttgattgaagagaagtgttattcgacttgtcctccgcatgtttgtagacctaacttaattgatctgttttctatagagttaattagccccgctaaaatggtgtcgattggattttcacacgagaaagtaaatgttataattagaaaaatactccaaagtttaacacttgtggtaaactgaggcgtgaaattccaattgttttgggtataagaggtcggcagaataattgttgtgacgataaaccaataaaagttttcttaaacctcacttttttacacattgattcattttgagtggggatttggaacatcaacaaaatcttcctattagattttggatgaacgaaaggaaattgccatctcgtatgaattgttgactttgcaaggggcctgtctttcgaaaaatattaatatacacgagaaattcacttctggtgtttatccataaatgtcgtttttaccatatttttgaagataaccacactttagtgatgagttggtgtattacaatggcccatataattatggatggaccggaaatgtggatcaacgtaaaacaatttatcgaactgtttttttaattaaccaaccgcttgggtttttgttttctgttttttctcaaagaaggttgcgcatttcacataacataaacaattcttttatagtgtaataaaaaaagaaagccgtataatatggcgtatcaaataatcttgttttatttatttagcatatgttccgatatcaaaatgtactgtaaggtgtagtaaataacatgccctaataataataaggtaaatagtcaatggtgtgccttatttaaaaattttatgcaaatatataagatataaatcaagcttaaaatatattttaagtgataaatcaactcacaacaaaaataaattataattacgcaaatttcttaattaagatgaatagtcaaacgtgtgataaaaagtcacaacattgtttattaaaaatatggagtagtaaaccaccacaaaattttctctccttttcttaggaaacactcctcatttctattctactatactacaaacacggtcacacgcacccaccccccaccaaacgtctatgctgtgacgaacaccaccaccatggacgccaccaccaccgccaagcgcaagcgcccagccgcctccgacatcgccgacgacgcccccaccaccgtcgacgaggtctccgacgccgaggtcgaggagttctacgccatcctccgccgcatgcgcgacgccacccgacggttcggngcccgccctcccccgccgcgcgcgccggcgtggcgccccagcttctcctgggaggacttcgccgacgcgccgcccaagcaggcgccgccgccgccgcagcagcccgccgaccacgagcgcgtcgccgagaacgccaccccgccccggcgcccggcgcccggcctcgacatgaacgtcgagccgccgtccgacgcgccggccacgccgcgctcggcgcgcgccccggcataggcgcgcgccacgaggaaacgcggcgcgtcgcgcatgcgggtgctcactgattacaactactttgctagctagaagcagctagctgcagtgttggattgatccatccatggcgctgccttgtcctccttgtgtgtgaacaggtgagacctggttaatcaatcgctcttgctgggaagaaacaatccattattggtcccatcatggagatgtactatcatgtaccaagacaaaatgacgggtttaattaattaccccctatattattcgttctgtaattcagtatatgtcattgttcattagctagtgtccacttgttatccttgacgggactgggttttattttctattgttatttcttcccttttctttggaatgagcacttgggcatgatcttgtcttaaagctttaaacttagttacaacatttctttgtttacttgtacatgcgtcgattaaatcaatatattctgttactgttgaacggtaaaaaaaaaagaattttgtaaggtattcgtaaagtatgtctgaactctgaatagaaaagcactccgttttagtgaatacaagagcacactgttttttttctttttattcagaaaatatattccttttttcagcaggggaaaagaggcaaagaaattaaagcatactaaagagtgatatgaatgtgcaccatcttttattcccagccgtcggcagccagcatctagctatacgcctatatatatattttccgcgaggagcacctagctatatatttttgcctacagcaaagatgtagtattattcttcaattttaaaaaatgggagagcttttgaagctaccattagggctttgggagaccctaaccatcacctgcaacgacgaagacaacgagcttgggggagcactactccaaacagatcaaaaggtagaaatttgaatcaattttgtaaaaagaagagatagttaagccgaatactttttcgttgttttctcttggaaggaaactctttcctcgtctattcttcgttctgtgatttgacaatatcttgtgttcctttctatattctgaaatgaaattcaggtggagaaactccctcctccccccttgacctttctttaaaaaaactcctttccatttattttttctttgaaattaaggggactcctttcaaattctaaataaattgtcttaactatcttacctttctaacttgctatgactaagctacttttccaacctccttccctcttatgacgactttacaagctgatgctatcgttctcgtgaaaaatgtacatcatttccattgtgtaacattcacaagggagaaaaaggataatcgacatgcataagaatacaacaaattcgattgaggcattggcatactcgaagaaaatgacatgacgcctttatatgagctcggctcttcgttggcttacaagcggtagctagaaaagggctcaaaattaatgtgaccaattcttccaagaagctcaaagataaataaacgtttcatgtctgatatggtgacatgtttaactttggcatgtaaaaccaagcgttttcttttcttgttgtctacatatactacctctattattttttttttcacttgatgcattgatattttctgtctttaagatgtgaattttgtttgtgttagaggtgtatgagacaaacattactgtgagcagtgttagaggtgtttatattttgatataaattttaaatacgaaaaacatttttattttaaaacggagggagcagcgctagtgtatcacatgcagctaaataacgtatcactatcgttctagtcttctagatgaccatattatgaattcgaaagaggttgtactgtgccacagtcggtagctcattgtagccagtcaagtcaactaattagccatgcaaatccttattaccatggtgcaagtgggcggaagttgtataattattctggtgcagaaaaagaatttgagccgtcgccactcggacgaaaaacaagtgcaagttccacttcagaaaacatgacaacaggtatagctcgccacaataaaaacaaaatttacgtgagcttctactccctttgtttctggaaaaaaaatagttttagactaatcatttgttttttaaaaaattatagtttaaaggtgtttaaaatagactaagaatccctttgttcgtgtttttaagctatggaaccgatagtactccctctctctctctctccttgttttagttggcttttaatctctttatttaacatgtatttcaactagtaaaaatatatctttttttaaagaatagatggagtttttttaattttttggcttgaccgtgggtggtggtcaatgacagaggatcctggtgctatgcacgcagagcggtaaagacaaaagaagtctctgtggcacaaactgcgatgatatatgcacatggctcggcgttattgcgccgaaatgaaataggagtactagagcggtgtggacggtgcagacgtacgtgcagctagcaggcgtcgacaccaaacccctcgccgtcgacggacggcgcgacacaaatgcacatgccgcatttgacgatgagagttatctgattctatctttattgtttctgaaaacagaaacatatacgcactccaaacacgtgaaaaaaaattgcgtggttcgttcggttcaaactctaaaccaatcttttcttgtggatagcggaactgcggaaagcttctgccgacatgcacactgccaaactccaaaaccaaactgatgcttgctcacggatttgcgtgtgagaaactagtttacgagggatttgacgtcgtgtgtgaagcatattgggaatgggatatcttatgggccctagcccttttggcccaatactttacagcgtgtgatcgcgcaaattaggcccaatattcaatcagagatgggccatgcgatgcgacagatgaaggaatatgtccattttaagtcccttaacttgacagcgagttcgattgtcttccctaaaccgatacaacgggtcccttaactgtcaaaatcagtgcaaacaagttctctcgatggtttagatggtgtttttggctgacgtggcgttcaagtgacggtgatatgacactagaagcaaaatataaaaattaaaaattaaaataaaaggtggggttcacatgtcagtaagacaaaagataaaaaaaaagagtagcatccacatgccagtgggtcccaccctcctctctgtctccatgcacgagcgcacgcaaagagggagaaggtcgaggggcggtggccatagggtgtcgtgatgtacctcatcgcgatgcggggtagttgttgtcgccgctgacagtgatccaaaacctgagccccctttccacacatgcgttgcacggccggccagtggagatgacgactggggagattgaggtctctatcgccgccctcgccacaaagaaggcactacaagaggccttcgacgtcctcactgctgcctgctcgcccttcacctggggcgacctcaactcctacatatcctcgctccagtcatcgattgactaacagcttggccggctttgggtcctcgagacgcccctcccagcgattgcaggtcccattgtggacgtcacaagcaatgacgagaagggctggccgcccctccccacccttctccctctccgcgctcgctgggtggctgacaagggagctccaggaggaaagaaggatagccaggagggagagaggagaaggaggtgccgacgcgccatggagattgagtgggggtgggacccactgacatgtgggtcccactatttgttatgttttatttgattgacatgtgggtcccactgtttgttatgttttatctgattgacatgtaggtcccacattttttaaattttaaatttttatattttgcttccagtgccacattactgtcacgtaggacgaagactaagtcaaagcaacaaagtaggcgtcatgtcagccaaaaccgtcatccaaatcaccgagggacttcgtctgcaccggttttgacaatttagggacccgttgtatctggtattgcggttgggggatgaaaatcgaacttgctatcacgcgaagggacttcagatgaacccatccttggcgacacaacaaactattgggccagagagagagagtctttcttgcatctacttagttgggtcagaattcgatcgtggttcgcaatcgcaccggcaaagcctacaagatttgagctacctgtcacatcctagctaagatagaatacctgatttgttgaggcgagatcgccatcaggaccagttgatctttgcaaatttcgtcaatatcccttgtttcaaatatctgggggtagttgttttatatacatctcttgttgaaaggctacaacgaggtgcggtggtcacaagagttggatcacccaattaaggtcgtcgtcgcaccttaattggcagctaatacaagagatgagcacatgttgtagagtattccactattcctgtacctatcaatgcgcagtgagtgacggcacctataagacgtgtgtaaagcgatagcgagcgagagaaatccaaggcgtaaaaaccgcctcgaaaccgtaccgcgcgccgctgcacaggagtgcgcgccgtgtctcatctgcatcgtcatgtcccacttaatttgattaacaaactataagtatttgtctatgaatggctggtgtgtgtatgtttgcaatagggagcagctgaaaaggagcgaagcgtgacgctgatgagaagaaacgcattgataaataagacgctcgatcgatcggtgacgcgaggtcggcaacaaaaaaaacccatcgcgtcactcttaaccgtgccacttcttgctgcctccatccggttcattaatttcgtagttttctgataagaagaaagccaataattacgggccgcaagtcagccaaatcagttactcctccttgcatgtctcgtgaaccagttaggcggttaacttgtatatcaaacagacgccgcgcgcgcgagcagttcgtcgtcgtcttcgctcgatcgtagtagttgccggccggcatcggcatgggcgacggcggggagaagcaggcggcggcggcggaggggtggcggctgagcgtcaacgacttccagttgccggagcggcccaaggacccgcacttcgtcaagagggtcatcaagcgatgccacggtacgttgctgttcatgccaccgatcgatctcttcttcaattcctcgatcgctaatagcttaatctgcctcctcaatttctcattttgcgacgtttgatctatacatggatcgatcggttaccaaccattggttggaactcgatcaacatccatggattaatccaagtccggcctgggactctgtttcgatcgaactcgatcctgggttccttacaatgaaatcaaatttggggggtgtcctgtttgtttacagtgatgtcaccaatcaaaactgcccagtagtttgacgcatgcatgcgtgttatatttaactccaagataaagtgccgtgagggtaaacaactaaagatcgattaggtagcttcatcaaattgcgctactgttagtggaatcatacgtacgtgtacagtactcttgctctgaccgagtcatcacttcaccaatctagcatcaagaatggcccttctgaagtagttgttcaggacaattaatggtaataaacacttcagtagattcgtgtcattacaaataatagctgttcaccaatcttaagcatggagaagagttgccattattcgtatatattgccgctcgttagacccaaaggctgtgcactcactgcttcccaagtgatctaaggcctagtttagtttcaaactttttcttcaaacttttaacttttccatcacattaaaacttttctacacacataaactttcaacttttccatcacatcattccaatttcaaccaaacttccaattttaacgtgccctaactaacttaaacttattaggagtagcactatgcgttcctttcttgttttgtcagagaacatctgaactactactgtagtactttttttagagggaaagaccattatattgaaataatgatctggcctttttattaagaaaacccacacaatagtctgaactagtacttgacacttaatcatgatctagctgatcaacgatgccgctaatctgccatgtcttgcggaaatcgatatatcttcgcgatgatctcaaggacgagatgtgtcacattgcgcacacaaaagaacacacacaatgcacggcggctaaatcgatataagaagctgacgaagccccttacacgtgtgaagcatgcagagttgcataaacttgcattcatgcatgctcctcacaaactaggcagcattggtggactgctagcttggtcctgatctccccgtttggtatgacaaaagcaattgttatattttctagcattggagtagctagcaagtaggtagcggctggtttgtctgcgcacaagttataaagaaggccctgttcagttcatactaaacttttcttaaatttcaaactttctattgtatcatattacatttaaaactttcatactcacataaaattctaactttttttttcaaactaccaacttttcctaaacttctcctcaaattcaggaactaaacacagctgaagtaatgcaatttttttgtctctaacagttgatatggcccgtctagattcaaactttgaacccaaaaatgtcacatcaaacttttctatacatataaacttctaacatttccgtcacttcgtttcaatttcaatggggtgtgtttagttccacgttaaaattgaaagtttgaagacggaaaagttggaagtttatgtataggaaagttcgatgtgatgaaaaagttctaagtttaaagaaaaaagttgaaatctagacatggcctaactactaaaagatacagtataagataatattcaaaattgtggtatcttttggtgtctctttcggaaaaaaacgtaaaaaccacttggttaataagaaaaactagggatcgaatgttcggtccaagtttaattattagacagctaagccttttcttctacggagtaatttgttatggatctctccataacaccgtccccatttggcttaggtggtgattttacatttctagccattttcaggagttggtacatcagggcatgtacatcaattcttattttctaacataatgggcctaaatgggcccgctttatctggcctagttataggatatgtgtcttttctgatgggccttgtccgatgattatctggcctactcctaagctcgaataatcatcccaattactcttcaaaagatctttaaaaaatactccctccgttttgaaattttgacaccgttgactttttagcatatgtttgaccgttcgtcttattaaaacttttataagatatgtaaaattatatgcatacataaaaatatatttaacaatgaatcaaatgataggaaaataattaataattacttaaattttttgaataagacgaacggtcaaacatgtaataaaaagtcaacggtagtagagaacaaacgcaaaattatgtaaagtacattagctcaacttggtactagagaaaattcttgtcccgtccttgcgcccacactatcgagttaataaatctctttataaactttgggcctataaactttaggcgtataaactttagatatatagaaatctatatatatatatataaatatttgaatttaaattcaaatttgaattggatatataaacttttgacttataaacttcgtgtctctaaattttagatgtataaatttgaggtgtacaaactttagttgcataaatttactaaaataaaagtaatgcggtgtaaaaaaaaaagaaaaacacgtggagaagaggggtgatcgctaggggtgatgtttcggagtttggtggcatcatcatcatcctgcagatatcggagaaatcgtgtgtgacttgtgatgatgatctgggagtcccaagtgtcgtctctgttcccaaagcctttgtatgctttatccaaagaagtggcagcgtggatgtacgcgtggccgatttcctggaaaccccggagaatctcatgttgcctagtcgcctaacccgcctaaatgacgcctaatccggcacaattaccccaaggttccgtgacggcacatacatgcaccggcgcgcgcacgtcacgacaacggacggcgacgtgatcgcgtgcgggggcggagcgaaacccgtgcagcctatagcctttggattctgctcgcgtcgcgactattgaaaccgatcaactttcggtgatcagtagatagatgtggagagatcgatccttggcgatcgctaccacgcgtgcccccagacgtatcagtcggcctcacgcccgcgcgcgccatggatatattctctccagctcggcccagttggacatttcgatcggatgagtacgatcgagttgcgtgctcctgatcatatcgctgcctctgcaccggcctagccaccagcagcaagcaggccatggggagccgaggacgacgcggcggcggggagagagagacggagacggaggaggatgagacgtggaagctgcgggtgggcgacgacttcaccgtcccggagcgcttccaccgcaagccccccttcttctccaggatcttccccgccggctcccatggtcacctactcacgcctcccatcctcaatcctctctcccctttcctgtttaatactagatggttttttttctcttgattgatttccctttgagatcaattctcttagattttctgcatatatactcactcgtactacagtaatactaccagtttagtaatcttcagggagaaaggaaacaaaagatggaaaaagcagctactgctctgatcatgcttcttcttttccagctttactttactcgtgcagcttttttacctcttcccttttttgttcaattcgtgatcgattatattagaatctcggtgtcttgtgatggcttgacccgcactaaacaacacgattgtctttactcatagtattgcagtatactagttgctcggtagactcagctggactcaattctgtcgttccactagtgtctagtctttggttgtagactgacgttaacagcacaagcattattttgatgcgaaggggccgtcatttcagtactgtccatacttctgcatattaagaatatcaacgaagaataaccattttgtctcttgagtcttggcaactaatacgtgaggtgctgctaattctcaagcatcgatgctcatatgaagaatcaaggtgctgacgatttagacacctgaaggaaatttcagtaaattgtgttttaggacatcttttattaaactaggagtggtccaacgtaaaacaacgctaaaattatctagtccaaagtaaaaaagattgattaaagggtgatctaaaatagatcgattaaaagatggcacagactgcaatttactgtattgcaattacatatagacatacttatcaaccttatattggcacatagcattagagatggcccaatggggggtccaaaagagtgatagattttgaggcccagcccgaaaatataatgggccagacagatttttatttgaggaccagcccaaaaaaggaaggaaggctcatacagtcttgttcagtcttttatcttcacctatgaataatgttcttactcaactatgtttgctaattacgtccactgcattaggtccattagtagcaaggaactgaaggaagacacttcccatgctgctaggactctttccaatctggactatatatatttttccttgtgtgaaactgtgaattagcatatgcatttatcctagtggaataccatgtttcaatcgaacagtactttaacttgattgatcaagctgttaaatgcatgtggaacatgctatggactgaaaaatgataagttccattaagcttaattaactatttggtttaacactctcttctttctttgattatttcgtttattagtacttctgagtactgaaaaagtcggtgccccataacaggaaagcatcggaaaattgcaaaatactacaagaagcaggaaaatctcctgaaggatttcagcgagatggaaaccatgaatgagattggttccttagatcagaatgctcctactgaggtaaaatcttgttaagagaacacatttcctcaatgcaatatgcaattgccagatttgtaactataaattggatgctgtatatttctttttttttttgtcttctatacacatagtgatatgaagtatatcttcatgttgttttgttaggaagagttgaggcaaatggcaaagggcgaacgattggccatcaacctgtcgaatatcatcaatctgattcttttcattgggaaagttcttgcatcagttgaaagtttatcgatggcagtaatagcatcgacactggactccctactggatcttttgtcaggtttcatactctggtttactgcacatgctatgaaaaagcccaacaagtatagctatccaattgggaagagacgaatgcagccagtggtaatgactcggttaattaaaatctgttctcttttatcagttttgcattactccgaacttaagctgtgcttttatgctagagatactaaaatgatctagacaaaattccagagttttcagatttcagattacctgcttcttattgcttcatgacaactattggagctaactgaataacctgttattttcagggcataatagtatttgcatctgtaatgggtacacttggcttccaagtgctaattgaatccgggcgtcagcttatcacaaatgtacccacgaacactcttcgtcaaattcataatccattatttatgtgatttatcagctgacactagcttaatctattatatgcaatggccttacaggagcaccaagtgttcgaccacaggaaggagctgtggatgatcggcagcatgtcctcagtcgcagtggtgaagttcttcctgatgctctactgccggtcgttcaagaacgagatcgtgagagcctacgcgcaggaccatttcttcgacgtgatcaccaactcggtcggcctcgtcagcgcgctcctcgccgtccggtacaaatggtggatggatccggtcggagccatactggtgagtgcccccattgctgcctgcctgccactctgctagctactccatgtgagaattaatggtggatatgcagatcgcggtgtacacgatcacgacgtgggctcggacggtggtggagaacgtggggacgctgatcggcaggtcggcgccggcggagtacctgacgaagctgacgtacctgatatggaaccaccacgaggagatccggcacatcgacacggtgagggcctacaccttcgggactcactacttcgtggaggtggacatcgtcctccccggcgacatgccgctcagccacgcgcacgacatcggggagtcgctccaggagaagctggagcaactccccgaagtcgagcgcgcctttgtgcacgtcgacttcgagttcacccatcgccccgagcacaaggccgaggtctgaattctcatttatgcaaattttctcttcacttcacttcacttctgtttctgtttggcttgtacaagtcatcgtttccctgtgaaacccacaaggatgtcagttttactaccactgtctctgtagtctttaagtagctgtgggtgaaactgaattcttgttgttcttgttttattgagaagagaaaactgatcgaattcttctagtggattatatacgctgtcttttgctggaaaatggccaaaatggctgggcatgtgtacatgttgtacccatctgaattgtcatatctgtgatcagaagtactactatatatatatttccatttccggtggtcatgtcactggggcagtagtgatgaaccggactagtttgtcattagccccaggcatgtccattcaagttagcttgggccctatccaactagggcagaaaaactcacaaaaatacaaagggcaaaccatgcatgaggacagtgcctgtgacttgttgttcttgctggttcgttttattgggcgagttgcagctgggtgttactatgtgggagccctaagtgacaggacaaattatcaatagcttcttcagctggaaggaaaagaaaggacatggccattgtagctgtgatcatcactaggatccaaacagccccacaccttgtgttgttgcttctcatcgatcagctgggattggaaagaatccagtaatttttttttcacgaatgcgcaaaatgattgcatgtcaatatattacaagaagacataatatatttttaaacaatgcaattggtcatacggtcattgcctggggacaagaaacaaagaaaaaaaaaagaaccaccaaagtaaaggaaaaaactactactggaaggctgttcacaactcagaaggtggaggcggagccatactgctcttccaacaagcctctaaagacaacggcgtgttcacaactcagaaggtggaggcggagccatactactcttccaataagcctctaaagacaacggtattagtacaagaccacaaacagccttcctgaaggatggactttcaaaccacagagacctaggagagagaaaaatcaagaattctagaatttcgctcctttcaatgctgccaaaagatgaggactagatagtcgaagcccactcgaagatgctcaagcaagtagaaagcgagcagccatgaggaggaacgaggacggccagcccgaaagaatccggtaattgtaacaaaataaaattaaattgctgggtgagatggatgcacacccttgtgcatcagcagtagcatggacttgtggtgggaagcattcatctgacagcattattggtaacaatggcaccccatgattgaattgccatatgctattaatttgttctctttacggctatactagacagtccacgcctaatgtttggcggttgttttgtttgatatccttttggacgttttctaatttctagtgcagaaaaatagcagcagcagcagcagcagcaaaacaggggacgtttgagcgaataatacggctataaacgactcacctaaatgctagaacaaatgccaaacattgttcatgacattttacaattaacaccggtttggaaaacaaaatgctgaacaaccaaagagaactgaacaccgaacattagatccaaactgcatacccctgccttgttttgtacttcctcagtttcgcaatgtaagtcattctagcattttctatattcatactaatgttaatgaatttagacatatatatctatctaaattcattaacatcactatgaatatgagaaatgttagaataatttacattgtgaaacggatgaagtggaacagtaaaaggcaatgaaaaaaaagctagctccatttttgagaagaaagtacagcaattggtgttcgtccaggcaagttcatcacgtgcaaaggagaaaggtagcaacaaggcaacctatacgatggatggattgagatggaggccggccgtggcgcatgtgagctatccgtcgtcgtcgtcgtcgtcgtcgtcgctgggtccgggcaaatggaccccgggcgaggcggggagccgtacaccagcgtcagccccaatcgcggcacggtgtaacgcgccgcggcacagtcgtcgtcaccctgcagcatctcttgcacttgctgttgtactacactagtagtactacctctcctcctctcgatcagtaactcattattataattactattattctactctgatgaaggtcctacgtcgtactgccagagattaaacaagttccctacttgcccgtgattctcagtttcaggactgctactactgttcttctatactgctcaggagtaggactactgtacttacttgtattagtattttttttaccaggcaatgaggcattcagtctctagatgtaattactctttccgtcccaaaatataataacttttagctctcaagatttatcctaaaacataacaacttcttcaccaacattctttttccaaccaatcacaatcctccaccatttactcctacatacttttttaataaccatgtcaaactgtaaaactttttatattatgggacggaggagtagctaggagtaacacagtaacttaattaatatcacatctgcacccatatgctcttaactaatgtaatttacctaggattttcaggtggtcaaccaagtaaattgttaatgtgttgcacctgtaaaatcttcttcttccagtagaaaacgaagtgtattatactactccaaacttatatacttggggcaactctccttgattcccgcttctcacacgcattatttgtttcagagcggaaacagccaacgctaacctaactagttaaaccaaaagcctagctttccaagcacaaacaccgaccatttcttcactctctaagctagctcgatgccgccaccgccggcgacgacgccgctgcctcgccgtcgcctcgcgctcatcctgtgcctggcgtgggcgctctggctccacggcggcggcggaggcatcagcctggcagacgcgttccaggcgccgacgccggcgagactctcgtcggggtcgtcgtacgccgtcggctcgcggccggtccccgcggcggcgccgaggtggagctcgtcgtcggcttctgaagctgccgcccggttcgccgacgacaagcggcggattccaagctgccccgatgccctccacaacaggtagaatataagatacatacatgcatcgatcgattcagctagctagacatgagtacgctcgatcagatcgatcgtagctagcaatttgtagtagcttgtacgagcagagaatgtgtgtgtgtcatactgcttggctgttcttccaaagccaactcgatctaaattgccggctatggtgtgttgcacggatcagtgattactgcaagcacggcggccatcgaattgggtgcctttgatgtgttctgtacaggttcctgcagggaagtgtgttcttactttcagtcatatactcatatatacaagaattcgtcattgcatattgtcgttgctcctgttcacaccagcttcatgcatgcggcggagatcagaaacttataatttgccatggttatttcagagagagagagagagagagagagagagagagagagagagtaattctctacttcaaattgctcactgcatcagttgagtgctaatgtactcactccgtttgaaattagttatcgttctaacaaatttcacacaaacctaagagatatggcagattacatagttaccctcgtttcaattcacacatcccattaattttctaaagaaatgagccaattaaagttgtgacagtataactatatcgatgaaggtttttttcatagcctattctttagccttggtttataaactgcaagcaaataacatataaaatatttagctataaattaattttagttaattcatttatttttttatatctcattagccctaactcaaccacaatcagagccgaatttaggggatggttattctcaccccgtaggtattggcaaagcttctgaaaatagataatgatccaataccatagggaaaaaaactgcatgaacttcataaaaactgcaacaatgctgtaatgttattctcaagtttaccacaatatatattattggcttgtagtcaaatcgtcaaatttattataaaactatttttttacatgttctacttctatctacagtttcatatacttcacaacgcattcgaaagatacggttttgcgataattttgcgaatcatttgtatttgatgaaatttacttaaaaagattttatgatcaatgattttggaaagcaatctgcacggtgtatgcacaaaatgaaatcagccttcctccataggggtagtacaatgtcaggatcgatgcctcatcaagctagctctccatcgatgcgatggttaatttccagatcgagcatcttttgtcccgctctcccactacgctaagctcacatgtagaggaacatgtaggatgactatttaatttcttaatgaatttgtacattaaattgagcgttaatcagctgagcgagtgcattattaattggagcaatcatcgacagagtctgcaatttcagacaccaatgggtcaagcttatattaattgcgttgccaatccccatacgtgatcttcatcagggcgtgacgcgtgcctctccagcatgcggtagacagcacgatcagatcactaggccaccatgtcgtcctcgactaattttggtttatggatgcgtttagatttaggttgaaaatttttgccatgtcacgtcggatatacagacacacattttaagtattaaatatagtctaataacaaaataaattacagattccgccgataaattacgagacgaatttattaagcctaatgtttattgtagtactacattgtcaattcattgagcaattaggcttaaaagattcgtttcgcaatttatacgtaatctgtgtaattagttttttctatatttaatactccatgcatgtgtctaaacattcgatttaactggattaaaaaacttgctagggcatctaaacaggtcctatatatatatgtatgtatgtatgtatgtatgtatgtatgtatgtgtacacacactacactagtgctgcctacacgtatatattggtgtaccatttcttcactgataaaaaataaagattaagttaatgtacgtacaacaagaaaagatattagcacgtgactaattaagttttaattattacaaacttgacaaataaatatatttgatattttaaagcaacttccacatatcttaataaggtaaaataattgacaaggatcaacaatggagatccaaacattgtcatggaatcctatttatttttgaacttttagcagtttaaatacttgaagttagtatagcatattaacaaagtatattagttccacatcaaatatttagaagttttcatggtcaaaatgtgaataacgcttgtggcaacttaaccctgaaaaatatttgaaaaatactttcttcgttctaacaagaattaacttattatggctatatgcaaattcatagccataagttattactcttatcatctactatattattaggataaccttaaaattatgcaccacattcgctatagagcctaaaaatttccacattaatcattaaaaaaagagtccaggtagaaatataatttaaaaataactgaaattcagaattgaaaataagcaataatatttgaagaagagcccagatagaacacaatacaagattaaataaaattgagaatacaaaaataaataaattctaaattagaaaaggaaatagagagttcaagacttcgagtagtaatataattttgaaattaaataataaggaatattgaaatgaccatccattagaacacaacacgagtttaactaaattcaaaataaaaataaaataaattctgaaattagaaaaagagagtttaagtatgaataaaatttataaataactgaaattcagaattaaaagtaacgaatatatcgaataacaatcatataaaacctaatacaagattaattaaaattcaaatgaagtaaattctaagattaaccaaaaggaaaatagggtttaagtaggaataaaatttaaaaaactgaaattcggaatataaaaagaaatattgcaaaaatattccatctagaacataacacgagattaattaaaatttagaagaaaaataaaattaagttccagatcagaaaaaaatttaagtaggaatacaatttaaaaataaacaaaatactaaaaggagacatcatccagaactcaataataaaaacaataaatgggtacagtagtagcgtttgatggtacttctaaaaacaataaaacgagaacctgacgaggcaataaattctaaaaactatatggtataattttaaaggtctcaatgaaaatgaaataataaatagaaaccgtgacatattggacaagtaaattaaggggtagcaaaaaaaaagtaagggggtgatgactggtatgacttactataaaactggaaacccgatatttgatttttttttaatatggtaatacaacgagacgactatttaacaaaatttgagaaaatcatgtataaaacaacttaaataattttatataggtgctagtcatgcaattatacgggccacctaactagctagttttgatggagagagagtatagtacctgatgaaaaatcccttctttcttggtctcggactgggccaggctacccctcgcgcttagtgggccgcttctgggtgaatcgagcccaactagacagtgggatggcccgtatgctcgcgttgttgctccgtgggccgtgggccgtggcccgtggatgcacaaaattcaagtgggttgccaagttgggctaagcttgtcaaaatctatgggccaccccaccgtcgctttctccaacttgttcaattgttcgctgcgaaagccccgtgtgtatgtatggataaagctcatactacttcgctttcacataaaaatggttcctcacattagcgaattaattaatgggggatatagtaattcatacgtaagtacgcacttcattatgggtcaaaatattaatttgtccgatcgagcagctagctaacagtacgcaggaaaaaaggtttgtacaggcagttactttatcggtagattatactattagctagctatagctaggagtataattccaaattaacccctttgatccactgatttggacgaaattaaattaatctaaatgtacatatatatataataaccttttcaaccctagccgtttcataccggccatgcatgcatgcatgcaaataaatgtgcatcaccacatatagctagcataagatatgtacagaacatataatcagggataagaaccaatgatgaagtcaattagtactaattcgctgatttggattaattcttatacaagaatactctgaacaaagctataatcgcaacctacgttccggggctccggccgtttcgttaaaagcattattaatttaaaatgttttgacgcgtctcgggcagagtcctccccattttcctgtgggatctgatatgtgtacaaattattgtggaaggattttattatcgagtcacttgttcaagttgcacgtaattaacaccgcctctcttgtagattattcactcacgggctacgacatcgtccgtacgtattgcctgctcttaatgggagaaatgcactgcaacattaacatatcgtctcaaagctaaaactacagttaatgctagctagtaaataatataagcaagtttacatcatttacatacttgcacaattttctctaattaactgtatattgtttggtcccattttctttttaaaacgagacacttctttattatataaaatgtcaataacgttccgatcattttaaaacaatatcatgtatctctactattataaaaattgaacatgtttttaccgatattttggtacgtcatccgtatttgagtcggtttttaagttcgttcgtttttggaaatatatatccgtgtttgagttggattttaagcttgttttcttttcgaagtataaaagagtcatataagaaatcttttgaaaatactcgcatgctaacttgagatgaaatacaggctcttaattgcagctcatgattttctgaaaaaaatatacaagcgaattcccacagtaaattttaccctggctaatccgtataacaataataaaattaaaatcacatttacccgttgcaacgcacgggcattttttctagtaaactaaaaaaaatatgcgtgtagatatgtatatgttgcaatttttttctttctaaactaaagtaaaatgtgcttgtgtataatatgcttatttgaccccgttttgaactctaactaccaatttgaccctactttttgaagtttgcttatttgaccctccttttcaaaaacgaagctacggtatgaccctattctgttaagggcatctaacggtgttgactgaagcacaaaattgnnnnnnnnnnnnnnnnnnnnnnnnnnnnnnnnnnnnnnnnnnnnnnnnnnnnnnnnnnnnnnnn

SEQ ID NO: 29313 - DNA, 1120 bp, Oryza sativa
  unsure (1)..(1120): unsure at all n locations
ttaatgagctttgatgcacgtttcataacaactcgctggctgcaagcctgtaaccgtgttggctggctgctacaccagctatatccaacactttcaaacaaccccaaaatatgtgcagaagcatgcccccaaacaaaaaaaaacccataaacacatcctattattgccgtgaaaaaacaaaatagcctaaggacagaaattgtgttaagcagctgaaaatcatcatgagttgaggatgatccgcttggttaagtttttgaacagatccgtatgtttatagtggattatctaagtgattataaatataaaaaatatatatattggtaaatnnnnnnnnnnnnnnnnnnnnnnnnnnnnnnnnnnnnnnnnnntcctcacattagcgaattaattaatgggggatatagtaattcatacgtaagtacgcacttcattatgggtcaaaatattaatttgtccgatcgagcagctagctaacagtacgcaggaaaaaaggtttgtacaggcagttactttatcggtagattatactattagctagctatagctaggagtataattccaaattaacccctttgatccactgatttggacgaaattaaattaatctaaatgtacatatatatataataaccttttcaaccctagccgtttcataccggccatgcatgcatgcatgcaaataaatgtgcatcaccacatatagctagcataagatatgtacagaacatataatcagggataagaaccaatgatgaagtcaattagtactaattcgctgatttggattaattcttatacaagaatactctgaacaaagctataatcgcaacctacgttccggggctccggccgtttcgttaaaagcattattaatttaaaatgttttgacgcgtctcgggcagagtcctccccattttcctgtgggatctgatatgtgtacaaattattgtggaaggattttattatcgagtcacttgttcaagttgcacgtaattaacaccgcctctcttgtagattattcactcacgggctacgacatcgtccgtacgtattgcctgctcttaatgggagaaatgcactgcaacattaacatatcgtctcaaagctaaaactacag

SEQ ID NO: 29314 - DNA, 985 bp, Oryza sativa
tcaccagaagaaattccaccaatgattgcatttcttgcacgataattaaaatcaacctgagccatatttgcaggcgtgatgtcagcatcatcgggcacagtgtaaggtgatttaaccttattccacacattatgcccttgcgactggaggtaggcctccattcgtgccttccaaatgacaaaattgtgtccatcgaaaacaaatggtttcgcagagtatttttcctccatagctgcgttcgttgccacggttaggttacaacgaacttaaccgggctctgataccaattgaaagacaaagaacagctatagaggggggggtgaatatagcaattcaaatcttgcccccgaaaatactcatcaagccggatttctcaaaatccttactagaaccgcggctattagagaagccggatctagaaaagaagagagcaaaagaagagagaaggaattcccgaaactagaggaggaagagaaaaggaattcccgaaactagaagagaggtgaggaagagagagcaaaactcatcatcgcaaagttcaaattgcaagcggaatttaaatggacaaggcaaaaatgaaatccttcaaatcatttcatttataggtgatgcaaaataaccgctcaactaggagcaagcatacaccttcagaggaacattaacacaaacttaaaatctctcagacaaacacactccaaactaatcctaatacaaaagcctctcgggcaaacacactccaaactcacaccgaaactctctcaccgagcatctcaaaaggattgccaaaggagcaacatccacccttgcatccatctctctatttataggctaagacccctaagacattgtctcaaatacccctagggcgaaaccctaactcagaatggatctggtccacccattcttccttagaaccgaaggaagcctcctggatgcttgccacgtcgttgatccaaactctccacgccgcactgatccgcgtgct

SEQ ID NO: 29315 - DNA, 26529 bp, Oryza sativa
  unsure (1)..(26529): unsure at all n locations
ccctgccaaccaatcacagctcacatgcacccatgggctagcaagctcctcatgcacacatgcatgtcttgcgcccgtgcatgacattcggccatgtgcacgcatgcacaaccgaagcaccactgtccatgcttgcatatgcacatgccagtgcatgtatacaagctcctcttccattctccattctgttcgcgaacccggcacttgcacttgaccttgcgaagtccgttgcgaagacctcctcacacggtgttcgtccaccgtgtgcaaccttatgtccaatcttgtcacccggcatccttgatcgctttggacctcaactcctccctgagtctagtcccgatccgccgttgaccaagatcgaccccgatcacctgcacacacatgaaccaaacaaccgttgtcttggcacagatgtcgcaatctgaccaatgttagtccacgcacacacttcttgcacttccggtacttgtcaatttcccatcacaaaagaactataaccacacatggtttcacaaaactaaggtcgtgttgagtctgaactatcgcaaaagctcgatttacctccctctagatacttaaataccggaagttcatgactcttcaacttttcaaaccaaacaagtcaccccaataacccaatccaaagtggttttagttctatgtggcatatacattgtctgcctcggagcacactttgtgacaacggcatgacatggtagctgtcaagaagagcgaaggaggtccctacatcttctccatggtgccaacggagaggagtgcaggcggcaacatagtcgacgctaagaggggacattgaagtacgtggtctccttctagatctgaccgatgacggtcctcattgggtgtgcagctaacctccctccatcgtcactgagccaagcaccacattcccctcgaggacaatgatgagctcgaacattgtcttgcctcacctcctatctccctctgctctcccaccctccttgttgccaccaaaacccactcccctccttgctcggtcttgtgggccctgggccctgcttccctcattcctaacgatggtggcgatggttcctcgatgcgcggtcaagagaactggggcaacaacggttctccttgttggtgttgaggtagtggtcgtgtcctcttgcttggatcaagatttggttagagggaggggggaggaagaagaagatagtgataagactgacatgtggggtcttatatactttttaaaatatatcgatggccttttcattggttggacagccgcatagcaaaactatcgccatatgtaggattaaaaccactttagattgggctaaggggaactttgtccagttttgataagttgaagggtgtaaaatgtctggtattggtgttgagggtgtaaatcaaacttttgcgacacttgaaggggcatgtaggacttaccccttatatcttattgatgttattttataattcttatgctatgaaatgtatctaaactttatgtgaaacttgatgttactattgataaataacctatatttattttttttataacttagcatctgtaattgcactcgctatccacaattcgttacctatacactactccctccgtcccataatataagagatttaggagggatgtagcgcatctagtactacgaatctagacagatagtgcatcctagtactacgaatctgggcaggctcatgtctagattcttagtactaggatgcatcacatcccttcaaaatctactccttatattatggaacggagggattagtccaatgtcagcccactatttgctatttaattattactaggagtactttgtttacaaggttaatatatatatgcaatgtggattgattgatcttaagcaattttagagatataagatgaaaactaatcttcctatcctatcataataactttggggctcgcaagaaaaagttgttgccttagcttattagcagcacccgtatcgagataggtcactaatgcgtgtttaattaagaattccgtagttttaggatgtgtcgtcccatccatctaagatcctttatattttgtgacggatggactacctatcataaacataaaatctagatttgttttatttttaaagaaacttttatatagtgattttttttaaaaaaaaacatttaacaatttagaaagtcctcacgataaaatagaaagtagccaagcgaatcccagatcagcctataaccatatatactttaacaaataaaataagtattccctatacatatatgtcatttagtgattattctaagctagttttgggctagagttcaccaaagttacaccacacttacacaccggctgagaataatcacaaaatgatctggtgccaaaggttgatgttcttttttccttcttgcaaggaaaataaactctataaccctccatatatatatggctgaactagtaccaatcatctcgaccaacagcagcagcattgcgctgtcgtcctcctacatctacggtggatcaatgccccagtacctaccactactgtcttctttattttctttgagaagaacttcacttcacctctagtggatggatggtgcaattaaatgatgctaatcaaacacccgtagctatagctagtaaatgcaaaaaacagttatccaccatgaaaaaaggctctcatcttctgtctcctgaagaagaaaaggaagaagacgaagatggaatcgatcgaattcacaccaaaattggaagtttgattgaaattggaataatgtgatggaaaagttagaaatttatgtgtgtaggaaagttttgatgtgatagaaaagttgaaagttggaagaaaaattttgtaaatcgaccaaatgtcaaaccaaggtctctgatgcctggctgctactccatcagttgactttgcaacgggtagccggccggtaagccatggcagtagctaagataggaggcggcagcaaagcaaagtcactgcaaaaaatgctttgatcggtgtgcatgtccactgcaaaaatgctttccaatttaggcgccacataaactggtagcctttcgccgtcctaggctctgcatggtccgtgcctttcatgtccagggacaccaacgcctgaaaatgtggattgcagtaataatggaggaaaagataggacggcaatgtactactccctcattgtaacgtttgaccatttgttttattcaattttttttgtaaatataaaaaacgaaaagttgtgcttaaagtattgtagataataaaataagtcacaaataaaataaataataatttcaaaaaaaattgaataagacgagtggtcaaacgttcaagcaaaactcaaaaaaaaatttttccccccccccccttttttaaaaatttaaattttttaaattggggggggaaaccgggggaagggggngaaaggttaaataaccttaattttgnccaagnganccatttanaccatcaggcataaacccaccacaagaaacatgtagtacattcatttgattaggaatttgtgattggagtatatctcttctcttctctcctgtccagttcttcagaatacattgcaggttggatgcaagaacacaaggatttcaggattcacctaaattgtctgtatgtattgatgtgtacatatatatagattatagagtaagttacatggactgattggtctttcagcactacaaaatatactgcactgagtcttgagtttgtggtttgcttgctgtgtatctacttacatggtaacatatctgcactatgctatattcaatgaaattggcacactctgtgccggttcgttcaaaaacatatctgcactagagtatagttctatgtaaataattcaggtctttgccaatgaatacaactgtgaaggctattctttgttcctgtgtattggttgttaactagtagggcatccttgccggaccagaggatgttctgacgatttcagaaccaagctcttgtattttacgcaacaaagccgctttctcccgctcaagctgctgtatgtacatgtcttgctcatcctggatgctttcaatctctgtcaaggccagtgacatggcctctgtgtcgccaccctcatcaactaaacctgtgaatttcttcaggctatctctcatctgttgaaaaaaaacacatgatgttcatcacaaaattgtcatgcataccaaagaggatactgagaggaatgtggcaatattgttatgcagagacatcgttcaaacaaaccaacgaagcctctcacctgcgatgatatcttgtgccctttgccaagggaagatgcatcagtctgaaagcttgttttcttctccaagtgtggtacttttcgcgtgatctttacatggacttctccgctttttactccttggagtggtatccattttacggcgggctgatttggaggaagcatgctgtattcgacagtgcattggcctatactagcagttggaaggactgcattatggtccttgacatgtaaaatcaggggttctcctgtttctggaaactcaaatgtctggttccaatctggagagagtgttttgtaaacaacctgcatggaatgagttactcagaatttctgatcaaatggattgttttttatagggtgattcatagtatctgtagaacagaatgaccatatataattctccagtctccaattagcgccaaaaaaggttttgttttttccttttataataacatactaaaactaacgagctattgctctataggtttcctctagtatgtgaggaggtaccacattttcaagagttaattcgtagcacctcgtagaggacctttgaaaagcccattttcctattgaagttcttatgttattctaaaccaagcacggactgctacaggctgaaagatttggactaatctgaattgatcatatgcacaccatctgaagatgccaagtgctgtactgtgtcagcatatttgttcatttctattacttcaaaacgccaacaaattcacatttcgcatgtcagaaaagcaatgcatgctgcatttcctaataaaggcatagtaaataactaaatacagaaaggttcaccaccaaaccttagttcgcttcttcttgctcccataatgcaccctgacataaggatcactagtgcctctgagatcagcagcaataagatccctagcttcaattatcactagctcaatccaggtagcttcaactctaccacttgaagtctgcttaagaagaacaatacagaatccagagaaacatcagtagacaaaatggtacaacagagcaaacggtataaaactaatgtttggtacagaatcaaggatatagaacatgttgctggaggtttcatgtgtagaaaaatagttgtactcaacatcccaaatttaaaatttttactgcgcatcctcttaagaaaaaatgtttctgacgctgatttcgcaaatgtatatatttttctgaattaagaatcctcgcaatattaaaattcaatgcttaaggaaggcaaataccttcaggataccgttgaaatcactctttattggctctatttgaagcctgatctctcctgaatccaccttttcaagtggaacccatacttcacggctatcaccatctaaaagtccttctagatttactcttgcgctgccaatgctttcgtctccaaatgtatctgcactatagcatttgatcttgagatattcaccaccagtgatctcatcaaactcgaatttatcattccaaaccggtcgagttgtatgagatagtgtttttgttttgtatagagcctataaaaagaatatgggattagaataccaacttgtataatagtaagtgaagctaaactttgggcaaggtaacaacaaacctttccatactgcactttcacatatggatcacactttccagatttaccgttaactgcaagggctttaccctcaactactgcaactctgagtttccgtcctgttctggactgaagcttgggcgatacatcaaatgaagagtgggatccgttgctcagagaattgctcaacgtaactgagccatcagagaattgccattcttttagcacaagagtgacagttaactgcaagggaaagagtttggaacagtattacacaactatccagaccaaataaactagaaaaggagaaatggcacagttaaccagttcgcagttgaataggtaggtgaaaaatgggcacattattgttggaaccttcatgaatgtcacggtagaaatgataaaaggaagttctccactaaaattgttaacttgggaacagaaacatcataattcatcatcaaaaccccacatttctggtcactctatcagtagtctatcctttatgtattatatctccagagctctcaagcccaactgaatgaaaccattgttacttccacaggttgtttctaaaaaaaaagggctgaacattttcctgatcctctctcttccgatcttgattccaaaagcgctaccaattcaacaggtcgaacttactcttttgtaatttataaaacaacccaactgtaaataaagttcaacagaaaatcaaatgtaggactatgggtcattagaactttaggctatacaagtagctgaggacctgaggtcctaaactcctaaaatctgttacttcacagtttgtatcgagtatatcaaatatggcataatttcaaacctgataggctagtgaaaatttgcttcggtggcttgataaaactaattagcacttcaatcaattgggaatccatttttctaaatgttacagcatatccaaaacaggttttggatgcaagagaaacagtgacaacacatcagtagttactatagagatgtacctcgcccctgatgtcctcaaatggaacaaccattccaacttcttgtccacaaagctcagtacgttttgcaacagcaccagaattatgtcctatagcccaaaatattgttgaatcatctagaacatacttgacctgtttacattactttcatcagcatcctttagatgtgttggaagaaccacaactgcatcatgtgcaatggaaactgactaaaataataagtttaactgtcatacctttatctcgcagcttgtcaagtaggtgaccttaacaccaccagagtccaattcatacagattgaacttgacaacacctgtctctccatgcaataccaggttaaatgtgctattccatgcagggtttggacccttgcttgtacttgtttttctcactaaactaccaacttctacctcaataaatgtctgtgataccttgttatcagcaattccagatgtagaacctccacttgagctttggcggatccctatttcattagttgtgtttctcccaacgttactagctgaaacaactgtgactgaaagaacacctccaactgctcgtttccttaaatctactggtggcaaagaaaaacacaatctgcgaggctcaaccattgtcttcactatggtttcggtcaaaagcttaacctgcatggctcatgaagcatcacatttagcattcaaatttcaatacgcaatggccgtaattgcactaaaagaattgcaaagataccaaggactaactaaatggcacacacaaacccaccagccatgttgagacaccgggtagctccataccaggaactgcttggcttccaccacttccaaatgccactcctatcctgacttctggagtggattcaaaagaataaagaatagcttcaccatcaaggatgggtaacagtagaagctgcaaagatatagtttaaatcgaagaaaataagagcttaatctgatgagccaactagaaaatgcgcttagacaagaaaataatcgtcaaatacagatataatactcaggacaagaaagcaaataaaagattttaacgtaagtggtgatccaagttcttatccacacaaaatttattgtgtttcaacaaaacgctaaagtgaaatagctcaaaataaggttgccactttatcctatgtgagaggcaggttaactacatcataatatcctatgtcaaccattaaggacaggaatgactccgaaaagccaaaaccatttttgttcatcatgattgttcattatcagctttgcgatctcagtgagcaaagctggcgacaattcttgcttaccaattcaaaagaagtctctctcaaatcaagataaatgagaaataacaataacaataacaataacaatgtaacagaatcaattgaaagagcaaaggacatacatctcccttgatgtgaatgctgtttataacaattcgagcagcgccaatcagtggttttgctaattttgccaaaaacattacactcatctcattgctgtcccaatcaaaacccaagcgcatgactttctgcatgttcaaaaaacgagagttgaagtgtgcaactgtacaaccaacagaagtatttcatctgcctctcctacttacaacataatattgttcaagatggaacaactaatgactaaggctatgcaggatcaggaagagctgcagaacatgttatatattcctaacagataatggaagaacacatgggttagttacagataatggaagaacacatgggttagttatacagatgcatagttataatcagaaaaggtgaataaaccattgatgacactgcattcgttagtgttttcaatgatgtaaggataagttaaccaaactagtacccaaaacagcacaactcggaatttatgaagcagagcaaataagctaaatcaccgctgttataattctgtagaactaaaaacagcataagcagttctttcaataatgatcagtgcctgaggcaatgatttcctccctctctaagtttaccacaggtgagtatcccatacacagtacagaatattaatatctgacctggtcacctgaagtcatccagcgcatcccatgctcccccaaggtaggtggacaacaaccaagtgagaattcctgtaactctattttatcctggagagatataaaagcaaatcattagtactacagtcagaatagcagcaggagaggataaacaactttaagagaacttactattagttttggttttcgatgctttaaacgtttctgcaaattcagagaacactcactggtcagctggttataaaaaaagcagaatagaagccagtgtgcaccatatcttgcaatgcatattgactatttgactacaacaaataaataggagcaatggagctgagaaaaaaaaatggccaggccggcagcgaagaagtgccccagccaattttattaagattggagaaggttaaaacaattgggcaacaaacatggttgttgttttacaacaagctgagaaattttctaatgaattttattttgagataatcatcaccaaagaaactcaaaaggtatatttccaaaagcttttaaaaccaataattattacatccaagcaaaaactattagacgtaatagaaactttcacaaatgatagcaccttcattttctagcatcctagtgctcaaaagattcataaaattatctagcaaatgtgcagaagctgacctcaacagtagattgaaacttctttgacagttttggttccatataattgggccaaacttctaccaaaagtttgttcaaccactcgcaaggctctattggcgtcgtaggctacaagagatacaaaaggggtattgctaaaagttcatgtataaagagcaaaacaaaaaaaaataagtgaaggaatatactgttgtattcagtataagatgcttccatcgtttgttcaaatcttctatggctgacctccttttaaacctcccatactgcattcatcattaaaataaaaatagtaagaagacaaaataaactctagaaagtggggcgaggtgtttctctgtgttattcttttcagaattatgaacactctgcaactcaaaagaatagatcagcacttccaaaccaagcaacaagcaatacttgcagtaaattagtactatctcaacacctagaaaaggactatttgtctgacaattcagcaggacatcaaagaagccaagccaaattcatcaaagaacaactttatccatatgaataccatgggaaggaaaaactacctgaattgttgcccatacagcagccaacaggggaacccagtttgagaatggcacaacccatcgttcaacaaaccatgcaaacaagacaagagggaccaggaaggggagcaagggctgctccaccatgacctggttgaaaaattctagtgcatccttggcatgcaatttcttcagcttcttcttcgccatctctcctccctgctgctctgtgaattcagcaaagctctcttctctgataaccacacagagcttgatgcagataccttttgttgttttttttggcctttgtttccactgcttcccgagttcctgtcactggccccttttgcactgtgggtattggatacctgtccacctacaattttggttccaattaatggccacagcaagatagacacctaagataaagcatgtatgattgcgacctattgctcccagacttgcgagatatttcaccacttctagaatggaacaatgaagagaaaacctccaaatttttcattctttcaggcagcgtgttctattagcacgaataaacaagaaattgacccaattgatggccctaacaaagtcaacagctggattataccactaagattcgttctagttctggaccacataaacgagagagagagagaagtccaagccgcagaaccattacagtgtgcgtacacatctggccaagaaattcttgtgaaaacaaccaagcagcataggagccaccaaagcctgaaacgtcacattcgaacaggaaaaaaacacatccatgttcttgacaacccaaatgctaacctccatgaaacccaaatagatcccctgtaaactgtaaaaaaaaatccgctaaaaaatctgcaatttaacactgactgacgtgtacccagcgagtagaataaactgcatgctccaatccaacccagtcaagaagaactcctcacccgtcgagtcgccaacgctatggccaggtccctgcacccatggagattgattcgcgcagagacaccgtgaggccaagcagacaggagatcgagaggagcagagaaggagagtcgcgaaggctaaccggaggcggagaaggcgaggtggctccactccacgcacgcaatagggaggagttgaaaaaactgcagctttcccccttcagagttgctacgaattccacgaactgcttccaagatgcctcctttccgatccaatccgccgcaaccgcatccggcgaaatcaccagccttccccgccggcgactgttcttccccgcctcctccaagaggggaagttggcagaggtcaaactttgcaagtttggaatgattctataaactccaagaaccaagaaccagggtgggacaaaggggggaaattttattttttgtgagttgaggggggctctgatttgttggaactggaagcgattgggcggcagaatcaagtagtagtggatttcagtgtgctgggacaggagggaacgaacgcgtcaaaatcgggctcgtgcgtgttcgtcaatcgtcagcggcgcagcgctcttctgtgccacgctggctctcattggtttgtactcctactccgtagtaccttggaatgcgactgatttttttgatcgatctcttgtttgtttctttgggttaattggaaccatgccattacaacttcagctatttggaaatatgccattacaattagcaaaaccggctgggtgccatcgcaatttcttccaaattggaaccatgccattatatacgtctgaattgccatccatgccatttgtcctcgcacgtatttccgtatggacgcttgtgcccctggctgagacgatacaagccaaccatcccggtccggctcaaccatctctgttccccattccctattccccattgtctgcaaaccctagctcgccgacggcgatctcgacggcgatcggtgcagcgccggcgacgacgacgggggctagggatacggcgccggcgacgacgacgggggctagggatacggcggcggctttaccgatagcttctcccggcgtagacggatcaacgcggcaacgagtttggaggcgagctataccagtggcagtggtcgctctgcaatttcgagaaggtgcagagtcccatcggtggctccttcaatcccagagctgaaatgtgcttgtgggcatgccgctgcggtgcagacatcgaacacaccaaggaatccaaggcggcggtggctgcagtgtcctggggaggtgagaatccagtcctacttgtgcatatttgtgtgtgattttctttctgaatccaatctggtttccttcttgtagaattgtagatgtgccttgtggatttgggaagatctcaacgaatacgttgaggagatggtcgcttactgtcatgctgacgagtacgactatcttagagagacatgcgacagtttgcgccagtttatagcagatcaaagacatgcatatctctcagttgtcagcctaggctgaggcaaaagagttgcagttgcaagccaattacgaagctttgaatcagtccaagttggggtgtgcagacttaaagaagaaattggagtgcgagaaggcttggactcgcacaattgtgtccatgatgatcttgttctatgtgttgttagttgctgtaatgataaggcaggtttaggagatgttctgtgtgatgtctggtgtgtgaaatattgtgatgtaccttaggtgtgtgaaatctggtgtgtgtatttatgtttgtgcaagttggggaatgcaatgcaagggctatattttggaatctggtgcaaataatctgctgcctaacatagaagctgtttatgtgcaatggtgactgaaataaatttgctgacataaatgacataaacttactgacataaatgacataacttgctcacataactgacataaacttgttcagaagtgtagcaactgacataacttgttcaggagtgtagcatagaccaacatgcagcacacaaaagacagaacatttcaggtttggagcccattaccatggccaatatctaacaagtccaaatggccatctacaagcagcaaaataaacaagtttgggtttttacatcacagaccaacctagtctgataattttctaactactctagcgggtggagcagtagaagcaacaagattcttcctcttctggggagttttcttcttcttaggagtatttttcttcttgacaggtgcagatgaacttgcttcagctgcagctccaggcactcctttcttcttaggagggtttttcttcttgactggtgcagcttcggcctgacctgcagcttcagccacttgtctcttcctgcacacagatagtaccattagggaagttttgaggtagtcaatttgtggactaaatagaaagaagtccaaattacctttttttggttgttggctggattgtttgctcatcttgatgaactggctcagcaagtttgcatatcttttcaaagtgaccaaaaccctgacatctcttgcatgtaactctcttcctgccaggttgttctaaacaatctcttattctttgcactctaggtcttccagcacctctcttctacctaggtgggtataccttgaagccaagatctacatgtggccactgagacctatcagtcattgttgccactctagctgcataagctgctctaaaggtctgaacactatagtagggactgacaaaatcttggattcgacctctgttagtgcaaatccaggccaatgcatgtttgcatggctttcaacttgccataccctacatgagcagttttggttctgtaaatcaactgtgtgccttctagtgttgttgtcagactcaacaagtgtcacttctgcgaaaccttcatcgcttctaacaacctttaccaccctgagacagacagttgcatcattcaattctttcattacatttggcaggatgccatccacaagctttttaccaacttctctcctgagggccatcttctccatgatcatctccctgatcccatccacaagttcatgcaacaacagacctttaagcttcttgatctggttattgaaactttcagaaacattgtttgtgaggtagtcacacttgctagactcagaaaagccacatctgtaccaaatccttgagtgatgcttctcaagatactctattgcatcagacctcacttggtatatttgttgcatgtaccacctaaatccatcctcagtataacttcttgcagttggatacaggtgatcagtgaaggcaggaccttgaaacttcttcatgaagttagcatagagatgcctcatgcattctctgtgctcaactttttcaaatgcagcatcaacagctttttccaaacccttacaagcatctgttgatataactaggccctctggattatctatggccttattgaggtgtctcatgaaccataaccaattttcatcagtttcagagtcaaaaattgaataggatacatagaacaaccaattatgtccatctacactagtggcagcagctagttgaccagtatatttacctgtcaatcttgttgaatcaacaccaacatagggcctgcagccattgaggaagccatctatgcaaggcttcagaacaacaaacatcctcttgaagcacattttcttccctatcttctgtacatcaatctctacaatagaccctggggacttcctctccatctcagatttccaattaaaaagaaattggaagctctcttcatatttaccatgtatatgttacaatgcacacttgaacccagaccatgccttcgaatacttcaactttatctgaaaatcttcttcaagcttgtgccttgcatcactagctcccttttttgggtttttcttgacccaatccccaatcctgtctgcaacccaaccttgagttgccatcttgttttcttgcaatttggtagatgcacatgtgtgctcaaagggaagaactttgatctgcattaaacatgtataattaacaaaattgcattacacaaacataatcaaaagcctaatcaaaataaataaatgaagcaaaccatagcacctgtatgactttggtcccaggtagctttgatgcatgaacacgccaaggacacccttcagcagcacaatgggctagaaaacgtgttggatctgtcttcaaaccagcaaacacaaaaccttttttaactgcatagtgccttattgcttttctgaaagcaattatatcaggaaataatgcatctttctctatttttggattctcagggtcacgtatgacattaaagacctatggatcttcatcagtaacctactcctcaggagctctcacccctgcaacaggaggctgagaagactgaccagtgccagtgtttccatcgggttcagcaaactgtggaggctttttaggttgtgagggaacatacaaatgctcatcatcgacacccacatattcttcctcattgtcaaatatgtctggttctctaacaggttcttcctctattgcaggcttttcaacaccttcaacattgggagcgggctgttcagaaccaatgatgggagcagagttgtcaggaggcacaacacatatgggttctacttcattctcgacaagggtggataaaggctcagatgtaccatccatcttattgtcaagcactgaaacaataagattgaattggctctctgttttgtacatttcgaataggtcaggtagctgactattgtccacaagtctaacatcctcaccaatcgccttgtgcaaaaaccagattgaaggagattgatttgttccccaggtgaactcaacacttaaagtattcatcagaaattccatggaaaagctatctgaatccacaacccaatgccgagtagctcctttcgtgtaagatttcctaccatctgtttctatcatgacataagctccaaccctaacctctactgaaaaccagtgcctaccatgaaaggagagaacatcaactgaaaatctacatgtaaatacgatgaaatacccaatgcacttctacatcagctatccaaggagtatattcgagttcaagttactcacggtatcgaggaaataggaggaatcgagcctcccagatccatcccctccatcggcaatttcgctgcgcacgatgatgtcgcaggtgaacttgcgatcttcaggggaacttctacatcgtgggtcgtcgtcgccggcgccgtatccatagcccccgttgtcgtcgccggcgctgcaacgattgccgtcgagatcgccgtcggcgagctagggttttgcagacaatggggaatggggaatggggaacagagatggttgagccggaccaggggggcctcgcccagcgcctctcagagatgaccggggccctcgagcgactccccgaggagctcgaggagacgatcaagtcatcctcgagggacctcgcccggggggcggtggagctcgtactggcaagctaccaggccagggaccctgacttctccccgtgggcagcgctggaagagttccctcccgggaccgaggacggcgcgcgcgcgaaggtccgggacgccaccgaccatatcgtccacagcttcgagggtacggcccctcggctcgcgttcgcgctcgacttcgatgaggagggcagtgacgacggtgcggacgacagcgacgacgaggccgacgtcccgggcgcgtcggagtgagcccccaggcccccgccaatcttaataacttttgcttcttcttccgaggccttcgggcccccttcttgtatagactgatttaatctgtaatcaaataaagaggaaatttctgcgtcagctctgcttgttgtgtgtatgagacgaggatggtctgtgccgcggtccttctttgtcttggcttgaacaagggctcgtgcccaggtcccagcctcaaacggcgcgggtcggggctagtgcctggggagatccacgtgtcgagactggccaggccgggagcgcggtgaccaagggttatggatgacccgattgtgggcctttgccgattcccccccgaagttcaccacgccccggggcacggctcggttctgggccccgtttggcgattttagctggcccgggccgccgagggcaaggtcgagcacgagcgtgctaattcaagccaagattcttcaaaaggaaaacgatggcacagacacagtcctcaagaaatcgaaaatgcttttattgaaatacggaagagaaaaaaggtaagtatatgcatgtggtagcccccggccaactctgcacgcccggggggtgcggggttggcccgagcccgagacatgatacccgacccccactaggggtagaagcgacgaaggtgctcgatgttccacgggttaggcagctctgtgccgtcgcccgtggcgagccgaacggagcccggccgggggacgccgatcactcgatacggaccctcccacattggtgagagcttgctcagtccagcacgcgtttggacgcggcgtaggacgaggtcgtcgacgcagagtgatcgggcccggacgtggcgctgatggtagcgccgcaggatctgctggtagcgcgcggctcggagggccgcgcgccgccttcgctcttccaaatagtcgaggtcgtctcggcgaagctgatcttgatcagcctcgcaatacatggtgacccgaggggacctcagggtgagctcagatgggaggaccgcctccgcgccgtagacgaggaagaaaggcgtttccccggttgctcggcttggcgtggttcggttcgcccagagcaccgctggcagctcctcgatccacgagtcgccgtgcttcttggggatgttgaaggtcttggttttgaggcccttgaggatttccgcgttggcgcgctccacttggccattgcttctggggtgggcgggggaggcgaagcagagcttgatgcccatgtcttcgcagtagtcaccgaagagctcactagtgaactgggtgccgttatccgtaatgatacggttaggcaccccaaaccgagcagtgatgcccctgatgaatttaagcgcggagtgcttatcgatcttgatgaccggataagcctcgggccacttagtgaacttgtcgacagcgacatacagatactcgaacccgcccggggcccgcctgaacggacccaggatatcgagcccccagacagcaaacggccacgaaagaggtatggtctgcagggcctgggccggctgatgggtttgcctggcgtggaactggcacgccctgcaccgccggaccaggtcgaccgcatcgttgagagccgtcggccaatagaaaccctggcgaaaggccttgccatccaaggtgcgtgaggcggagtgggctccgcactcgccttcatggacatcggcgagaaactcgacgccttgttcccgaggaatgcacttcaggaggactccgttagccgcacgccgatagagggtcccttccaccagcacgtagcgcttggagatgcgccggacgcgttcactcccttcgcggtcctcgggtagagtcttatctgcgaggtacgcctggatctcagtgatccaagcaatcaatctaggggagctgggagcgctcccctcggatcccgaggcctggactccgacgggcctcgggggccgttcaggcgcgtccgtctcccctagggggtcgggtcgcgccgacggctgggcgagcctttcttcaaaggcgcccggtggggtctgggctcgcgaggaagcgagccttgagagttcgtcggcgaccgcgttatcccgtctgggcacgtgccgaagttctatcccgtcgaagtggcgctccatacgccgcacctggcgcacgtaagcgtccatctgcgggtcagagcaccggtactccttacagacctggttaacgaccaactgggagtcgcctaacaccaggaggcggcggatccccagtccagctgccactctgagtcccgcaaggagtccctcgtactcagccatattgttggtcgcccgaaagtcaaggcggaccaggtatctgaggacgtctccgctcggcgaggtcaacatgacccccgcaccggcgccctgaagagacagggagccgtcgaactgcatcaccaagtaggcggtgtgaggcagctgcgaggggcccgagctggcctcgggggcggagacgggctcgggagctggggtccactccgccacaaagtcggcgagggcctggctcttgatcgcgtggcgtggttcaaagcgcaaatcgaattcagagagttcgattgcccatttcaccacccgtccagtaccctctcggttatgcaagatttggccgagggggtaagacgtgaccaccgtgacccgatgcgcctggaaataatggcgcaacttcctcgaagccatcagaatagcgtaaagcatcttctaggcctgagggtatcgggtcttggcgtcccggagggcctcactaacgaagtagacgggccgctgcacctttcggcggggccgatcctcttcgccaggggccgcatctccagggcgctcttcgtccgagaggccacgcggggcgcactcggcttctgtgccgacgacctcggggtcagagggcgacaggcgcggccttcccgcagtggccccggggccatcctgggggtcgggggcgcctggcaccgtcggacaagcaggcggagggccagctccggccgtcgggggcctcgggccgccgttcggctcgggggcctctcctgcctgctctctcccgggtcgagtcgacgcagggtggggatgcgcggagtgagggttgtcctcgtcgcgctccacgaccaacgccgcgctgaccacctgcggggttgccgccaggtagagtagcaacggctcatctggctccggggcgaccaggactgggggagaactgaggtacgccttcaactgagtgagggcccgctcagcctcctccgtccaggtaaacggcccggagcatttgaggagcttaaataggggcagtgccttctctcccagcctcgatatgaaccgacttagggcggccatgcagccggtgacgcactgcacatccctaagcttgctggggggggcgcatccgctctatagctcgtatcttctcggggttggcctcgatgcctcgggcagagaccaagaacccgagaagcttgcccgcaggcacgccgaacacgcacttattggggttcagctttatgcgggcggagcggagactttcgaaagtttccgctagatctgagagtaaggtctcttggttgcgcgtcttcacaaccaagtcatcaacataggcctcaacattgcgtcctatctggctacccaaagaaattcgagtagtacgttgaaaagtaggacctgcattctttaacccgaaaggcattgtcgtataacaataagtttctatgggggtaatgaatgcagttttttcctcatcctccctagccatgcgaatctgatgataaccagagtatgcatctagaaaacacaaaaggtcgcaccccgcagtggagtcgacaatctgatctatgcgtggcagggggtaagggtccttaggacgtgccttgttaaggtcggtgtagtcgatgcacatccgaagcttgccgttcgccttgggaacgacgaccgggttcgccagccactccggatggatgacctcacggatgaatccggcctccagaagtcgcgccacctcctcacggatgaaggcttgacgttccggggcctgccgccgcactttctgccggaccggccttgcgcccggccgtacggcgagacggtgctcaatcacctccctggggaccccgggcatgtccgccggtctccaggcgaagacgtcggcgtttgcccgcaggaaggagacgagcgcgtcttcctatttgtcgtccagaagaccaccgattcgtgtggtcttggacgggccgtcgcccagggcaacctccttgaccggaacctcgtcgcacgtgaccatccgctgccttggggcggccgggacggaggtggtgagcctctcgtcgccacccgcgggcttggacgccgcggcgaggtggtccgcgcgctgctccatacaagcaagcgcgactttgaggtcgccatggacggtgatggggccaccggggcccggcatcttcatctggagatatgcgtagtggaccgccgccatgaacttcaccaacgcgggcctccccaggaccgcgttgtagggcagactgaggtccgccacatcgaagtccacccgctccgtgcggaagttggcggaaccaccgaaggtgaccgggaggtcgatatgacccagcggccaggtgtgccccggcgtcacaccgatgatcggctgggacggccggagcaccatccccggggccttgatggcgtcaaaggctgcgggggaaaggatgttgagggctgcacccccgtctatgaggacacgccccaacttcacattgcaaacggtgggggaaaccaccatcgcgatctgtcctccccgggcaacgcacggcgggtggtcggtctggtcgaaggtgagggcaacctccgaccaccgcgcccgccgcgtcgcctcatgggtaggggccgcggccagaagctctcgcttcatggccttgaggctccggcgagaagcgtgagcgcacgctcccccatcgacggtggcgacggtggcctcaggctcctggaaccccaggtcatcgtcgccatcgttgatgtcctcggcggtggccttctgcttggcctcacctcgccggttgccggcgggagccgccggggtcttgccctcacggcgctcctgcctcttctcctcctcccacttcctcgtccgctcagccaagcttttgaccgcgcggcagtccgcgaggtcgtggagggaggtgttgtgcacggtacaccacttgccggtcgggcgctccctgctgggagcgccggcctccttctttttgtcgctcgcaggcctcccctttcggggggcccacgaagcgccctcgacggcgaggacatgaccctcgtcgtcggaacgggccggccccttcttcctcctcctgttccgccgctctgaccgagtggcggacccgggggcggccggagctgtcacaccagagccggaggagttccaggtccaggcctcctccttgcgagccacacggtccgcgagctcaaaaagctgcgcggtggtctggggctccttggaggcgatcttctcgagcatgcggttgtgccgcacgccccccctgaacgcgtagatcaccgcgtgtgcggggatgcacggtatggtgttgcggacttgacaaaaccgctgaatgtacgagcgaagagactcatcgtcccttcgctgtaccgcatgcaagtccgcttcttcacctgggcgcggatatatgccctggaagttcgtggtgaactgctggcacaaatcctcccaagagtggaccgacgcgggtggcaagttcattagccaaccccgcgcctgacccttcagggccatggggaagaaattcgccatgaccctgtcgtcgcccccggcggcctcgatcccggtcgtgtagatctggagaaactcggcggggttgacgcttccgtcgtatttttcggtgacggtgggccggaaccttgggggccaacggacgttccgaaggctcgccacaaaggctcgacagccggcaccgccaaccggggacacggggggccggcccccgtgcccggaccgaagtggcgctccggacgaggaagcgccctccattgcgtgggcggcgtgacgagcgtcgcgccggcgctcgatatcgaggcgggcatccggccccccacgcatatctccttgggtcggaggcgtcgacgagggaatggcggacgaacggcgggtaacggccgccgctcgccgcgccctccgcctcgacgacgtggagccggcggcgggagcgccagaggtctcggtggcggaggaccgcccgccggcgcctaggcgctgctgcgccgtcatgaccaagtcggccacatcatccagccaacgccgagctggagtctctggatcggggacgacgggcgggtgacgcaggagcgcgcccgcagcctggagcgcaccctggggcgtgccgccattgccgtagacgaggcggcgacgcgccccgtctcgccgtcctcccccgtcgcccgcgggcggcgaagtcgcggatcctccggcctccccgagcgcctccccccgcccaagatttcggcgagagggggacggtggggtgcgagcccgacggcgcgggttctgctccccgtcgtcaccgctagcgttcggagagaggctgtgcgcccctgcccgttcgcccattgggctgagcgggagaagcttggcgcacacgaaagaggacgagggcttagaaagacacgcgcgccccctacctggcgcgccagatgacggagcgtggggctcctcaccgggagactacgcaggcccccctttgccggttcggccgggggcgctaagtgaggttcttcgccctcgatctgaggaacgtcagcgagagaagaaatgcgcaagacacgggcgacgtagacaggttcgggccgctgagaagcgtaacaccctactcctgtgttctggtggatctgtgtgtgaaggaatccagagactcgagagcgagagagagagttcaggttctagccaacattcgccagagtcccaactcccctttcgtcctcccttttttttaggcctgggcctcctttttatctggtcaggggtcaccacatgggcctctagctacctaagaaaggaaacatgcttttacaatgagggctagtctacagccggaagtgacctctgacaagccgagcgcacgtctcttgctccgctcgcccctcttccggtggacgcccatttcaaccttcatttaatggccagcgacttccttgtcatacttgcgctgaagcctggaatgaatctgaccgggactgacatacccactcctggagttggcacgccggctccggctagggacgagagctaggaagatctcatcattccgacgggacggggcgaggcgtgtggcaggccgcctgttgccacctaacccgcgatctgaccggtctgtgaccggtcactcaccgcgatcggtcacggaccgaataagcgtgcgctgcgccgcattaaatgcggcgtggcgcgctcgtccaacctgctataaatgcggttaggtgagcccggtgtgctcacctaacccacacacgtggcgccaaaaccacagggggtcggggcaccccagccctcggggccgaaacgggagcggcccgacccctcggggagacagagggaggggtggccacgtcaccttcgggcccgactcccccgagggggtcaggccacgtgggtgaccgcggctacccaggcctctagtcacgatacccccggccccatgtcaccgacacggtccttaattgaccggggacggtactagccttttccagataccacccaaatcctctgtccgccccagtcgaaaacagttgtttaattttatttctcctttcacaaatcatgtcatcaacatcatggcaatgtggcgctcatgtctccacatgccgcatctcaattaccttcccaaaggtaattgcccaagcatatagcatttgataaatatgagtatgcatgattctagaatagcatttctaagcaattgtcatagttgactagggactcatacgtaaacatggttacaaagatttaagggtaaacaataatcaaggcatggcataatcacaagtaggatgttcatcattgcatgcaattttatttgtaaataaaacaatttcgcaattgggatcaacatgttcaaggaatagtgatgacttgccttgctcaggatagtccttattcttgatataattcttgatcaaccttcacctcctggaagttgctgacgttgcctcacgactaaccgatacataaattctataacacgcaagaaaaaccaatattcaaataacaaccaaatatgcacaacaaaatatactattcatgtcttctaatggattccaatcacgctaggggctaaggtttcttaatctttctattgtcaacgtggcctatttaggagttaaccaacatagcatttataggatacatatatatttggctaatcggtggtttagtctatcaaatggctatggaaggattatggctaagcatgcatctatctacataggacggttatttactagaggttctgttgttagatggatttaggatcaatcaaataattacagtgaatcatttgtattatttattttattgatggaagctttactttaattatgaacatattttacttgtcacaataaattataaaaggttaataattatccatgctttgtatgttagagttgtttaggttaatcatattatggttacagattatcccatcacataattttacaatgaataatcctaatttacagttgaactataattataattatatgaggtcaagatttataactagtatttatctaatatacatgtttgtcatacactccctcttaatttaatatatgcaacacgcaaattaatactataccgtaccactataatgggatgtatagtatatgtgtaagcaacaatatcttattattggatcatatatttgagtagttgctttttactgtaagctatacaatacatgttgattttaagatggctctgtttggttaactaatggatatcaaccgactatatacatatattctacttcacatgacattgtatcgacaaatttttaagtggtccaaatacaactagctctatgattactctcctaaacaagttaaagattcatctatgtgtgtttatattttagttacaaaatatgaggctaaactttatgtaaacaatttataagtcatggatttagttatatttggacatagaccagtaaatagcactaatattttcctatacacccattaatttgaaggattgattataactaatttatttagttgctacagtgacaagacatgttaaagataattatgctactgtacaatatccatttttattcattggcacactatttaggttaactattatctaatcatttgatattaattaatttataattataaatatattttgttaaatactgaattatatatcattggaaagcttatgaatttagatgaatttaggttcaagtttcactcaaatccaagttaaaatgaataagttatgctagtgtaaagattcaaatttgaattaatccgagaaattgcgaaaagctactgttcataaatgatttatttttaatccaagacatatccacagccttgtccaactgacaagtgggaccccgggtttatttctttttcctaccgaattattttctaaagggaaataggaagagctaatgacaagtggggcccacatgtcatagactcgagaccataaaacttctataattagatttttaaccacccggacctacatgtaatagacactat

SEQ ID NO: 29316 - DNA, 2406 bp, Oryza sativa
gcatcgggcagtagaaggaggaggggtaggacggctaggaactaaatcgaacacctagggggctaatgaacagtgctagccggctatttaaccctattttagcctattcctatataaattttattctataaatcctaatttttacacaaatgaagtttactcaatatttgtgttattctaaccaatggattcaccctagattaatattacccatatttatttatttatcgcacaaatgaattctttttagattaatttgagttattggccctaaggtgaacttatatatttttgaagactttggggtactattaaatttaatataacgacttgtcatgattaatacattagcagattggtcaagtttagttgtatagcaatatattttacacggataggttcaatctatttattctataaatagtaaattgagactcggcacaatattaatctaattgtttaattaaaacctcacaaaattttataaagcttaatttaattatatgaccattatttcatgtgaattggtttacctttatatatatagaccattagagtttagtaatatcccattaattactcctagtgaaactatgttatagatagagttccattataaatggtcatcatttcatgtgtatttagacgtcatggcacgcaacacatggttcacgtatttagtatttaatccataatttaaattagtaattaaccttccgtttgtctggctttgttttcttgtgcgtaattatttgtagggttaacaatattatattctcgtaaatttatctattacttaaattttagatccttactttactttctttgtgatcatttacggtttggcaagcaatagcaatcataacaaccagcatgatgtaaaagttttaaaaagttcaaaattttagtgatttttattgtcttgaattttcaggatgttacaagtctcttccaaggagttctggtgctggccgcgtgaaggaagtggctcctcgatggcttggctgatgtccattgttatatgtcagagctgcttttcgctttggcgactttcgtgtcttcagtgtcgctgcagttgtgaagtcggcgctgctgggtcgcttgggcggatagctcggcaatgataacacctcttctacgatgtgggagttgttatgtcgcttttgtgtttagcttggcggtgacatcctgcttttgggctccgccgtcgttgttagttgtgtagcggtgggtttcagccggttttactataattaaccgtgtaattgtgtggttttcaggcccggttttccttataaactgggtcaattctcttcttctaaatataaaagtggaacaaagttccgccttaggtttcaaaaaaaaaaacactctgtagaatctaaccaaactaagaccctgtatagtttcaaaaatatcacatcgaatctttagacacatgcatagagtattaaatatagataaattaaaaaaactaattgcacagttaggggggaaatcacgagacgaatcttttgagcctaattagtccataattagccataagtgctacaataacccacatgtgctaatggtggattaattaggcttaggctcaaaagattcgtctcgtggtttccaggcaaactatgaaattagttttttcattcgtgtccgaaaacctcttccgagggtcaaacgtccgacgtgacacccaaaaattttcttttcgcgaactaaacaggttctaagtgtcacattttagtttaaaatacttatattttgggattgtccatattcataatcctatgaagcgttccatcctatgaagagagtactacttttgtgttctttttcctgataattctttaacgaaattttgaccatctctctgggtttttcttccccatggtgtaaacggtaaacaggtttaccgtctggaattcatattgtgagacgcacatggtagaaaagcatgtacagcatggttcgaacaaagaaaaactaggaagttttttatttttttaaacctaaggtggaactttgtttcactgttatatttagaagaaaagaattgactgtcgaaactaggaagttttagcttaggaaaatctcttttgcaaacttagagctatggactgtcgaaataattacatttaagaaagtaaacaaattcctaacttactgtcaggcaatcaccttttacccaaagcaaattctcaattatcataattcaccgcacctgaatttgatgcttgtgtcatcatatcacagttgttccctctccctacctttcaccatcagagttttcggtgccaaaagagacacaacacatcgtcttgattcttgatttagagtattcgctatactcatggcgattaaggttttggtgcatgtggtgttttgttagcggtagtctaattgatg

SEQ ID NO: 29317 - DNA, 814 bp, Oryza sativa
  unsure (1)..(814): unsure at all n locations
cacctgaatttgatgcttgtgtcatcatatcacagttgttccctctccctacctttcaccatcagagttttcggtgccaaaagagacacaacacatcgtcttgattcttgatttagagtattcgctatactcatggcgattaaggttttggtgcatgtggtgttttgttagcggtagtctaattgatgtatgggtggaattaaagtgcagcaagtgtcataaagtgtatatatggtaagtgatacgcgagacaaattatacaacatgccaacaatttggtaacatactaatttattattgagtgataaaaattaattaccttggggctataaaaattaattaccttggggctatttaaaagtgcttgctacaacgttttgaactacaactacacagcacggactctcgacgcaacatttgaatgtacatcgtataaccgctacggcattcatttaatgagctttgatgcacgtttcataacaactcgctggctgcaagcctgtaaccgtgttggctggctgctacaacagctatatccaacactttcaaacaaccccaaaatatgtgcagaagcatgccaccaaacaaaaaaaaacccataaacacatcctattattgccgtgaaaaaacaaaatagcctaaggacagaaattgtgttaagcagctgaaaatcatcatgagttgaggatgatccgcttggttaagtttttgaacagatccgtatgtttatagtggattatctaagtgattataaatannnnnnnnnnnnnnnnnnnnnnnnnnnnnnnnnnnnnnnnnnnnnnnnnnnnnnnnn

SEQ ID NO: 29318 - DNA, 2477 bp, Oryza sativa
  unsure (1)..(2477): unsure at all n locations
nnnnnnnnnnnnnnnnnnnnnnnnnnnnnnnnnnnnnnnnnnnnnnnnnnnnnnnttccttctctcttcttttgctctcttcttttctagatccggcttctctaatagccgcggttctagtaaggattttgagaaatccggcttgatgagtattttcgggggcaagatttgaattgctatattcacccccccctctatagctgttctttgtctttcaattggtatcagagcccggttaagttcgttgtaacctaaccgtggcaacgaacgcagctatggaggaaaaatactctgcgaaaccatttgttttcgatggacacaattttgtcatttggaaggcacgaatggaggcctacctccagtcgcaagggcataatgtgtggaataaggttaaatcaccttacactgtgcccgatgatgctgacatcacgcctgcaaatatggctcaggttgattttaattatcgtgcaagaaatgcaatcattggtggaatttcttctggtgaatttaatcgtgttcaacaccacaagtctgctcatgacatgtggactgctctgtgcaatttccatgagggaaacaatgatattcaattggttcgtcagaatcaatttcataaagaatatcaaagatttgagatgcacccaggagagtccattgattcttatttcaagcgttttggagaaattgtttcgaagttaagatctgttggaaaagagttttctgataatgataatgctcgtcatcttttgaattgtcttgattatggtgtttgggaaatgaaagttacttccatcacagagagtgcacctctgagtgaccttaccatggacaagctttactcaaagctaaaaacccatgagatggatgttttccatcggaaaggcctcaaacactccatggctttggtagctgatccctctggtagtacttcttctaatgactcagcttttgtgtgtggtggcttctctcttgccgctttacactcagtcactgaggagcaattagagaagatccctgaagatgatcttgctctttttgctagaaaattctcaagagcttacaaaaatgtgagaaataaaaagagaggaaaaaccaatgaaccatttgtgtgttttgagtgtggagagcctaaccacataagagtgaattgtcccaagttgaagaagaagagtgacaagacgaccaagaagcccgagggacaagggcgaaaggggaagaatgatttgatgaagaaggcgatccacaaggtcttggcggctcttgaggaggtgcagcttagcgacatcgactccgacgacgatgatcaagaaaagggggacaaggacttctccgggatgtgctgtctcgccaacaacgaggacttcatcaacctgtgtctcatggcacttgaggataaggatgactcatcggagcatcctgaggattttggagtggggagaagtaattcttggcttgtggactccggttgctcacgccacatgaccggtgaagccaagtggtttacttctctcactcgtgcatccggtgatgagaccatcacttttggggatgcgagcagtggacgcgtgatggctaaaggaacaatcaaggtcaatgacaaattcatgctgaaagatgtggcactagtaagtaagcttaagtacaatttgctctctgtttcacaactctgtgatgaaaatctggaagttcgtttcaaaaaggacaggtctcgagttcttgatgcttctgaatctcctgtttttgacatttctcgagttggtcgagttttctttgctaacttcgactcttctgctcccggtccttctcgttgtctcgttgcctcagagaatagggatttgtttttctggcatcgacgtcttggtcatattggctttgaccacttgtctcgcattagtggtatggatttgattcggggtttgcctaagttgaaagctccgaaagatcttgtgtgtgcaccatgtcgtcatgggaaaatgacatcttcctcccacaagcctgttacaatggttatgacagatggaccgggacaactgcttcacatgaatacggttggtcctgctcgggtccagtcagttggggggaagtggtatgtcttggttgttgtggatgatttctctcgctactcttgggtctattttcttgaatcaaaggaggaaacgtttggcttctttcagtctcttgctcgtagtttggctttggagtttcctggtgctcttcgagccattcgcagtgataatggctctgaattcaaaaattctgcatttgaatctttctgtgattcttctggagtcgaacaccagttttcttcgccatatgtcccacaacagaatggggtggttgagaggaagaaccgcacccttgtggagatggcacgaactatgcttgatgagtttacgactccaagaaagttctggactgaagctatttctgctgcttgtttatctccaatcgtgtgtttttgagaactatcttgcaca

SEQ ID NO: 29319 - DNA, 17509 bp, Oryza sativa
atcattggatggcattttccttggctatgctactcattctcgggcttatcgagtttatgttctttcaactaacaaaattgtggagacttgtgaagtcacttttgatgaggctagcccaggagctagaccagaaatttcaggtgttctagatgaaagcatctttgtggatgaggattcagatgatgatgacgatgattccattcctccacctctagacagtacaccaccagtgcaagaaaccggttctccttcgactacatcaccttcaggagatgcaccaactacatcatcttcagcagctgaggagattgatggtggcacatcaggaccgacagctccccgacacatccagaaccgacatccgcctgactcgatgatcggaggcctgggtgaaagggtaactagaaatcggtcttatgatcttgtcaattcagcgtttgttgcctcttttgagcccaaaaatgtttgtcatgctttatctgatgagaattgggttaatgccatgcatgaagagttagaaaattttgaaagaaacaaagtttggtctttggtagaaccacccttgggttttaatgtgattggaacaaaatgggttttcaaaaacaaactaggtgaagatggttcaattgttcgaaacaaagccagactggttgcacagggtttcacccaagttgagggcttggattttgaagaaacctttgcaccagttgctagattagaagctattcgaattcttttggcttttgctgcttcaaaaggtttcaagctttttcaaatggatgtgaaaagtgcttttctgaatggagttattgaggaagaggtctatgtcaaacaacctcctggttttgaaaatccaaaatttccaaatcatgtgttcaaacttgataaagctctttatggtttaaaacaagctcccagagcctggtatgaaagattgaaaacctttttgcttcaaaatggttttgaaatgggggcagttgataaaactctctttactcttcatagtggcattgattttcttcttgtccagatatatgttgatgacatcatatttggtggctcctctcatgcacttgttgcccagttttctgatgtgatgagcagggaattcgaaatgagcatgatgggagagctgactttcttccttggacttcaaattaagcaaaccaaggaaggaatctttgtacatcagaccaagtactccaaagagctcctgaagaagttcgacatggccgactgcaagccaatcgccactcccatggcaactacttcatcgcttggtcctgatgaggacggtgaagaagttgaccagcgcgagtacagaagcatgatcggctccctcctctacttgactgcgtcaaggccggacatccacttctccgtgtgcctgtgcgcgaggtttcaggcttctccaagaacatcacatcgccaagcagtcaagcgcatctttcgctacatcaagtctacacttgagtacggtatttggtactcctgctcttctgccctttcagttcgagctttttcagatgctgattttgctgggtgtaagattgatcgcaaaagtacttctggcacttgtcattttcttggcacgtctttggtctcttggtcctctcgtaagcagtcttctgttgctcaatcaacagctgaggctgagtacgtagctgctgctagtgcatgtagtcaagttctttggatgatttcaactctgaaagattatggtctgtctttctctggtgttcctctgctttgtgataatacaagtgcaatcaatattgcaaaaaatccagttcaacactccaggaccaagcacattgagatacggtaccactttctccgagacaatgttgagaaaggtaccattgtgctagaatttgttgaatctgaaaaacaattggcagacatttttacaaaaccacttgatcgctctcgttttgagttcttgcggagtgagttaggggtgatccacccctatggcttgatttgagggggagttgtttttcttttgcatgcatttgtaacatattgcatcatgtttactttatgcattgtattatacactcttcaattgagctttgcttgttatctcttggtcatcactatgctatgcatgtatcactcttttgctagtttgatctcttgtctagctttcatttgcttaagtagcttgtgtgatcatgttatgctgttcaagcttgttgaaacctgcttaaattgactattcatttgaacttaatcaatgtgcaatgcttgctctagaagtttgtttaaattgaagtatccctctcatactcatgccatgtttacattctttttgcaataactgtcagtacatgcttatgaatgctcatgcttatgcgtccatactttgtatcaatcatgctttacaagctttatctctgtttttgtccgggctactgagtgcgtttacgcatgagtagtgccgaagatagcactgagacagcctgtaatgggaactctagctggaacacttgattgaggtcagacggcagtgtttggcacaaccatcacttgctgactgataagatcaggtggaccgtcgtgattgtgctattgtctttaaagaaattaaaaaacaatcttaaaaataaaagtcatgagaaaagattaaaagctcatgttctatgctttgttatcatgttgatactctttatgaactgggcattagcacattagcatgggttcattgctttgattatgtaaatcttgcatgattatgagctggtttgcttccttttaagcttcttctagaaatagctttgcacactaaatcactaattcacttgaaaactttttgcttgctggcgatactaacttgatatccatgacctgtttcatacttcttatgcacatgcttagctaggcttgagcacatgcttgtatctgtgtgatccatgtctaccttttgatgcctttagataactctcaaagctctcaaaacactaaaatttgtaagtttcatctcatttttatcttgcatttttgtctcttttgatcttgatggcatcattgacaaagggggagagaaatttgcacttattgaaaattaaaaaacttgctttagatcttggtgaaagggggagtttggcacatagggggagcattcttgcatttgcattcgcatcccttttcttcttgtcacttcacttggtcttgatttttcgcgatttcaaaatgaccaaagttcgacgtttgcaaaatggtttgctttgtgaatcaaaaatcaaattttcaaaatttttgcttgggattgtcaatgttcccatcaagggggagattgtgaaaccatgtgtggttatagttcttttgtgatgggaaattgacaagtaccggaagtgcaagaagtgtgtgcgtggactaacattggtcagattgcgacatctgtgccaagacaacggttgtttggttcatgtgtgtgcaggtgatcggggtcgatcttggtcaacggcggatcgggactagactcagggaggagttgaggtccaaagcgatcaaggatgccgggtgacaagattggacataaggttgcacacggtggacgaacaccgtgtgagggtcttcgcaacggacttcgcaaggtcaagtgcaagtgccgggttcgcgaacagaatggagaatggaagaggagcttgtatacatgcactggcatgtgcatatgcaagcatggacagtggtgcttcggttgtgcatgcgtgcacatggccgaatgtcatgcacgggcgcaagacatgcatgtgtgcatgaggagcttgctagcccatgggtgcatgtgagctgtgattggttggcagggaggccaagccaatccagcccttcctcatggctcaagatgatggatggatcagcaggcagggaggccaggccgagcaggcccaagacaagacgacggcccacggcattggcaccatgcgcgggcaagcgcgggagatcgcgcgaggcacgcgcgcgcagtggacacgcggcggcaaggaattcggcgcgtgcgggcgtggggtccacgctgtttcaagtggctcggaggcgggagttgtactgggacccacgcgcgatttcgcgagcatgcgtgggagcagctcggcgggacgcgtggaggctttggactggatgcgcgcaggtgagcgtgggatccacgcggtggagcgcgcgctctcgcgtgctgaggcgtgacgtggcagctcgtcactggtttggagagggagcacgcggatcagtgcggcgtggagagtttggatcaacgacgtggcaagcatccaggaggcttccttcggttctaaggaagaatgggtggaccagatccattctgagttagggtttcgccctaggggtatttgagacaatgtcttaggggtcttagcctataaatagagagatggatgcaagggtggatgttgctcctttggcaatccttttgagatgctcggtgagagagtttcggtgtgagtttggagtgtgtttgcccgagaggcttttgtattaggattagtttggagtgtgtttgtctgagagattttaagtttgtgttaatgttcctctgaaggtgtatgcttgctcctagttgagcggttattttgcatcacctataaatgaaatgatttgaaggatttcatttttgccttgtccatttaaattccgcaatttaaattccgcttgcaatttgaactttgcgatgatgagttttgctctctcttcctcacctctcttctagtttcgggaattccttttctcttcctcctctagtttcgggaattccttctctcttcttttgctctcttcttttctagatccggcttctctaatagccgcggttctagtaaggattttgagaaatccggcttgatgagtattttcgggggcaagatttgaattgctatattcaccccccccctctatagctgttctttgtctttcaagtttctcctatccatatgtgaagaacattgtttaagtgtaataatagcccaacaaagccaataatggtcgttaagagcaataacggccattaagttctaaaatgctatatttgttgtgctacttgtagtggttgcaatagaggttgctatatactccagtgtaaaaatccactatcgttataatgaccgctacaaaagctatttattacctcgtttgtaaactacacatatatatacatatacatcattttactatgatagtactatgtatgaagattgatgtcaatgaatgggagaggcctgtgggttgacattttgagaatgaacgccgtcctttttgacaagcttgagtcagtgaagccctctcatctcatccctagcttgggttgggtttgggtatagcaagaatgactttgcttgctagctagtgctgcatgaggacaagggacacctcttacaaagctagcagtgctagtactagtgtatgtgcttgacacttaagatgatcagatgtgtaagaagtaggtgttcagctagcctatgattgaggaccactgattggcaggggtacgttaatttgctttttgaggtagtgttgtttttttgcacaaagatattgcaagccccatgtatatatagtttggacagatcacagagatatacagtgtctctaagggacgccggtactccctacttacgtcctccggtaccctcgcacttaaatctaattataaatattggttgccagatcaaaaggcacaaactaatgtgaaattaattagtccaaatatgagcacctccatttctgagttgaatgtaattcttttttttaagtggaagcggcaagagtattgccgaatatattagaatgatagagttgaccctgtttataaggaacgggcccaaaaaccatacaactgcacggtttgctaaagtgaaaccggcaaaaaccttacacaaaagacacagaaagcctgaggcaaaaaagattacgaaccgcagaaggccgcgggaagagcaaaaccctaaggcgaagcctccgaggaggtgaacaacagcaatgtaattctaaaactagcttgtatgcaattatagttccaattggttaaaagttacattgaaactacataatatcagcagagctttcactaaaagagcttacacaagccacactatacatacccttaatgaattatcatgttatctcatctattcatctaaggtcagagtaccaacaaacacattatcatctcatgacaacgatgagggagaagggaacctatctttcgttttactcatgtaggtcttccatccctaagatcttttagtgtttctttttttagttctttgccgccgacgactacatttatgaggtatacttgcataataaaacttgtttattgatgtgtcgattaaccaatattgacacgatcgagttcggattttgatgatccaactatagctactttaactagttttgtttttttttcggatttaggcagctagccggataatctctactaagaaattagaagtgtttccgtcgtccgttcatgaaaaaagagcggaaaaaatcgaatccgattatatgcgacatggtaaaaaaaatgtgacacggtaaaaaaaattaaatccgattccgtcgacgcggtaaaaaaaagggcgaaaaaaacgaatcttttcgattttaaaaaaagaaacaaactcccgtctgtttccaaggaaaaaaatagaaccgctggccatatccttttgggccgaataggacttggtttgaattataccaagtcctattcggttagcatcaccaggaaaacaagtgcatatatacacacacacgtagtataaagaatcacaacacataacaaagaatcacagacaaccttatagcacttagcactgaggaatattagtttataaggttgctgatgaagattttgccctaagtgaggaaaattggtctcattgtattaacccattaaccaaggtaataaatagcaaatagcaagctggtagaatcatagatagcaggtatattattatgggcacaaatttcaacagaagaacgaaaaaaatatcaccataagtttagattatatatcaatactaacatcgggtttcacataatagcataagaattacaaattaacataaatgaatgcaatataaagaagacacacgatgttaagttcttgtatatatccatgcacgaatcaagaacatcgtttatatatgtatcattcgactataacgtctatacgcgttcgttacatgtgagagacacacgtttttcaagtttttgaatgcagttgatatgatcaacttaacggtgagcattgacttgtttttttcactcggttatgcatgcattcatacacaccataattgcatatgcatgcgtactgattgaccatatgatcgagatgcacatgagctttttgcatcgttgccctgctgcagatgactgcagctatcagctgctatgcatgctatagtttagtttgtggtccgatcaagatcgatcatacatacatatacacacacgatgcataaagcgatagatcgagagggttggatacttggatcatggtgagggagacgcgcgtatacggggcccaggagatcgatctatcagttctctgaatatatatataaaaactttggcaatgcagatgcagatgccagtgacacccccacacatcatcagatcgatgcattatgcacggcattcatacaggtgatcgatggatcgatgagaaagagagaaagaaagaaattaaaagggcatggcaatggcatgcagctagctgcagcaagaggcagccagcgagagaggtgcatgcagtggcagtagcagtgtatatatctgtgtagctaatgctgcatgaaatggcaggagtatgcagggccaggggggcgccaatgcaatgcaacactagaggtatctctatcgatcaggaggctcctgcttgttgtcttctacctctggcctccctcacatgagatgagagagacgacgacgacccctgagagctgcaaacctggcctgcctgcctgccctgctgcccactgtgcaaatctttcactactcctcctctccctgtcctttctttctgtcctcttgccctgccatccatgcctgctcctctatatgcatccatctcctggctctaacttgagttacatccccttaattaatttggtcaaatgttagttagttgtgcacaattacaacaagtcgatttatgtatcgtttgaatgatatatatggggtgaatagccaaagtggtcctccaagtttcatctgaggcttagtttagtccttaatgtgtcaatttgtccatattagtacttcaagttttaattttagttcaaacttatccttgaacccacttaaaagccacatggctaaacataaccaacaactctctcgataaatgacacttataccccatcatacacttatataagagaaaaaattgcatgcaatgaattttttttatagataatgcatagtaagttatgtacaacgaaaataaattatgtacttgcaagtgtatacgatagccattaggttaagtttcatgtgcacatgttgaaagaatgggaattacatatgcaacattgtttattcatcttggttttctcttttctattatatagttgttacaaattaagggcaaaagggacattttctaatagaaatgttaactagaaatagccatataacatattaagtgggtaaaaggatgagtttaagccaaaacaaatatttagaggacctatgtggacaaaacgaaacctgaaggatcaaattgagccttcgatgagacttgagggactaaattagctattcacccatatatatgtgtattgttaaccaagattcgatgggtggcttttagcaagcataacatgaatatgtgacccatgcatgcatatcgtctagctagggacacacacttcaacctgagtcctgatatatgcatgcttttaggacccaacatccttgaatatatactgcctctgttagttatcttagtacagtgtcacacatattttagaaaacatatacacatgtttttaaaaggagaaattttacgtttcttgagaaaatatctcgaggtaaattttgcactaaaaattttagtacctcgagatacatatatagtatttggaggtactatttttttttaaaaaaaaatgataccttctggtaccttcttaagaatgtcaaaattatccttttaaaagacatatagtaattgtgtactctttatcttgggttggcagtttttaggttgtttcttcttgatggttggtttcatcttttaagtttctttgaacttcatttattttaagtgtgagattataataattggctatagctctttgagcaaaagccagtatgttatattccattatctaaaaaaaagacatatagtaggccaggtacatcagctagcatccaactgatggaagatccaaatggaaaatgatcagttgtccatacacatatataccatttcacattaaacatgaaataatctttgacaaatttaagcatatgcctgaaaaggtttttcatctttaatttgctccctcgagtaagtatagggcctccattctcttcaactcaacacaaattggagtatgttgtggatgtgagattttgcccgattatatattcatgctgaaatttaactactcctaattactctgaaagttctacaaattaaagatcatgtgaacttttgctaggggccttaatttagtgaggaaccatttttgttcttttacttgaaaggaagcgaatacaacatgggatcgagaaaaaatctatagttagctatagcacgagctctaacaaattttgtaagagaatgagcggaggtgggttagatattaatgatattttcccttcatcctaaaatataagcattgctggctatgtatctaaccagtgtttaaatacataggcagaaatgcttatatatattttttattttcttattgtccttactcttagggtattatatgtctcccaagcatggaaggaacgtatcgaagattggctaggagtaaatcaaccggtgtttatatgaatgttaaagcaggtttcacaaaaccgactagttctttcttattttcgtacgacatttacagaaattaagttgtcggttttcaccagttttttggtaaactagtgaggagaggtttatattttcaaaaggaaaaggtaaaccctaatcttgtctttggccatgttttcttgtttgatcatatctcatcccctaccaatgcctacatttaatttgtctgggcttacatggccaggccaagccagtgctacaaacctgcttgaatgttgcaacccattgtagtgtgtgtgactgtgtatgtgagagagaaagagtgggagagagagagagggagagggagagagatctcacatgaaaaccatgtatgtcaatgtcattagcactatccaacacaggtcctatcacttgtactggtgaaggtctcggtgtctcacattttccatacacacatccctccaaaggcactttttactgcccatgtatcctccctggcctcctctaccctaaactcccagtacttgacaacagctcttcctagcatgcatgcatcctactagacctcaaaggctaagccatatgcatgcgcctataggggcccctagcttgtgcatactctttctcaactaaattcagaaccagggctttgtaagaggtgcccttgtctttattaccttaccctctagtatctctctctctctctctctctctcttcttctcaagagctctctgcaatgcatgcatgcatatggcctacacaatgcaaccacaggttgaaggagaaagatgcaaacaaaggacacacataggcctataacctacactagatgatggatatgggtacagatgtgtgtgcgcatgcatgtgtgatgtttgtgtgtttgatccctttgcacaagatctaaagaaaaagagggcgtagcttactctatttaatgattcaatatatgcaggagagaagagaggtctcactctcagcagcatgcatatctgctgctgcattgctgcttacaaagtgatactacagtgcagtgttaagagagtagtggtgctgtggctgtggggctttctttcagctcagctcagctgccctacagctaatagtgtggacactcacctacacatattgacatacagtcatcgccataccatacgtcctcttctctgatcctcctcgatctcgatcgatcgatctctctttggatagataataataacaacgcaacaaatactgcattcctcgcacttggattacagccatcacatactccaagaatcatatatgcacaggcagcatcttactctctcactcttaatcagatggagagagagagaggggtagtagtggtagtagtgtacgtaggtgtaccagtgtatgtgaatgtgtgacaggagagagaaagggacggctgtgcagaggtgaactgatagagaactttcaggcttctctctcccccagctaccaagctctactactgcttctctcactctatctacaccccaaaccaacacttttaagacagccgttccccaatgcatttgctgttcccaaactgcagtgtctttttgcttttgtgtcatgtactaaatcaataatacttgtactcttttctctctacacagtcaggcacatcactgagctgatgagagctctactcaacgcgtctcaagtcgatctcaaaccccacacacacagcatccgatatatatctcgatcccctcttttctttttcttccggcctctccttccaaaagcctcatttgcatcatagtgttcagctgtttctctccctgctgctctctgctccaccatgtaagaaggagcctacaagcacaactacccctcatgacttttttgtgtcttcttctattgttcatctccatgttatgtacatcttccctctgaaacactgctgtctttgtgtgtcttgtttatatgtgcacatatcttgtcttgttttttcagcaatttttttttccaaacagtcactcttggatgtgtctgtttgtgtgtgtaaatccgatattacctgtaatcttttctatgcatacatcatatatacctgcatttttactactagctcctgttacttatcacaactatctagcctactatggatctccatgaacagcttgttttctactatgtcattctagtactatataaaactactatgcatagattcattcttgctgtcggcacagtgcactactacttgtgttctatcggcatcttgttgggctacctcgctcttgagttcctgtgtgctcatcattgtgcaaacaggaacttgttgatccatctgtgaatctgtatcttcaacaagttgtatatatacgtactaaatggtttcctcttcttcttcttcttcgctatgaactcatcaaggagacaagaagggagccccctggacctgaacaacctgccggatgagttcggcaagcaaacggtggagagctcaacgaccaccgccgcatccagcgccgaagcatccagtaaggatatcactgcaacattcataaccagcaaatgctagtacatatatagctttaatgtagagtaaaaaagatagatttttgttttgtgtgtgtgtctgaatgtggtcatctacttaaaattttctcctgaaccgtctcgatcattacatggaaaaaagaaaaccttaattgttgcattttagataaaggaagtacagttacatagcttcagaatgggataactgaatgattagctaattgtttacaggggttactaagaagaagagtaatggagggaaggatgaagctggcaaggtgtacgagtgtaggttctgctccctcaagttctgcaaatctcaagcgctgggtggccacatgaatcgccaccgccaaggcaatatcacacaacaacctacctagctatataatcgatattttttttatcaaagaaccaatttgatcgatcacaaatatatgaagaagttcgttttttttatcttccacgcatctaatatattctaatccaacagtaaccatttatatccttaagaaaaagattcaattttttgatcttccatgcatctaatctcgcattccctttgcctctaacttgtgggatattgggatttgatctttcagagagggagaccgaaaccctcaaccgcgccaggcagctcgtcttcggcaacgacagcctcgccgccgtcggcgcacagctcaagtatgcatatcacatcgatcgatctaagcgtgaattaaatctccattaatttgcaagttgtgtcgtctcgcccgatccttcctttctcatcatcgactagggtttcttatgaaagctttcttgctacagtttcagggatgtgaacatgggaggaggcggcgccgctgctcctccaccgacgatgcagatgggaggaggaggcttccggggaggcggtgtcggcggcgacccgtgcatcccgctccggccggtgcagccacggctgtcgccgccgcagccgccgccgtaccaccactacctctacacgacgacggcgccgccgtccgccttgcacccgatgagctacccggcgacgtacccggccccgccgcgccaccagcagccggcggcggtcggcgactacgtcatcggccacgccgtctccgccggcgacgcgctggtggccccgccgccgccgccgcaccgcgccagcttctcctgcttcggggcgccgctcgccgcgccgccggcgaacgtgcagcccgacaacggcaactgcaactgcagcttcgggtgcggccacagcaacaggaacgtgaacgccgcctcctgagctgacgcgtagtatttactgcgtttgatgtgattgcagttaagttattgttcatgtaaattactaagagccaagaaattagaagtgttcgtgatcgataggcgatgtgttaatttggggggcaagagagatcgagatcgatgggtagttgttcatgatgttcagttttacctttaaaatctactgctaagtgaggtacatgtctgcacttattggattcatgtatggtaatgttgattttttggtgtgtgagtttttgggggtgtttttagttcagatatggaattaatttaatcaactgtgtagtagtggagagatgcattgatgtttttgaacgcatatgattctttaaaatgtataaggctgatgaccaggtgtttttcttatgattttatgaacatatatattactagtagtacaaactggagtacttacaaaagttaaatgggttaaatatgtactggtagagtatattttgaaccaatgtgaaagtctcattaaaactactctacggttgtgtttagatccaaactttggatccaaagtttgcaaaattccattacatcaacctgtcatacacacacaacttttcaatcacatcatctctaatttcaactaaaatctaaactttggatggaactaaacgcagccgtttaatttgagctacatctatctacatggtactgtgggtactgaattattctgcagttttgtgctctcttcactctctggccttccctataggtgccgtactagtacaaataaaatacgagcagtcaatacacgaactcatcagaacacacatcacatcacattgaacttgatttgacataggcgccgcaagtcaacccaggctaacgatggcataattatagctcattcaagtgtttaaaaggtgatcgatatgaacaagtgcctgcaggtgagtgctgactctcggggaagctactcctagctatagatcctgatcaggattttgaatgcagtgccactagctttgaccaatgttcttgatggaacagcaaacttttttcttggttgctgctgggcttagggcctgtttaattcacgaaaaaaaacttttagggtgtcacatcagatgtttgaccggatatcggaagtgattttcggacacgaataaaaaaaactaatttcataactcgtatagaaaccgcgagacgaatcttttgagcctaattaatccgttattagtacatgtgggttactgtagcacttatggataatcatggactaattaggctcaaatgattcgtctctcgatttcctccctaactgcgcaattagttttttaatctatatttaatgctccatacatgtgtccaaagattcgatgtgatgtttttgagaaaaaaatttgggaaactaaaccaggccttatttctgatttggcccgcactatcatttctaaaatgaccagtataataaaaagcccaacagcgaaatccatcggatgtataagccccggtttgtcaatcaatttccctttactacgtatacaattttcaaaaaaaaaaacactacatatacagtttaatcgtttggcctatagctgaaaaaaaataaaccttttatctatgcattcttagtgatataaaagctaatgttgaaaataaaatacaataaaaacccatcaaaatcaactctaaaatttagtttcaaaatttaattattagttgcaggtgataattaagtcaaaaggcaaacaatgatgctgatgattatggcttctttggatggaggaaatttataggattttttcctatattatactagtaacacccttcagaacaatatgattgtagtaaaaatttgtatggattaattgcttttctatacccactattgcataggaattttaactcgagcttacaccttttttccccattgctaattaagtccaatccacaatctcttctcctctctctctctctctctctctcgtgtacgtgattttctccaaaaatgccatccaaagacgtgttcgcgaaaaaaaaaaccatccgaagacattacctttagtgtttctatgttttgaaatcttgtatacattgcttaacattgacaatctctgttcctatgtttttttttctttttccgcatattggaaatcctatgttccaaaagaaccccaaatgcatgcttaataaaaatcatatgcccattaatataagtaacaagtatacttatcgacctgatcacctgtatacatttcaatgaaaaatgctactataattaagagtttaagacgtacaatatcccccacacaccacaatacacacactactgttacaggtagtcaggaaagtcttcacatagctggcgtatgtgtaccagtgtattaattctaattgtactgtgctactcctggggggttgggtatagtaccatggttgacatctgacagcataagttgtatttaactcaaccagtgtatatagtacttctccattatcatggatttggacagtagatataatgaatttaattagtatccatctctacaaattagagttctagctggttgttgatgaggaactagctctcgtacctcaaaaaaaaaaaggaactagctctcaatcttctgataggtattaataactctcgattcgacggatactttgacacacacgatttgtgtcttccaatcaatacgatttgaacctggcaatcgcagcatcgcttctcctctggtcattaattgtgcactatccggttatcaacagattgttgtttgcctatctctttgaaatcaaatcaaattacattcggaaatttcgaatgcaacttggatttggcccctcatatttgtatgttaggccagacactgtggatagacatggcttatcatgcaagtgcgcatgccatatatgtgtcgtcactctgcaccatgacaactaggcctgcacctattttttttccctgattacatgcatggaggacatacataacacacatatcacggtacacacgtatcccacaaaatacaaaggtatggtctctacgttaattaaaggttatcatgttataatagttaagacaatacagtctctaaccattaatataccaaaatacttttttactagtcacttttcctttatcagactcaatgcaacaaaaaaatttctaataaatgctacgagtcgactctatgcagttgtcatgcgtagcaaccatctttctattttcttcttcctctctctttcacatcaccaaaaatgcttgcatgacaataaagagagaccgctaataaagaccattgtacatgccctaaatacagtccttaattaacaaatgtacaataaacggagttaggaataaatcagttaacataacgaatatcctactgaaattaaacacataaatgatatgagcaccaagatttaaacaattgtggatagatttgatcagtcatgcacctactattggtatcacactgaatgtttattcatgtgcaccccacgcatgcatatactaattgaacaattaatacaaaatagaaacacatgaaaactaaagcaagaaattaagaattttatgtattgaattaatctttaatgtattttagccagattaaatttgtcaaaccaggaatttagttatcagataaaagttttgagatatgatcttagtactccctccgtccccagatataagggattttggatgg

SEQ ID NO: 29320 - DNA, 1852 bp, Oryza sativa
  unsure (1)..(1852): unsure at all n locations
cacacaaacacacgcatgtttgcatgtacaaatatcatgtcgaatcgccgaaatcgacttgtcagaaaagctacggccgcggctgctgcctcctaatataataaagctacactcttcgcttccgatctctagctagctctcagtcctactacacactcaactttaatcagcgatgtttgcatgcatgatcacaagattgatgagcacatatcgatcagtctatacatctacttgcatttcttcaggagaattattataacagagacgagaaactaggcggtttgcaatgtgtttatggcgaagcagcacagcacaggacatatgatgcatgcatgcacaaccgcagctacaatttgtactgcaacacaagagagaatcagagaagagagtggatgggtgctatagctgcagcttgaagctaataggtagccctgctgcacaagcacaaccctaagctctgctcatatgcatagcttctcctctctctgctgtcttctatacgtacacgcaccgctttcttctttatgatctttagctgctgtatgcctgtatctgcgcccccatttggcacacaaattaacaagaggaacaatccaagggcatggaaataaatcttcaggatcgcacttgcaggacatggccatatgcctggccgatcgagagaaaagggaaagagaagaaatcaaggattaagtgagaggcagcaaacaatgtacgtagatacttgaacgtaatgctaggtgctagacttatgtgctaaactctgaaataacattttgattcctcctaataatagaagttattaggaaatatgctatttcgaagaaaaaaagattcaggaaaacataaacaatatcaatgacaagttcatactctctccatttccaagtgtaagtgtttctataattcaaattttatacaaaatataagcatttctggcacatttcaaatgcacaggaaggcaagcattttcaaccaatcagttgcttaggagagaatgcaagcaatttaaagtttgaccaatgaaattacggaaaaaaaactaaccctcttgaaaagcttattttgagaataaaccctgctaaaaacttatttcaaaattgaattgtgacactaaagtccaacatctcagcaacctaattgtctctatgacactgggtccgagatggcagaccgagttccaagtgctatggtgctaaccatggaacctcagtgccaatggacatagcaccgtggtaggggaatgtggccaggagctcaatggcggtggtgacctctagatcgatcatgcagtggtgtcattgcttcgattgatgttccaacaccaattgactccggtgctgctaccgatttcttgctcttccacatcgccattgtccttgtcgagtctcgtcgactctagcaccactacgagctcgttgagatccagagcacaagcttagcctcctacctcagcgtcatgcttattggcgttgaggttggaagttcaatgccagagcacttagagttgaccacttgccacgttgatcatccagcttgaactcggtgccatgatagcagggggttaacactagcgtgactggtgctgagacgttggatcatagtgtcatcgggcttgacgttgagttcgtggttcattttaaaataagtactggcacagttcatgtttgaaatatttcttttataaggatcatattgtcaaaaacatctgcaaacttccaacttttccatcacatcaaaactttcctacacacacaaactttcaacttttccatcatatcgttctaatttcannnnnnnnnnnnnnnnnnnnnnnnnnnnnnnnnnnnnnnnnnnnnnnnnnnnnnnnnnn

SEQ ID NO: 29321 - DNA, 5414 bp, Oryza sativa
  unsure (1)..(5414): unsure at all n locations
aaagagaatattttctcttatccttaatctttatagtaaataacctacaaatgtttacatttagtaacagagggagtaagagtaggtacgtgtgaatgaaagacaatattgtacattacagcaaatgatagattctactctaagctataatctcatgacaagtcgaacctagcttttctgtgtcgctatagctctccgaagctgcgctagtggccttgtcgcgcaattgataaacaacaaaactagctgagatttatttactttggtaagccagtgggaccctttggcatggcttctcttgagagagagacatgcagctagctgagagtatgtactgggtcccatcgatccccatttgattctgatgagcttctgatagatacctctgggcacatctcatgtaggatcggagtagatgaatggtccagcttgagctcggtcttgaaagaaaaatactataccatgctgcagttgctgtccatctccatgcaatgcaatgcagtacagcagcagaaaacgatcagaccgtagcacttgtggagtgctgtactgagtcaggtatagtagccgactatgcacggtgaaaacctacaactatacacacgtacgtagtatgcgtatgagtagtgtagactagtacgatcgactagtagtatacaaccaagagctagctagcgctttagccagcacagctagccagtgtcgttgttcattagtaccagtacactatcctccataatttactcgactatagcatagctagtactcctatgctacagttctcaaatatggacacttgatcgaccacggactcacggagagaatggtcatgctatggatggttggaacctaggaatttctcaggataatttcctattaggcaacgtccgttcgtttgttttcttgctggtcgatcgacttcggttttcaagtactctctccttttcctgaatacttgtcgattttaactatgcgtataggttaacttggaccattgttggagaaggttatatttttgggatcctccctccctgttagatccataaggcacaattactgatcaggacatgagttctaaactacggtagcttgccgctatgagagcctcaattattgggccaagcttcatgtcccatctatagatggccatctgggccacccggcacggcacggcccaagcccgcccggccgtgcctgggccgaggcttgtcgggccggtatggcccgaccgacgcaccgagccatgccgtgccagcccacgggcggcatacacggcccaatactactcggaccgtgccgggccggcccaccgtgacaagggtgcaacccaggcacggcccggttgtcgggccagcacgggcacgaccccagtcgggccgtgccatgcttgggccgggccaaaattgcgggctttgggccgggccatgggcctcgggccatatggccatctatagtctcatctacatgttaattgatgtcagtccaaagcccaaataaccgccccgctcaaggcatgcataagagtacaagagcaccccaatgcgagcccacttagtatgtgtgtagatacatggtaaatctccttatccccatatagtagtactgtaatttctagctatgaatctaaacatatatactagatctagtttcatatatagccagaattagtttagagtgagttgcactttgggccatgttttattgccaaagcttcactttggacagccctattgctccaccgccacctaaatctccactgatgtcattgtttgcccttgccgccgcctccggctcctctcccatcgatcgaagtggggcggagtggtaggcaaggaggatgccgcccctactccccactctcctttcctgcggcctcttttcctgtcacaccccaatctggcaccgccgtacaacggcacctgacaggagcgtgtcgtaggaaaacggcatgaactgcgtcctacgaaaccgcgatctcagtaccagtcccaggacatagcgctggtacccacggtgacaaacatgaatcattgcaaatccttataattaatagaggacttatttaccttaacttaggttgcagctcagacagcccgagaatgcaactggcgacacggacgaggcaaacaccaacaacagcagcagcagaggaaccaaccaacggactaacacccaacgccacaagcaacggcaaggaactaggacgaaaccctaatcttcacttcacttcaacttcatcttcggagctggcagaactatatttatatagagagcaagggtgagtacttacgtactcagcaagccaggggaacttaggtggttaatgcaagcttcaagggaaggctgtttatttagcaatcagttttgttttcaaggttttcaacaatctaagtgtgtgctttccacaaccagagcgagacaaagtctcagctcggtcggggtgagaagtaacaaatttatttatcaagatttgcacaactccaagagttggcttcaaatctagttttcccaaaccaaaccaattttccaaacttcccgataatagtggtccccaaacgaccaatcacttccagggactcccggtcccactgtcccccggacagctaaatgcttcccaagcattaggtttcccaaaccttaacaccttttcataaaacagggtaaaacaaaaactacgctaaggaatcacctcacatccgcccatgaccgtgggcacggctgttcgaatagtttaataacctctgcagagggggtacactttacccacacgacattactaacctgggtcacctagcccgtgcagaacagccacgtctggcgactttgaggctttcacgataaggtgtttccaaagccgacacagggttgccatatgccaatgagaggggtcccagaccaacaacaggttaggtcccagaccatactgtgccaggaagcccgagggttctccccgacaccaccccgttgaatccacatgtctcttggcatcatggttcccctaattagctaattactcagccaggggcgtcccattacacccatgtggtcgcactgttgtattctcggatgtaattccgaaggaatcggtccttaaatgcgaccgcacaagtattccacccaggaatggccttgtgtcgcgagtttcatttttaaaactcattttctttcacaaggcaccgacccaggcgtcgggttttccaaagattttgtaaaccaagtgttacccaagaagttactcaaattttaagtttgaaggcgaccgtcgatactcgcatagagtgcacgaattatcgaggcgcaactagatggttacaagggaacatgatataacaattaacaatagaaggatcagatgcaacaagttaggtaggcccaccggtctgccttgcagacggggcaaacagattaagtgcaatcctatcaatgcataatattttgcaagcaatataattaagttcaaatataggctcaatatgttcaaaggtggcttgccttgctcagggtcttcacgaagcttcacaaatcttcgagaaatccgcttgaagaaaaatatccgataaccgcaactaggcgcaaacaatcaaaaacctaagcaaagaccaaataaaatgtcctatttaggctaattaatagtgccattagatagatcacaattcaatggaattactggaagtggaacggaggcaatcggacgaacggatcgagggatatgaattttggaagtttaaatgaatttttctggacaaggagacgatttgtcggaattttctggaatacgagaaatggtttatggaatttatagaaataatattctcaagaatattattgacatccactgacatacaggctcgaggggacgaattattggaatctccggattaagaggatgggtttatggaatttggaatataggaaatgatttattgaatttctagaaaagagaaatatgtgtggagtattgaaaaagatattcccaagaatatctttgactcattgacacgtggggccaacaagaaggtgagagagagagaggagcaattggagggagtaattgtggacttttagctcttgggtgatggacactgggcttggacgaagggagtgtatatggactttgtttgtcttacttatcaggccgaggaggagggtggctactgggccaagcccaagagcaagagagagggggcggctgctgactgggcgtcggctgacttggtcaagcggggccgacggctgaggtggcgccaacgtggacgtcacgtcggatggggaagggagaggaggccgggcggctcatcggacggctcacggcgggatccggcgaacggcggcaagccagaggggcggctagcactggcggcaggagaaggagaaggggaactcattccccggctcagatcgggaagacgacgcgcgacgacggccgccggcggcggccaatctcgccggcacgccgacgtggccgcacgcgagaagagcgaagggcacgcgggctcgggcttagccgaaccggtatggggttgcgacgcgcacgcggtgacgcgggacctgatggtcaccggcgacgcacgcgcggtggcgttatgcggcggcggaaggggcgacacggcgcggaggcaaaggagaaggccgacggcctagggacagtcagggggagctcaaggggatctccgggagcgtggcggcgagaggaatcggcgcgagaggtgccgacggcggtcgattgcggcggcggcaatcaccggcgagcaaaaaggggaaaacacaacgagacgacgaggattcgattcaaaggggtgggagcatctccggggttcaaggaatctgtttccggtgtcggatggggcggagaagcactgaggagggccggcgacgagcagcggcctccgggagcggacggtaatggcggtgaggccatgccgggcgacggcggtgctagggaatggtttggggaggtcctagggagctcaaggacggtgttggcgagggtggtcgacgagctggggcccgacgacggcgcgcgactgcgcgcagcggcggaaacagagcaacggcgaggcgcgcggcgcatcgtgcggcaggctatggcgtgcagcggcgggcgcggcatagcgagcggtaagaggaaagggttcggcggggagctcaccgacaagaggaagcggcgtcggtggatcggagagagtcgtggcgaggtggtcgcgacggtgggacggcgcggcaccgagtgggcgcggccggggaggaatagaggagaggtggcgcccgtagctcctcgtcacgcgcccacgcacgcaccggttcctccggtgctcggcggcggacggcgacgacgagatcgagtcgagcggcannnnnnnnnnnnnnnnnnnnnnnnnnnnnnnnnnnnnnnnnnnnnnnnnnnnnnnnnnnnn

SEQ ID NO: 29322 - DNA, 5007 bp, Oryza sativa
agagtgggcacgggcggctgcgcggcgcaggcgggccagggcggacggtgaccgagggcggtcggccaccacggcgggagcgcgcgcgggaacgagcgaaggcggtggaggtttgagcgatgccggcgggaaatcgacgtcggcgcgtgagagagagaaagcatcgagagagagagagaacgagagagcgagagagctctctctcggctcggctcggcgcgtgcaacgcacgtgcgaggctgagggaggagatcggccaaggaaggaagaatcggcccaacgaccaagggggaggcaaaatagacttttgcagagagatgatttggaagggatttggatttggaattgaatttcgaatttgattacttggactcagggaaacagggaggagtcaaggaatggattcaaggtggactcggatatttgtggaatcgggacaagtatttggcgaggattcaaaggaggcgattgaatttcaggatttgatttcggaaacttgaatcgggattggaaacttgaggtggaggattttgatggtgatgagagggaacaacgatggagattgaattgagatccatggcacgacttagactctcactcaaagaacgaaatttttgcatataggattttgccgaattagtttttaacgtcacgcaaaaagcggagcgttacatttccctaccgctcgccgctgcgagggatggggagaagtcgcgccaacgccgcagcacatcgccgagcgtggagtgttcggagaaatagaggggagaaaggggttgacaagtggtccccatgtttttaatttttttcctagtcacttacaagtgggcctcacttgtattgtgtgactaggttgccacatcagcacaaagttgaccaagtcaaagggttacactagcaaaaccgctctccaaaattgttgagggagtcaaattgaattttttttaattgttggggatcgagatatctggtattgtggttcagaggtacgaattagatttggcccccagttaagggagttgaagtgaacttatttcggcctgcggtactggcttgtgaaatttgtgggctttgattgccaaaggccaacaacttctatatatattatcttacattagccaagaggccccgcctattttgaaacaactcagcccaaaccaaaataaaactgcatcatcaacgtgttcgttttgattttgttgaggttgttcactttgttcttggtaaccaaattttgtcagtgggaaatcttttcccccactctttttgacctgtttacagtggccagccactttctgactctgctaatcttttctttgccaaaagcaagagcaccatggaccatctctgtactcgactctgcacgtagcaatcgacgtcaagagcttatccaatgtaaaaaagggatataaatgatcacttcggcgtaatctttggtttgtttatgcagcaccaaacatatctaaatgcaggtcagcacaacacaaagctcatggatgattttatttagttggatacagagaagtcaggaacttgtagaacacctctttaatcttctgtttccttttgttatgcagaggagaggctgctttccctgatgacataacataagagtgccaacatccacaaaggaaaaaaaacaaaagataaaataaaaaggaaaaggaggatgatgtggttatcctaaaatgttgaggcaaatctagtgtgacatttgttgctatcatcatcttgtgatccaaggaggagagcctataaagcagagagagaagaacacatgaaaaagataaagcattgtcaaagctgtgcttgtctccatcctcaccacctcacctcttttgctttccattccatgcacacacagattgtgtcacatacactcacacggatttatatacataatgacatgaagcgtctagattccaaaatccatcatgcatgcaacgatcaaatttatagtatctcacccccaccacatcacatgcacccaactacaagattgatgtgggtctcttatttatctactatgtataaatacataagtacacatatattgcctttacacgatctcttcatcgatctctgactctctttttacagaactagatcaggctagctgcgtgccatgcatattctcatgtcgtctatgcaactttatctttttctcactatatcaacaaaggaagatttgaagaggagatgggcaagaaaaaagtagtagattacaagcagggactagctagttacagctgctgatgctgctgtcaatgtgcagggaagaaaagaggagacgggtccctctgcatcttgccctgagccgggtcgactttgaccctgttcatcttctcctcgcaccagtgcagctgctgatcggtgatctccggcattcgcagcactctggccacgatcttgaggtcgattaagcccagcagtattgacatctcctcttcttccctcagcttcgtcctcctcagacaccgtcttggcctcgtcaggtccttgagccggctcttcttctgaagatttcattttcaggcaatgagaagaaagtggaattaatgatgatgatgaaagaaaatctgatcagcattgtgtgtgatgtttatttatgtggctcactttcttgttggccttcttgagggtgatgaccagagtctgatccatggagctggtcctcctcttcaccatttctctgaacatttggtagtggctcctcttgtctgcacgcaggaacgccatgaacgttctgatcgactcctccagtatgtacaagaactgcaccgccgatatcagatcgtccttctcgtcctcctcatctgcaatattttcaaaaattaacaacgcactactcaattctcagctactctaaatcagctaacaaaacaataaagtttggtcaattccatcagagaaattagttagttacctctgaactctgggacgaggagaagcttgggggatgagttcttcatccgggcgtacacctccgggcggagtccgtactcgtagggctcgtcctcgatgaaccggtgaagaagaacttggaattgctggaactcctgcgcgacgcgcgccgggcagcacctcgccgcgatgtcgccggcgtggcggcggaagctggcgtagttccagttgagcgcctcccaggtgaggcagatctgcgccacgtacacccgctccagctccgggtacgggtccctcagcccgatcgccggccgcggcttcggcgtcagcttctgcacgatccgctccgacaccgatcgcggctgatactttatcgacctgtacgactctgcaaattaaccgttccagcaaacgcaactgatcagtaaactttctgtaaatattttttgttgtgtgagccccattgtgtgtagagaaagagttgcagggagctggaattgcgtcgtttgattgaggtttatgtttctcgagaaaggtttaattaatctagcttgggtaatgagtggtaatgatgacttgattttggaagaataattagtatgtacctgtctcggtgagcttctgggcgccgacgcgatggaagtagaccatgtcctcgtcgtacttgcggaagagagcgtacgactcccaccgcgacgagctccggcgagacgacgacgagaaggggtactccgtctccgagtccttggtcaccgtcgagctccgccactccaccgagctcttcgacgtcgactcgctcgtcagcgtcgacgcgcccaacctgctctcctcctcgcgctcgcgctgcactcctcctttcccggccatggcgccctccagaagcagcttcttcgtgtcggcgagcgcccggctgttcacgaacagcttcacgtcatctcccctaaacctcttctcctcctcatcgtcttcttctccgtgttcgccatggccgtcctcttccccggctgcaaccacgtacgacgagtgtcagaaccaggatgaaatgcatggttaacaagaagtaatagaggttagtggaattaatggttataccttcgacgggaacgttctccggtgatggcacggcggccggaatgatatccttctggctcgacgcagtggcggcggcggcggcggcggcggccttgggctcctcatggctgaagctgcactggcgatggtgcggcgagattcgtcgggtggattccaccatgggaaaggtgctctccacctgcaagcaacgtgcaggtgtaggtgtaggtggtgtggtggcagcgtcgtacatgagctgatcctttccttcgccaccaagcagagcagtgtcctcgaacacggcctcgtcgaaccagaacagcatctccgcttgctgctgctgcactccggcgatgtcgtcggcgccggcaaactcctccctcccggaggtctccgtgacctggtgctcgtcacagctaccatggcctctacatacatacgcacagtaaaaatgtgacacgtccatgcaattaatggcacaaagatctctctgaactgaagctagcttgtcactcactcaccggcggtgaaggccggcggcgagcttggcgaggaggaagaggaggaggtaggcgacgaggaggaggacgttgagggaggccagtgcatggagaagagacggcggcgccggcgtcgtcagtgccagcatctccccgcagacgactgccgggggaggtgcctgcagaagacagccgtcgccggcgccgccgtagccatgagaaggagacggcgagccaagcacttgcgcatgcaacggcgccgccacccgagagcagcagctgctgccgctcgcattacgcatctaccacctgcagcttccccttaatttgcctcttgctcctactactacttccacactgtcaagctagctatccttgcacttgcttattagtatcactttgaaatgaaaaatgggaggaaccaaagtggtgatgtggatcaaatcgggcgaatggtttgggacaacacaaagtttatataggctttgcataaagcatctgggagagatcgagtgattagagaagcatgggg

SEQ ID NO: 29323 - DNA, 15159 bp, Oryza sativa
  unsure (1)..(15159): unsure at all n locations
tgcattacgaggtaagcctatatgcgtttcatcacctggggttttggtataattctcttacttcgattttctcatcatctcatcaccgccgatagctagctttaatttgacagtatatatgatcatccagctagtggtagtacgtaacatatctagcagatcgagagcatcttctgaccattatgattttggttacttgcataagtaggtcaaagaacacgctatcatgcagcaacaatgtcggaatagaatcagaacatagaatcagaacatgaatcagaaaatgggcttgcgaaatgggcccccggttagagaaatagtcaaataggccgaatatggagttattaggcccggttacagaataagcccaacatagagtaataaacttctgggccatcaacattttgtgctatatatctgggctaattttcaagtgggctatattgttgcgcaattagtctatttgggcctcactgggccctacattctcagcccacttgcgaaaagctttattgagcctcaagtcctcttttgtccttctgaattcccctctgttttcctcctagttcacatctaaacatgtctttcttctccttttagtgcttcattttacctcgttcaattaacatatcgattaaccaatcattaaccaataagcaggttgggctttcatcagtataaaattaacagagttagacgtgctctaaaaccagcagtaactggcctgttactgtcgaagaatgggagcaaaagccctgcataattaagcacttgatctacataatttaatgcacattatcaaattaactcaagtcgtcaacaattgtggccacttgacttggaacagggcaggaacgagcgatcgacggccggttgaaaacagggaccgtaccggtacgtaattaattaactgggctgtcagtggactgatgatccgtgtgacaacgtaattcacgctctctatcatgcgtcgtcaaattataatttctcaatcaagcaacgagaaacaaaaagttacacgctatcttggttcaaaagaaggtcgaaaccatgggaacaactttaattttcccacatatagtatatactactgctttgcaagatcaactaggaaagcctgaagtgtaattaggcactagatataattaatcaccaccacgagctaagcttgatgagatcatgccaactaggatgaacacttgcatatgcactcagccccagcagcacacaagtttgccacaagttgagcaataaaactagtgttttatggcaagtgtcctagaatcatttgcagctaaaccatatataaataaattggtatccagttgctgatggccctgtacactcggaatccaagtgcttattaggtgcattgcatctctaccaatcgatcgggccatctgattggggaatgcgccatgaacaccaggagattctgtctcgagcgagggggccccaaattttgttggacagcttgatttgttctatgtatttttagttcgattttgtcctcaacaagatgggtttactgtttcagagcatatatacttttactttccccgaaataattgtgtgtctgtttctgaatttttggatgtttgcgtcctagctgatgagacatcgtacgttcatagcatatataattaagtacatatatagttaagtccgaacttaaaattgaattaaacctgaccaaatatgctctatgttcttgacgaaaaaggctatacatactaaaactttcttactgaacttttaataacactgatgtgttatatatgctgtgggtacatcactagatatccactcatctatgttaatcaaattgttgaaattattatttgtaagagtttttgttttttaaaaaaaatatgtgtagtagtgctccacgttcttattccaatcggctattgttgggagttggttgacacgtgggtcctctaaccgacatgccattttcgctctaaaagaaagttgggaattgatggtcgggtggtgacagaacaatcatcaccgctagctactcccttttataaggagtatagatagactagcaaacatacaacaagggaaaaaaatcataaggttaaaagagtaaagataaagtcacacaatttgctattgaaaacagggatagaaatgcaaatgccatgtttcttgggtcggtttagtcctaaaatttcatttgtgcaaactcgtccctctcaatgttgatttgcaccaagccaactcaatgtgaatctagcgtaaatagtaaaatccccgattaaagttcaaattgatatctcacatgggtaaatgtataatttgtacttcctctgtcggtgacatggggccgggggtatcgtgactagagacttgggtagccgcggtcacccacgtggcctgaccccctcgggggggtcgggcccgagggtgacgtggccacccctccctctgtctccccgaggggtcgggccgctcccgtttcggccccgagggctggggcgcccccgtttcggccccgagggctggggcgccccgaccccctgtggttttggcgccacgtgtgtgggttaggtgagcacaacggggctcacctaaccgcatttatagcaggttggacgagcgcgccacgtcgcatttaatgcggcgcagcgcacgcttatccgatccgtgaccggtcgcggtgtgtgaccggtcacagaccggtcagatcgcgggttaggtggcaacaggcggcctgtcacacgcctcgccccgtcccgtcggaatgatgagagcttcctggctctcgtccctagccggagccggcgtgctaactcctggagttggtatgtcagtcccggtcagatccattccaggcttcagcgcaaatatggcaaggaagtcgctggccattaaatgaaggttgaaatgggcgtccaccgggaaagcgggcgagcggggcaggaggcgtgtgctctgcttgtcagaggtcatttccggctgtagactagccctcattgtaaaaagcatgtttcccttcttaggcaactagaggcccatgtggtgacccctgaccagataaaaaggaggcccaagcctaggagaaagggggttgggactctggggaagaggggcgagagcctgaactcactctcgctctccggttctctgtattccttcaagcacagatccaccagaacacaggagtagggtgttacgcttctcagcggcccgaacctgtctacgtcgcccgtgtcttgtgcacttcctctcccgctgactttcctcagatcgagggcgaagaacctcactcagcgcccccggccgaaccggcaaaggggggcctgcgcggtctcccggtgaggagccccacgctccgtcatcctctatcccaaaatataagtagttttaattagatgagacaaatcctagtactatgaatctggatagatagtttgtctagattcgtagtactaggatataccccatccaaccaaaactcattatattttgggacggagggagtatatgaaaaggatgagtatatacacctagctaggtgtaccgtgtataatattttcttttatgagtatacatatatgtgtgtgtcggatacctactctatatatagtgcttgcgggtttaaaaactccctctgccaaagctttcaatcactataggggaaacgatttttagtcccggtttacaactcctttactaccaattgtagcaaccgagacgagcaaatcgggactcaagttcaaaatctttagtaccgatacatagcaagtgaaaataaatatgtgggatatgggattcgaactcaagatctctcacctcagccctcacacgcgtaaccaactcacctactacacacatctagcttgaagagatgttttacttttgaactaaccctggaggctttactactggtctttagtccatgttggtgttaccaaccgatagtaaagataccagttggtaatatcaactaggactaaagatgtttctagggatttggacttttataaccggtactaaagcatttttagtactggtttttaatctaaccgaggtatttgtgattttgggtactacgtcaaaaggtttgttctctagtagtgaatactccctaatccaagattaattaagatacatgtaaaaaaatataattaagataaaccagcaaagcatgattactagtaataaagctgtaagtcccaccaattcaaccctcctatattcttcttttctattaatagtaactccaagtcctcaatctagccaaaaaatattttggcaacttagttccttgtcaaattttagaaaaaaacaatgaaataactatggctcaaaattgctaaatattaacctggttgtcaaaagctgatctcgatcgatcggtcgatcagattgatcatgtaagctacctaccatttacccaaattaaactgtagtgctgaccaatttagtagtcctggcacacgacgcgcgtggaacaattttgcgtggagaccacacgccttctcgttaatctaatccaacaattctaaattgagaaaaatatcattgatcacattgactagtagcagtaaataaaacgtaattagagtggagtagccatcaagtgggcggttgataaaggttagcatatataccaccattaggccggaggagggtccagatgcattgcaactttgcacacagcttcgtcgggagagcctcaaatcaaatgacacattggtcgaggattatgtcattgatgagctgtgcgattacacgtaagtacaaaaactatatacctacaaagtttatgagggtacgacgtagtcatacgaattatttttttcttagattcttgagcggttgcaagtttgcactgtgcgtgcctggctagatttaaattaacctaggtctagaagtctttgatttatctaatggctcctctctttgtgcacctttcttctttattccatgttgcaaggaatgcagagatcgaaattttgtttaatccttattttaaatgcggctactaacagcatactattcaaatagttttagttagtggtacggatctaaatgaggttctggatggataattaattcgtttctcatgaattttatgatattattctcattcaacacgaaatcttagtgggaactcgtcatggaaatatgtttgcaaaacagtaggcaatactcgtggaataatgcaaggaagagggtattaggcttatcctgaattatattgattgatgcctcgtacgtttagttgaccttgatgctacgaacaggattacccaaaaccatgggcgctttctttttttaatttttttcgatatgatggattcatgcatgtaccatgcgattcacattatattacacagctcatgcatattggacaagtggaggcacaaatattagggagaaaccaagctagattattttgtttattgtccctatgcctttttaccgtactactccctccgtcccaaaataagtgtaattttacactattcatctccaacgtttgaccattcgttttatttgaaattttttatgattactatttttattgttattagatgataaaacatgaatagtactttatgtgtgactaaatttttttaaatttttcataaatttttcaaataagacggacggtcaaacgttggacacggatttctatggctgcacttattttggaacggaggtagtagtagctaggtttttctcctaataaatgtaagccattcagtaccattagcccaaatgcaaggcctcacgcttcagaaacttaaactactcacatcaaatcaagaaagaggctttgaagaaattttccttttaatttatttaatggagaaaattgcaacatgcatggtagtgatgttctaacgtacatatatatgtactccatgtacgtataatgtgcgggcgtcactgtacgtaccggtggtcgaactatatattttgtttagataatgaaatggtttacaaaggtcaacctaattaagggcctgttaattaatttgcaacattaaaagttcacagcatttatctaagtttgcatataagttttctacaggatataaatgtgttttttttacataataaacagtggttacaagaacttaatttgagaagtacggggtattatgaaagttgaacttggaatttgacttgtcaaaaaaaaaacaatgtgcaccgagtttccaacaaaagaaaatccattatattttttttgtaagataataaggcaaatataagtaatatgaaccctcaaaatatctgaaatttaattacatatataagcaatataaggtaagctcttgaaatctattttctcatttaaatagccctcaaatattcagagtatttatgcatatgtttttttcattttcatttccattttattttagctctttactctggttgagtttccgatcaaatgtctcttaatttgcttatatgtagttaacaattgtgtgtttgtaagttgataattttgagctatatatatatatatattgattgattgacaagttacttcagctaaagcttttttttaaaccaaaaccattgtgggtacagctaaatattttatgtccacttttgatatgatatattgttttactaaatgattaaaatattggatgtgtttgtacatacatatagtaccccctaaattattgtttgcgcagttttggtgtaggattgaactctattacggtaattaaattgcaaccacgcaaaaatacataataatagctaatttcctgaattttactatccggttatcgtattgtagcttgaataaatgacactacccatggatttaactaattggacatggtttaagatttaggcggtttttagtccaagatcgtcttaaccaggaaaactcctaaaatgaagggtctcaaacgtaacgaaaccttatgaaagctctcatgagataaagctagtgaatagttcagtgtctactaccttcgtctcaaagatagtaatctagtacccaatgagacacatcatagtattacgaatacatatatacctcattggggcttaggatgagttttatgtttttcagggcacgcaaaactagaaagctcataaccacatcattaatttagtattaataattataaacttgaaaaataaatttatttgaatttttcaaacaacttctatatagactttttttgaaaaaaaaacacatcatttaatagttcgaaaagcgtgctagctgaaaacgataaagaagccttagttaggaaaacccataaaatgaagaggctcgaatgtaacaaaaccataaacctctcatcagataaagctaataaatagttcaaagttactacccctgtctgtaaagatagcaatttagtactggatagacgacatatcctacattctgaatataaaaagataattcgttcatatccgtaatattagagtgtgtctcattcgatattagattgttttattaacgggatggagggacaagcagagcaaagttatgaaacggccctatacgtgtgctgcaattggacagagaacgtcggatgcgaacaaataaaatccgaataattaacaaaaagcatccatgcctgcatggtgggggatgcggagaagcaacagttccacttaatttgcaaagcctgtctgccatatatattcttcttagtctgaacccccctttggcatctcttcccattttccctaagtacgccgtacctgtctggtcataacaaaggcttatttataaatcagcaacttccttgttaattaatctttaatttgtatatgagcaagtggcaaatttaatgggatgcagtactagtaccacaaaaacatcgccgggtcaatatgaggtgtactacgtacgtactacactcttggttcattgtctctgatatgtgtgctaataatctaatcgatcgaccacttgttcttgtgtcgtacaacaaaattaaactagcaatttctttgctgatggagccttcatcaaggtttggattcacggtgtgatgacctaaaatacccaactaatgagggctcgggaatcttaaacggatcgaatcacatgcaatctcggtagttaagcacatcctcccgcggcgcgtactactggtggttttagaagttgtctgttattttaaggatacacatatcgatgaatttattctataaataggctcgaacaagcttgtagtagtgctatatcgtttggcctgattatcagcgacttaaaaataatttttttaacattacaaacgcaagtaccattaaaaaataataattagacgtaaatgtgagaacccatgtcaaataatctaggatttgaatttgggtgggctggtttcaccaaaagaatctaatcagttaagctacattcgattcgcaaaaaaaaattaattaatgcataaaacttctgtatatgtgtgttcttagtaacttaaaagctaatactaaaaataaaatatgataaaaatcaaaatcaactctataagtttagaaaaaaaataaattttggttgtggctgataagcggaagggcaaacgatttttcatctataattaatatattaattatttggatttattctatatataggcttgttcaagcctattgtttaatcttgatcagtaattaatgtcttgaatattgttttttaagtaaagaacggtaaaaacttcaattaatcagccgcatatggtcatatcgttttttagataaacgacggcgcgaaattgaagcttgatgaggtaagtgaaaacaacgtacaaattacactgtgaacatgtagtctttgttagtatttttgagaaatgcaactagctaggagtgggaagcaccacttgaagctagttagcaagctataagaactcgacaatgacatcgttggtatatatacgtacagtgtgatcgagcaagctattagcataagaaaaacatttggttttgttaattaattaatgaagggcaacaattaaacaagagaaattaacgtacgaccgctcctaggattctccattttaagttgtaactatatagcttccccaatggagatgcatggcgtacggggacccccttaatttctcttagtactacacaaagttaattaattaaacacagagagaggacacacacatataaaacggtactaattagggaggttcaacttgccggtgatgtgagctctcaacctaaactgtcgtaggcctatgatctatctatatactccctccgtttcaaaatttttgacaccgttgactttttagtacgtgtttgactattcgtcttatttaaaaaaatttaagtaattatttattcttttcatatcatttgattcgttaattgttaaatatacttttatgtacacatatagttttacatatttcacgaattattttgaataagacaaacggtcaaatatttgctaaaaattcaacggtgtcaaacattttgaaacggagggagtatcaaagctaggtactagcttgattcccaacataaaataagcgtgccaaactgaaacgcacgtaaaactggatcatgattcacgcagctatagcatttgggatcggaggagggcagatgcatgaatggttagcagctgctatcccccacagaagcatatgatatgatttgcacggcagagactctcgctgcctcctaccaagttggatcgaaaaaaaaggaaaagaaaagggttagcaaaaccgcccatggaaatcgaatcggctctctcgagcgcccacagatgttggtggctgtgcgcgaggaggaagacgacgacgtacgacgaccacctccaccaatcaccagccagtgcgtggggcccacttaagcctagctatagctcgtacgactataccgtgggggccccacgcccaggtcgctgggggccgccctcctctcgccgcgtgcacttcctcccggaaacgagcgttgcgattcgcccgccgatggatggcgatgacgacgctgacaaccaccgccacgcgctgtcatgtgtcccccacacgcaccggatttataattagtatgctatcctcggattgcttgacctaattgcccttgccttcttgcctgctgcttaatgctgtaactagctagtaatgcatatgcatgcatgataccatgtggttccatctggaactattttatgatgatatatagcttgtgcccttccatgcatgcatgcatgctgatgacagttaggtttcatcaccatcgaactgtctgaatttttttcagtcataatccccttttctccacaattcctgtttgcttggatgtattcatcgcattgtacaaaaccgattgactgaagttcttcatatgactccattcaaggtgccaagtaccaacagatattacacaattgttgttgtggtttcagtagaaatttagtgatatggattttcatccttcgacatccgctagcttttttcctacatgtcacctaaatagtaaaaaacatattttttttgacaatataggttaatacgatatatatcactctacaaacatgcataggttaaattcgactttcacaagttgtaaaaagaacaaattaaactgcaactagttaacgtacactttgcagttatttttgtaacaacttggaagtcgaatttgagcttgcatgtttgtgtagtgatatatttcatattaatctatcttgtgtttttttaaaagaaatataactctttaggtggcatgcatgcaagaaacgataagacatcctctcgaggggtgaaaacatttcctacatttagtgactttagtgaatttcttttgcataccgtctctctgagcatgtgtattatattaatgtgatgcgcctgccagtgtgtgtgcgtgtatggtgcacttttgtttgtttctactatgtattaggatatatgcatgaaatcgatcttgtaaaactttcaggaagtgtgtgtgtgtgtgtctatctatatctctctctctctctctctctctctctctctctctatatatatatatatatatatatatatatatatatatatatatatatatatatgttttgacattttctctgctctcatacgtattattttacttaattagcattgcgactatatatttattatccaacatcaatatttgaacttcttccgctcatctatatatactattttaaaaggctctagtggtggtagtagtgaatctaccaccccaactactcctattgtaaatttttaaatcacctcctgaactctatattaaaaacaatcaatctaaatggatagtgattcctagaatcaaattaagataaatggtttccatagcaaaacgacaggtagaacatttcacgaaaaatacattttatctgcagcaaagcacagacagaaaatttttcttttgtcatagaagaaatgatttttaggtttatcattaaaaatatatatgttggtatcatcatatttagttttttttcttttttgcgggaaatatttagtatttttctagctacaaacatacaactagggaagtggttaatggccaaattaatacaggtgtatatatatgagtccatgttaatgcccaaaatcaataaggaatttatccaataacaaataatcagaaaaatgcaatggtcaaataagtgtgatccaagagactaacaagatcctaaggaaattatctctcttgagtcttgaggaaaggaaaacaagatagatcaagcacaacacaattaagtccaataattaaaggatggtatgaacttggagatctgataccgtacttgtctcgaccataaacaatgtcaactagagctatggtaaaggttgagcgggaggaagaatcattcatcttcgcggagttatctaagagaaacatgtcactatacactaattgaggtatgttcactcttaatttcagggagcaaaccagggggtgaattaagccaagataatgagccaagcatatagggcttatagggcatcttaattactgtgtatttccaaaatttttagataggatcgtaaaagatattaaagagacaaacctagaaatcaagccctaattattgctcaaggctagtgagagtcgtagctactatattactactgttggaattttcaagaacacacttagttgatttgttcttataaaactgaataattataacataggggatattatattagaagaagaaaaagcaaacgcgcatgttatccctcgcggagaaaccgtcaaaaccaactaaatgttgagaagtaaggtgatgatttgacaagaccacagctaatcaagtaaattaagcttcgttctagagtcgttacacttatctatttagttttctgtttgctacactgaggtggttttcatgtcatatatacattccgagctaggtcagcatattgcaacagctatagcagtactactactatagcttgaatggagtaaacatatgacttcttttttttcctcctaataccgggtttctaattagtcagaaccttctgtcagatccctttctttttgaggcaagtacacaatatatattcaactcccatatatatatattaattataaccaagttaattcaacctaggaccacttggtcagccagatcgatcaccatcacatacctagtatgtatatataattatctaagtaattaaagtttagttataagttttagaagaagcttagagagatcatgagatggaaaagtgaggggcattagggtaacatcacatgtaggggagaaaaccagctttccactcccagggaaaccggaggctttccagtccgctgccgagctaacccacggctccacctcccaatgctttatatacacccaacctctccgcccacacacccaccaccatttcctcctccttcttctacctctagctcggcattgctagctcgatctcaccggtcgtcgtctccggcgagccgcgcgggttagtttgcgaggatcatgcggatgagctgcaacgggtgccgcgtgctgcgcaaggggtgcagcgacaactgcgccatccgcccctgcctgcagtggattcgcagccccgatgcgcaggccaacgccaccgtcttcctcgccaagttctacggccgcgccggcctcatcaacctcatcaccgccggccccgagcacgtccgtcctggtacgtgtgcttagcccttgttgctagctagctacatggccatggcgtttgagttcgttctctgactcttgggttgcgtacgtgtgcagccatattccggtcgctgctgtacgaggcttgcgggcggatgctgaacccggtgtacggatccgtcggcctcctctggtcggggaactggcagctttgccagtccgccgtcgagtccgtcctccgcggcatgcccatcgcgcagccgccgccgtccgccaccgccgtgcccccgctccccacctgcgacatccgccacgtcggcgccaggagaggcgacgtccatggcgccgcggccggcccggttgccgacctccaccggcttgacatcagctcgcgcgccaagttcaagaggcccggcggcggcgccgccgccgcccacaggtccgaccatgccgccttcgagctcgtcttctccaagcccgccgccgccatggccgtcgatgtgataaggcaggcgcagccgctcaactgggcgcccggggcgctcagccacgagtcggcgagccacgacgccgcgccgccggagagcgagggccacagcaacgacacggccgacaccgtggacggctcccacgtcagccagtcggagccggagccgagagcgacgtcggcggcgaccgaggtgcacgacgccggcctagacctcacattaggtctaccgccgccgccgccgccggtgcaaaagaccgagccggcggacagcgacggcggcagccagcagcaacacgatcatcggaaggagaagccggtggagctcggcttggcgatctcaactaaagtagcagctcaatgaccgatcaatatatacctaaatatttgtgatcaaatttccaatggacatatactgatagagaaatatatatatatggatcaggaggagtattttgacggtcataagtgtcaattaattaggtgttaattcataggagctagctagtgtgtatttgatgtcttccaatattggagacatcgatgtaataatcatccacctgttcttttttttctatacactgtcatattcatttttctcttttcatctcttatcctttttagtttgagatcaatattttccatgtatagagagtttgatgtatgcttgcgtgactatgataccgatatatagcacctgaaagggattcgtgtacgtcatgcatatgtgcatgcatgctatttatgatacaggaactatatagacgaatttctttgttaacagaaataattccgagttcatatatatatgatgcagatgcacacacttaaattttcatatgtagatgaatatttgtttccacatagcaaacatatcaaattttctgataaattaccaaaatataactctatgggattttgactaaatacttgagcttgattggatatatttctcagaaccaaaaaaaaaaaggcaaagaaattaattaaatccagtactagaaaattttcctccaaggtaaaggggttcacatagaagttggaacttgaaaagatttcgatctgactgtccctagctagctctctctctctctctctctctctctctctgatgcacatgaccttatctagttgttctttgtccacgttaatgtgtgtgtacagttaacagtagatgcacaagcagctgagaaagaaagacaagcctttttctagcattggtgtgtgtctagtagcttgctaagagagagaaacaaattgagagagagagagagatggacaactttaaattttcttggtgcatgcggcgcccccacagggagaggttcagtgtatatggcaaaagtatgcggaatgggaggccaaattgcacaataaaaatggaaaagttagctagggtttgatcacctccaagcaggagaacaagactgacaaatgaagcgcataaagcatttgtttagacaatttgccaactagttaattaattaagtatctcgatcgccaatggtactgcatcaccaactatagctnnnnnnnnnnnnnnnnnnnnnnnnnnnnnnnnnnnnnn

SEQ ID NO: 29324 - DNA, 2922 bp, Oryza sativa
atttctattgaagtgtaggtagagtacgtatttgttttacgagccagacgacaagcctataagcaatggcctctaatgatgttttgtattatgatggaatagcccagtatgtagaaagtctagatagctacatagcaatggcttctaataatgttttgttcatcatgcttgctcgggaaagcgtacgtgaggcgcggcgatgagggccacgccaaaataaacatgcagtatagcacagcgacccacacaaattaacctcagaaaaaaaaagttacatgacatgcttaacacatgagtttaactagctataccgctattagaataaaatgtttcaaaatatacatcacctaaacttttaatatagcatattgttatatcgctgttttagtccaatatatgtactgttaaaagctttctctaacaaatattgagcaacatgtaatggtatattaattaataactagcactaaggatctccttttacataggcaagactagtcaagtaaccaatgtgacgactatactaggcagatcagatcaatcggttgggccatttaaaatatgagtattcatccaacattgtttaggagaactggtaccgtcactttttgacaactggcataatgcaagaaccttcattgccacaattctttaacccctcttctagaacttctctaaacttaacatgtagtagctagacactgccagttgcatcacatgaagatgtgcatatacacatgtctaaagagctccaaagtcgaacggcgttggagctgagactgttgggtggacctcagaagacaaggattggacgactttgtgtctatttcagttagatgtataatttcatacccgcggcactaaactgccccggccaaatattattttgcaagtaatatgactccattggtgtgtagtactagctttaggtgatcaaattgcaatattcattttacgctctagctatgacgcatgaattccgtgttcaaccaagggaaagaaagctccttgttgacgcaacctcctctatatgccatatcaccaccggagatccatcacccatcaataaatagaccatgaaccctagctacgatagtgaaatcgctgaaatctaagttggcatcttcgttaccacggccaattgatgcttgaatcattcaacccaccaatctagcaaccgattgaaatctctcctatgattttgagttgaaattgaggtttttgtgtatgaacgcaaggtgcctgagtggaaagatgggatgatcaaaatatggcaagatgtagaaaaaaggtaggacgaaagaatgacatattagtgtacaaccattatgtggtatagtgatatatataaataaactccatgaatatgatatgaaaatatgtttacaaccacctcaaaacaatatattccgtcatcatattgtatagttcatgtaaaaagctggaagatcctcgctaaagattgtatttataaaagttagatccatagtgaaaatcaaccaatcaatattttattgtgttgtgattcgaagaaattatacatgtcacaaagatcaacaaatcaaccaaaattaccaaaaaaaattacatgccatatctcttaatatcatgtagaatgtttttggtttacaattagttaatcgttcataaataggaaaagttagggcccatttggtagggctccaatttctaaatttaactccagcatttaggtatggagtggagttgtaaagttgtttaagcccagcttctttcagttcattttgtgggagcacttcaactagctctacttttttttaggtggagatgaaaccgtttggttagatttcagttttaggagagatggagctgaactgaagcggtgtcaaacgcacttaattagatcatataataacagctggtgcaggcccatcaaacacgtcactgtgctatatagaaagtttattgaaccattcccctgcataaaataagcaattggcgcgtggtgaccacggtgtgggaatcgtttggtccatgtggtcagagaggactctgcattgcttgcataacaaagaaagcaaatattaaaagtatagatctaattggaggcagttttggctttcttgggtgtgggaaggtttgccttcatcctcctctcctcgagacctcccaacacacactggatagatacgccaaagccagcctcctctttggccgatgcagctgtagttagtaataattaaagaactaatatatgtttaaacaaatctctggacctaattggtgcggtgatcagctggtcgcttgttccttcatttagtcatgcttgaatttgttttctcggatggcatggcatatgttttgactttatatgtcaatggtttaatggctcacggtttctgtggcatgcatgtcacaaaactttggctgaactttgactcagctgaaacgatgaccaattaatttgagaacctgaaaagatatatatatatatatatatatatatatatatatatgggcaattgcttatttgaccccgttttaaaccctaactaccaatttgaccctactttttgaagtttgcttgtttgaccctccttttctaaaacgaagctcccgtctaaccctgtttccactagtccgttaagttttgatttaaaataaaaaagaaatgcaactaatattcataatatccagaatacccttaggaaaccctatccatccacccaaccttatccacatttctctctctttctccttcctccttcctgctcgctcgacttgtggcggcggtgctagggggcggcggcggcgactgagggggcggagggagggagcagcggcggcgacggctgaagggcgtggagggagggaacggcggctgttgaggtggcgccggtgcggcaactgaggggcccggagggaggaaaggaaggagggagc

SEQ ID NO: 29325 - DNA, 601 bp, Oryza sativa
  unsure (1)..(601): unsure at all n locations
actatagggcgaattcgagctcggtacccattgcgacctattgctcccagacttgcgagatatttcaccacttctagaatggaacaatgaagagaaaacctccaaatttttcattctttcaggcagcgtgttctattagcacgaataaacaagaaattgacccaattgatggccctaacaaagtcaacagctggattataccactaagattcgttctagttctggaccacataaacgagagagagagagaagtccaagccgcagaaccattacagtgtgcgtacacatctggccaagaaattcttgtgaaaacaaccaagcagcataggagccaccaaagcctgaaacgtcacattcgaacaggaaaaaaacacatccatgttcttgacaacccaaatgctaacctccatgaaacccaaatagatcccctgtaaactgtaaaaaaaaatccgctaaaaaatctgcaatttaacactgactgacgtgtacccagcgagtagaataaactgcatgctccaatccaacccagtcaagaagaactcctnnnnnnnnnnnnnnnnnnnnnnnnnnnnnnnnnnnnnnnnnnnnnnnnnnnnnnnnn

SEQ ID NO: 29326 - DNA, 829 bp, Oryza sativa
tccttcatctatgcagacaaattttgatgtcggcctagtattttttacctaacttgttatggaagaccatatactactatgtataatcatctagctagttggatgagatacacttgatagtgcagtggtaatgtgtgtggtttcaaccgtaagctctcgtgctaaattccaacatgctcataatttcttaaaaaaatgtttggagagatgtttcttccttcaagtcttcttttttcttatccagctggaaacggagtagtacagtagtttttcatttatcatatgtgtgcatgccaaataatcttgcagtgcacaccgctttcgacgccgtccgagaaatgtccggttaaatccgcacaaatatacagtgtctgcatcaaatgtaaagtagcagctatagttggtgatgcagtaccattggcgatcgagatacttaattaattaactagttggcaaattgtctaaacaaatgctttatgcgcttcatttgtcagtcttgttctcctgcttggaggtgatcaaaccctagctaacttttccatttttattgtgcaatttggcctcccattccgcatacttttgccatatacactgaacctctccctgtgggggcgccgcatgcaccaagaaaatttaaagttgtccatctctctctctctctcaatttgtttctctctcttagcaagctactagacacacaccaatgctagaaaaaggcttgtctttctttctcagctgcttgtgcatctactgttaactgtacacacacattaacgtggacaaagaacaactagataaggtcatgtgcatcagagagagagagagagag

SEQ ID NO: 29327 - DNA, 484 bp, Oryza sativa
tgagatctctatttctcaggaattcgtagccttctaagtccaatattctcattaatttcatccaaccaaactgcaatgtttctccatcggcaaatatgctcaaggaccggacatggcataatatttctcttgtggcaatatatttcacacctctgctatgaacagttagccgccttatcttctcttgcggaaacaaagtgttctgttctcctactagagtgataaaattatcttcaattgactttgacacaatgatctccaacatcacatcatgaactcggaatgttttaaccttccctgtaaagctagtggtcactggctgaataatgctccggttaatgaattcatcaaagtagctttctgccacctcaaaaacactcagtccacgtttgccagtcacaaagcgttctgctacccatcgcctgagtatagttttccttctgatattatggtcctcagggtaaatgcttaaatataagaagca

SEQ ID NO: 29328 - DNA, 139 bp, Oryza sativa
gagccaccacaccccgtcgtgccggagttggcgaaacacgaagagccaccgcaccccgtcgtgccggagctgccgaagcccgagctgccacaccctgctgtgccggagttgccgaaacacgaagagccaccacaccccg

SEQ ID NO: 29329 - DNA, 2006 bp, Oryza sativa
tggcatgtttaatttgatttctctgtacccttttactttgcgcaggtctctgaatggatgaatgccaagggacatgtaaaatttctgccaaaggatcacgctgttcacctggatttgattggtgaaattcatggaagcagtgcagccgagacttacttcaacaacctgccagataaagataagacagaaaaaccctatggtgcacttcttaactgctacacacgggaactcctggttgaaaaatcgttggctcattttcagaagatgaaagagttgggttttgtgttttccacactcccctacaacaacatcatgggtctgtatacgaacctagggcagcatgaaaaggttccttcagtaattgcagagatgaaaagcaatggtatcgttcctgacaatttcagctacagaatatgcattaactcttatggcacaagggctgattttttcgggatggaaaacacccttgaagagatggagtgtgaacctaaaatcgttgttgattggaacacgtatgctgtcgtggcaagcaactacattaagggcaacataagggagaaagcattctctgccttaaagaaagcagaagcaaaaataaatataaaagattcagattcctataaccacctgatttccttgtatggacatctgggggacaaatcagaggtcaataggctgtgggcgctccaaatgtcgaactgcaataggcatattaataaggattacactacaatgcttgcagtgctcgtgaaacttaatgagattgaagaagctgaagtgttgctgaaagagtgggagtcgagcggaaatgcatttgacttccaagttccaaatgtcctgctcactggataccgccagaaggacttgctggacaaggctgaggcacttctggatgatttcttgaagaagggaaagatgcctccttcaaccagctgggcaattgtggcagctggctatgcggagaaaggtgatgctgcgaaagcatatgagctgacaaagaatgccctatgtgtatatgctccaaatactggttggatccctaggcctgggatgattgagatgatacttaagtatcttggagatgaaggtgatgtcgaggaggttgaaattttcgttgatctgctgaaagttgctgtgccactgaactcagatatgactgacgctttgtcaagggctcgaatgagagaagaaaagaaggttaaagatgcagtgtaagcactatgatgaagaagataatgtttcacgagctctcaaggctgctctttggtctgcactgacactttgttcttgctgcatttcttcttctcgtttttttttcttttttaagagaatgtgggtgggggatggtaaccaaaatgagatattatctgacatacagtagttctggtaacattgtctgtacctgagtacctgagtgaacttgttatcactcgattggtcactttaagtatgttgctgggattctcagcaatagttatattgcttgagttataacgatcgtagagccaaaatcactcaaaatgtagatgattttgatcttgattttgcacgtatgcataacaaacgctcatctcacaatcgtttgggagttggagtgaagcaaaaacttccactaaacccatgttttcacatgatatttcgccaaccttcttcgggctttttttgcgtttccactgaacagcatatccatgtatcgattcatccatctatccatccattcaagatccaaccactttctcctaactcataggtgtgttgttgcgtaagctaagctccgatggatttgcatccaaatccaaaaaccggttgcatggatgcatgagaaacagctcatccctattaactctgcacctaataacaaatccaaatctcgccaaaatcttatcccttttcaaaatctctcttttatatacatgtagctctccatctcatttcacaccatcactggacgagcagtaagtaaacactctgtggaacaatggccgccgtccttcccttgctcgccg

SEQ ID NO: 29330 - DNA, 2676 bp, Oryza sativa
taagagccaaaagcacgcaaaaattatgcacacactttacctcctcctttatatacaggcactatatgatctgcgtgccaagcattaccctcatttggctcatgtacaagcttatctagcctgtggtaaaatatagtgaaaaaaacagtgtcaccatcaatctacaaattaggagaactactcatattcattaatattttgtgagttcagaccacaatagtgtccccaatagcctgtaagttgcctaaataggcaaagagaagttaacataagcacaaaacattgaaaagcataatatcaaagtatggcacttacaatttcaatctacttgcaatatttggagcaacattcctaatgtattcttctctctttttcttgcataatggtctgatattcttgacaagctcgtgacagtcaagtttacacttggagcatataccatgttcaatttcaaatagtgcctattcatcaggcaagcattgctttagtacatataacttccatattttcacatatagctggcataccagctttattcataaataatgcaacttaacactttgtttatgaatgctaattgcagaagattaaagaaaaatctcacctgccgtgcaaacctgccactagttctcgatctgaacacctcgaagcaaggcagaccacagaacaggtcttcaaaatattcaggtgactttgcaagccttccactgatcacaaataacaacattgttattttttttcaaaaaaaaaacacagatggctactggaaataaagtgcacaaatgagacatattacttgcaaggtccttgacataatttgcagagaggttcatcgtgaacagtccagccttgagtgtactctctctctctacttgtaccattatgcaaaaccacctttctccattcagcattttctggcaaaggattactaatatcacaccatggtgttacacgcctcttacttcctcctttaagcaacccctatgaagtagagcacaattgacaaaaaataaacatgattaaaccaaggaatgccaagacatattttttttcatttcatgttcttagtttggtacaaaatcagatcctttaaactgtatttcaaatgaaaaattaatacatcgggatgatatgatagcagctcacaagcaaacccttagctacaatgagatgcctagggtagtgtggcactgtggtgggcctagcagcttaaaagctgcagttttattttgctttttttttgtatatgccaaatcaccaattgaatcctccattagagtaatatcctccattagagtaaaagtcaaacattgcaatatcctctattagagtaaatcctgatagaggggatcctctagagtcataagaaaaacttgcataaagaatgatatagatagaacatagatatgcttaatatcatggaagcgttgcttttgcatattttctgcaatatttggaattaaaccaatattcaaattgatcactcaaaatcaagaggaacgtacttttgtgctgtggttgttggtatctttcaggtagcacaactcaaggctcaagggaagctgtaagggctttcccagtagtctcttctgctcaattggtctaagcgccaaccattccttcacgaacgctttgaacgtattgcaaaatgcaggatccctcttcaagagacgattacttgttttcatggtattatcagaacataaaggtgactctacttcttctggcaggaagttttcaaaaagtggtctgggtcttgaatcatgccctggaacacatatgtacaaatgaattcggcctgtgtgctggctaacctgtaaaatacgaagataaatcaaatgaattcaaagaatgaagaccggaatggaatgtaaaatgaaattaacttcacattaatgagacaagtcatgagaacagaatatgaacagagaggacagttaaacctcaaatcgcagaaacttctcttcaatattgcagtctgtagttgcttgaaggcctaaagtctgaaaaatttcagaaagcctccgacgagcctgcgatatttgaggtgatgttgcataggatatagtgcaaaacattgtataatacaagcaagaactttttattacctttactgatttagcgcttgacattgaagggcaaataactgaagcttgagagatagaagaactatcaaaagctatctcttcatgtgctgttggagatggacaattttgcattaccgtatgaaggctatcatcctgaggaggcatagaaaaagaatcagttgaaggatttcataggactactgactgataagtagcaactagcaagtagtaaacatgtaccaaaatttgcaaggaacgcctcttttctacctcaaagtgaagaggaattgtcctaatactgaagaaatctgactcaaaattcatatcgttgaggccaggaaaattctcaatggacatatcatcactttctacattctctcctggtccatgcccacaatctgcatgaggttcaaaaaattcagcctttcatttcacttacaagcatgtaataatgattggtaccaatgcatgaattctctgttaacgatgttcagatgttttaccagcattatgattctccaaaggaagaaatccaagctgtgattttccctcagatttactgctttcctcaaggtggtaaacttgatca

SEQ ID NO: 29331 - DNA, 3463 bp, Oryza sativa
  unsure (1)..(3463): unsure at all n locations
agtgcccatcctaacctccctaaggaacagtataaaatcaaaaattacatgaccctatggcctacctcaatctctcttatagcatctttctttccattcatcaatgatgagacacggaacagactctggttcaaatgaagccaatgtgactcatctaatgtgttctgtgaccaagacaaaacagaacaatttatagttataatttgacaaaattacaaagtacgctacaggaaaaaaaaaaggaactaacccttgcacagaatatatatatgttgacagcatttgtttgacctcgcctatgagctctatcctcagcctatcatcaacaatcaaatgtaccaaacagttagaaacacaataaacaaacactaacagtagggtgcaccatgcatgcgtccaagagagcacacacattaagtgtgcgaaagcatgaaaactcatgcgcatgaaccatgaaatgtagcaatttactgtgcattattgatttgtttcatttaccagataatcttagtccacatcgggataaagaccatgcagaattgcatttgaagcaggcaatagacagattgggtaagaggcgtaaagggatcaaaagagagcaaataggaataagtgtttttaagcaaatagaggagaaacatttcttcttgctcgactgataggggatgacttgacctgatccctatggaaaacatatctgtaaagaaacttacatatatataaagaaataaacccaacaataaaactaattattcttatctctgaattccaattaaagctacaccaccaggcccagtgaataatactgcagttgctacagtacatataaataatatcatagtgcgaattgtgaatggtgggctacacaacaggatggtgaaaaaaaactcaaaagtcttcttgtaccctatggatgaggaaaatgtatgtgcaagagagaaggctaaggacctgaagcaactctgaagctgactttgggagctccacgaaaacaacattctgagcagatgagaaatctaaaccaacaccgccagcagtaattccaataattgcaaccattacctatttggtagaaaataaaagaactagtaaaatagtaaataatggataggcagtttgagaataaaacttgagagcttaacatggaataccaagtatgaatcgaaccgaatggaagggaagggacaacctctggatttaaacggaaagaatcgacagcatctttcctttccctaggagatgtgcttccgtcaatgcggacatacttgatcctctgctctgtgacaaacacctacgtacgaagaaaaacttcagtcaaaagtattggcaaatgtttttcataaagttagatggtatagtttaatatgatataatgctatctaactattataaagtgaaagtgtgcacccgaatatccgattgatcataagtctgatttttcncatgtattcaactgattaatggactatcttgaacatggcggcaatgggatgattgtcttcaatggagtatctccaagtttatcaaccgacttgatgttagcaagtgaggaagctggcctatgtaatttggcggggctaaggggctctccctaattatggaccccagctagggcattttattttagttttagttccttttggtcatgtaaccgcctttgcaatgggttgttttgcggtggtgaggtcttgtacttcttgctgttctttggcgtgtttggactcctattaatgcaatgatatgcatcttgcgtattcgacaaaaaaaacttccaaaccattacgagaacatctacagtcccacagaaagagtattatatgctagagaatgccagaatgctggacatggtactggtggcttctaaaaaacggtgccaatgacatgtacatggccagaccaattttacacatacaccagtgtttctattcatatgagatcctatagtccagcttcttgacacatcatttattttgtttcatttactctaaagatgaaacttctatttcattaggaggaagtgaagcttacaagatatatagaactacaaatagttgaaatgatacttgcaaaatcaaaattacataaagtaacatagttgtgattataaatcttttcttactgttcaagattctattgtcaatcgtgagaaacatagcatgataaactcgcaaaaaaaatacagaaaagaaacctcagaatttacctgaactccatctaggacctttaaatgatgggcgaaaattattgttttctggcaattagactgagagtccagactaccattatcagctggttctttcatgatgaaatgatttaagaaccactcgctgaacccaggtattttcacaataccaatttcttgtgtagtgagattccttggagatttcttgcaaccatcagctgtgggcaaatgaaaaggaaatacaaggaaatgagcacaatgtttataaggagcagacagaccaatcttactaatcttgaaccctgaaatagtagaaaacatgtgctttatcccaagtgttaataccagtgttacatttaacattgttacattaataattgtttatgagaaagaaacatgttacataaggataaaaagaggaaggttgtctcctttaaagtggcacgctactcttaaaaagaggtggttgcctggttgtttgtcaaaaagaaacataatgttttgatcatggtagttcatgtttaacatatcagaatttttttaaaaaaaaataagtacaatgattggaaatggcaagtaatgttcttcacctgtaaaagtacaacaggatattgcacagttgcaccaacatttctacttgatatacatagtgttcttcagaacagaaatcaacaaaaatgctggttatctttttcttgacaaatgttctctgttactatagataagaaaatggctctttttgaaaagaagttgtaaataaatttcgattcagacagtgtcaagtacaataccatactgcgccatattgcattgcttatgtcataaccaactgccaatatgcaaagctgtaaacccatacatgtttggcattgcatatgccacaaatgccaagcaagcttcaacaaaattacagttccatataagttgttgcattttgttatagttctgaaatctaacaatatcaaacattcaaatgcaacaaggtgtgtattatatatttcagcataacaaaggcacataaaattataactgatacaaggaggtctcattatcatatctgccattagctcaatgagtgttaccttcttccatgttcacctcctcagagtcattgctattgtctggcgaggcaattgtaggaatctcatcactagtgttcacccctttgatacaagatatagctgtcttgatatctgatgcattcagcttcaaccaaataatctgtcgacgtttgggaggtagttcattcaacaaatgcttctttcagcgcctaatctacag

SEQ ID NO: 29332 - DNA, 3149 bp, Oryza sativa
ggggcctgaaaagccagggaagtgtgatcagaaaagtttgataagactaacacaatacaatggcattcaccttttccttaccatagcatatttatctgatgatagatgtcaaaaggtctattgtctcctaggagaaaacaaactgtgagatagatctgacaagcaaaatagaagtctccaatcaaggctatcataagtaaaccatacataagtaccaagaaatcagattaatcaagtaaagaaggaaacatataggaatgacaaaaatgtacttgagtgctctaaatctctacggtacaaacagccagacttcgagccaaatatggaaaaaggaagatattgcaagtaacaagtaatgaccagtaaccaatgaacatagtgcagagaatgcatttgaaaataatatgggtaagtacaaatacactagatgaacaaaaaatggttgaaagagtaatagacaaaaaaaaaaactttctgtaaaatttcagaaaattgggccatgataaagttttcatcattcccttttctcaattacaaggcgcaggtagcttggatattgctatccacacccacctctggaattttaaaaccgtttagatgatgtacacaaaatatgtcatatatcatagcagctatctgcatgattggagatccagatatcaaggagtaaaatagcacaatagcataaggagctttaagagaaattcaaccaatatctttaaagttacaaccttgacaaagagggtgtcccagagagcagcacaatgcgactgacatttggcgctagttccagtacagcctgtgtctgtcatgaggtcataaaatagtaccaacggtcacttaccattagtgaaatcaaatgcaatattgatacacaaggtgactgaagtagttggaataaatagtttgagataatttcaacatttgtgcattgcaatattttagaaagcagggagaaatgctgaaaaatataaccagatcaataaaatcaactgggagaattttattttaaaaaaaagtgaggcgtttctagcacaataaaatatgatctaccaaatttacaaagcaccaaatcaccatcatggtctcatggattggagaattcaagagctgaatactttatgttaattgtattgatacataagattgttgcatgacaagctaataatttaaacacctcatttttttcgtgttttttctttgtgcagcgtatgttgtgtgattcatcgataatcatcagtgcccatctcctattcatcatgcttttgcgaagacggcttagcatctgatatgaaatgaccactgcctttgggcaagctcctaaacgttcaagactgtcttggtgaccaaacactgaaaattatacagtgacaaccgaactgttaaaattgtgctcctaattaaaaaaataagtatataacaaaactgaaaggctaaataaagtagtaatatacaattgaaggacaagtgacaagaaatatgatattagccatacttttttaaacagtatcttcagttcttcactagtatagaagaatcaaattattatattgcatatgtgactcagccaaaagttaaaggcactatttaaacctcaagcgcactggtaaacttgagtaaaatacttatgttacctaagtttagggctgaagttcacaattttcaactcaggtcaatacaatcaatctttggttactgcattataattcctttcatactgttcatgaaagcatttcatttttagctagtgcaactttactacaagatttacaaaacctctagctgatcctaggaaacaatgagttcagtaaaatctcaagttaattcaactaaacaaaaaaaaagtagagtgaatcaatcaacaaatagaagcaggtcatctaatctgtaatgttactctatattgaagcatttcaactggattgacgcaatgaatgtagctttctcaatgtccaccattcagaattttcaatacatcaaatataaaatatgcaacatttattaaaaataatacaatctacagtctttggagaaatagaatgtatatgctttttaattgaaaagtgaaaaatactatacttttcatttaaaaactatatttactggaatcaaactagagtaaagagaaagcattgaagaccctaaatgattacagtaatgaaaatgcgggcaaagataaaatcagcacttcacaactatcaaaggcaaaatgagttttatacaccagagctttacaataatcataataccagatttcacatcaacaaactgtaaagactattagaggttgaatgattaccaagatgaatatcttttggcagaaatgaaggatcccatcgttccaattcctctgcccatgtataacgcaaaacagctggacacactattaacactgggccctcatccttgtagcaacaagctattgcaattgcctgcatttaaatgaatgagaatgtgctgctttcacagggaaaaaaggacgctcaaaagcctattcattcaattattcatatgctctaaaaaacatttttttattaagaattgtttggaaatgaaactaaaatggaagttgctatttcatataagctgtgtttctcaaaaacgcaagagagctgtgcttctttgtattatcgaaagaagaagaaaaaaagaccccttacaatgcctcaggcagtttaatattcatataagtctaatttattagtgttgtaaacagtaacatgctttaacagtgtgcccaaacttcagcattatgtaggctccaaaaccttgttttcaacaataatactttattcatgtgcacaatagtcatacagaatagcaatggttgcatgctctcatgtaaaatgctcacctggagagtcttaccaagccccatctcatctgcaataaggcagcgcccatgccttcgaagcccaaacttcacaccttcaagttgaaagggtaggagtgcatctcgtaagtgttgtggcaacttcatgagaagcccgtcaacttctttatcagaagcgcagctttcggcaaagaacttagggagattcttgataacattccttgttttgtaaggtatatcttgcacagcaactccaggcaacttcttcaggcattttaacacgggctcatagtccatgagcttaaatacggagaaa

SEQ ID NO: 29333 - DNA, 713 bp, Oryza sativa
tagggcgaattcgagctcggtaccccaaaaactgattttagtactgtgccacgcaacgaagaaatccgaatcaaactaagccgggatggatctccacgctaccaccacgccgccggctcatgaagcggagggagagagctgagagagaagaaggaatacctccggtgccgaaccgccaacggcggcggcggaacgagcgaggccggccgcgccgcgccgcccccctcccaaaacctgttcacaccggcccgcggcgcgcgcgcgcgcgcgcgggaggaagggcgggagtcgggaaggagtggaggctgcccgaaccgtgcgtgccggagcggccaagctcgccggccgccgcgcgaggaggaggaggagaggcggagcggggaggaaccagccgagccaccgccgggggagagaggaagcgaggcgaggggagatagagagaggggaaggagacgacagatggaaggggaacgggggcattttggtcatcgccattttcctcactttgttagagcagggctatatctatatttctaggtgttaaacatattaagatttgaaaaaaataaaatactataatgtctttatcaaataatttattggtgaaaatggaaaggtcgttgaggggtagaagaaaaagaatttaaataagatgtgagtgataggataagtagtattttagagtgacaagtattgttagacaaaatttgaat

SEQ ID NO: 29334 - DNA, 2195 bp, Oryza sativa
aaaactccgcaagcaatattctactttcttcaggcaagagatcaccatgatgaccctatcattaaaaaaaaaaaaacttctggtaagatagtattcgttatacattttttacaaagaacttttaagcagaatatgcacttggcagtgcccttgtttgaaggaatatttggacagaatgaacagagaagtgaatttataaagacacatttcttaaaagaaagtaagttcagaccattccaaaatccatcagtgagctgaaactgaaactaacaagtgatgattcaagccatttggatatattaactgcaaatcgtcaggataaaaaactgacaaaatgcttcactggttgttatacatttccataatttatatatgagtttggagacaagttcaacccactagcagaaactgaatttggtgtttattcttcctgctggtatatttagtagtaatgcttgagacacttacgatgcgggaaattcgatcacagacagcatggtgcataaggattccagctgcaacagatacattaaaagaatccaccatgcctttcataggaacactgcagtgcaagtctgacaactttaaagcatcatcacttatgcccctgccatagaagtagaatggctagttaatatacaagtagctccacaagtatactgaaaaataaattcccctaagttagtgtgatatactgagtactctctttactttccaaggtataaatccatataaaattcacagtggactatttggaacttctgtagtaaaaacaaacatggcatttctagtttcgaataggaaaacttttaagcgaaccattttgtacaacatacatcaagatgattaagcagatttcttgcaagaggagatgtcagattagttaccccaaagtgattaaaaaagatgtagaaaagtaatgataaagtgcaacatacatgaagtagaaaagaggacatcgtatctgatcattccatttaaatacttttgagactcattataacatgattgcaagagaagatgtgcatctggagaagaggaagagccctacataagttcattgcccacaacaatagcggtaggttgcgaccaatccatgtcgtacacacaaacctacagatccattacgagcatagttattccttgaactgtattacttagatcagtaaatgataaagcatctttcaatgcaatacagagcggaaaaaaagtatattgagaaaatgacagtgtagtattacattgttgcaaaatcccacaaaaggctgaagttaccaattcactaaagaatgtgtatttgggacagataaatatatctttcattctaacctaaacggtcactaatatactctcaaataggagatgacaataatcattctgcaatcagtgatcaacaacattggtggtggcaacgaccacacaccaatctatttcaaggcttttctagcctaattttacaacaaatgtttttatcttgtctatgtaagtcactgaaaatgttcttacttgaaaagaaaaaaaaagagttgtctttcactgcggataacaaatgacaatgcatgtaatgatcacaatcactcttttttggcttactgttcaaaatacgagcgaaaactaaaaaggtgagcaacaacaaattaccgaatcatttcccaaataagtagttgcaatgcgataaccacgcttttttaaagcatcaaagcattctgcagttgagctccataattcgatatcaagccatttctcagcacccatgctcacatgcctattgtctctatacctgcaatagttaagaagtatattcattcaatggtcttgcaagttgagaaatatatacaaattttaaaggatgcaatacgtatataatttcattcagataatcagatatcagaatttatgtataaaaaaactaataagaaagaaaaatgttctgtgttcttcagtaccaatccagtggtctaattaggaaaaaatttagcataaggaatcactctctttgtgttggatattagaactacatgactagatgagggatcatttccttccggtcagtatttctgccatttttgtacaaactactgaatggacaaataaaatgcacaggtcacaaaaaatatttctcatttattttgcacctcaatgaaaaaaagaataataccatgcagtattgaggtaatcaggtattgcagattcag

SEQ ID NO: 29335 - DNA, 479 bp, Oryza sativa
tgaaaaagagcaagagacgatgtgcatcaaactatttggctccctacatgatagaatcagcctttgttggattatcccgaagcaataatactcataaaacgtcgtataatctacatccgtcgaattttatcaataccatatcctatatcaaaaaggcaaatctatcagataatccacataaaaagtcaaataatctacatccgtcggattttatgaataatatatcctagtctattgaattttgtaaatatatataccagaatcagagtgaatcaggataacaagatgcctattattcttcctgaaaaaatggtagtgctcctagtgcatctatttattaacagaaaaactacgatatggtatcccatctagggagttagggacgagatacttaattaatgctctccatccaccctaagtgcttcccatccactcgttgatctttgtgagccacacacccatacgttcggcgccaccct

SEQ ID NO: 29336 - DNA, 1538 bp, Oryza sativa
ctgccgccgcaccccgccgtgccgaagctgccaccgttgcccaagcgtgagctgccgccgcaccccgtcgtgccgaagatgctgccgcaccccgtcgtgccggagctgccgcactacccggccgtgccggggttcccaaagcacgggctgccaccgaagcctgagctgccgccattgcccacggcggagctgccgccggagcacgaggttcacgacccggagccggagaccaagcagccatgatcgtacatacacacacagtattttttttttagacaatggattataaaaaacctggcctctacaccttgtgaggatgtacacagcctaaaagtaacaaacacgagtacacaagactataagactctcccgttacatgggtaaaacataaataagttttaaagatggataacaagcaagaggaactaaaagctaagcttccatcattcttctaaagttccacccaaaagtagagaagatcagctccatcatacacttctctaaaagcttgcacttcgcgattacttcaatgccttcgtcttccttaagaagcaaagaccaaagccttgacaactgagttactttgaaaattacctgtaagaaaaatacgtggttgtagccattaaagactataattcatttatattgagccacaaagcccaacaaatcgctgctatacccacccaagtttgtcttttaagcttaggttcaaaacctcttaaccaattttcaaacaagtgtgaactattacggggttgcttgactccaaaagtaagatagatcgcattccaaatgtatctagccattatgcaatcaaagaagagaggttgaattgactcattagagttacaaaagctacaaagcaagctacccttccatcttcttttagcaagattatcttttgttagaatcacccccttttcaatataccaaaggaaaattttaatttttaaaggaatccttagcttccaaattaaagatttcccaggtattacaccattaagcataagggttttatacatggagttaacataaaacaacccttttttttattgctcttgcaaaagaattggtcttgcttatcattcaaattgatactcaccacctttgaaacaatttcaagccaatcttccaagtttttccctacaattgctcttctaaaagagacattcaaagggacccttcctaacacatcggccactactaagtttttatttctaaccaagctatacaaggttggaaattccaaatgaaggggttggtttcccaaccatcggtcctcccagaatcttacttgtttcccattattcactgtgaagtggccaagtgtctggaagggttcttttgctgccataaggctagcccaaaaatgagaatcccccggttgtttttggacctgaaaaatggatttccttaccaagtattttttcctcaacaaattctgccacactccctattcattaattaacttaaagatccatttactaagcatacacttattttgagtctctaagtcctggattcctagccccccacat

SEQ ID NO: 29337 - DNA, 530 bp, Oryza sativa
aatgccaatatcacttttcatggttggatatctagaatgactaatgttcaacagtagattgtgtatgtcaaactgttacatgcttaagccttttgtattcaactcatgaatatatgtggcttgctccatatgtgataactgatattactcctagtagctccaaaagaattaactaacatttgttggaaactatactatagttactttcatgtctgaaaagcttggttgatgatctgggaatatagaagttggttgtttatggtctgtttaagggttgggttatggggcgctgatagcctgatactgcttttgatgttgcctccctgtgtagagaacgggtcctgaactggttagctggaatccccatcctttttttacctgttttcagtagctagttgtccctgttgtttagttttcgtttcttttgtataagaccttgttatgttttggctttcttcaaagggccaggtaatgaaatttgcctattgtctaaaaaaaagcttggtagacattactaattatacttattc

SEQ ID NO: 29338 - DNA, 1475 bp, Oryza sativa
atggtggcggtggaggaggaggcgcgcacgggctgccgttcctggtgctcgcgcgtacggcgttcggggtgcgcagcacgcacttgctggcggtcatcagcgtgctcatcggttgcgggtggttcggcatcgaatcctggatcggtggccgcgccgtgttcctcctcctgccgtccaggctcaagtcgtaccagccgctgctcgcgccagtgccaggcctggggctgcgccgctggagttcgcgtgcttcctcgctttctgggccgcgcagctcggcgtcatcatgcacggcatggagggcatcagcaagctcgagaagtacttggaccatcacgaccaacattcccgccaacgtggtggtgccggcaaacgcgctcgtcagcttgagcccgcggaagttcacgttcgccaaggtggcgctggtcactgcgttgcttcgcatcgccttccagccatggcggctgttcggctccagcgagagcttcatctacacatgcccggtcgagctctcctcaggcaccagcggccgctgggctccccggcgacctataactctgacgcccatgagggcaaggtcgtgcacctgcatcgtcgaggacggcggcggcggcagctcccgagaccgagctcatcgtcgagcacggcggcgtcgccatgtgcgacggtggcgacgccacgttgcgccggccgggcacgtagcagctgcggcgcgacgggggtgggtggatgtcggccaccacgaagtcaccgtcctcgtcatcgtcgtggatctccagggggaggaactccctcctcgtcgccatcgtcgtcgttgtctccggcgagctcgaaggtggcttacggctggcgttggccgtcgggcgcgacttccactcctagacgctctcttgccgcggtggagcacgaggagcaagcccgggggaggaggcagccggcggcgtcggcctcctcgccgaagaagaggaacgaatggtcggccggcggatgggaggccgttgaagctcccggcggatgcggaggccgaccaggaagccgccgcgcgctcccgcacctccgcgacctcctccgctccctcctccactcccccgcgggcgtcgccgtacgtcttcctctctgacctcctcagccctcgagcgctcgctgtggccgccgagttcgcaggaagaaagaagagggaaataacgtgatatgacgccacatctgacgggggaaacgagacggcgtgagataggagatggaaaaaggaacggcagtggcatggttccaattttataaattttcagtggcatgtagccgatatgatgaatagtagtggtattttttaaatttagcaaagttgcagtggcatggatccaattaacccttcttttaaatgccattagaaccatgaatgctctttattaaaccatagtttgaggaactttcatattcaaaatgatccatgaagtgggatgatcttatccatgtcagcaatc

SEQ ID NO: 29339 - DNA, 1479 bp, Oryza sativa
  unsure (1)..(1479): unsure at all n locations
gccttgatgtattatgcatagcgtaaagagaacataccgagtccagtgtggtgtacccatccttacagcaagcaacaacgagtggtcgcaatgaagtgaacggtgagaagagctctgaatcaatatcctcaaagttcccataggtattttcaaattcacgtagggtaccaaaagcccgctgaagatgaccaatggatgaatgagcataaatcttggcaagatatgcctctggcgtcggtgcccttttctggtgcaaggacttacgtaatattgaccaagcagcattcaggagatcagtgctacaagttctggcagcagcacttagagctgagagtactaaaccttcatcaactgaaagatgaagaggaggaataacacgctcagaacgagcaatccatcttgcaagatattccaaagcaaaaagacccagcttgctgttgttagcttcaaaagcagcttctgctatttcaacacaccaggaccatggtggacacaagactttgttctgatctgtagcctgaaacaaaataagtgcaccgttagtacatacaccgagaagattgaaacatatattcgaaaatgaagaatgttgaaggcccattggtagcccacaaacttataacaattgagaatttccagcattggaaattaggagtcctaactaacagtatataaacagtaaacagacttgtcagtctaaaagaataataagtaccttgcacttctctatgactgatgccaatgtatccaatctaccagatcttacacatgcccggacatactcaacaaaaacagaggaagatattgtgtagcctgatttaagcatcaaatccaaatatttcaaagtagagttcaccccggtcagtttaatcagaagatttacaaccaaattgtaggattcgtcatctggtgagtttcctgttgcaacatccctgatttcacaagataaaatcattttcaatgtgaaatctgtagcagtagtgaccccagtataggcaacatatagacaaaaccaaaatgcaagcncttagagcataatacatgaaaatgctatcgtatatcatttgacaatattctgcacaattcattgacaataataacgttcttacagctgcaagaaaaaaaacttaagttcctgaatgttatacacaatctgtaaggcatcttttagttttatgcactaactacatattataaattatgtatgcaatgttgataaagcatctgagatatgttacatcagagaaaccgtaagtgcaatggatccatggcttttataaaacaaaacgttacatcgtatctatgttacccactaagcatcagaagaatgaaaggcgtgcatatctagtaaactagtcgtgtcactaaagacgcaattcaggccttaaaatttgctgcaaacgacctacgaggttccatggttgagttgtacatgcacattatgacaacaatgaatcagggaatggcgatctcccattc

SEQ ID NO: 29340 - DNA, 1200 bp, Oryza sativa
gccatggcggaagaggaggtggggtttggactagggttttagtaaggtgggagtgagagggaaagaagccgccgacggcggctcagaccggagatggaatggaacggaaggagcggagaaatgaagggtgtgtttcgtaattttgacttgttacgagggtgaatatgtaaatttttgtgcgaccgttgcattcagttcgacggtgtatcactgcgataaaaacggtttaacccacggaattaacatcggagtacgaatttcgaaattgtttgtgccaaattcctgtgaagttcgcctgaattttgagcgatgcaaatggggctcttgtctatactagatcaatgttagagatggggctttgtaagaaccttggcagcacgtagctgcgttttgcattttgcaagagagtggcaaacttacaaacatgaatttgaggatcagatttcaactcccagtatgttattgttgccaatcggtttcttacaaaaagattgctttcggtcagttccatacaacgagaaatgttgccgatcatcagtttgcatactactcttaactaaaatcttctacaagtagttcatgactcttgaggatccccggatgcatgttcctcttccaaagttgaacatggcgcgtcggataatcgcatccgttgtgcagaacttcattgccaagaagctgtcagcactgtcacctttgaagatatacagacaaacataaagcacattacttcggggagccatagaaactccttgcagtatttgattgcatggaggtgcctgttgagtgcaggaacaacattaaaatgctaatattttgtcagctgcaagtcccaagcagcaaatactcctaagtatattgatgggacagaacctcaaacagcaagactgaaagactaatatatatatatatatatatatatatatatatatatatatatatgacactcatatggggcaccatggtgcccgggcaccatggtatctaatgcacaaaattactcaaattttttcaaaattttcaaattgtgagtatatacctagttataataatttgattcatacctatacttatcaacaaaacaactcaaatttaactttatttcacaatccatgattacatacctaactaattatatgtatggatgctatatacctagaatcaaaatctaacaaaaacaagttcaaattcagttcaaac

SEQ ID NO: 29341 - DNA, 440 bp, Oryza sativa
atccaagttgcgacctgcagcaccacaggcatatgataattaataaacaattcataagttgccatcgctaaactagtgagttacgaaatatacctatgaaaactatcttgtttgtgcgagattctgtcttggaccattctcgagctggcagaacttcataaacttccctcactgcctgcatgagagcaaacaggtgggataatatttgtttgaaaactcataatgtatgattcttgagaatactttttatgatgcaacaacctgtaatgtatgaacttgatccgagttatggacatgtaaaatccctttacaacgataaatatccatgtccaacttcctttcccaaagaagatcctcgagccatgattccaccttcagaacaaattaaatcaaacaaaaatgcatatatctcacaattgtatatcggtgttcattggtca

SEQ ID NO: 29342 - DNA, 733 bp, Oryza sativa
tccagttcagccgcgctgtgggcgccacctcgtacggcgaggccatgggcgacgccttcggtgctttcggcagggggatcctctagctctgcgtcgtcgtcaacaactgaacaacgtcggcgtgatggtcagattcactgaacatttcattgtgactctaatggcttgtgttctttttccctgggatgagttcagatccactgaaatacacgccggccgtgtcggttgctctggccatcgtgttcgtggtgatcaatgtcggaatcgccaccatcaagctgatgagagggcagattccgatgcctaagctgttccctgatgttcatgactggagctccacctggagacttcacactgcagctccagttcttgtgagttgtgaccgcctacatttgccattacaacggtacattttaattaccagctaagtttgcatttttctgtgggaatgtgattaacttgccactgcattcagtgcacacaattcacaacgagctcaaggaccactcccagatcaggccaatagtgcgggcgtcactgctgctctgcttggtcgtgtacaccaccaccagcttcttcgacttcctcctcttcggcgaggcgacgctggacgacatgctcgtcttccccatcgtgttccacgcgctgcgattcaacatggacgggctcctcttcccctcagcgaggcccctctcctgcgaggctgcgacaaccggaggttcggcgcgatcac

SEQ ID NO: 29343 - DNA, 1294 bp, Oryza sativa
ttcggccggccggcatgaccggcgaattagaagagaagagaagagaagagagagagagagaggaggggaaagagatgacgtgtcatcctgtcatgtggggcccacgtgggtcctacgctgactcaggcgccacgtaggataaaaccggtgtcaaaaccaccgaaggacatattgtaaccggttttgattagttaagcgacgtcgaatatctggttttgcagttgagggatgattttgtagctcgatgacaagtcgagggaccttcggtgtactttttcctcaatttgcggttgtgcaaattttcttaaatttgggaaatggtttacgcggtgacaaaataatttctccgctgtttgtttgttactccagcttatctccgctgcatccgaactttaaatttcgaaaaattttagagtttatttttttcacattagcaattaagttgctaagaacatcaccaagtttttttttaacgacttgcacaagacggtgcaaaattttattgatagaacaggaaaaaattacaaagattacaaccatgtaaggtcgtaactaggaaaaacgaaaaaatataccaccacccacacaccggtagcgccaaactacaagtcttggagaagactagcatcggaccgaccgccgctaagctaacaacggaaacaaccaagatcgcccaaaaccttatctttacaaacaacataaagcccaattcatccacgtcttcaggatctagggagaaagggtgggagagaagatggaacacctctccccttaggccctccgccgtggccaacttgttgaaactaggacaagttttttttttttggttgctacattgatttctccacttatttatcagccatagagcaaacgatgagaggctattaaatgctaatttgttttatttttgtaggtcatggttaatttgagtttataatccaaaggagataatttgaattaggatgtatgatttgctagtataattcctgtcacagtgaaaaatctcacagaacattgctgaaaggggaaaatccaaataccccccccctacaagtcactgctctttctactctccccccacaactcaatattgttcaaaacactacacataaattaatttctcttccaattttccactcctattcagtttttacgctttctcgtgatgcgctcaatttctcgttatcgtgggccttcagcgcagcccacgggtggagttgtctcgtgccacattggcggcaaaagcgcgcacaccttcttccactttccatctttccctgctttaatttcacga

SEQ ID NO: 29344 - DNA, 1011 bp, Oryza sativa
caggaaatatttttttgggaatacacgagacacacattttttattaagaggaataaatgtatttacagagcgggcctgaaaaccaaaaagaaggggacagggtacaggagaggggaaaagaaaagcataagcctaatctcccgaatgatttggcgacccaagaacaaacgaatggactgtcatggttggtatggctgatctagccatccgccagaggtccacttccccatcatagccctagctatcttcatccaaggtctgctcttctggttgaagacccgattgttcttttccttccagattgtccacgctaccagtgttgcaattgtgtcgaaccctcggcgatgatccttaatcatccttttgcgactgtcacacagccaggcatgaaaggactgctcgttgagaggtagacattcggaatgaccgatagcactaagagcaatccaccaaagctgtcgggactccgggcatgcgaccaggagatgatcaatcgtttcgtcgcgttgatcgcagaggggggcaatgatccgggaaatatgaggagagtctatatgatagcaccataggaaacaaacaaagcataggaaagtttccaagaggttggacctcttgcttatttcctatgaaattgagctataggaatgcaatcatatgaaaaatttcctatacttttatgtgaatcaatgggtttcataggaaaaattccttaggaaattgaatactccaaaattcctatggcaatcctccaatttaagggtcctaaaagttttcaaattcttagatatttttgaacaccaggatgtgtatctcttgttttgacgacacgtgtgtcgtactacctccattttcatttactcatcacttttgattgtgaatatatgtcactacgcacttaaatatgtgattcctcttttgcccttggtgagcctaattaaggtcatatatgtgcggcatatgtatttataaacctctagattctatatcccactaagttaggggtattttgat

SEQ ID NO: 29345 - DNA, 588 bp, Oryza sativa
  unsure (1)..(588): unsure at all n locations
gcaggtcgactctagaggatccccgtcaaagattcaataatcatttagttttcagaaaaactcttgagttctagaacaattacaaatcagtccctaatctcagagtaaccttcaattttagagaccccgaggtgtgaagtctccaggtggagctccagtcatgaacatcagggaacagcttaggcatcggaatctgccctctcatcagcttgatgggggcgattccgacattgatcaccacgaacacgatggccagagcaaccgacacggccggcgtgtatttcagtggatctgaactcatcccagggaaaaagaacacaagccattagagtcacaatgaaatctgagcccctagcagcaggacatcggccctctgccctgacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 29346 - DNA, 552 bp, Oryza sativa
cccttccatcctccccacccgcctccctccatccctccgtctgcctcctcacctccgtccgccttcccgcgcgggagagaaagagagagaagggagagagagaggaggaagaaggaaggaggactgacatgtgggccccacatgtcagtgggcccacatttctttttgtgtgaatgactaatgggtcccacgcatattttttagttctaccgccacgtaggtgccacgtcatcgccacgtggaacgaagactcggtcaatattgccacgtaggcgccatgtggcaccacgtcagcaaaaccgcctcccaaaaccgcccagggagtcaaattgcaccggttttgtaagtttggggagtcaagatttctggtattgcggttgagggatacgatttagattcggtggtcaattgagggagtcaaggtgatcttattccggtgtatgacgacgtcgtggtttgggaaaaagtctactttacatccctcatcggtctaaactgcaaaaaattacagatttttccccggtttccgttaacatgcttttcaaactatta

SEQ ID NO: 29347 - DNA, 618 bp, Oryza sativa
  unsure (1)..(618): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaagagactactgggaaagcccttacagcttcccttgagccttgagttgtgctacctgaaagataccaacaaccacagcacaaaagtacgttcctcttgattttgagtgatcaatttgaatattggtttaattccaaatattgcagaaaatatgcaaaagcaacgcttccatgatattaagcatatctatgttctatctatatcattctttatgcaagtttttcttatgttctagaaattgctcaagttctatcaggatttactctaatagaggatattgcaatgtttgacttttactctaatggaggatattactctaatggaggattcaattggtgatttggcatatacaaaaaaaaagcaaaataaaactgcagcttttaagctgctagggggatcctctagagtcgacctgc

SEQ ID NO: 29348 - DNA, 652 bp, Oryza sativa
gtgtgagtcttccttcaaggctggtaccgatggtgatggagggaaaggctgactaaggtgctagatctagagcttcgattggcagcttgtgctgtttgccaatccatcgtgctgctcgtcaatattgtgtgtaggtacactgtgcagcgtgtaattctcgcttgataccgataggtgccaagtctgatactcgtggtatcatggctggtatgcacagatatcaggcatggtacctcgggcaccgataccatcttataaccattggtgcctgatcagtaggacactcgccatcgctgcttggctggctggcgaaccgtttcccactaatgtcttttctccattcaacgcctctccttggctctggtctttccttccctagtgttgctgtggctagcgttgccatgtgtgtcgacacctcctagcatcctaggcattggcgccgatgcattcgcctcaccatgctcctccgtcgaccaatggttctgctcaaggtgtgagccatgagcacgtggcgtggggtgggacggagtcgtagacttgcgaggataaagcggaggtgcggatgacatcaccttcgtaaagtatcatgtcgaatgggcggaatgccgtcccctagcaatcatcatttattaaggcataacaaacaaggcaa

SEQ ID NO: 29349 - DNA, 1240 bp, Oryza sativa
actccaggaggatggcgctcttcctggccgtggaaccatggagagggaagtatttggttctaatcctcagcccatcttgggtcgcatggttgcgatcgaagattatgttctctgcggttttctccctccaccttctgaatttcttctcctggttttgaatttctatggtctttctcttctccatttgaaccccaattccatcgccttccttagcatctttgtgcatctttgcgaggcctacatcggggtagagcctttccttgatctttttcgcttttactatgaactgcgttggatggaatccaacagggtatctggttgcgtcgggttccgacttcgggatggcctgaagttgcgttacgttcccttccagtgcccttcttctcgcagcaagtggaggaataggtggttttatcttgagatcaagaactcgaaccctgtcttcgtggttcctgaagatcaaccggacaagattccgtcttggaccgcaaagccccccttgaccccctctcttcaatcgtttatcgacatcatcgacgatctccgagtacggggtttgtcgggatatgaagtcgttgcagacttcgttggtaggcggatccagccgcttcaggctcgggcccatccagcttataactattccaggccagaggacgcgacccgggtttctcctcggggtatctttctcgcatttatcttgacatacttgtgctcgcattcctcttgacttatcgaaggttggttctcgattaacaggtttgagcggcgaaaccgtggagcgccgcgtcggccaagtgatgatcagtggcccgaccacggcgagtgacatccctatgcccctttgtgaaaagggggcggcggaacgtgatgaagccatcaatgtaagtatatttgatgaacatcccgcattctcctttcgaaatcactttatgacttgattgagcgtaagcccttcctttgactgatatcatcggaccgctcgcggaccatcaggtggcgtcatctctgaaagttaaggtcgtcaaggaggtgtctgatgctgccaccactagcggtggcagtgttccgacaaagccgaggaaattctcgtctgtaagaaaatggaccgtcatcttctatccatgcaaattctaccatccaaacatacctctcactgactcactcatttaacgctcctccacttactcgctcggcttcgttttatgaatttttaaagtcttataaaacgtgtcaacttact

SEQ ID NO: 29350 - DNA, 3398 bp, Oryza sativa
  unsure (1)..(3398): unsure at all n locations
ttggtttgttgagtccatcctcccgtctcctcctcgctggttccattcctgcaaatgcataattaagcaacccagccactgtttttcctagtacatatatagagacaggccggccgggccatccactcacgtgtgtaggaaattaaacggcgaaaaacattggatgcactcagctaggacaggggcacagggctttgatgtaagtttgtactacaacttaaagaggatacagttgatccagacactgcggagaggtacaggacaacaacaggatatgtgtgagccacacatcccacacaggatggatgaacagttggatgataacttgatcgcaatccgtcccatttccaataatgttctcattccaaccaatcttacttatatcatttttttccagatttacaaaaataaaaaccctgagacagacaactactgcctctgttgtaaatcaatctatgtacaggacgatatctagccaaacttttaaagcgttcaacaatttatagcttcttaagtgcttaatttaaataagcaaaaatatgggtagatttggctaaaaaagtacgtacattgtatttttagagagaagaccttgcggcccggtttatattgaaagccacattacgtcatacggtagagttggtaatgggggttgccagtttacaaaagatgaacaacttaaccaagtgactcaacgagtttggagaaacaccatgcgatcatcatgcaacagggataaaacctgcagctctaaagtagcaagcacctgatgtctcttagatctattacaaaacaggaataatacagaacattagcagaggtataggctacccaacccctgttcttcggatcttcaaagcggttgtcacatttttcaacttctctgcaaccatttccatctccacaacatccttagtgtgacaaagggctctccgcagcaaaagagagatgattcgaaaaggtaggatcagtggagagtacaacggcttggatctggaaatcatattatttctagtggtccataataaccagcaaacaaccacaaatacagcagtaaaaactctagattcaacttggttagaattgttaattagcaaaaagaactcatcaaaatctcttgttccccacccaaaagaatctctacaaatgcaccaagttaaagaggccatgaggtaggtaaaaagaatgtgggtggtcgatacaagtgccccacctattgacaaaattctgagcactcccagttttttttaattcttctacacactgcattttcacatctctcacacctctaaaggccattgcttcatagagtgactttgtggtgtatagtttattagctgataatcctcagatcatgaggtctggtgaattgactagtacaatctcttcaattatatatgtgacatcatactttctatgtcttcaaaagatcttataaaagataaacaactagcactctttgttaccaactttgagattgtgatgtctcgttggttacaaatctaaaaaatctttgggtatgtggtcttaagggggcaaggatcatgccagaaccatatatgtcttccatcctctagaagccactatgaccctagtttcatccattttctggtattcagaattctttctcgaattgtgatcccttttgaccattacattgggaaactcctctatcctaaagatattttttttctcaacaactcaacacacagactattgtatgaggactcaattttcataactcatttggccgatagaacagtgttcagcattctagttttagtcaagccaatacccccaaagtcttttgggaaagccaaatctgtccacctcaccatgtggtattttccgccctgtttgttaccagctagtaatacctcgccataataacttttgatgtaatccctcgaaaacagaaggtacttgtaatatcataaagtattagttttataagtttactttaatataaaatttatggtcaaagtttaaaaagtttggtaagaacttatctagtcaaatatttatggttggcggaagtaaaagaaatggtgcgcattagagaaattacagagcaagtttaacctttatggtgtaaacgtatgtactccactatacagtggaaaataaaaaagacatttcttacaataaaaaatataacgacataaatagatagtcccttcgactatttgagcgatggtagagagggccatggaactaaatattccacttgactagagcccgatcgagaggaacagaaagaagggaaataggagctatggtaagctgcagggtgtgtgtcaccggggccagcggctacatcgcgacctgcctcgtcaagaagctcttggaacgaggctgcatcgtccatggaacattgagaaatcttggtacgtacaacgtactccgatccatctctagctagccagctagagacctctcccaatcactccctgtttccaattgttggagatatggagataatatatctgacaggagatgagaagaaggcggcgccgttgagagagctccccggcgcggcggagcggctggtgctgttcgaggcggacatgtacgacgccgacaccttcgagccggccatcgncggctgcgagttcgtctttctcctcgccaccccgttttagcatgaacccagcagcaaggtatacgtagtcacaagctcgatcgaacacgcagaaaaaaatatcaatgtcatgtcatcatgtgtacgtgggtatttgttgattttgcagtacaagaacaccgccgaggcggccgtggacgcgatgcgcatcatcttgaagcaatgcgagcgatcaaagacggtgaagcgcgtcatccacactgcctccgtcaccgccgcctcgccgctccgggaggacggcggcgaggggtacaaggacttcatcaacgagtcctgctggactccactcggccagtctcacccatacagcagcgacatgtcggctataaatcaagtaatcaaccagcaaaaaaaaaggttatttttaaataattttttttaaaaaacaacaagatatatattgtgataacataagttagtacaacaaattagccctacacttaaagaaagaaaataacaaattttcatttacagtgtatttttttgttattttagtttctccgactgcagatacacgttggaagaatgtgtgcttaaattgctcctaggtgtactaatatcaatgtccatcaactaatggggtgtttagattcaggggtcaaaagttctagcgtgtcacattgggtattatatagggtgttgcatggggtgttcgggcactaataaaaaaactaattacagtatccgtcaataaaccgcggacgaatttattaagcctaattgagnnnnnnnnnnnnnnnnnnnnnnnnnnnnnnnn

SEQ ID NO: 29351 - DNA, 797 bp, Oryza sativa
  unsure (1)..(797): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcaaactgatcataatcctcgtcaatcttgtcctctactccgacaattttccttttgcctgggagaaccacgtggcgcttcggctcgtcaggcccttttcccttctttcctttgctagacatgtccttcacgtaaaatacttgcgttacattattggcgagaataaaaggttcgtccgagtatccaaccttgttaaggtcaacccccgtaccaagtggtatgcctccatctcgttgggactggggtgaaatgaccaggagaatggatacccttgatatttagatgggagagatccaatacaacctcgaggaacacatagcacaaacgcaagaatagcatcagactactgatgctcagttcatcaacatcaacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 29352 - DNA, 1148 bp, Oryza sativa
caaatggttacacgagttcattttaagcagaagtcgggggctactatcagggttacgggttaggcataccctttacccttcgatatacgttacatatcgatatggcatacccacgcgcatgtagatatttcctgtatattctaaggaaacctttcacagaatctacagatgggaagaatcctactcgggcagaaccaggtcgttggcgtatcgtatagggtctgatacctccgagttctatgaggaaatctccacatctgcgatataaaaggggccccccggggagggtttagacatcgaatctcagagccaacacaacctccacagcctacgaagccggagcttacgaggagccaagtcatcgagagctagtcgaatcaactcgactacaatctcgccggatccgacaagttcccttgttctctttgtaacctgtgttttctaccatataattccacatcaactggactagggctattacctatcaaggggtctgaaccagtataattcttgtcttttgtttgcttgatgtcgtactacgtagatccttgtatcaacgtaccccaataccctctatatccggtctacgggtatcacccgtcgacaaatctatgatccgatcacaccgttgtattcgttgtaattaaatctttacaacaagatatcgcatgattatattttgataaaagaaaaacatatgtttcaatctgttaatacttattgtttcacatgtgacagcgacatgttacaatgtgtatcttcaccatgtttcataaaatatttaaatgtttcaattgctgttttttttgtttcaccatatataacttaatatttcacttgttggtcaacgctctcccccgcactgtcgtgcgcccgcgttgctcccgtgccgcgttgcttgcctgtcctgcatgtgttgcttgcgttgctgcttgcatactccctctccctctccctctccctctccctcctattacatgtgcctaattttttcctcaaattttaaatatttttctccaaaattatatatctgatctaagtttcaattataccattagatttttgcacaaatacttaattatgttgaaatatttttaaatagacgctacaaatcatacgtgggtaccgagctcgaattcgccctatag

SEQ ID NO: 29353 - DNA, 300 bp, Oryza sativa
ggagctcggaacgagctgttcggcaacggcgttccggcgagggtggcggcggcccaatacggccgcgacgtggcggtgctgaagaaagcggtggagcgtgtgtaccgcggcggcggcgaggtgcccaaagtgctcgcgccgggcgggttctacgacggcgcgtggttctcggagatgctgcgggtgtcggggcgcggcgccgtcgacggcgtgacgcaccacatctacaacctcggctccggcaaggacagggacctggcgaggaagatgcaggacccggggtacctcgaccaggtggag

SEQ ID NO: 29354 - DNA, 1092 bp, Oryza sativa
aataagttagatgtgtaaatgtagctagaaaaacgtaagtatagactacgtgaaatggttgccccatgatttaaaaaaccaagtatgttttagtatataaatataagtgaatttgacttgtacctttgttttgatatatctgtggcttatctagtttactttttattttttattcctgatgcactaagcaggtttccaaagagcagagaaaattgagtggagccctgaggaaactgcaggaatcacatgaactagctcagaagcaatctatggagataaagaaattgaaggattctttaggggtatgtgcttgccagggcgatagtggcctagtgctccatcatgttttcttagtctttacattattcgactctagatgctcccatcagcttcatggtatactgatatgtacgcgtccattccagaggtttaactctgcgttgaaccatgggacagtttgcagatcttgctcctgcgggttctgcgcaatgttgttagagctgtctaactgctctatcgaaggactagttgatgttagatcttccaatgagaagccacagaaccaagctctactagaatggcgtcctgatgaagatgcggatggtgaagccggctagaacataggagtgctagatgatcacttttgcactcatgcgtgcagttgttgtagataattctttgtaccaacattgttatatgtaaatggggttaaatgcacatgtatttgtaaatcttagttagctgttttgttttccagattgctttttctagctttctctgggtgttgatttgctttttctagctttctctggtgttgagctccaattagtagtgaaaaatgtatgttaaacttcatgtttttttcccaagaaattttgggtgtgccatttgtgcagcaagttgaatgctgcatcttttccttagataatgctagaagaacatgcatcttaagcagtcggaccaccttggtgatgctgtgtgtgttttcagcaaggggaaaatccaaatacccccctacaagtcactgctctttctactcttccctctacaactcaatattggtcaaaacactacacataaagtaatttctct

SEQ ID NO: 29355 - DNA, 1081 bp, Oryza sativa
aacaccaagtcaaaaacacattccagaatatttaagacatgcttattgaagtagaatccccttaaaaatcacaattcaaatctgatagttagaagtacagaaaattatttgtcgtaaaaaagatggtactgagattaagaagggatcagcatcccccactaattgtagctaagaattttgatgtaaataatactactgcataaaaataggagatcagtttctcctaatttgcagctttcttccagtaggaccgatataaggcccatctggcacatgatggtagagaccaacaccaaatgcattgtccatatatactggtggctgtgtggatgttgttggaatatcatcttttgaactagaactaataggctgggaattgctcctcttcttcctcctagttatttgtgttttacactgagagaaacagacaacaaattgtgagaagtagcaaagtacaatgtctttatatgataaattagtagtgtactcacattttgagatgaagaactttggttgtcttttccatgctttctgctgttatgaccaaactctttgcagacgctacatctaattgttgtctttgcaaccgaccttccttgaaccctaggttcatcagatgctctagttctctttgtttttggcctccctggttgtgtcctagccacaggtgggtctacatctggaaatggagttttttcccactgtgtctcatcaggaacgggataaatcatcccacaatatgtcctcgcatatgcatcctttgtcaatatgtcatcaacatagctctctggcctttgcttgaaaccttgaatagctgaaacaacatgcaaacatgggattccagttaaatcccattttctacacccacaagtgtgcttgttcaaatccactacatattgattaccaaatgcggacacttgccaaatgcccctaccagcacacacagatttgcaatatcttgcctctctcttctctgcctcaagcttctttaatatatttggtgggatttgccaattgtccctttctacaccttccctcttattattgaaatcagggtaccgagctcgaattcgccctatag

SEQ ID NO: 29356 - DNA, 1538 bp, Oryza sativa
  unsure (1)..(1538): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactaacggctatttgaccgttcaaatttgaaaataaccgttgggaggctaaaatattcataaaaatttcgaaaaaattctaaaaaatctcaaatttcgccccgaacggcccgtgggccgcaggcgtgccgtgccggcacgggcacggcccggccatccacgggccgtgcttgggccggcggctcggcacgtgggccggcacggcacggcccgtttcatcagccgtgcctaacgggccgtgccgaaacgggccgtgccggacccgtgcccgtgccgggccgggccgtgccgcccgtttggacacctataagtaatggcgatgaccagatggtgtctatctatctacaatgacacatacgcatcgctagttgttcatgggtaggctagtgtaagccgacaatattcattggagatagaatggcgtgatatatggtaacatcgcatacatcgtcttataataaagtagtggatatttgtctctttgctgccagctgataaattcatccactggacctctttttatgattattgcagattatattgcaggcttttttctgagtggtaggaaagaatttagagctttttcattattgtttggatacatttaattattcataacactattagtttaccactgagttttacctatcgtttggcctacaactaataagttgttttacgatttatcggtaaaataaataacttatgagtaatatttttatacgtgtgcttagtgacttctaaaatctatgtttaaaaaacaaactataacgaaaaaaacctaatatcaactttaagcttaagttttaaagtttaaaatttgatagtggcttataaactgaagagatttgctccgatacctcacagtaccaatcatttcctatcgttggatcttaatgggcattattagatccaacgatcgaaaacgatttgataccgagaggtactggtaccttgagatactttttgttggaccggagcaaatctataaactgcaaggtaaacaatagaagctaccacgtagtttaccagtgaggtctggtagatataccaaatgattattttctaaaatatggtgctggactatgtagcaattgcatgcgtatccatcgttttcttgtaccttgtacccaataataatgaattagtaatgtacagtacgctattaccgcacagtgacacggcaatataacgcatacatatgtgttttatatggatgatctcctggatagttgcaaatgttatggcgtgcgagtgacagcttatttacacttaattctttcttaatcagtctagctgcttataa

SEQ ID NO: 29357 - DNA, 600 bp, Oryza sativa
tgtactctattcgatctggtgctattgtcgatggtcagaagctgcatgacgtcttgtgtgatgtatagcatagcggcaaggtactacaatgcggatttcttatgagttcaaattatgaatttgggttgtatggtattatttgggtttcatattggatttaatgaaactaagctgaacaacgttctcaaggaaattaatggagcattgcacaagccaatcatgatctacaacttacgaactgcgtctcttattttgcacgttattttgcacggagccttctttttaagtaaacaatattatcttcagtaaatcatgatgcatttacacgatgagcggtctattattaccttcagtaaacaatattgctctccaatgcaatgtgctagtactaattcgtttgaagtaactatagcaattccaaaaaaacaaacatcaagagtatacataattgacatggcatgcagtataggaataaataacacgagagccgtaaaaaaggctggaactgagagataagttgagcaaacatccattgattgtaaaacatggtgctttgagcaggcaaaaaaaaaaatctattaggacccttattctgaaatc

SEQ ID NO: 29358 - DNA, 2381 bp, Oryza sativa
  unsure (1)..(2381): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtcgaagatggcgacccgaaccagagcagaagggctatgttggggcaattcgatcatgaagagccgaagtatctcgggcagcaagacgttgcacggaaatcgaagccccgcatcgaaaaatgcagcaaagaccacggtttggttgtccccaggcttcggcactaccgccttgccaagagcaaaggcctatccttcggccatgaccccggccgagaacagcttcgccaactccgtcttatcgataagcgaagcgccgagatacctgatgtgaccttcaccaatcttccccggatcaggaccagtggccgaagcaggagcaggtttacaagggtccatggatgaaaagtctggaaagcccggtataagagccgaggtcacactggtcgaagtaggcaatgaaatctcgtgaacgcaaggagaaacaaagcgataccagccacagaggagatggtaaaagtgactagaggtaaaagtgaaagtgacgctagggggtaagtgtatatataacccacccgcgtgacggttcgcctgccacccagtaagggactgccacgtgtcgccagggtgtacggaacggtaatttcccgttaaggctggccgaacaatgaaacgacgaaagtaacagcacaccggcccatcatgcccattactgttcacgggaatcctaatttattcaaccatttcgccaataataggcgaggaaaggaaagaacagtgatcgctagatctgctaatgcaaaatgctagactttttcgcaggtaaaaaaatataggtttcagcaagaacatcggccgaaacggagcgcgtcatggtataccacacgatttgcaaggtcttggtcgaagctccatactcacccttgcccttgaggggcttgttggaggtataccacaaggacctttggccgggcttaccgaaaccaaggacataggcaaaggcgtaggctggaggcaagtggcgaaggtcgaagggacaacataggtgaaagccaaacagcaaaagccgtagcatcaagttgacaagcttcgccaaagatggaccatgccggagggcatgtgtttcgccaagtatcgaaccttgccaggagaaggcccagcaggccaacacgccttccagaggcttcaccatggactgggccgagtcacttggcccattaggagcccatacgagcaaaagacattgtatgcccataaagatgtccctatcataagggcaaccacgtaaattcctctgtagagcctaaaccctaatggagagtctagggccatgtaacagggggatctgaaaaaatttttactaagcaatacaattgtctttacttccaaccactgttaaaagaactaggtccttcgacgtgacacagttatcaattcgacaacacttgctttgcaatttctgtgcactttgaaagaaatacaagatgggatttcttttcgctttttccataagaaatatacactttcatgggaaggattatgtacacttcttggttttcacgattcctgtaaaatcgatctccagaaaggaatttctaggttcgagaaaaataggttttgggaagacatttctaatgctccaatttgcaagaaaactaggacgaatgataaccataatcctacacttaggcttatgcataaatggattgctataactttgtttcctagaggtgatctacgacccattagaggggatgaattaattgtcatgtttgtcatggttaggaagatcaaagttgctgctgtgaaatgtatgataaggcaaaggctagaaagtataagattttctactcctgtggagtgcacttccttgattactcggataacaaagggactaggggttattaacaatgattagattgcttatgtcttagccgcttgtccctgtatagatgagaattatctagtgcaagggaacattcttaaacatggagtagatggatctttgatttacttcttccccggttgtacatatgaaatcttgttgcctaatgcgggatattatttgaacaactaccatgaactaaccattcccttgcataccatagaagaatctcgtgcaggtggaacatacagggagacacgcaacatggcaagtaatgaacgagaaggttcatcatcctcaacacccgtgaaatgtatgaggcaagttgggagccaactggggatgcacctggatggacccaagctccacgccacagcatcggagtctcaagctgcgcaagcg

SEQ ID NO: 29359 - DNA, 8152 bp, Oryza sativa
ggtaacttgtatcatattgcgtatttccctttccaattgcattctatacacctgaaaacaacataataatttgcaaaatagaatataccaaaaagataggttaggttttatcatgctaggtaagacaaactagttctctttgttgaaatgatgaatagttgctctgttttatatctcttatgtatggattcataggtaagtgctctctcacaaattaaatgtaagtagcccacaattatttgagaacctgaggtaaatgagctgcatttgctaatctaagtctaagttgttgcaacataagagatagtaaataagggttgctatgatcctagtccaagtttgacttaaattccggatgtttgtttttcaaaatgataaatttgaaagtttctcatttgatataaattcttacgagagccaaaaatgtgccattatgattaaaaccatataaattttggttacttgccattcaattgaactttgtcaaattcttgtgacttgtgtagatacttttcatgctctatgatcaagatcatatacccacatatatgcacatgctaaactcctacactgagctagcaattatccattccatttccattctaccactaaataaattcttcatgcttttgtgtgctttcttctcctaaaaagaaaattctttctggaaaaaaaaagaagaaggagggaaaggcatggttatgagaaaaaaagaaaaaataataaagttatgctctttcaagcatgagcatgatattatataaaaaaaggaataaaatggccatgccctctccttattaataaaagaatgacactactagaaaaataatttattgccatgaaaaaaatcgtagcatcaatgctaaaattgtggcaatagatacatgttgccacaatcttaaaatcgttgttagccgtggtaataaatagcgtggtaacaggttattgcaacgatttttatttagttgtaataaaatttgatattgccataaaatagatgtggcaaaaaatatatattgcaacacttcacatggttgtaataaataactattgccaccactctatgtgtggcattagttatacgtaccaaattaaatgtctcaatattaatttatcatcctaactatcttcttttgatatcttgtcatgttcaggattcgaacccaagatctctcccttacgcgcgctctccatgaccaactcacctacgcatcagttttgtttaaaaatgcatacaattccatttgagactgcctaacttagatttgaatcatgaatttgagtatttaaaagatttcaaataaaaaatttaagttgtagatctcatcgagagctataaatttcatataaaatttatcctaatccgtgtccatatgaaaagaataagtcaaattatgagatgataaattttttattgcaacgaactaaatgtgtggcgatagaacatgtttttttgcaatagtaatgttttttttggcgatagctcatttcctattgcaacaaaaatactgaataaaacaacgattgtaaatcgttgcaacaaaatatagttatttgccatagaaaaaatatcattgtgatagtataatatattgccatgaattatttttcgttgtaataaattggtggcgatagctcaaccctcttgtagtgtgatttttgggaggacgtaagcacaaagaagaagcattttctttatttttcttcatattccatttccaccatatatcacacacacacacactttgcatgatcctaagtatgtttagtcatctattttagtctgagtttttgacttagtaataaatgtgaatgcaaatatgccatgtttgatccctaccaagcaccacatatcaaaccttagagtaagaatcaaaatggcaaaatggtgaggaattcttattgatacacttagagagactgagtgaatcatttgaggaactcggctttcttttgcaaaatcatttgaaaacttccggaataaaagttgaacaaagattgggtgattactgctttaattgttgttctgtctttcaaccgcccaaggcaaggagaagcagtgtctggtgggaatcaggggttagggtaagccaccgtgccaaagattatttaatttaagagagattacatatacctttgagatattcagcatagtagcaactcctgattaacaaccaagtctttgtttcctttcgtcctttacttgggacgagcaaaggttcaatcttggggtgttttgttgatggtcgttagcaatcagtttcgaacgtcaatatttactaaatagaggagaactagttatgcttgcaatgcatattcatgttagaataataatattccactagtatttggttcactaaacttttgcagagaataatcataaagtggaggagaatcgacatcaaatcaaacgataaatcaatcggacgatgtcgagaatcagacttatgcatgaatgggccaagaactcggaaatgacacgacgaattgggccaaaattcacaagtctacggagaagagcacgagaggatgccaccagccgtaatctgggctggttgggccggccccaggttcagccgaaccctcctcagcaccgtttgatccaggtcttttctagatggtgtagatcagcccccaatggcggttggagggtatttccgaccattccaaccgtcacaaccgtcattaggaggttataaaaggagctctcatcctcacttcactcacacacctcaagcaaagctctcccatattctctcaagtttagtttagtgttcttaagctagtggagtaggaatagaatagaaatcagagtccggaagccttcggaagagttcggttatggctctagtagctctgcttcactcttttgtaagctttgtactttatttagaatactcttctttatacatttatggtattgaaatgctttccgagtatatgaatgccaactttactttatgttcatgttatgctgattatactcctagtttatctgggagatgcataggtacaggtataatgtttgcttatgcaattactctatgtcatgatgatgatattagagtagtatctggtagtttaggcgtggtgtctagattacgggatatcattatttggggttagatgctgcggatgagaggtgggccgctgaaggtgatagctcagtacgggtattcctccgcgcatgtatataatcctaagttaatttcctagggagggtactgctccatatttaaccccggttgtatggtcataacgggctgtcgtaaggaactcagcagtcaggggtggcttctcgaagtaccacgagtgcatcggaaagagggtattagctagttaatcgtataactagaatgtatatacactatgtatactagaagtataggaatagattcttttctattttctttccacttagcttaggtaatttagtacgagaatgagtagctccatgcatgtgtgtcactctacccattgatttatcctaatccctccttagactatgattattacaagtaacatataaattattagtacatttctctctactatcatcttcccacgggattaaataaatacgatacccttggaatactctcgggtgaaatgctacaatggtatatccgtgcgcttgcggatgaactctgtaaccataatataccaagagtatttctgcgccattgctggagattatatttctagtaatgtcgttaagaaataccaagactccttcatcagtcttgtcgaactctatgctactcaggcacaagatgggcactaaatttttgctccactgtcatctcccaatcatggtatttctcagcatcataataacccgaaaaagatggtattttaaacttaaccttagcataagggtcatcgggcacacgattattattaccttgttggtggtggtcatttgaagtgccacccatacctgtgcggtatgtgcatagacgacgtcgtagtcgtgcttgccttgtagcttctgcatcaatattgccactaaatcatacatcgtgtcctcaggatggccaccagcgttgctgccactcacttcctcactggaaggttcttgtgtctccaacgcagcaacccgattagctagcgtggatatccgcttgtccagcctctccatgtggtttaagaagccacttttattgatggcatcttggacagcctttgtaacggcctccgtcatgtcattttgagcaattttctacactagttcgtagttgctcttgacagactgtcgatatttcttaacgacattactagaaatataattcccagcattggcgcagaaatactcctggtatattatggttaaaaagtttatccgcaagcgcacggatatacaattgtagcatatcacccgagagtattccaagggtatcatatttattttatcccgtgggaagatcatgtagagagaacttgactaataatttatatattacttgtaataatcatgttctaagcaggggttaagataatccaagggtagagtgacacacaagcatcagctactcattctcataatatattatctaagctaagtggaaagaaaaaagagatcatctattcctatacttctagtatacatagtatacatacattctagttaactgatatactagctaataccctctatccgatccccttctggtacttcgagaagccacccctgactaccgagtttcttacgacagcccgtcatgaccatataacctgggctaaaaatggaggagtaccctccctagggaattaacttaggacaatataaacgcgcggaggtatacccgtactaagctgtcaccattagcggcccacctctcatccgcagcatataaccccaaataatgatatcccgtaatctagacactacgtctaaactaccagataatactctaatatcatcgtcatgacatagagtaatggcataagcaaacattatacccgcaccaaagcatctcccagataagctagcagcatattcagtataacatgaacataatgtaaagttggcattcatatactcggaaagtatttcaataccgtaaatgtataaagaagagtattctaataatagtacaaagcttataaaagaggaaaggaaagctactagagccatacctgaactgttccgaacgcttccagactcctgattttctactctattcctattccaccagcttgatactactaaactaaacttaagagaatatgagagagctttgcgtgaggtatgtgagtgaagggagaaggtgaagtccttatatagaggtagttatgacggttttggaaggggaattgtccgaagtgccctccaaccgtcattgggatgcaatcctggacgtccatgccgaaacctgcatccaacgacaccaggatgggttcggccgaaccatgggcaaggccatccccagcccatcttcggctggcggcctcctctattgctcctttatgcagacttgtgaattttggcccaattcatcgtgtcaattctgagttcttggcccattcatgcataagtctgattctcgatattatccgaatgatttatcgtttgactcaatgtcgattctcctccactttatggttattctctgcaaaaggttagtgaaccaagtactagtggaatattattactctaacatgtatatgcattacaatcatcactagttcacctctattttggtaatattgacggtcaaaattgatcgataacgaccgtcaacactgacacagtcagcaaagtcctgggcagtcctctcatcatcgtcacctgccattgaaacaccaaaacaacaacaaatgtgaaggttatccataataatctaccaggcaggtgcagtggtgcctctcaactactctcagcaatatgaagaaccttaccaagcccttaccaagcaatggatacctggaaggcgtagtcagcgattgtagggatcaagaacatgtgctgtccagaagtaatatgtggagctaggaaggctaaatatatgtgagtggtacacaatccaatgacagatagtaatgctaaataaaaatcccaagtcacttgccactagttgctggtctactcgtgtcctagacagtagtggtaacaatgatggcgcaaatgaaggactggcaggcaagcttcagcgagtctcagcaaaaacagcaaaaccgcaaggctgataagcacaccacgaagttacagctcaagcagagttgatatgtggcctatggaattttctgaagccactataaagaatgtgcagaaacttgtgagctcgaacagacaattttgcaagccaatttttttctgagtctgagtccgtatgcaaaagttatggctgtttgaagttggggcttccgtgtaggttttccagagggtatataaactagtctgtttagcggtggtatgggatatggtggcaacggagtatgtaggatgttctagtgaggtgtggtgatctggataggtgtttatgatggcagaaacggatctcaaaagatgaaccctaacacacggatgaaaggtggcggctatggttacaaaggaaaacacacgactagactaaaacatgcactagaccatcaacaagaacttaagctaggactcaaactcaacactacaaactctgaaaaggattgtgcaaaggccaaacacggtttgggttaaggacactaacgactacaacttttttttttggcttttctttagactctaggataaatgcgaaaacaaaaactaaactaggataaagaatccgagcgaacctgacggtgaacctagagctctaataccacttgatgttgactaggtttcccgatctttcgaaaggttctgataatcaacgatttgggcggagtcgcgacacaaatcgatccggcttcttgaacgaacacactattgagccccgcaatcgcagcaccacgtctcctctggttatcacccatgtcgaaacgcggatgacctcgccgagaaggctaatccctatttgcgaatcgaagaacacacacaggaacaaagaaggacgcaaccaaaaatgcagatgaatgaataagctcacaagttgggtcttacaaaccgatctagcggtgaaactgttctcgacagaataatctaagcaaaacccaaaccctaaagatgacgacaggtactgatatcaagagtttagggtcatgcaaccaacccttaacgcaaccctaataggttccaacacgatacacggcccgaaagcccaaataggatgatgcagcaccgggatatattttggatgtcaacttattcagtcgattcccgttgactcggaaagaatttggacgtgtgtccaaaaccattggaaaggatatcttcttagctttccatccatatagagaacgccccaatctggtcacgtatgcgacctgcgtgcccattttagtgcagactgatcctagactctgaattgcactcgaagccgacttggtttgggcctccaccttgacttggatgtcctcgatgatcctccatgactctaagtcctttcccaagtgtctcctttccccttctattgttcctaatcacaatataatcattaggtagcaatctattctcaaattcgtacaaaaaaagcacataggaacgagctcacctctaaattcaattgtcgcgcgcgagcgcttgttatcggtccttgaatgaccggtggaggattgttgtgtgtatccgaaggagtgatatccgcatcacgtgttttctcatcagtttataatcttttaggttgaactatttggtgcatgaaatttaataacatttacaatctttcttacattgaagacgctagaaataggaattattcctaaatcctgataacatttgcatatgaaagtttcttatcaaaaccgttactcacatagcgaaacttacaatgacctaaatgtattaaaaaattcagtgtatgaagcaactcagtgtagtggtggaatggggaataaaatgattacgacttgtttgaaaactcgagggaagatgattggtagtttcaacgagtaaattgatggtgagattaacatggaaatttgatttttagtcccaatcttttgtttggtagaggtggtgggaattgatagatgattggtagtttagttgaagattagaagttagaaaaaaaac

SEQ ID NO: 29360 - DNA, 26384 bp, Oryza sativa
  unsure (1)..(26384): unsure at all n locations
actacagacaacggactactggtgtatatatagtgtgcaaagaaattctcaatcgggccaaaaaatgtcatttctaacgggcgcacactaatctctaactggtacaaaatgaagcccgacaccgataagagtcatcggtgacgggctccaaagaaggccctattgagatggccttaatgcctgtcaccgatgactcttatcggtgtcgggcttctatttgtaccagttagagattagtgtgcgcccgttagaaatgacatttttttggcccgattgagatatactttgcacactatatatactccagtagtccgttgtctgtagtttatcccactgttcactattttggtgggaggttgaagggggcgaatttttgtaatttttttgcaaacaaaaacaggaaaaatcataaaagtaagtaaaagggtactaatcatttcctattaatttagtagtacttatgttatgagatgttaactaatattttgttcattgttcagcgatggatcgaagttggatgtacacgactggcttgaggcgtcattacaaggagtatagagatggcgtattaagttttatgaaaaccgcagaggaggataggataagaagaaacaacaagtacatgtgttgtccatgtagcgattgcaggaatgagattttgtgggaagatgaaaaggaagtacacgctcacttgatacgccggggattcatggagagatacacatgttgggtgatgcatggagagcaagatctgggtactaatggtgcagcagcagacagaagtggtgcagacaatcatgaagaagtagatgagaagagcatgacatgtttgtcccatctccattgggcggtgaattggttgatgtggaccctgatatgcggcaagacatgttacgtgacgttgatgacctagctatgaacgagagagattccatgaagttcagcaggttggtcagtgactcggagactcctctatacgcaggatgcaagccaaagcacaccaaattatcagcaacattagacctaatgaagttgaaggctagtagtggatggtcagacaagagttttacaaaacttttgggaatactgaaggacatgcttcctcaggggaacacattgcccgagacgacatatgaagcaaaacaggttctctgtcccctagggttagaggtctggagaattcacgcgtatccaaacgattgcatattgtaccacaagcaatacgcggacttagatgcttgtcctgtctgcaaggcttctcgatacaagcgaaagaagagcgcgggcgagggaaagaagtcaaagcggggtggtccggcgaaggttgtgtggtatctaccaatcattgatcgtttcaagagaatatttgccaaccccactgaagcaaagttagtacattggcatgccacagagagaaggaatgacggtttgctaagacaccctacagattggattcaatgttggaatatcgatcgaaagcacaaagagtttgctgccgaccccagaaacgtgaggatatgtttgtgtacggatggcatgaatcctttcggagacatgagcagttctcacagcacttggccagttctcattgcgaactttaacctcccgccatggttgtgcttcaaaagaaaatatattatgttgtgcttattaatccaaggtccgagacaactcggcaatgacatcgatgtgttcttggagcctgttatcgatgaccttgagattctgtggaaagagggtgtggaaacttgggatgcatatggtcaggagaacttcacactacaagttctattgttctgcaccattaatgattatcccgcgctgggtaatctttctggacaaaccgtgaaaggaaagaaggcatgctctgactgtatggaacatacacacagtaggtggctaaagaaatcaagaaagatggtttaaatgggtcataggagatggctccccctacggcacgcctttagaagaaagaagaaaattttcaatggtaagaaagaacttgggtctgcccctgcggatttgtccggagatcaggtacacaatatggtgaaggacattactaatgagtttgggaagaaaagaaaacgtagcaaggaggacaagaataggttgtggaagaaaaaatccatattttggcggctaccttattgggaagatcttgaggtccgtcattgcattgatctgatgcacgtagagaagaatgtgtgcgatagcttgctagggctattgttgaatatgcctagcaagacaaaggacgggttgaatgcgcgtctcgatctataggacatgaacattcgtagtgaacttcagcctgttacagatgagaagacaggaagagtgtacctcccaccagcttgccacacattgtcgaaggatgagaagatcgcaatgctatcatgtctggcagatattaaagttccttcgggctattgtgcgagaataagtaagcacgttaaattagaggatccaaagctggttggaatgaagtctcacgattgccacgtgctaatcacacagatattgccagttgctataagaggcattctaccaccacaagtccatcacacgatccaacggctttgtgccttcttcaatgcaatcggtcagaagattatagatccaaaagacctagatggcttgcaggccgatattgttagtaccctgagtcacttggagatgtattttacactagctttcttcgatatcatggttcatctcactgttcacctactgaagcaaacaaaaatatgtgggccagcttttatgagagaaatgtggccatttgtcatgaccggaaataacccagcgggcgttccttacgtgcgtgtattattccttgtcccaggaggcaaggtacaccaaaaattgatacaatacagagtttaacaagcggaagcgtaaacaattaatttattacatgggcggtgaaggcccagcacacaggaagacaaacaaaaaacagcggaagactacggcgacgaccacaggcgcttgacggcaggcacgagctagacaccaaagccttcatcttccaggaactcctcttctgggtttgggaaaaattgagcaagactgagtacaaccaccgtactcaacaagacacacccacgagtgcagaataaatgcaagggagtacaagggagttataatataagggattagggtttgtagtaaacagcattaaaagacacttagttgctcaaagctattttgtaaatacgatcctcgagctatgcaatattattaatcaaggccgtgaacccacacgaacctgccttaacccaaggcctacgatgattcagaccgaactggcaactcgaccctgggtcccagctcgtcccaagccaacccaggccaaccattccacattttagtcgttaagaaggttttaagaattgaaacactaacttgggtacattgctcggcttgcccataaccgagggcgcggctattcgaataggttatactctaatcaaaggtgtacatctttacccacaagacacatcttcctcacgtgtaaccacgtgccacataccaccacggtatacggacggaagacatgacatagtttccaactcatcctatccatagacaagagtaccgacccaaccccacctacggccggaacctccgggacaggtaggcaggactgagcccctagcagcaggacatcggccctctgccctgacatctcgactaccgggccgcagctcgtgtagccttcatttgccctagagatgtccatcgacccccgacttcgtccatctccatccgtgtacttttgtttataaccagactgagccacaaactaagccttacccactagacatgtggaagtacggtagtgctttgcaacagaggcccggagaccggtccttatatggccgaggtgctactatcaaaaccatgcaccccgagctcagcctgaagccattttcaggattttgaatagagggggaggtgtgaatccaattccacaataactcaaccattccataatgtccaagtgatatgaatattcccaaagtctagagttgtaaaaccacctaatgttgcctaattaaccagcgaagcatctacctaaattcatactaggggaaccttgagtagagtgcacagtagttggggttttgtttattctagggtgaacaaggtaataataacaatagaaataataataaggtcataacaaaggtaaataggcatggctaaataaaacagtgataacgcgggaatttaaataaagcgataatgcattaatttaaatcaaaataattttataaactggaattcaatatgttcaaggatgatgtgacttgccttgctcgctttcccaaacgtcggcttcaacctccacgaagagcggatcttccgaagctgcagtgtctacacgaccaacggaaaagcaaaaggcttttactctaataaactccatataaaaagcaggaacaaagcacaaaaatggattcttgacttcttaaggaaaaattagagacttgaacggtccaattccgagttcaaatggccaagttatggccatttgaagtttatatgctctttaaatggatatttgcgaatttctttatttaaattttaatttaaaaagggtttattgcgtcagccgaggggagagggcgcgcggaccgggtccacgggagtggggcccacgcggcagcctcacggtccacggtggaccgggtgcacccgggctcacaccggccagcgccgtgggtcccacgcgtcagccgcacccgagggcacgggcggctgacggccgggccccacgcggcagccgctcggcgcgcccgaagacggccacgtcggcgcggccggcgggaggcggcgcgcccgcacccctatggtcaccggcggcggccataggcacggcggagcagcggccgagagaggggaagggaagggggaaacgaggcggtggtccacagctcaccccggggcgatggcggcgacagaggaggcggccggagcggagggaggcggtggcgcggctcgggtcaacggggtcggcggcgctccggcggttggcgaccgaaacggaggggtggacgaggtcggcgaggatgcggcgaagccgaaggaggcggtgccgaggtaggaggcggtccggggcgacgacggcggcggaccggagctcggcggcgacggcggagagagagagcgacgtcgcgagctcgaatccggcgaggaggaagggcggcgagaggcggaaacggacggaggaggtgcggggagggtttaaatagggttggaagggggagtggccggccggagaaggaaggaaactggcgcggcattctcgggctccatcaatggcgtcggcgggattaggggagaggttttcaaacgaatccaagggagagaggaggaaaaattggggggaaagggagaggggatcacggggaatatttccccctactttattgcacgcggggacggcgggaagctgcgggattcgcggcggcggcggcggcgctaggcgcgggcgagacggcgggaacggcgggaggaaggggatgacgggtgggccccacccgtcatcgagggtggcgggcgggcccgcccgtcagtggcgcgcgcgcgggcagaggccgagtgggccgcggggaagaggagagagggggagggaaatgggccgagccggcccaagagggggagggggggattttaaggtttttctttttataaaatcattttaactttgtatatttcttaataattattatttgtgctctgaaaattccactaaaatttatttacacattttaggcttttaggaaatatacaaaaatcctctaagccttatttgacttttaactttgcagattttaatttttggaggctttcacacggattttaattattctaagcataatttaaaggatgtattttagggtcgttttgggacgtgacaccattcgagagatacatgggaattctgaagtcctacgttcggaacagagcaaaaccagaggggagcatcattgaaggttacacgaccgaggaagccattgagttttgtatcgattacatggccgagactgatcctatcggagttcctatgtctcgccacgaaggaaggttggcaggtgtcggcacaactggtagaaaaagaattgttcccgatcaagcttcctacgcgcaggttcatttcgcagtgctgcaacatatggctgaagtaaccccatactttgagaagcatttagcgaaggtccgacaggacaatattggtcgatcagatatttggatcaacagagaacatggtgctcgcttcaacgaatggttcaaggatcgtgtagcacagtcgaccgatggcccaagtgagatattacaaaggttggcaaggggtccatcttgggatgttgacacatggcaagggtacgatatcaatggatacacattttacaccgtcacacaagatgagaaaagcacagtgcaaaacagtggagtccgtatagatgcatatcaggatcaagctggatcgagcacatactttggccgcatagagcagatatgggagctgaactatctgaacttcaaagtccctttgtttcgttgcagttgggtgaatatccgcacaggtgtcaaggtcgacaaggaaggcttcacattagtggacctggccaaggttggatatgcaaacgaaccatttgtactagcgaagcaggtcgaacagattttccacataaaagaccccgcaaacaagaagatacacgtcattagggatggcaagcaaagaattgtgggggtgaacaacgtcgtcgatgaagaagaatacaacaagaatcttcatgtcagacctcagatagaccttgacgatgatcccgaagacgaagtggcttacgttcgttcagaccattcggaaggcatatcactgtgaatgatcatctatgaaaataagtgcgttgttggatcggaaaatcagttggcataattgccaaggaatactcgcaacaaggattgttgtagacatgtcacaagggccttcagccgaacctgccgaaaccatcaaatcagcgagacgccaactgagtccacgaggttcctctcaagcgaagccaaaagacgaagtcaggagggttcgtcaccaagttcgaagggctcaccatcaagtttcccatccaggtgaagaagcaagaagggttcgccaccaagccgggagggctcatcgccaagtctccgctctgggtgaaggcctcagggtgaagcacaatgggttcgccccatggaagatgggtttcgctagggagaccagctagcagcatggcccatgaaggctgttcacctcttacgggccaggccaggggccaatcaaaggtcccatagttagaatggatactgtatgccccttttaatgtccctatccatataaattcccctgaacatattgaaccgtagagggtatgggcctgtagtaaggctataaatagcccaatagggccatgtaatgggggatcccctaaaaatttcataaattagcacgttgtttactattcaaatcattccaccaagagagccacgtcctttgacgtgaagttcttgtcattttgacaacaaggattagaatttactgttacaattaatagtttctttagttagggatctttgtagtgatttatgcaatagggagcaatgatattggtagaatcagatatttaccttacagtttgaaatcatcattaagtattgtttttgattgatcgtggaaactggcttgagtactgctcctgggactattatagtgctaagctaaataaagcccgtacaacgaagattggtacatgacttgtctctatcagtctgttgcatgaaatttaacgagcatgcttaggagttggagacgagggagaaatttaaatgatgagtgattggaggaaaaaataatactctagaattagacttacttttacaagttttgaatcctatgaaattacaattaatttattattatgagaaggatggagtaaataatggtccacggtacttgaacattgatagttcaaatattataggagcaaaatcaagagatagtaagtactataatgtgtgtttataggggtaaatttatgggcgctatcagcacatgcgtttgtaccgtgtattaaaaaaaatgatcagcataggtactcactggtgagtaagttgtaagccctcaaaaaagtgtgcaggggatgttccaccgccaaagcgtgttttcccgattcaatcattccatgtggttgttacgtgcatgcatagtgcgcaatagtgtttctgttgcttgtgtatttttttaagctctccaaacaactaaaaagagttttcatagagagcccaaataatgtgattaatgattgtcccattatgcagtctgaacatattagatgtacaccgaaatgcttgaaagaaaattatatttggtcgattaaaatctaaaaatcagttggcataattgccaatggatactctcaacaaggattactcaaacctctatgttgtaaggaggctacactaaatattttattattaattggtccaattagttgccaagccctttatgtatatgtaaggatattttgtgcattttttttaaaaaaatgtttcacgatcactataacatgcatggagtagaaacaattgacatactcatttgtaatttgtgtgtgtgcccgtatataagcatgcatacattcatggtacatcaatttggcacgtaggtgtagtttaatgcaagaattaatctgagtgtacgggtaaaacaatttgcatggcgggtacgaggttggtacaataacttaagaaataatgcaacaacattctttctatacacattcagtttttaagtaattattttgtcaatatacatggactaatttgtactaatatacttaaattttgcaattctagtaactaaagtcacttaaattttgggtttatagttgagagtgaaaaacaaattggtggtgcaaaaaggatgaggaacataattcttatatattaaattccagactgtaagctaatatccttcgaattgtgtaatgtcatatctaaagaagtggaagctgaaacatttcttgaaaaaagacgcgtccacgtcatcaataaaccttaaaacgtccggtatttttgtagatcgatgtgagccatcagattacctaaatggcgaaagatcataaatgtccgtcttgaaaattctattcatttgatattttactattttcccctccactcccccatccaccagtgttaaacggctcctcttctcctgccttagctgctctctccacaccgccacttttgcatcccctcgccgccaccgccgcctgcagccgccgcctctgactcctatccatcgcgccttggcagcaggctcctcgtctccctagccatactgcctccccatccaaaccgcaccgcgtcccccgtcggacccagacgcgcggagctcaagggcgctagactcggctaggctcacaacggttcaccgcctcagcctactcgcccacaagctccgacgctgcctcctccccatctaaaccgcagctatctcatctcatcttacaccaacagcctctctcctcatcgccatcaatggcactgctgatccggacgatttctcatccaaatggttactatgcaagagggtttcttgaagagaccgaggaattagtgcatactaatcaccaacccgtgcgttgcatgggctattattattaatattataatattttagattctaattatagaaaattcattagatattttttaattatatcggtttaaacttaaagatatataaatcagatgtcaattacaacatggatagtataaactgaagaatcaaaagtattttcagtagtctgttattaactacaatagcctattgttaaatagggcattgttatttaatttttaatcgtacctatggtcatgataatacgatccaagtaagtactgaccagatttataattaatgttttagctcataacgagtgctctattagtttggtacactactacgaaaaccatctttcgtggcggtcattttgggtttccgctggcagaaatcgcagccgtcacaaagcaaaggccagtgaaaatgtcgatcttcgctagcagttatttaccgccagccaaaatgcatcttcgctggcggccgagaaaggaacgcccgccagcaaagagatctcttcgctggcggtagccttaggacggccgctagcgaagccaccgaagacatgtccttgctggtggcggacataacgcagccgccagcaaagaagtatctccgcttgcggtagccttaggtcggccaccagcgaagataattctttctttgataggaaacatattttcaaacaccaagtcaaagaagatagtagttcccatcccgggcaggcatgaattgaaataatagtttccatcccggataatagtgaatacatcctagcatttgccggcaagccaagtaagcgtgatcagcgcttacccacaggaacatgaataaagatccaaattgcactcccatgactacacatgttccttgaataattgaaaactagaatcaaagaaccaaattgaaatcatattgcgcatccatggcaagcatggaacttgaattatttacccagaaccagaatccggaatattgaaacaagaataatgtcgtaaacataggataaacatgaaaacctaaatggcgtgaacaacaatatgaatataagcggtcacatgtcacatagaaatatatcggaaataaatagatagagcaaacaatccatgaatcacacaattagttcatcatacacttgcctccaaagaaaggttggtatcatgcacaatctgaaggaccactacctaatcacaaacaaaacctcagcaaacacattcaaacatgcatataaaacaatgaaaaaggtgaacctactgtcccatcccatcaaaacgcaataacaaagaacgccgtttggactataaacaagactgctgcttcaaaccttcatatcttaaaatatgaaaaggctatggccgcaaataaatacattttggaaatacgaaaatgctatgccattaaaatggtctaatttgcgctcgaaagaaggcttcacaatctgtccaaaatttcagactatccgcaccaaaacaatcaaaactggagttctactcgcccaatcagggtattcctgaccaatatggaaagctaagaaacacctctacaactttgtttataggcggcttgggtgattccactgtttaacccatccaaaaactattcaatctactactatccaaattatgacataaaaacaacagttatactaaaaaattcatatcgtctaaaccagttgagataaaaccgctctctttggtcagaagatagacataaatattatctacaacttcctaattatatacactttcacaaaaaatatcatttagtcctccgaaacttcgaaaaaccgaaacactgtaaatctgccaacgtgcagaacagccaattcgaaccacaacaacaaaactccttctctaaccttctttatccaggaattaaaccactaaaactaccatagaacaactgatacaacaaggggataagcctcacctagggttttccttctatatcccatgggaaacgacgaggaaactccgatctaacccctcctccttctcatctctcctcctcttcgttccgtttttccacattgcttcttgatccaagctatgaagatggagatctagggagggcaatttgttgtagaggggagatatgcgaacacatgaggaacaggaggaaggaggcgctggccagggagaggggtgggattcggtttcctaggttttaagggagaactaatgggcagggtttatgagccttctcatgttggcccacttataaagatatttttcttttatttatttctattaacatatttattttaacaagtcaacccaaactaaaaacctaaatatatttttttaatatacggggtattacaccttttcatgatgcctttgtgctatgtaagttttcctctcttcgggactcatcgcctttgtcggtgatatgggcatggggtctcaagaccagagggaggaggccaccccccaacaccacatggccctccctcgaggggagtctggcccgaggtggggtggcggccactccttcctagagactagatggaggaagctgccccccaatgccacgtggccctccctcgaggagagtcangcccgaggtggggtggcggccactccttcccagagactagacggaggaagctgccccccccaatgccacgtggccctcccccgaggggggtcgggcccgaggtagggcgacagccactccctcatgtgactaggggtcgggttcccccgacgccctccgcgagtcgccacgtgcggtgggttaggtggccaccttcgagcgctcacctacccgcattaatggtgacctaagtaggcgcgccacgccacatttaatgtggcgtatagcacgcctaaattggtctgtgaccggtcgaatgaccgacgggacccagggtgtcaggcgcactatcgcatgtgtcagggggcgtacatcccgtcctgtccagtcagtcatgatgatgagaggtcttagcctcccatcccggccagagtcggttcattcgctctggtcaattagggttcccgtttcccagtgcaaccaggagcccagaagactacacaccttaaatggtggttgacaggggcaccccccgtgttaggcggcaagatttggcaggcctcatcatcaagatggtatgcgcttgcttcccaagtcaagagacaagacaggcatttaatgcaaagattgtaatccttctccactaagttgtgtttttgggcccatgtggtaaccccttgaggtataaaaggaggtccaggcctagtaagagagagagagcttatgcccctgatgatcaacaccttctaccccaacaaggagatcttgtaatttctcacaagatcagctaagcacagaagtagggtattatgcttctcagcagcccgaacctgtataaaccccttgggtcagatctttttggggggttcaaccccatcttcacacatctacacaggaatctcgaatctcacccgctgccaaaccaaaaaagagggacctcacggttccctggtggaggagttcacctttcgacagccttgatgtgttccggtagcttcttctcgtctagcgtgtatgtgtggttcggcttacttatcatgcacgggtttaggtaggcaacaggcttttttatcacttcggcctccacgtaattcatcctgccaacaatggatgatcaaatgagctacgcatataggtgtagtgatctattaaaacgttcaagtctagcacttacagacaccagatggcaatcaaattggcgtccagcctcttcctacagtagagggaatgcatatcggagaaatggacttagagtagacaaagacctctctagaagatgttctcccccacagcaactgtgaatgatgaaatgcctttcatggtgcttgccctaatgtaccaatcgtgccgccttcttagttgccacggtccttctcttagtttccagtcgtaaatgaatggtttgtcattctcaaactcgtgtggctcatctagagaattgatatagttgagatagtgataaaaggtatgtttgaacccttttaattttcttttatcaaactcggcatttacgatatctttctcctttcctcggaatgccgttaccatatactgtttcttggacgcactttttgctttgtgcttgtgcgtccttaccatcactagcacatcggcatccttaggttcctctggttgcgatggctctggttgatcaggcattgtctgttcaggcaccgcttcaatttcacccgccgctagctttgtaggctccgcttgtacaggctctgatggttgtgcggaagacatttgtcgtattgctagctgtgattgttgctttgcaagcaccgattgttcttatgcatcctttttagtcggaggtgatgcaacaggaggctctgatcctggaggtgatgcaactggtggctctggtctagggggtgaagcaataggactatccctcggactagctacgactagtggacgtgatgataataccgatatccttggtggacaatcagttccttcagttgaccctagttcaatatcattcttgtgccatagtatgaattggtcgacggcatctccaaggtacacaatctactcagtagttggaaagtcgagcgcgtgcatccagtaagcctcaatgaccgtccggacctctaccttggcgtagtcatccggaatgtcttggcaatgaaacctgcgacctggtatgaacctcccagttgcaacgagtattttctttcccgccctgccgaccggaatcaagagcttgcacggagtatcctccgttacatcatcgaaaggatagctcagctcaggctctaaaacagcagcaccgtgcatcattttctgactccagtatatattgcattcgtcacgagctactgccctagcctgagagtcaatctcttccctgtagcgatcacgcttcttgtatgtatgagcatcctgtttgaatccatccttccagctagtctttgaggatactccccgtacacggccagagtgctccggtttgcccaaggcataggtcagctcgtcccagtctctatctggcacaaacgtccaggcctgttgctgcgtgatgatgttcttcatcttgacagctacctcctggagcttctgatccttgaatactacatccccctcagaggtgaaggccggtgttcttgcacgcacccagttcctgcttcgtgggttgtgatttttcataggaatcggtttcccagccttctccatctcttcatcttgttttgccatttcttcaccgcttgccggtaaccggtcgatcccaaatgatgtggatattcattccttcttgctagctcagccatcttctagctcttctccttttcttccgccgatgtcttaagggcaatgaactcatcccactgggcctgtgttatccttccgtagtccttaaacggcgtgagtcccttctacatatatttcttatttaggtctattttccagtttcgccacagcttctccatagtcttcaacgcatattccttggctttatcgtcgtctgtcccctctggatattcaaacttgctttgcagtgacgtccaacagctgttctttctactctctagaactttcttccaatccttccatgtgatctccacaacattccttaccaccgccccacattggttgctatacttcgaatatgagtcttccggtgacaagggttcccctgtctcactcatccgtgtcagcacacttacttccttcaatagcattttcttccctcgctcgcccctccatttcttgggtttgcttgaagctgttgtgcgcacgacagctgtagcttcagcttcaggttcggttgcggcttgggatttccttttggagcgacgtggagcattcttctatgtttgcaattcacgtggtttcaattaaaatccatagttcgtggttaatatgattggaactaaacatatattatatgctacgtaccaccggttcagggggaacatagtcagagtcaacttcattgtcactaccgccctttctcttctttgcaggagaaggatgggggtcactcggtgagtgatacgatctactacctggttcacttgagctcgacgaagattcctccgcgactacttgcgtgcaaatttcttcctcgatgacggcctgagtttccttgcccttgtcacccgtgggttgctcttgggtgggtttgtccattgatatcctttgaaggtgaatatatgagattggtaacgacaactatattacgatggttgaactaaattatcatcgtacatctcatggttgaaccaaacatctcacaatgtttaattatcaaaaaacatctcaccatttcaaactacctaattaagttccttaattatcaaagaatgacagatttcgaagtgcatggaaaattttggtgtctaggttggttccgtgcatggactaccctgaccaatccaaaaaaattccccatgcacttcgtattctgtgatggcttgataacctaggaactacattaaatctacggccaatctatcaattcatccatttgaactaaattttaaaccctaaacctaattaagttccttaattatcaaagaatatcttcactggtgtcagcttaagagggccgccagagaagatatcctatcttccctggcggccatcttaagttgatcgctagcgaagatgtgtttccgctggcggcccttgaccccccgactccaagattttctatgctggcggtttttccacatagccgccatgaaaaatattttccaaacgccatgaaaaatcgattttctagtagtggtataagcccgattaatagattttatatgtcgcttaaatattagagaactactatatgcaataaaagaactctaaatctctaccatttgactcaattagttgaaggttaaagaaaattaatattaaatgacactgtgccccatatttgtgtttgagaatgtttgtaagaaaaaatttgtagatatatcttttcctatataatattggcttgaaaatctatctagcatgaatacaaatgggtgcctgagggccacaaatattcatgactaactgaatcgaagcaaaccttcaaatagtagtatttcgcattttatttgaattattccgtagaatccgagactatctgtctattatatactaaaagtccatgaaacttcctagaaacgctctcaagccgccatgtggcgttttacaaacgctcctaagggcagtcccaacccataacactaacatagacactacccttccaatgcaaacaccactattccatacttcaatttaatgctacttatctcacatgatgtcttggatgttgtgtagaaccatgtctgatgcaagacatgatttccttctcttttctcatttattcacttgccacatcattttttatcctaggtggcagcttatttaatactatggacaccatcctagtcattgggttgggaatgccctaagtcgcctattagatcgatctcttcccttcccctgccgtacatgcatgccactgtacgtatgtacgtatatgtgatgcgtattccatatgccctccccttttctcctattttctaacaactcaatacaaaatagtttaaattttaaatagctaaataagcatgattctcaatttatatacaacattaaattcatttgtgctatttttatttgtaattaaataaatacatcaagatcggtattgcatatattttgcgaaggtaaaggaaaaactgaaatacgtttggacatagaccctagcgtcgcagtcattaaacaatataaaaaaatgacaacaactatatcatcttaactcattctatatataaatatgcacattaaattaaatatcatgtaggacccaaaccatcaccctgcacatcttaaaaattaagaaatcactactacgaaaatatctttcatggtggccattttaggttttcgctggcggtttttgcaaccgccacaaagcaaacgccaatgaagatcaaaatctaccctagcggttatcggccgtgagcgaaaattgattttcgctggcggttgtgttataccggccgccaattcaaattattcccaaatccactcctcgattcacaaattcacataaatttacatcaacaatttacaataaaaacagtcaaaatttttcattcacaatcaacacaaatccacacaaatcataagatattttccattcacaagccacataaatccacagaaatccgagcaccaccgcccgcggcccggtggcgtccgtcgtgacgaggtcgaggccgatagtcacgctccaccgcccgaggccccagggccgtgctccccgcgccgcagccagggcggatccgtcgttcccctgtccgtcctccccggtggcagcttcctccccttagacagatctgggagaggggagaggatgggatgggagggcgcggcgccccagtagagctagctgcggctgctctccttcatgtcgacactcatgacatggaatctgaggtaggccagcgagtcggtgaagcacagcacgcacaggatggtcgtggtcgccatcgtcgtcacttccttcgtgttcgtcgtcgctgcagcttctttcgtgatcgccgtcatcaccgtcgccagttgacgtcgtcaccatgcacatccatgccacgcccctcccgccgtcgtggtcgccatcgtcagcgcgcgcccctccggccacgcccctcccaggtggaggaggctgggggcgcagccgcgcagggaaggaggagggtctcggtgggggaggaggaggagagggaggtgggtggagagggaggtgggtgggtggagaggagatagagaagagaggggacagtgggtggttgaagggaatatctcagcgcgcgtgattttaaatgacgtcgatttttttttagcgggctatgttttttcgctggcggaactgtttagtaaccgccagtaaaaatgttggttttcgctggcggacatttaagaagtacgcctaaaaaaatagagtattttttatagcggacgtcttaacgtggttgccaggaaaaataggttttcgctgacggtcctatacccccacccctcttgatgtttttgctggcggttttagcatatatccgccagtgaaaattatagtgcgacgccatgaaaaattgttttcctagtagtgaatatcgttgaaattctataagaaaaaaaaagcaaaacatcctaatatcattttacacttaaatcggcaggcgtattattttcacccattagatatatcattctactcccataagccgctacttgtcacatgttaaaaattaatagaaattacatgtattctaaactaagagtccataaaactttctagaaatgctctcaagccgccatgtggtgctctacaaacgctcctaagtcatcatgtggcgctttaataaattggaaaaaaatcctaaaaattttaagaaaaaagaaaaacatctcaccattggttttagtggacccattatttttaaccattagatcaattttaaaggaatatatactcaatccaacctatgggcctattagatcgatctcacagaatatgtagccttcccttcccctgccgtacatgcatgccaccgtacgtatgtacgtatatatgtgatacatattccatatgccctccccttttctcctattttctgacaactcattacaaaatagtttaaattttaaatagctaaataaccatgattgtcaatttatatacaacattaaattcatttgtgctatttttatttgtaattaaataaatacatcaagatcggtattgcatatattttgcgaaggtaaagaaaaaactgaaatacatttggacatagaccctagcgtcgcagtcattaaacaatataaaaaaattgacaacaactatatcatcttaactcattctatatataaatatgcacattaaattaaatatcatgtaggacgcaaaccatcacccttcacatcttaaaaaattaagaaatatcgttgaaattctataagaaaagaaaaagcaaaacatcctactatcattttacacttaaatcggcaggcgtattatttttagccattagatatatcattctactactcccataagccgctacgtatcacatcttaaaaattaataaaaatcacataaattctaaaagaatgaagcatccgacctcgataaaatcattatttcagccattagatctatatttaaagaaaaactttaaaaaacaaagtgccatcccattccccctccccctcgattaacaaagcgccatctttatattctgaaattataaatatatagtaaatgaataaatatatcgttggagtatataaccatactaacaaaaacagggagtagggaaattgtcattaattaactcaagttgcacgcattagatttttaacttatgtggtatgaaaactattctacatggaccaatgggagtgctagaaaggtccattaggacacttccaaggttacatgtggccgttgatggagacaaccattaataaaaattcatactgaaaagcataattttatagcagagagtacatgtctaatatcatatcacgaaaagacaaccttgcatgagaaataacatacaaaatataacttaaatgattatctcaactctccattgtactatgttaggagtaactttgtctaatgtggtcaatattgtggatggcagtaacatccttaactctcctaagatttatttcgaggcctaacaaattagaaaacaagccatagcacaatggggccatagtaagaatgcacggggtttgtgcgagtcaggaatcccgacaatggaattgcctaagcatcaactctattttatactaacaaagaattacattggactctagcaaatgagataaaagtccgggcatggccggcgttgtattaataaaattgccaaagtatcaactcgatctattttgtattaataaagaattgcatagcaactaactccactgttgaaaaataagtttgtcgtaaattcaagattccacaattttggcgaattttaatttagattttatgtgttttaaggatcgttacaaacaaaatcataaccatatttcagagcaatcccaaatagatttttgagagaagtatcataggtttaaaatatgataaaaaatccaagtaaaaatcagccaaatttatacattcataaatctatctatctattatatactaaaagtccattaaacttcctacaaacgctctcaaaccgtcacatagaactacaaacgcttctaagctgccacatgacactctaataaattagatttatttttcttaaaatatgatggtcccattattttataccataaaaaaataaaaaattgaaaggcccacattcctctccttccgacctgtacgtgtagtacgcacgacatgctaccatacgtacgtacgtagatgtattggcccctccttcctttctgtttctatctctcttatttttcttattttgatgacccttctattcctatctctcctattttgatgatgtggtagattgaaaacatattgatgtgttcgctggaggaagttgggaacctatcactggtggagaaaccatctttcgtcggtcggccgatttccacaatagtcccggatgcaataaaaaccggggctaaagatgatctttagtcccggttcaaaagggtaacgggcatatttgatctttagtcccggtttgtgttaccaaccgggactaaagatcatccttagttccggttcgaatgctgtcaggacctgttaggcccccccgggatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgtttttttttgtcatactacatttgcacctatgttttgcacactttttttctccaaaatttagttgtaagttgatgagagagaaaatgtgtgtggggaagaaagaatatatagaaatttagttcatttgctaaacaaggttttataaaatagttgagaaggaaaactctagtgaaagttaatattaaataatagaaaacaaactaaaataaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcggtttttttgactcatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgccagggaagactgcgaaagtgaaaaggaggcccataaattggacaagatgttggaggaccagagaacttcgttgtacccaggttgcgagcaggggcacaaaaagttggataccactctggagttgttgcaatggaaggccaaaaatggggttagtgacaaggcatttggcgatttattgaaactcgtcaagaacattcttccggggggaaacaaattgcccgagacaacgtacgaggctaagaagatagtctgcccgttaggactggaggttcataacattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattcctgctaaggtgatgtggtatttccctataataccacggctaaggtgtttgttcaggaacaaggggaatgctagaatgttgcgatggcacgctgaagagcgtcaacaggacgggatgctgagacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccattacgatgtgtatctacaacctccccccctggctatgcatgaagaggaagtacataatgatgccgattattattcaaggccccaagcaacctggtaacgacatcgacgtgtacctaagaccactggtagaagatcttaaacagttgtgaaagaaggaaggtgtccccgtgtgggacgaggacaaacaggaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggccgaccaccgtacgaagcctaaacatcgcagcgggaaaacagtgtttgctatggttaaagatcttaaagtagtgttcggaaaggggcctggaagccagcatatagagagcgaagatgatcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagctatgtgcattcatgaacgcaatttcgcagaaggtcatcgatccggtagattagaagcccttcagaatgaagtggtgcaatgtctcgtcagttttgagttgatatttccaccttcatttttcaatataatgacgcatctgctttgtcaccttgtgaaagagatccgtattctcgggcctatgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtacctgaatcacgccatgaagggagactacggggaaagggaactctcggaaggaaagcaataatgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaataacttgccttcctggcgaggggaccgtctgggtcgatcgcgacattccagggatatgagatcaatgggtacacattctacacgagagcccaagacatgaagagcacgaaccaaaacagcgctgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttcgatgtattgattatccatataaatcaattgatgtatggcatatgttaattacgcacgattattagaggtttcaacaagtttaaatcatgtatatgttagttatatgtgatacttacaatttttaaaagttttaaatcacacaggtggcaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggtttaaatcatgcatgtggcatttacatatgttaattagagtttttagcatttaatttaatataattcctacgctaagtacatatgatgattacaatttttattaattttaaatcatgcagtatgtacattaatatcttaattagagtttttaccaatataataatatcattcatatatatgctaagaatatatatatattggaatttttattaattataagtcatatatttgcttattacgatttatccacttaatttattacagacaaaaataatttttcgaagtaattgtcatcaatctttgtactttaaataatgttaatgcattaacttctattttataaacacatatgtaagcgaaaatcatatgcaatgctataatcttcagtcccggttcttaaccctaaccgggtttaaaaagaatttcgaaatagcgggaaaagatatttactcccggttggtgagaacaaccgggactaaagatcttttctttactcccggttgttctcaacaaccgggagtaaagattttttctttactc

SEQ ID NO: 29361 - DNA, 8690 bp, Oryza sativa
ctttagtcccggttgttgaaaacaaccgggagtaaagatccaggggtatatatattcccggtgcgccctcggcttcttcaccaacacttaaacgttttcggccgatcgatctctctcggcccctctccttcgccgccactgcatagggcaaatccccgcgccgacgccgccatatctcgccgtcgtctcgagctcgtcgtcctcgccgccgcctccgcctcctcccccgcctccgcctcctccgctgccgccgcatctctggggtgagagccgccgcatctctggggtgagagccggcgcatctcccttcatgcatctcgatctctccgatctcgatctctctccgtcgccttcgacgccgccgccttcgacgccgcgcaacgccgccgccgcatgccaacgccacgccgtcgccgccgtcgccacgccgccgccgccttcgccgccgcgcgcgcaatgccgccgccgccacgccacgccgccgccgccacgccacgccacgccaccgccgccacgccacgccgccgctgccactgccccacaacgccacaccgccgccgccgtcgccacgccgccacgccaaccgccgccccgatgtcgccacaccgccgttaacgaacgagaacgagaacgatcgaacgaacgagagcgagaacgaacacgtcaacgtacgttgccgcgacaacgtgaacgagaacgagaacgatcgaacgaacgtgaacgagctagggaacgtgaacgagcgaacgaacgaggacgaacgttaacgtgaaatgcaatatatatatatatatatatacatgtatatatatatatatatatatatatatatatatatatatatatatatatgttacttcgcatttatcctaatacattttttttatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctaggaattgactattgtagtcttaattagacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtattagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggatgcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctaaagaaaatggcagaacaatttcagagcttcaagggagatctgtaccagaagtatatactgaaggggcagacaccgaacttcgacacattcccaaagctaagggatcactgggacgagttcgttgcatataagacaggtgaacaagggaaggcgatgatggaaagaaacaaagaaaatgccgccaagaagaagtaccatcaccacttggggtcaggaggctatagtgtcgcgatgccgaagtgggagcagatggaggctagcttgattgagatgggtatcgaaccggcaacagccaattggccggaacgatcgaagttctggtactatgctcacggtggaacgctcaacccagctgatggctcactggtcttcggctatcagatacaagaggctgcgcgacgactaacagatgcagtggaagcctcctctcagggcacgttccgaccagacagagatagggacgagctgacactcgccctgcagactccagagcatccaggacgaactcgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggagatggcaaggaaggtcgatgaacgcatggccgcacatcggtcccatgatccccaccgaccattcctcctgcaatggtgagcccatcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttgaagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagcaggatactccaaggtcgaagttgagttggtcgaaggcgcgtacgaggacctcgagctggattaccctggaggagacggtgagacgcatctacgagacacatgccatgccattattctatggcgcaggcggtacatcatcctccctgggcgacaagcggcgtctcgtgcaccatctcctccggctccaccatctcctcctcaggatcctgcaccgtctcctcctcatgctccgccagcaccgtctccaccttaggctccagcatcgactcctcaggatcctgcaccgactcctcctcgtgctcctacacctactcccccgcaagctcctcttccggcaccttcaaagtcaagggcccccccagctccaccgcttgcccacacaagggcaacaaagaaggcgaaagttgacgccgccaagatcaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagagacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagaccatagaaaataatatactcccttttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcatcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtaggacttggtatcggttccgtcatttggtccgcggcaaatagagagaaagacttaggcggaagttcaaatttccagtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttgttcatatatatatctatatacatatgcatttgcataacatatatatgtataaatacatatatatatgtatgcatatatatgtattgaaacatatatatgcatggtttatatatatatatatatatatatatatatatatatatatatataaaccatgcagcaagaggggcatgcaaaaaaaaaaggtcagctctatctttagtcccggttatttcacccgggactaaagatagcgatctttagtcccggattggtactcccggtttggaaaccgggactaaaggggggttacgaaccgggactacaaagggtttctccaccagtgtatctcagctcacggaaaacggagtggtccattagcgcgtgattaattaagtattagatttttttttcaaaaatggactaatttgatttttttaagaaacttccatatataattttttttttacaaaaaacacaccgtttagcagtttgaaaagcgtgctcgcagaaaacgagggagaagggttggcaaaatggggtgccaaacacacccataagactatacaaactaagggcccctttgaatcgtaatcgtaggaatgaaaaaacggaggaataggaaaacataagattctgacaggaatgtaagtataaaatagagaattgcaaaacacaggaaaaatacaggaatgatcgtttgattggaccacaggaaaaacacaggaattagatgagacactactagaaaaataatttgttgccatgaaaaaaatcgtagcatcaatgctaaaattgtggcaatagatacatgttgccacaatcttaaaatcgttgttagccgtggtaataaatagcgtggtaacaggttattgcaacgatttttatttagttgtaataaaatttgatattgccataaaatggatgtggcaaaaaatatatattgcaacacttcacatggttgtaataaataactattgccaccactctatgtgtggcattagttgtacgtaccaaattaaatgtctcaatattaatttatcatcctaactatcttcttttgatatcttgtcatgttcaggattcgaacccaagatctctcccttacgcgcgctctccatgagcatcttacctacgcatcagttttgtttaaaaatgcttacaattccatttgagactgcctaacttagatttgaatcatgaatttgagtatttaaaagatttcaaataaaaaatttaagttgtagatctcatcgagagctataaatttcatataaaatttatcctaatccgtgtccatatgaaaagaataagtcaaattatgagatgataaattttttattgcaacgaactaaatgtgtggcgatagaacatgtttttttgcaatagtaatgttttttttggcgatagctcatttcctattgcaacaaaaatactgaataaaacaacgattgtaaatcgttgcaacaaaatatagttatttgccacagaaaaaatatcattgtgatagtataatatattgccatgaattatttttcgttgtaataaattggtggcgatagctcaaccctcttgtagtgagagagatagactcaaagaattcttaccaagaggttggacctcttgctaagctttctccaaaacctatatgcaataagccattccatatgaattttggaggatttggaaaacttcaatcctttgaattaaagggctacataggaaaaattcctataggattcaatcctatgaaattctttcataatttctttgattcaaatgggctctaaaatcatataactatttttttatgcacttctcgtacgtttgttgcataattcaagacccaaatcaactatatttaacaagtaactttggactagctattggacactcgagacacaatttttagggaaatcatagagtttaaaacacttgattgatagcacctagcttatattagaacatcatgaaacacagagaattaattaataagacttaaatattaagtagtagaaaaaatatatcattttggttcacgaagattatatttatgtttaaatatatataactctaaacggtaaatccgttaattggatctatctcaatctatccgtagcctcatctcccatataatttatctgttaataaacaatgatagtctatatcaatcttactgcttaaagataaaagattattggatttattttttttagaaaaatgacacataaggtgtaacactatcactatgtatcatatagtaaaatttgaactgaaaataagatttgtataaaataacatagaaaatagaaaaatctccatagagtgtaaattgaaccaatctatctatcactacaaacgttctcaagccaccacgtggcattctacaaacactctaaactcgccatgtgtcatgtcctaaaaatcagaaataatcttataaattctgaacaaaatgaaacctatcagcatcagttttaagttccattatttatataagttagaaaaataaatcgcatgcacctcctcgcctactcatatgcacataccactacctgtcccctccctatttttagctattaaacaataaatatataatcaataatttatatgttagaaaaccataatatttaagatgcacgtttgatttttttctctagttataattaaaccaagaatttaagatccgtatgcttatattttcttatatacaaagtatgccattcgcccatattcgacctacatgctttgtatattatacaaataaaattgaaataccttaaacaaattggctgcatatattacgtcattatacacgagtctgcaaacaagctaaattaaataaatagtataactacaaaactatttttgtagggtgaacacccctgcccttttacatgttactggaattgccgtaaaagaattatgaaataatccaacaacacaggttgcatcatcatatgttgtttttgcaaacttgcatagctaaattaggtagacattatctaagtaaatagaactaactaaaatatgaatagcaaatccaatgcccatagttagagaaaacaaagtccaattatttcgtgaattttcttaaatgtgctgaaataatgcaagccagctaaatgatctttcgtgtatttgctctaaactatgttaccatcaaattaacattgtgtgtggttgtggctttctacaccttcctggtaattctgtttattttctttgtgcatagaccattcaaaaggtaaatcaactatatg

SEQ ID NO: 29362 - DNA, 5150 bp, Oryza sativa
  unsure (1)..(5150): unsure at all n locations
nnnnnnnnnnnnnnnnnnnnnnnnnnnnnnnnnnnnnnnnnnnnnnnnnnnnnnnnnnnnnnnnnnnnattatctaagtaaatagaactaactaaaatatgaatagcaaatccaatgcccatagttagagaaaacaaagtccaattatttcgtgaattttcttaaatgtgctgaaataatgcaagccagctaaatgatctttcgtgtatttgctctaaactatgttaccatcaaattaacattgtgtgtggttgtggctttctacaccttcctggtaattctgtttattttctttgtgcatagaccattcaaaaggtaaatcaactatatgagcattaataatctatgaatatacacttgaagcattaactttggagtccatttagattttaatgtgagaaaatcgtacggtaggggaaaaaggaacaatgagtttagctaggtcttactttttcactaaccccaaaaactaatgaaaataaaaaccaccttgattttaatatacaattaatttgttgaacatgttctaaacaaactaagtctactattttttatatagtgataaagattatagataattggttatactgataaattaaatattatatagtatatgacttagaggaattatcaaagtgatgttgacgaagaatatttatcgaggaaacgtacttccgaaagatggtagaggctatctggttaatatgatccgttctcaacgcagcccacaatacatgccagcgcgcgtgcttgggctaccttcctagttttttaccaaaacgaagaaagctattttccaacaaaaaaaagaatacagaagtacgcaaaaagtcaacgtagcaaagggatacctatgaaaatagttttttaagtagttcaattgcacattacacaccccagcgtatagagaggacatatagatcgatatgtaagttccctgcttcaaaattattatgaaacaactcattctttggtgaactagtagatttttactgtcagtcgaccatgataaaacaactccatcgatacgccaaagatcgtaataatttcaaacaaaattgaaaatatgttccagaaattatatgtacagtaacatcaccaaagggaatatataacctgtattttaatttcttgccatgattgcactgttgttgacagtacgttccatcatcccacatgcatgtagccttgttcctcgtctactcagttgtttatttttattctgaattaaaataaattgaaaagttgttagtaccatcgatgaagccccggccaggagctgtcgaacctgaaaatcatgatcaatatggtggggctgaccgtcttggcggacgattccgtcgaatggtcgctcctcacgacgctgtcgcggttgcgtatcgtgctgcccaatccgccattaattccaatcagcatcagctaggctgctacgtacatacgtggttagcacatcccgatccgttgatataacttgagataggataggatacgtacagatataggtggactctctatacacgttaggttcacttaaaaatgccaatgataacacatagattacaatgtacggtcaagattttataatccatagatttagatttttctagttaacatgcgagctaaaaaaatgtccagttagtatgggtatacatagatggttggaacaccaggatttgatttgtgttcatagataaaggtatatgtatataggtagtattgattggatctgttgattcaatcaattttaattttagggttaaatattcttaatgacatacatttttatccagactacccattgttgacattctaatttttcagcaagtttataatcttctaaaagtttcaaatttcactaatggtaatgataaaatgtactacaccaatgttaatgcaaaatgaattgtccatggcagtttcaacagtttcttaggatgttagcttgaggagttgattttgtttactgaaatagagtagtttaaaccttaaatcagtgattttagtccagccattcactttatttgaagatatagtcattgatacagctggagtaaacattaaattactacctcggctgccttaatatgctgtggctgtgaagcagaacatatgcatgttctttggagtagtatatgacaagaattggggaaagaaacttattagtttttctttactactactctcacataggcataacaaaatagtgatattagctgttgttttaacgcaaacttccaaagcaggccgctttactaaatgttattactttgtgataccattactttcaagtttcaactatatatttatatatttattatatactccctccatctcaaaatataaaaagttttagggttagacacggttattaataaagtacgtagaagtgagtggtggagggttgtgattggatgagtagtggaggtatgtgggaaaagtgaatggtggagggttatgattggttaggaagagaatgttggtagagaagctgttatattttgggataaatcctaagagctaaaagttattatattttgagacgggtgagtatttattattcgaatgtgaaatgaaccgtacagaataacagtggggctcttaccgctgtggaaaatgcccacggcatgattgatatgggagggtatagctgatcgcatccattcagataacatatttgtttgcggattcagtcaaggtatggaaaactaagttttccagagctgtgggaagttgtaccatcaattaagtattgaacatattgtcttgcatgtgctctcacgttagtaattgtttactctatgccaagatgctacgtggtgagtcacataggtgtttggataggacttaaaacttttaaaactttttagtccctatcacaacggatgtttggacactaattagacgtattaaacgtagactaatgacaaaacctattccataaccctgaactaattcgcgagacgaatctattgagcctgattaatccatgattagcctatgtgatgctatagtaaacattctctaattatggattaattaggcttaaaaaaattttctcgcgaattagttctcatttatgtaattagttttcgatgtagtctatgtttaatactttaaatcattatccaaacatccgatgtgacatggacaaaagttttatccctagatccaaacaccaccaagacttcacaataatcaaggaaggtatgcaactctgtcgatccctttattcatctagtttagtttattgttcatatggtgtaaccgtgcaaccttaagagttggaactacgttactattcgaaaaacaacgaaacaacaaataaaattaacccaggataaatttattaggattgaaatgtattattatcttatatgaactaatttaccaagaatatttttatatggaatctgcacatcttatgtagtcagcttaatgtctttatctgaaaaaaaaagctgaaatgaattctgaagattttcaatgaatatattttaggcaaaatcgtatgaaattaagcaaagtttgaaactggcagcacatatcgagggtatcaaagttagcgagatgatgagggcatgtttttcaatcctgtatcaccttggtgcttgcaaatattcaactgtatttaccttttcttttctttcagtgaacttgataacatcaagagcagtaaactcaattactgatttatttatttattttgcatgtataacatctaaaaaaaagattggaaactactctgaatgaagcaaggtatgaaaagcacatgcagtcagccttatttggttaatgaaaaataaaataaaattaagggaaagctatcattacagacggtttggcttacatgaaagtacatgaatttgaacctaaatcgtattctatcatggaatttgacttgctgtttgtgctcatataaagctaaattagttggaagtgtaggatcgaatcataataactaagccaaccagagagggggtgaatggttggtagagaactcttttttctgcccctgcaaagctaattatttgtaattattttggttcataacttgtatatgtatcaatggtttaggcaatgaacacaacaaggcagagcggattacagagggaacggttggcttgagagttaatcatgtgaagtatgacggtggtaagaatgggcatcaaagaatgacaagatatagtgtgactgtttaggaaatatagtagtgatagtctttacgaccccttctttttagcaagaaacataattacaatgaaggatcacatcaaaacaagtcacctcctatattaattcttttctaccttcaacaaatgattttactcattcatcatgtgacacatccaacgatcgaaaattatctgatgacgtcgatcaaacggctccccacctccctcccgattcgatccagatcacatcgcttcgcctcaccccagcaaaatcaccgcgccctccctcctcctctttctatctttcacgcgctcctgcccatccgcctcgccttccactgccctccatctcaccgcactcctcagctcgcttcttcgtcaatccgccttgcatttcgccaccctctatctcgccgccgccaccccccatccacccgccggcccctcctcctatcgcatcggtctgcgcctccgggacagttaccggccagttcgctattgccggagtcaccatcccgcacccgccgcatcctccctcccgcacctccctctctcccacacccgtcgccaccgatccagctctctactggtagtagaaaataatctagaccgttgatctcaattcattaaaaggttgagatttatttctattaccacctcacttaatggtagtagaattgtggaaaaaatatctgtgcagggtataatcattctttacactcgctaactgctctctctctctctcgttcattccttagtccccgaaatcccccaaatcgcatccgagccgacccctgcgagcaacaaaagtttgtatttgtgtatagaatgtttgtatatagtatattgtgtacgtacgtatttaaaaaaccgaaaaaaacagggaaaaaccagggaaaatactgaaaatatacgcccaaaaatttgtatatgtgtataaaaaatttgtatttgtgtatcaaaagtttgtatatacgt

SEQ ID NO: 29363 - DNA, 2329 bp, Oryza sativa
ttctctttctgtgtgtagtgtgtgcaactagaaggcttgttccatactagtttgctaggtcatggaaaagagcgagattttcgtaggagcacactcatatgcagctatatgtgcttttacactcatcataggatggttagctcactgggtatacagatggataaatcctccatgcaatgggaggcttcctccgggctcaatgggcttccctattgttggtgagaccttccaatttttcagaacaagtccatcaatagacatgccaatttactacaagcgaagactggagaggttaggattcaaatagttaataattaactttttttggaatcagtatgctatatatagttaaactttaggagaaagaacattgttgatatgaagacactattgctctaaatatgaacaacacacacaataaatctaagttcggtgtactgaactatcaggtatggacctatattcaaaactaacataggaggccagcacgtggtcatatcccttgatcccgaggtgaaccagttcatatttcaacaagaggggaagttgttccaatcctggtttccagaaaccacactaaacatctttggaaagaagacactcaccacgtataatagaactgctcacaagttgatccggagcttcgtatgcaagctctatggccctgaaaacgtgaaaaaatcactcctgccagaactagagaactccatgagggaaagcttggcgtcatggataggaaaacctagtgtcgaggtgaatgatggcgtgtcaaatgtaagttaacatctgcatttctacataagtattcacaattgcacagtgctcataaaatcatcatgatgttttactatgattaatttctattgtgcagatgatcttcggcctagctgccaaacatttgattggcctcgacatcaccaattcaggagaattgaaaaagaactttcaggaaatatttcaagtgatggtttccatcccattcccaatatattttccagggacctcgttttaccgatgcatgcaggtaggtctttatatcatccaaatagctttatgaaaatacatattttaagaatattaataagctctctaaagttataaaaattgtgattcagttaccttgattttttttttcattcctaatgaagggtaggagaaatgtatggaccacactaacaaatgtaatgaaaaagaggctaagtgcacctggaaacaaattcggcgaccttgtcgatctgatagttgaagagctacggagtgaaaatccaacaattgatgaaagttttgctatagacactctatctgggctcttgtttgctagctttgcaccgctatcgtgcaccttgactacaacttttaagttcctcaacgacaatcctgaagtttttgacaagctcaaggtatgtatagttctttaggagtgaatattttacatgtatattgaataattaaagaggatcaaacattgaaattttgggctgatcctaaacaaaaaaattcgttgcatctaccattccaggaggagcacgaaatgatactgaagaaacgagagggtgcgaattctgggttcacatgggaggaatacaagtccttgaaattcagtactcaggtgatttcaagttaatgtatgcttggattgaagcatcattggtgccaccctgatgcatttggcaatggcttttaaattgagcttgtttcaactgcaggttgtgaatgaaattaatcgaatcactacggttatacctggtggtttcaggaaagcactaacagacgtgcaagtaaacggtaaaaacttttttttacaaaaacaataaggaaaatgttgtgcatgtaggtcatgcaattgattattagagtatttgcttttgcacacaggatatacaattccgtctgggtggctagtcatgattagccccatgggagtgcatctaaacccaaaattgttcgaggatccactcaaatttgatccatggagatggacggtaagtgggaatattacattctaatcttctcaatgggatttattaaatcggtctacgcttaggttatatcataacttatattaaaactaatcacaaatacaggaggagaagagaatctcgatgcaaaggaatttcatgccatttggaggaggaatcaggatgtgtcctgcgggagagtttaacaagctttttatcacactctttctccacatcgtggtgaccgagtataggtacatacacaagctcgcattcctttgttgtacattatattatgctcacttttcagcaaacacgcaagaaagttgcacaatttttattaaggaagaacattgaataggctgggaatg

SEQ ID NO: 29364 - DNA, 7285 bp, Oryza sativa
agtgcatctaaacccaaaattgttcgaggatccactcaaatttgatccatggagatggacggtaagtgggaatattacattctaatcttctcaatgggatttattaaatcggtctacgcttaggttatatcataacttatattaaaactaatcacaaatacaggaggagaagagaatctcgatgcaaaggaatttcatgccatttggaggaggaatcaggatgtgtcctgcggcagagtttaacaagctttttatcacactctttctccacatcgtggtgaccgagtataggtacatacacaagctcgcattcctttgttgtacattatattatgctcacttttcagcaaacacgcaagaaagttgcacaatttttattaaggaagaacattgaataggctgggaatgaacgacagagaagaaataacctagaaaaaacagaggaaaacagaaggctataatcttatgccatgaattgaaaatgctcgacaagatgatcacccattcattaaaaaaaaacttccactgaaatattctaacactattttcttttcgtcaacctggtgaatagatggaaggatatcgacggagggaatgtaaagcgtatctccgaggttttggtcgctcaagagtatcatattcaactagttcctcagacgtaacatacctatgggatattcatctataaaaaaccaagtgtcaatggatcctacggagctattcgtacatgtacttcaatattttcatcatatggtcctcttatgtgtgtgtgtgtgcaagtttgaatttccatatattgttccatacttccattaaagtctcatatgattttcctcgaatttgatgaactagccgccaaaccgtgcattgtatcacttttcatatattgttataatatcattaatgtattggttatctatatcacttttcattgttctaagtcagatcgtgataaagtactggtagtttcattcaagttatacgttgaaagcatgtcacgagggcctttgactgaacctgccgaaacaacactggcgaacaaggcagagccattttggtgaaacaagatggcgaagcaccaaggagaaggcaaagacaaagctctttgccatcgccaccaccgtgccgaagatatacggtgccaagaatgggccgaaccgtcaaggacggcccacttagcagcccaactaggggcccatgaccaatttgtttttaattaagagcgtctgcagcataaacataaaatcgattttacagcaaaagaactgaaccatgcacgttgtagctatcgaactgtatgtgtcggataacaaatcgaactccagattggagtcgaaaggaactagtacaaacctattttactatgcatacgtgcgtgaaaggtagactagtgattggttgattcattttttgcgggtcccacaaagcaattttaacgctacagctatcaaactgaaattttattcggctcttggatcagatcagtcgaaccaaatactacagatgccctaaatatcgctatcataagactaaccatgtaaattcctctataatatgtaaccctagggcatgtaatctataaataggcccaaaggggcatgtattagggaaatcccaaaattttcaatcttaataaactgcttttgcttttccactatgtgaaccctgccatttagtaaacacagttgttattcgacaacagctggtgacgatcatggggaaccctagccgaaatcactgatgccaccaaataagtctgtgagtgagaaagtggtgcggatgaggtgtgagagcgaaggagaagtcgaggcgagcaagggcaaattggccgcaggggccgaagctgaagccgagtcatgaagagtcaaagctgggattcagcctgccagagcagagggcgaagctcgagtcgaagcgaccacaactcaagtgactgcttcaaccatagctgcggtgactactttcgttagtccagaagtcgacgcttcagcagccccaaccatagctgcggcgactactttcgttagtccagaaatcgacgcttcggcagcccaaggagcggagatttttttagagaaggatattttttacccggcctctatatcctaccggataaatgcagtatttttcaatttagaacttagcctatcaaatagggaacttaaccctcaaataacccaatctgaaatttgctcttatgaagatttgaactcagaaccttatggtgctacccaggtcactgccaccactaggctacatgcctaaggaggggagatgaaaaccatgcggcaagacacactacgccgaatgcaggagcaacaccaggcgtacgaagcagctatacaagccaagtcaacagcttctaccaggccagctgtcacttcattggcaacgaccactgtggcattgactgcttcgacgccacaagtttcggctgcaacaacttcatcgctattgccaatcaatgcctcaagtctctccatactccaaatcactatcgcgcaatcgaccatggcaacatgcacaacttcaatcgaccacatcttccgcattttcacttctgaaaattaactagtaatttctgaactaatttgtgcataaaattcttgtaaaggaatcattgagataaacaaatcgataatttaatatatagattcatcaataactaaaacgattgaatgcttacaaagaaaagaaacaacagcgaacaaacgatatagcgacggcttcaactccactcccacaggcatccccattgtggtataagccaaacgtgttctctttcacaactttcttcaactgaggttgattgattattgcaaggtgagtacatcgaatactccgcaagccacacagcaaatatggaagtgcacagggatgcaaaggatggaataatagggttcatttgtaaaagcaacatttggcaaacatttgagaattgtaaaacattagagtaattaattatcaatattaatcaatcattaagcatcacacccatactacataggcccaactatctatgaacaaccattcccgattgcactgatctaacctctaaactaagaattatccattccaaaccatgagctaacagttatcatcaattaccatcttattattattattactagtaatttgcccgtgctaacgctatggaattttttttaatcattcgggtataacgcacgttatgaattaaatttaacatttgcaagaatttattatcttttgaagaatcaatgtctagactttgaagttcctaaaaagggataatacatagaatccagaataatcgaccaaaattcataaatattagatagacgagtttctgatttgttgtttacatagccaccttaaggactctattgtcaggttaaggtatgtcagaatatgagacaataggatcacagtatctagaatttctaccatcatatgtaacaagataatagtacaatagttataattcttttttttacaaaatcaaaacataaaatcattatagtaaagacttattagccatcaagctcatgccgttcgtcactgtacatctacaatactcaacaagtctaaaattataaggaacttcttttagccttgaatgcccagtagaatttctatagaaaaacgcgcatctgctgtttgtcatagtagattggatttggcaaacaactaaaaattctatccaaaaacacacatttgctaaagcacaatacatgttaagattgttagtgatatgccctagaggcaatcatagagatgattgtatcacatactatgtttaaatatttatccgacattgttccttgaaatagataactcattattggttaatgaatatgtgattctttcatgagactctttatgttgtttgttactatttctaaaggatccttgatcaaatatcatatgtggaacaaatatgtttaaatgatcagcacatgtattaattgatgatcatgtctcatggatcatggcatagagataccaaattaataatgtggacacatgttggtgaacatgttgttggatagacccaacatgagacactgcaaaagccatatgtgttgtgtcatcagtgatctcatcatggttcctaacatgtgtagtagcttacttagggactgctaaacgctactctaattctagaggttaaatccagtaagttattactgaaattctagaggttaaatccagtaagttattactatctctaattaactatttatgaaatcaagattcatcttacagggtcttttggtctttactgaaccttaccccacataactatttatatatctagttttgaagcccaacagcacaattaccatatttcttagcaatataaaatacttcttgctgctagctacatgatgatacaaataattttgaactataactaatctttctacttgtgagctaaatcaaaatatttataccctattgtttacacatgttctgcagctgaaattattatatgatccttttactgatttcagagatattcttgttcatattatgatggatgagaatgcaacacacaactcctacacatactagtatatgcatcacacaagaatcatgtcatgatatgatttcacttccattttaatcttctaattacctgccatgctttagggtgactgatatgttattcccttctgactttgcagctgctcctctaaactatggttcaagggttctcctgatggaactctgctggaacaccacttgctccttcttcaggttggtttctctgctatctcacttcagcatctccttgctgctttggtttatatggtaagataagtgaaaatcttgattggcatctggatttgctacttcccttggttttcctggagtttatcctctttcttgatttctgctccatcttgcttgagctactaatggttgcttctcctactactcctctgacctctcattcactcaccctagcctctcctggctgtacacacaaggctgctacggctgtggtgaagcatgggtgagatgttgaactactgatttgctagctgtgattatttctctttagcttgagttgaatccctagctgaactgctggtgttgatttccgttgcggcagctgctgctattgctctactgcggcaggtgcttgaggtggttttccaaccgatgcaaccgaggctggggttcactgaatagcttggttgatgtatatgtgaatttggtgaagactaggtgactcacctactttagttttgatggttgtttactgactgacacctaagcagtgcttgatcggtggagtaatgtgggatttcactaaattttttctagttagataaattctgatacaattaggtacttttacacttgagtccctcggggtctctaaaattgaaggttactctgagattagggactgatttgtaattgttctagaactcaagagtttttctgaaaactaaatgattattgaatctttgactgaggtgtttcagtttatgatatggtatcaataaacaccttatatatgcacaatatatgcgatgcatactgtataagatttctagagtacaattatatgcatatatgtatgcagacctgtagtggtaaattgtaaataacgaactgtggtttctactgtgcacatgtgtagctcacttcgtgacgactaatctatgctataatttaaccaaaactaaattatcccactcctcactaggtctactctaactaaaaataatgatgcatatggatatgacttgataaataaatgacaaggaaacgatcgaaaaatcatttaagatccataatagaacaacaatcaacatatttataggtcctagccagcatcgtggctcaatcgacaccgctctcagccagtgtgaccaagtcatttgcgtgactaagactatagctgatatgatctttatgtatgtccggtgggtcaatacgttctgctaggggccgctgttgacatgtggaccgagaaggagttttcggtttacagccgagtgtacatgaacctacagggtcgcacgcttaatgggccaaaataaggggattggatagagatctaatatgagcttaattcggatagggatccgaataggagtcctacgggccttggaggcccgagtgatggattctatatattcgtgaggggtgtgaccggcggaggtattgcatcacgtgagaaaccctagctgccattttcctccctgagcaaaaccctagttgcgcgcgggtgctagcacatctgcgcgtggcattccgtccctatacgtgtggataccggtagaggcaccgctggtttgcggtgctgatcggcgtgggagtacggcgaggaggacgcacgaggaggagaaggtcgagccggtgcgattgactacttcctctacatcgacgcgcgctacatcgcgagggttccttcgactccttagcgctttcttccactgcgcagcgcgtcgagtggtaacgatctatgatctaatgcttgcatggttcctggtttacgcggtagaaaaattttgatttatgctatcgtagcctacgcatatcccaacagtggtatgagagccgccttgtattgtttatgatctagatcattgcatatagttgatatgcgggtgtagtagatgagatctattatattgtatatgagttcttagatgtcacgtcctgataaattcatcccgaaataaaaatcattctctaaaaggaataatagaattaattaaaattcgaaaagaaattggcaaacactaaaatacgtacaagaaaaattcaaatgtggcccggagaatttttgttaaattctccttggtctaaaaggagccctcaatttttggtggaattttcagagcacaaataataattattaagaaataaacaaagttaaaatggtttcataaaaagaaaaaccctaaaaagtctttcccccccccttttccctcttgggccggctcggcccatccctttctctctctctcctcttccccgcggcccatccggcctcctccccgcgcgcgcgccgctgacgggtgggcccgcccgccaccctcgctgacgggtggggcccacctgtcatccctgtcctcccgccgctcccgccgcctcgcccgtgccctagcgccgtcgccgccgcgaatcccgccgcctcccgtcgtacacgcgcgcaataaagtggggggaaatattccccgtgattccctctctctttccccccatttctccctctctctaccgcgttcaaacgggcggatttgcccccgcaaatctcgccggcgccattgatggcggc

SEQ ID NO: 29365 - DNA, 6832 bp, Oryza sativa
ttcctcctcgccggatttgagctcgcgacgtcgctctctctctccgccgtcgccgccgagctccggtccgccgccgtcgtcaccccggaccgcctcccacctcggcgccgcctccttcggcttcgccgcatcctcgccgacctcgtccacctctccgtttcggtcgccgaccgccggaacgccgccgtccccgtcgacccgagccgcgccgccgcctctctccgctccggtcgccgttcccgtcgtcgccgtcgatccggggtgagccgtgggccgccgtttcgcttcccccttccctcccctctctcgggcgccgctccgccgcgccggtggccgcgctggcttggccgccctcgggcgcgccgagtggctgccgcgtggggcccggccgtcagccgcccgcgccctcgggtgcggctgacgcgtgggacccccggcgccggccggtgtgagccgggtgcacccggtccaccgtggaccgtggggctgccgcgtgggccccactcccgtggactcggtccgcgcgcccctcccctcggctgacgcaataaatccgattttaaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttatttctgcttgttatatggagtttattagagtaaaagccttttcttttccattggtcgtgtagacgctgcagcttcggaagatccgctcttcgtggaagttgaagccggcgtttgggaaagcgagcaaggcaagtcacatcatccttgaacatattgaatcccagtttataaaattattttgatttaaattattgcattgtcgctttatttaaattcccgcgttatcactgttttatttagccatgcctatttacctttgttatgaccttattattattgttattgttattattaccttgttcaccctagattaaacaaaaccccaactagtggatactctactcatggtaccactagtatgattttaggtagatgcttcgctgtttaattaggtatcattaggtggttttacaactctagactctgggatattctcatcacctggacactttggaattgttggattattgcggaattggattcacaccgccccctctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggattagagatggacgaagtcgggggtcgatggacatctctaggacaaatgaaggctacacgagctgcggcccggtagtcgagatgtcatggcacagggctggtgtcctgctgctaggggctcaatcctgcctacctgtcccggaggttccggccgtaggtggggttgggtcggtactcttgtctatggctaggatgggttgaaaactatgtcacgtcttccgtctgtataccgtggtggtatgtggcacgtggttgcacgtgagggagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctaggacccagggtcgggttgccagttcggtctgaatcatcgtaggccttgggttaaggcaggttcgtgagggttcacggccttgattaataatactgtgtaactctaggatcgtctctataaaatggctttgggcaactaagtgacttttaaatgctgttttctgtaaaacttaacccctatattattatccccttgtactcccttgcattaattatgcatctccggtgtggcttgctgagtactgtggttgtactcattcttgctcaatctttctccccctttcagtaagagaagctttggagaagatgtcttaggtggagtcttggcttataccccagttgagcgcctgtgaagttggagccgtaggcccgcaagtccgctgctgtttatttttgattgtcaggccttaagtgcctttgtaataatgtaaatattatcgatataataaagatgtgtcttttatatcatgtttgtgtggtgtaccccggcttttcctgggacggggattaatacactagcgttcgggaaaaggaaattttctcggtcgcgacattagatgatcggaacatgagatgaaccgatagccgcttgggttgatgagatcaatcggtatgtgtgttggtgacttcactggaatgtctagtactcaccaaggccgagcgcaattgtgttcatcggatagtccgatgtccacaagaaccgcacgccaatgagaaaaacgagccaatgagattgacttggtttcggcataattcgattactccgttaaggttttgacatggcgaatcgtagatgagatctatgtacacggctagcgggaccgccgtgtgcgttgccccttagatttcgcttagggttttatatctatcttattttattgctgttgtatatttgatatgacatggtaggatagattccctcagaaaaattaagtgtaatttatgctcttccaataattgcacctattacggttgtgatcataagtgataggtttgccatagcaaagtgtcactttttatcatgataaaataggatagatgtcggacatctatctgcggagattattggtttacttgacaaggagatgtcaccccaacagcacgagagtcacatatgatgtgattagcaaggtgttgcttacctattttgatagttatctagctgtgatgccaaagctcactagacactaataaaaatgaggatcttgactcactatgttattagagggaattttgtttcacaatacatagtgggagtatctttcgttaaactgtttaatgaaaggttaaatgtagacatggtgctgattttgcctacatatatttctattgtagatcatggcagctcctgcaccatccagttttaacttgcggtctattcttgaaaaagagaagttgactggaacaaacatcatggattggtatcgcaacctgagaattgttctcaggcaagagcacaaagagtttgtgcttacacagccttttccagctgacttgcccaacaatgctcctgctgctcaacgtagggagcatgaaaagcgatgtaatgattatcttgatattagctgtctcatgcttgctactatgtcccctgagcttcaaaggcaatatgaggcattggatgctcatacgataatcacgggactgcgtaacatgtttgaggaccaagcaagagctaagaggtttaatacctcaaagtccttgtttgcgtgcaggcttgcagaaggtaatccagtgagcccacatgtgatcaaaatgattggttacaacgagactctggaaaagcttggttttccccttagccaagagttggctactgatttgattctccagtcgctccctcccagctttgagccgttcatattaaatttcaacatgaacaacatgaacaggaccttgacaaaattgcctgggatgctaaagactgccgaggaaagcattaagaaaaactccaaccatgtgatggttatgcataagcgcaagcccaacaacaagaagagtggttagaagagaaagctaaactctgatgagatcacgagtactagcaactctaagaccaaggttcaaaggacagggcctgctaaggatgcagagtgcttcttttgcaaggaggcaggtcattggaagagaaactgtaagaaatacctagagcagctcaagcagaagcagcaggatggaaagagttccacctcaggtattaatgttatagaaattaatcttgctacttcctctactgattcttgggtatttgacaccgggtcagttgctcacatatgcaaatcgttgcaagggctgaaaagaagtaggagcttagcaagaggcgaagtggacattcgcgtgggcaatggagcaagagttgctgctgttgcggtcggcactatgccattatctttaccgtcaagattagtttggagttaaataattattattgcattccagctttgtgtaagaacgttatctctgcttcttgtttgcaagcagagggttatggttttagatctgtggacaatgattgttcagtctattataatgacattttctatttccatgcacccatgatgagtggcttatacattgtgaatcttaatggatattcagtctataacattaatgcaaaaaggcaacgtcctaatgatttgaatcccacttttatttggcattgtcgcttgggtcatataaatgagaaacgcatggagaagattcatagagatggacttctacactcttttgattttgaatcatttgagacatgcgaatcttgtttacttggcaagatgacaaaggcacctttcacgggtcaaagtgaaagggcaagtgaactattggcactagtacatactgatgtatgtggaccaatgagctcaactgccagaggtggttttgggtacttttttacctttaccgatgactttagtagatatggttatgtctacttaatgaggcataagtctgagtcctttgaaaagttcaaggaatttcataatgaggtacaaaatcatttgggaaagacaatcaagtatctacgatctgatcgtggtggagagtacttgagccttgaatttggcaatcatctaaaggagtgtggaattgttccacaactcactccgccaggaacgcctcaatggaatggggtgtccgaatggaggaatcgtacattgttggacatggtgcgatcaatgatgagccaaactaatcttctgctaagcttttggggttacgctctagagacaactgcgttcacactaaacagtgttccatctaaatcggtggataagacaccatacgagatatggacagggaagcgtcccagtttgtctttcctaaagatttggggatgtgaggtctatgtaaaacgtttgcaatcggacaaactcacacccaaatcagataaatgcttctttgtggggtatcctaaagaaacgaaaggatattatttttataatcaggaagagggcaaagtgtttgtcgcccgacacggtgttttcttggaaaaagagtttatttcaagaaaggatattgggagcatggtgcgacttgaagaaattaaggaaacaccggaaaatgcttccacgtccacacaaccacaacaagctaagcaagatgttgttcaccaggttgaacaagttgttgttgaaccagttgtggaagcaccggtttcgcgaagatccgaagaaaaagacagatgtagatggcaatgttcacatctacaaggcacgattggtggcgaaaggtttcagacaaattcaaggtgttgactatgatgaaactttctcaccagtcgccatgctaaaatttatttggattgttttagcgattgctgcctatttcgattatgagatatggcaaatgtatgtcaaaactgctttccttaatggaaatctggatgaggatgtatacatgacacaacctaagggatttgacgatccacaatcagctaaaaagatatgcaagttgcatcaatccatttatgggttgaagcaagcatctcggagttggaatattcgttttgacgaagttgtcaaggcgttgggctttgtcagaaacgaagaagaaccttgtgtatacaagaagattagtgggagcgcactagtgtttctaatcttatatgtagatgacatattgttgattgggaatgatatttctatgcttgaatccgttaagacatcgttgaaaaatagtttttcaatgaaggacttaggggaagcagcatatattctgggcataaggatctatagagatagatcaaagaggctaattggattaagccagagtacatacattgacaaggtgttgaagaggttcaacatgcaagattctaagaaaggtttcttaccgatgtcacatggcattaatcttggcaagaatcagtgtcctcaaacgactgatgagcgaaataagatgagtgtgattccatatgcttcggcaattggatccatcatgtatgctatgctatgtacacgtccagatgtttcatatgcacttagtgcaacaagccgataccaatcagatccaggtgagagtcactggatagctgtaaagaatatcctgaagtacttgagaagaactaaggatatgttccttgcctatggaggacaggaagagctcgttgtaaatggttacactgacgcaagcttccaaatcgacaaagatgattttagatcgcagtctggatttgtgttctgcctgaatggaggcgctgtgagttggaagagttccaagcaagatatagtcgttgattctaccacagaagccgaatacattgccgcttctgaggctgtttggataaagaaatttgtttctcaactgggtgtgatgacgagtgcttctagctctatggacctctattgcgataatagtggtgccattgcgcaagccaaggagcctaggtcgcatcaaaagtccaaacacattttacggcagtatcacctcattcgcgagaagtgggtagaggagatgtgaagatatgcaaaatacatacggatttgaatgttgcagatccgttg

SEQ ID NO: 29366 - DNA, 6407 bp, Oryza sativa
tgaggcacacactagggcaatgggtataagatacattcatgattgactctagtgcaagtgggagactgttagtgatatgccctagaggcaatcatagagatgattgtatcacatactatgtttacatatttatccgacattgttccttgaaatagataactcattattggttaatgaatatgtgattccttcatgagactttatgttatttgttactatttttaaaggatccctgatcaaatatcatatgtggaacaaatatatttaaatgatcagcacatgtattaattgatgatcatgtctcatggatcatggtatagagataccaaattaataatgtagacacatggttgtgaacatgttgttggatagtgtggaccctcgtttttataacaggaatcaatcgtgtaaacagtactatttccctggatcaagtagtctggtacacacgagttcatagcctggtgctcctcttccagctgaagctgctgcactgtgaggtcagtcacctcagtctctaactctcccacacgcctctgctggtcgtcgatctccaacagagcctcctcgtaaaagtcgtctactgcctcagcccatcgtgacagtcgggtcactatcgggttgtagcagcaaggtgtgtcctgaactgtgcagacggagttgctctcctctcgaaacaggtggtgagcaaactcagtactcgccaactcagctcggtggatagagctaagtcggaggaatgcctcccgggctgcatcctgcatcgcagtctccggtaagtcgcgacggtggcgggtcgggaagcggtagtctgactctgaaggaactcgtgtgtgaacctcgacccgagcctcccaaacagatccacactgtctcactcggtagatcggaaatctggggtatcgcagacgcctcatcagccggttagctcaatgacgtatccctctgagcggggtacgcccatctcccaggtagcggatgaatcctgatctgccatctaattttaaaaaacccaaggtcagctaagagtaaaactcgttttgtgaagaaaatagttaagagtaagatgaaaatcgtacaaagttttgtaaacatagcgtttttatttttgaaagtattactaaatgggaatttctcccttggccaacttagaaaaggggtggggcgccttttggtcttttcctacagtcgtatggctctgataccagctctgtggacccctgtttttataacaggaatcaatcgtgtaaacagtaccatttccctggatcaagtagtctgttacacacgagttcatagctgaaataccaaatgcacacacacgaaagtctagtgcgaattattacatcaaaagcccgcaggcatagtcttaaatcatcggaccgagcggtctagaatacattccaaaaacagaagtagataaggcagcggagttaaggcagcggcacgccattgccacaggcaacgaccgtaactaagacctagcgagtgccatcgtcttcatcaccctcctggtagtaagtgtagggatcctccaaagcttcatctccgacctctgattaagtttgtatattgcaagggtgagtagcaaccgtactcaacaagccaccacagcaacaatgcacatgataggggtattcaaaggatggctatggttcttttgcgcaaagcaagttttataattcttttcacaaacctaagacctatcacaaactgatcaaattttagtaccagtgttcatattaaacaatgacggttctgtccaccatccattgtgagtcatcatggttttctgaggacgtccacattcccgcctctcaggaagtggtttcatcagtatagaaatcatcatgcaatatcccatcccacacaagttaagaatttagagtctagccaagtgtaatacatgtcccggtgctcaataaccgtgagcacggctattcgaatagatttggtttactcacactgcagtggatgtacactttacttgcactccgcgactgcccaacacatgagcctcgtcccaacacatgagacgcgtcacggcaaagcttttcgataacctcgccttggcagtacccgctccatgaactttacatcctcatgcactctaggcgtacacggtttctagcagtgagaggagttctggcgcacccgggaagggaagactcatgcatgcattaagttataattatgtttagattctcacatggcagtcctaccgatggcgacaccactgtagacacccgcctcgcggttctaccaatggttgccccaccgtagagcccctgcctcacacatcaagaaaccactatgcatggatattacctccgctcagctatctactccgctaggtctatacccatacgagaagtgcggttgtacgggggtcgtttcatgcttaacttcatggctcagtccttaacttgccaaggacggcactagccttttccggacaacacccaaatcttccgtccgcctcagtcgaaaacagttgtttaattttatttctcctttcacaaatcatgtcatcaacatcatggcaatatggcgctcctgtccccacatgccgcatctcaattaccttcccaaaggtaattgcccaagcatatagcatttgataaatatgagtatgcatgattctagaatagcatttctaagcaattgtcataattaactagggactcatacgtaaacatggttacgaagccataaggggtaaacaagaatcaaggcatggcataatcacaagtaggatgttcatcattgcatgtagtttatttgtaaacaaaataatttcgcaattgggatcaacatgttcaaggaatagtgatgacttgccttgctcaaagtcttgcgggtcttggccttcacttggatccgcaactcccttgggctctatagttacgtgcaaaaattgatttgaattcggttagaattcaaataaaaatccaaataaatccaaatggaagtcgaatgcgaaagtcgattcttttatattaactttactattcgcgaactagggcaaacctaatttcaatttatacatcctaaactatttttgcggggataaatattttgttatcataagtttttaatttaatgtacccgagtattatatccatataataggttagaaatttctatcgcgagctaaatatcagacggaatccaaaaattatcttataatattatacgatttaatttagtctatgactaaacgattaaatataatatacgtctaaaattcctattaattaaatccgagtacctaccgtgaattgatcacctatagagattaccaaaataatctataattatattaaatttttgcaattctacgactataattgatctataattaaattccaattattttaaattttctaacttccctaatctctctctaatttctatttatttattcttttcttttctttttctctcctcttttctttcttttcttttcccttctttcttttctttctttctctcctttttctttctttcttcttttctctctttctctccctcccggcttcttctccctcctctctctctctcagctctctggcgacgacgaccgagcaaggagaggaggcggcggcttaccgacgacggcgacggcggtgatgacggcgcaacggcggcgcacggcgcggcgccacgaaggcggcggtgcgagggcggcgcgacgacggcgcacggcgcggtggcacaaaggcggcggtgcagcggcgcgatggcggcagcgcggcggcacgaaggtagtggctcggtggagagggaagagcggagaaagagggagatggagtggggcaaatggagagggggtgtggagtatttataggggagagggggaagaaagagagggggaggggtggccggcctgacgcgacggcggcgcggggcggcgacacgacggcggggacgcgacgggcggcaacgtgatggcggcgcggggcttggggcggcgcagggctcggcgcgcggtgatgggacggcgcggcgcggcgtggggctcggcgcgcggcgatggaatggcgacgacgacagcggcgcaggctcgaggcggcgatggaacacgcgtggcgacgggacgggcggtgatggggtgcgtgggcgcgcgggtcggtgggatgacggcgcgccggctcggggcgtgaggcgcgcgcagcaggggagatgggacgggcgcacggctgggaaggggcgcggggcgcgaggcgacgacgcgacggcgacatgagataccttgtacatacgccacactttggttctagtcctcttttcagcttcatccaatatccggactgggtgttctggatacatgagatcattgctaatacgaatttcttccaatgtagcttgttcttccggcactcgcaagcacttctttaactgagacacgtggaagactgggtgcacatcggcgatgtttttcggtagctgtaactgatatgcaacttctcctcgtctagcgatgatttggaatggtcccacatatcttggtgctagttttcctttgaccttaaaccttttcgttcccctcatcggagaaacctttagataaatgtaatctccttccttaaattccaggtttcttcttcgggtgtcggcgtaactcttctatcgtgattgtgccacttttagatggtctcgaatcaggcgaaccttttcttcggcttctttgataatgtcaggtccaaatactgcctgttcatctgtctcggaccacatcagtggggttcaacatcgtcgaccaaacaatgcctcattgggtgacatctttaggcttgcttgaaagctgttgttgtaggagaattcggcgtagggcaaacatctctcccagtctttgctaaaatccaatgcacaagctctcagcatgtcctccaagacctggtttgttctctccgtctggccatctgtctgtggatgataagctgtgctaaaagcaagataacttcctaggacttcatgtactttttcccagaaatgcgaggtaaactatgtgcctcgatcggatataatcctcttaggcacaccatgaagacacactatcctggtcatgtacaactcggtgagtttagcactgctatagtttgtcttgacggggatgaatcttgccgtcttggtgagtcgatccacaatcacccagatggaatcgtaccctgttgcggtcttgggcaaccccgactatgaaatccatacctatctcatcccatttccattcggtaatcctaaggggttgcaacagacctgccggtctctggtgctcagccttcacctctggcatacgtcacagagcgctacgtattcggccacatctctcttcatattgggccaccagtatccttccttcagatcctggtacatcttggtacttccggggtgcaatgaatatgccgattcgtgagcttcctttaagattaatcctctcagtccaccctgttcgggtacatagatcctctttttataccatagaacatctttttcgtcggttgaaaattcctttgcaaatcctgcggctaggcgttccttcacctctcggatttcctcgttgtccttctgggctttttctatttgggttctcagaagaggttgaatgtccaaggtgtttatctgtccacgaggtactatatgtaggtttagttgggccatttcctccttaagctcaggagccatcccttccgtcctcagatgattgcaatggctcttccgactcaaagcgtcggccacaacgttggccttgccggggtgatagtgaacctctagatcatagtccttgattaattccaaccatcgcctttgcctcaagttgagatctgactgggtgaaaatatacttcagactcttgtggtcagtgtagatatcacaatgatttcaaatcagataatgtctccaaatctttagcgcatgaaccacagctgcgagttctaggtcatgagtagggtagttttcctcatgtggtcacaattgtcacgacgcataggccacaacttttccgtcctgcatcagtactcctcctagtccttgcctcgatgcatcacaatatataagaaagtctttcctgttgtcgggaagaaacagaataggtgccgaggtcagcttttctttgagctgctcaaagctttcttgacactgttctgaccatacaaacttcttttctttcttgagtagttgtgttataggtcgggctatcttagagaacccctcaatgaacctccggtagtatccggccaaacctagaaaactccgaatcttagtcacagatttgggtgccttccattccgtaatggcctcaactttagcaggatccactgctactccaccggctgagattacatggcctagaaaagcgacttctctaaccagaactcacatttactaaactttgcatataattt

SEQ ID NO: 29367 - DNA, 1135 bp, Oryza sativa
tccgtggtagtgggtacttgtttttgaaagttacttcgttcagtgagcggtagtccacacacattctcatgctaccatctttcttcttaacgaataacactggggctccccaaggtgacgaactgggacgtacaaatcccttttcttgcaactctctgatttgctttttaagttcttccaactcattgactggcatccgatatggtctcttggatatgggagcagttccgggtatcaggtcaataatgaactctatgtcacgatctggtggcattccaggtaaatcttctgggaacacatcaggaaatcgcttcactacgggcattccctttaggggtagcttggtaaatatgcctctggcacgttcggttagtctaggatcttgatccacggtcgctgtcatatccgatccccaaggtgtggtcagggtaacttccctacgtctacagtcgattactgtcacaccccgaagttttccccccaagccaaaattttaatttataaatgaccctataaagatgccggtgcaaagcaagagtaaacccttttaaatcaatgcaaataataatcggaattggcatgtggaatttttcttgagttctacatgtcgaaattcactaacaggatttttagtggaattttcagagctctagaaataattttaaccaattaaaattgagcaagcaatattttaattccagggaaaatcctttttcctttttctttttctttttcctctctttttcctcctttttttcgaatgggccgccggcccattctctcctttcttccccctcctccctgtagggccggccgcaggccgaggcccatccaggccgtcccgcctccctcctctctcggggtcgccgacaggtggggcccacctgtcgggcccgtctccatcctccagccgacgccgcgcccgcaaccgccgccgcgtccacgcctccgcctcctccgggccacgtcgaccacgcccacgcgtgcgccgcgtttcccgcgcccactcccctctctctcccgctcgcgcccgcgcccgagatggccgggattcgattttagaatcccgcctctctctcctcccccacttcccccacgttggccggcgaaatcccgcctctcccggccacgtccg

SEQ ID NO: 29368 - DNA, 705 bp, Oryza sativa
  unsure (1)..(705): unsure at all n locations
nnnnnnnnnnnnnnnnnnnnnnnnnnnnnnnncaccggtgcatgcactcggcgagctgcgtttgcatcaagggacacctcagcgaggacgcgctgttcctggtctttcgtcacatgaactggaaccccaggctgatcgccgtgctctcgtgcgtgtgcaagtggttcgacgaggtcgcgaagcaggtgctctggaaggagttctgccacgccagggcgccgaagatgatgctggatttgcattcgggtggcagtcacattgtcgacgggaactggaaggcgctcgggaagcttctcatctactgcaatggctgcacaaaagggggcctctttaacaacattcatgtccctgggcactttgtgttcaggacacgcttttcgaggaccgcgggcaagagtttcctgccccagcagtgtaggaatgatgtcttatatgtctcagatccatgcgagcatcttgatcaaggggatgaaggtgacttgggtttcttccgtggtatcttcatgtcgttcgccacctcaaaggttaagaagatgttgattgagaagcgggcaaggttccatccaagcgagtcatgtccctactgtaaggctaagctgtggagcatgttggaagcaaatatgtcgccggggagtttttctgccaggcttggtgcttacgaggattctgtggagtattttggatgcctggaccgacatgtcattg

SEQ ID NO: 29369 - DNA, 24379 bp, Oryza sativa
caactgaggtttgatgattattgcaagaatgagcatatgacatactcaacaagccacacagcaaatatgcaagtgcacaaggattccaaaggatggcataatacaagctcatttgcaaaagcagcatttagcaaaacatttaagagaaataaaacagtgaagtaattaatcagaaattttaatcaacactgaacagcacacccatgctgcacaggcccaaccatcctgaacaaccatacccggctgtacagatctaatctccaaaccaggagctaaacaaattattaccaggtataacatccataattattgtgagaggtgtgagactaatcacgaaaaacattgctcaactcgcccataaccgcgggcacggctattcgaatagttttactctagccagaggtgtaccactgtacccacaagacacgatttcgcacatgttgccatgccccgaaataccaccacggcattgcaaagggggaaattgtgacaataccctttgcacaacacaactcaaaacagtgcaccgttcctggatcataatcaccccctctacaatcagaggcatggactccccagcgacccccatggacttctcgccacttcacagtctggcacactataatgaatcatgctatacaaaagataaagccattgcccatgctggcttgtggttggtacggttaatgtttcacaacagtagctcgcgaaccggtccttaattgtcatgagcacgactctcaaaaccatgtgctcacaacccaccattaatcatattttaattaccaattaattatcataacacgattaaccatcgtgagctaccattaaaaataaccataaataataatgtagtatatatgattcatcccattagtgagctaatgtttctaagcatggctaagcaattatatctaacatctagttgaaccaatatatataaagctcaactagtcaagttataataacccaaggtatcaaggaatagggtaatcaatgcaaactggccataataaaggaataggttcacaccacccggtgacattcaaaaataaatgcacagttgaaataaatagagaatttaaatatagaatcaacatgctcaaaggattgtgtttaggatctgtgtgacttgccttgcaataatcggtcttcaattaatcttcttgatgacttccgacgcactcacgaacctttgcaacgacggaaacgacaagctaacacgtaaaacgaagaaaaagactaataaaaaccaaataaacagtacataacaagtaaacaaacacgtagatcataattttagatgaattatgagacttgaacggcctcattctgaattcaaatgaatttattatgaattttacaagattaaatctaattaaagcccatttaaaaagaattaaataaatttaatttaatttatggacaattttaatatgtagatctttattttagaaaaatttagcaacttgaaccacctgaaacggatctacggttatttacttatgatttccgaagatttaatctattagaaaaagggcaaaagaaaagatgatgatgtcacgatgacgtcatcgacggcagccacggcatgggtggcgacctcaccggagctagagaggtcggccgggctatctaagggcatctacacgtagacgacgacgacgcgatctcaacgatactcaccaacgcaacgaacgacgacggatgacggccggcggcgagcttgtgcggcggtggcgactcggtcgtcggcggcggcgactctccggtgaccggcgacggcggggagggggcggccgagcttcccctcttccacgcgcacccgacggcggcgagaggagacagcggcgacggccaaaacgacggcgcgaggcggctgttcgtcggccggcgacggcggcggctaagacgacgtggcggcagctctacggttgacgagagagctcgggagatggggcaaaagaaagaggagaactaggggatgctttatatagtcttggactagagagatcggactccaaacgagaggaatcgatgccggaaaatcttcgggttagtttggagagataaactcaaaacgaattttatttggataaaatacaaggaattaggttccgattcttgggggaaacgaaagaggaagataaaggaaatatttcccctcaactaattttgcaaacggagctcgggatgcggcggatttggtggagaaagcggcggctgcacagggcacaggacggcagctcgggctctgtccagagctggaagatgaacagtagtagagggaggaacagtagacttttctggctgggctgagaggagaggaggcggctcaggttgggccggcggaagagagaggaaggaaaggaaagaatgggccgaaaatggcccaagctgaggaggaggattttattacttttccaattaaaataatcacttaaatgatctttgaattgttaaaaatacttccaatgctcaaataattccaagaaaaatcctgaaaatacttggacactcaaagtacttaccaaaattataattagaccatttaatgattaatttaatatgtgggtaattactgaaatgctctttgtagattaaaattaataattgagctccgaaaaatccgagaaaattccagagagtataattaaccatggagaatttaataaaaaattaaatccatccatgctttatatttaggaaattttatttcccacatttaacttcacttgtaaattaatgaacatttaatataaattctaataataatttattaaataatctataaatcctgaaaaaatcaggatgtgacaccgtccacccctcctccgtcgaggttcgtcgccggagccctcgttccctcgcactcgggtgagcaccacctccaccgccgccttcggccatggtttccggtcgccgtggtccatctctctctctaatccctctcttctccttccttagggcaccccgaagctcgtccgcccaccgacgtcgtcctcccgtggcttgccgtcgccgttcgccatcatcttcttccgcgccggccaccctcggtgaggcatccctcccctcttttccccttcctctcctcctagtgccgcgccgccgcttcgagtcgcatgccgtcgccttcggccgccggcgccgcctcccgtgccgccggtcgccgccgtcgttggccgcatgccgtcgccgctagacctggccggcaggtcggctttgatgccgagccgagccggcggtcgcctttaacgccgcccgtcccctccccttcctagccgccgcttagcgtagccgccttcgcgtcgccttttgcgccgtcgccctcgccgccggttgccgtcgccggcaacgcgttcgcgcgcgcgccgtcgccgtcgccgcggccggtcggccggccttgagccaagccgagctgggtgccgccgccccttttctttctccccgccgctgaccagtgggcccgcgtgccggcgcccttcctccctctcccgagccgctgaccagtgggcccgcgtgccggcgcccttcctccctctcccgagccgctgaccggtgggccccgcatgtcggcgccgcttcccttgtgctgacgtcagccctggaatatattgcgcaataaatgatttagggtttttcttttatagtaataaacacagtgaatcttctaaaattcataactaattcatccgagctccgtttaagcccattcaagtctcagtaaatcaagaaaaatgtgtagaatccattaaaaatggttttgttccctgtttcagtagtcttatagcctgtttgcaatgtttgctttgtatgtcgctagattccgattcctccgacgctccggtgtactttgagatagtcgccgaggttcctccagcagcagagcaaggcaagtcatgcttgtcacttgaacatgttgatcctatattgcaaatgctctattgttttctttcaaatattgcattgttttataatattactatgggatggttacctattgttacagccatgctttttggataccatgctcctttgttagcttggggttatgacatgattagagtttggactaggaattgcttagctatgcttagttcaactagttcacaatggggaaaatcatattaatgtttagactgttggttctaatggtaatgttggattataccaccgctctggtgttggttaattaaaatgaatcatatggtgggctgtgggtgcatggttttgctggtcgcacccatggcagttaaggaccggttcgcgggatgccctggaagaacttaacgtacttaccacaagccagcgtgggcaacggctgggcttgtagtgtagctttcctctagccgacgcatccaggcaagggtgggcgtgatggagtttggatgggccctgcgacggcctatgcggcttccagattcacctaggcacgagaggggactgcccgctgccttgcgaggagtgggggtgaaacctgaggtgtggtgtgcttggttagagggggttatgcgaatggtcctgtcacggcctctttccggtatgtcgtggtgacatgttggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatcttttgaatttggatagtttaggtggatggttgggcctgtcgcaacgtgggttagcgttggacaacggatgattaatatgaattaattattacaactgtttaaatctttcaatttctgtttataaatgctcgctttatgcaaatgaaccacttcagctcttctttgttaattccctgcatcatacccctattccggtatgacttgctgagtatagtgggtagtactcagtcttgctctacttttcccaaccccagagttcgagttcgggtcagatgaaggtttctctgaggagtaggcttcgtccgtgccgtcgaggatgcctgtggagtggtgttcccgctgcagtttagtcaaggcttagctcctgttgtctttcttttcttccgctgcatttatgtaagactttatgatgtttgtaagacgtggatctgaatgtcaacattgtcgtttgtgtaccccggctggtcctggacggggattttaatgcacattctgcttggaattctattcgggaatttctgggcgtgacaacatccagggtctggggtatcaaaaccataaggttggagggaaacaccacaaccctaagacgaataggtacatctatgcaagcatgactcacagttatctcgcccccaggtgagtgtactatcataggctttctaagtcccactagggttaagttgtgcttttgactagccttcagagatatgaatgaatgcgatgcaccagaatcgaagaggactttaaccggggtagaattgacagagaacatacccattagtacgccctgatcttcctgggcctcttcagctcgaacatggttcacttgtccgcgtccaaatccggtagcggtcctgttagtttgcggagtcttgaatagacctcgtccggtagtaggggtagtagttccacgaacaatcattgcattagcgccagtacggacaggagttttgtgtggatgagggcagttgttggcgtagtgcccatactccccgcagttcaagcagtccacattcttcttggctccaggggcagccagggttggtgtaggggtgcggttctgaatcgcaaccgacctgttgaatttgctaggtgcagcggggcggttggttgccacaataggggttttccacccagacgaagtggcttccttgagtcgctgaggcactccctgaggtaggcgattcatagaaagcctccttttgcggttgtgctctacagtcctttgatcgttctccagcctaacgaccttgttgattaggctctggaaactctcttgatcttgcccaatcataggtccacgcaactcatcattcagcccttctatgaacttgtcgatcttttcttcttcatctgcgaggtctccaattgcatagcgggccaactgagtgaatcggttcagatattcctgcaccgttgtgttcccttgtcgcagccttctaaactcgttcctcttcatacgcattaccgcagtaggcacgaagttctcgcgaaatgctgcagtgaactcttcccaagtgggttctccatcatcctcttcccgagcttccttgtaagtatcccaccaatcaccagcgggtccctccagttaatttactgcgaagatcactttgtcggcttcgcgtacccggacaagggtcagtttattctctatgatacgtagccaatcttctgcctccataggctcgtctaccgtagcgaacgtgggtggcttggtcctcataaactctccaaagctcgatccgccgcggttgccttggttattcgcaatggcttgtagaagttgggtttcagtggccataactctggccagggtggttaggtcaggtgtcgaagtttcttcattgctggttgacgcccgacgtcggcttgccatctgtgtaggccgattaagtaagtatcctaattttctaactagctcttatggttttatcccattaagggagttgtttcgatgtgaactttgttttgcaagcatggtggaataaactcatttataacacaacaacaataatatcataaataacatcatagagttccacaaatagtacataaatcatgatgcaatcgactgcacacatacgcagtccaaataaggttcatccaaaagatgcatcgaactaaccatcaagctactcgtcaatctaggtaagggggggtgtgtctcgcatactatccaaaaaccatctgaagcgagatcgaagctgcaataatcctccagtctagtcatccaaccatccgcaggatcctggggcaggtagagggtggtcgctggcacgggcaaacctgagtccccacggctcggaagtagtggcctctggatctggcttgggcttcttgctcgggggtcgggtgctcttgcgggcagtgctgagggtgcgagggcctccgaggaaggtgatgcggggaacaggggtctcatcctctgaaggattagtgatgtctggctcgatctctggctcggtgtcggtcccctctgtctcggagtcgacttggatcggagtctccaaactggaacccagctgcggagaaggtgtagggatcagtggagtgtgcacaatctccggggcaggtggctgtgtcactgtcgggtccaccaagtaaggtgctgactcagtagccagcataccaacctctcccaaaagagcgtgcaacgctggtgggtatggcagggtgaggaaaaagtagcggtcacgtcctactgttgtggaagtagaagctcctatggtgctgaccgtggctgctcgaagctgctcctccagctagctgacgtgctcctgactctctctcagctgctcctcaagtgtatccatcatcccgcggctgtcgttgtactggtcagataactgctggaactggtcgccgtggacctggagctgtgcctttagtgagtctatctcactgccccaagcctggtgctcctcttccagctgaagctgctgcactgtgaggtcagtcacctcggtctctaactctcccatatgcctctgctggtcgtcgatctctaacagagcctcctcgtaaaagtcgtctactgcctcagcccatcgtgacagtagggtcactatcgggttgtagcagcaaggtgtgtcctgaactgtgcagacggagttgctctcctctcgaaacaggtggtgagcaaactcagtactcaccaactcagctcggtggatagagctaagtcggaggaaggcctcccgggctgcatcctgcatcgcggtctccggtaagtcgtgacggtggcgggtcgggaagcggtagtctgactctgaaggaactcgtgtgtgaacctcgacccgagcctcccaaacagatccacactgtctcactcggtagatcggaaatctggggtatcgcagatgcctcatcagccggtgtagctcaatgacgtatccctctaagcgaggtacgcccatctcccaggtagcgggtgaatcctgatctgccatctaattttaaaaaacccaaggtcaactaagagtaaaactcgttttgtgaagaaaatagttaagagtaagatgaaaatcatacaaagttttgtaagcatagcgtttttatttttgaaagtattactaaatgggaatttctcccttcgccaacttagaaaaggggtggggcgccttttggtcttttcctacagtcgtatggctctgataccagctctgtggacccccgtttttataacaggaatcaatcgtgtaaacagtaccatttccctggatcaagtagtctggtacacacgagttcatagctgaaatatgtcacatcctgatttttgtttcaggatttataaattatttaataaattattattagaatttatattaaatgttcattaatttacaagtgaagttaaatgtgggaaataaaatttcctaaatataaagcatggatggatttaatttttattaaattatccatggttaattatactctctggaattttctcagatttttcggagctcaattcctaattttaatcatacaaagagcatttcagtaattacccacatattaaattaatcattaaatgctctaattataatttttttaagtactttgagtgtccaagtattttcaggatttttcttgaaattatttgagcattggaagtatttttaacaattcaaagatcatttaagtgattattttaattggaaaagtaataataatcctcttcctagtcttgggccctttccggccgatctccctcttttgtgtgcacggccgtgcagccctagtcggcccagccgagtttcccccttctctttctttctttgctttgttttcagccagcccaagacgaaaagtctaatttgcgtccctcgacactgtttatcttctacctctagcagccgaactgagaccgatttggctcggtttttctcctccaaatctgacctttccccttgtgtttttctaaaattagttgaggggaaatattcctcttatcctcctctatctttacccccaaaaaatcggagctaatcgttgagtatctcatccgaatcgaactcgttttcgagtttatctccaaaaccgagtttttgatttcccggatcgatttcttgcgggaggagtccgatctcttcaatccaaggctataaaaaggaccccctagtcctcctctttcgtttgccccctctcccgtgatcttccgtgcctcgtagcgccgccgccacgtgctccaccccgccgtcgtcgccggccgagctccatccgcgtcgcgccgtcgcctccgtcgtcgccgccggtcgctgtcaccgccgtaaggtgcgcgggagggtggagaagcccggccgcctgacccccgaagccgctgatcaccggagccccgtcgccgccgtcgaccgaagccgcgccgccgctagaccccgtcgccggccgtcgtcgttcgtcgtttggttcgagggtgagtaccgttgggttcgtctcgtcgtcctctacgtgtacatgtcctccaaagtcgcagccgaccatccaatctccggcgaggtcgccatcttggtccggccattgatgaggtcatcatgacgtcatcatcgtttttctttttcctgtttttctaatagattaaatcttcagaaattcataactaaatcatcttagctcggatttagttggttcaagtctctaaatttttctaaaattgagatctacatgctaaaaatatccacatatactgttcatgcttgtttatgtgctgttttggtgtttttgctcttttctgtttagattccgatgtttccggagagtccgttttcgcaggagaagaatttgaagagttccaaggccagcaaggcaagtcacacagatcccaaacaaccctttgagcatgttgaacctgtttaaagctattgatttatttcaactgatgcattgttttcgaatgtcattgggtggtgagcctttcccctttaattatggccgaagatgacttgggatttttctatgggttataatttgactagtatggaccttatatattggattggttcagctagatgttatttatagttgcttagccatgcttagaaacaatagctcactaatgtgataatcatgcttcactatcacttatggatatttaatggaagttcacgacggttgatcgtgattggttaattaattacttgtcaactaaaacctgataatggtgggttgtgagcacatggttttgatggtcgtgctcatgacaattaaggaccggttcacgagtttcggttgtgaaacatttaccgtgccaaccacaagccagcgtgggcaacggctttaccttttgtatagcatggttcattgcggggcacccgactgagaagtgtcggagataagcccacgggggtcgctggggagtccatgcctctggtttttgagggggtgattatgatccaggaatggtgcgctgcagtggattgtgttatgcaagctcctttccgaggtaccgtggtggtattgaggcacatggtgacatgatgtggggctgtgtcttgtgggtacagtggtacacctctgatcagagtaaaactattcgaatagccgtgcccgcggttatgggcgggttgagcaatgtttttcgtgattagtctcacacctctcacaataattatggatgttatacctggtaataatttgcttagctcctggtttggagttagatctgtacagctgggtatggttgttcaggatggttgggcctgtgcagcatgggtgtgttgttcagtgttgattaaaatttctgattaattactccactgttttacttctcttaaatgttttgctaaatgctgcttttgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagctgaagccatcgctagaccgttattccgctgctgttttcttttcttttgtaagtgtgtaacgttattattatgatggatttgtatattaaattgtcagtttgtgtacctcggctgattcctggacgaggattttatgcacaaataagttcggaaattactagtgaatttccgggcgtgacaaaataccaaatacacacacgaaagtctagtgcgaattattacatcaaaagcccgcaggcatagtcttaaatcatcggaccgagcggtctggaatacattccaaaaacagaagtagataaagcagcggagttaaggcagcggcacgccattgccacaggcaacaaccgtaactaagacctagcgagcgccatcgtcttcatcaccctcctggtagtaagcgtagggatcctccaaagcttcatctccgacctctgattaagtttgtatattgcaagggtgagtaccaaccgtactcaacaagccaccacagcaacaatgcacatgacaggggtattcaaaggatggctatggttcttttgcgcaaaacaagttttataattcttttcacaaacctaagacctagcacagactgatcaaattttagtaccattgttcatattaaacaatgacggttctgtccaccatccattgtgatcccaaggatagcttcctgccattgagtcatcatggttttctgaggacgtccacattcccgcctctcaggaagtggctccatcagtatagaaatcatcatgcaatatcccatcccacacaagttaagaatttagagtctagccaagtgtaatacatgtcccggtgctcaataaccgcgagcacggctattcgaatagatttggtttactcacactgcagtggatgtacactttacccgcactccgcgactgcccaacacatgagcctcgtcctaacacatgagatgcgtcacggcaaagcttttcgataacctcgcattggcagtacccgctccatgaactttacatcctcatgcactctaggcgtacacggtttctagcagtgagaggagttctggcgcacccgggaagggaagactcacacatgcattaagttataattatgtttagattctcacatggcagtcctaccgatggcgacaccactgtagacacccgcctcgcggttctaccaatggttgccccaccgtagagcccctgcctcacacatcaagaaaccactatgcatagatactacctccgctcagctatctactccgctaggtctatacccatacgagaagtgcggttgtacgggggtcgtttcatgcttaacttcatggctcggtccttaactgaccaaggacggcactagccttttccggacaccacccaaatctttatatccataccaattaagtttttaatttaatctacccgagtattatatccatataataggttagaaatttctatcgcgagctaaatatcggacggaatccaaaaattatcttataatattatacgatttaatttagtctatgactaaacgattaaatataatatacgtctaaaattcctattaattaaatccgagtacctaccgtgaattgatcacctatagagattaccaaaataatctataattatattaaatttttgcaattctacgactatatttgatctataattaaattctaattattttaaattttctaacttccctaatctccctctaatttctatttttttttcttttctttgtctctcctcttttctttcttttcttttcccttctttcttttctctctttctctcctttttctttctttcttcttttctctctttctctccctcccggcttcttctccctcctctctctgtcggctctctagcgacggcgaccgagcatggggaggaggcggcggcttaccgacgacggcggcggcggtgacgacggcgcatggcgcggcgccacgaaggcggcggtgcggcggcgcgacgacggcacatggcgcggtggcacgaaggcggcggcgcggcggcacgaaggcggtggctcggtggagagggaagaggggagaacgagggagatggagtgggggaaatggagagggggtgtggagtatttataggggagagggggaagaaagagagggggacgggtggccggcctgatgcgacagcggcgcgggggctcggggcggcgacacgatggcggtgacgtgacgggcggcgacgtgatggcggtgcggggctcggggtggcgcgcggggctcggggcagcgcggggctcggcgcgcggtgatgggacggcacagcgcggcacggggctcggcgcacggagatgggatggcgacggcgacagcggcgcaggctcgaggcggcgatggaacgcgcgcggcgacgggacgggcggtgacggggcgcgtgggcacgcggggcggcgggatggcagcgcggcggctcggggcgcgaggcgcgtgcggcaggggagatgggacgggcgcgcggcggggcaggggcgcggggcgcaaggcgacgacgcgacagcgacggcgatggcgcgcggcgcgtggtgacggcgacgcgacgcggtagcggcgcggggcgacggcgcgcggcggcaggcggcgatggctacgtcggcgcggctcggggtggctaggggcaggcgacggaggaggggcagggctacggaaccacatcgagcaccttccgcgcaatgaacagtgctagttttcattttatccttatttaacctattctctatataaatcttattcattaattccaaatttttacgcaaatgaagtttacataacatttgtgttatttcaaccaaaagattcactctagattaacattacccatattttatttttatctaattttcttgaatttaattaattcttatttcatcgtactaaaatttaattattgctaatatggtcgcgataatattttatttatttccaacctcacctaatctttattttaatttatattttaattatttatttagccaatttgatttttagggtttattcctagttagttattcattattcacgattaataaattccgagatcaaaatccaatgaaataggcgaataaaatcggcatgatgcaatttatttaaaaagtttttgaaggtccgtatttttagagttttgatttttgtcggtcgaattttcagggtgttacagatagacccaacatgagacactgcaagagccatatgtgttgtgtcatcagtgatctcatttagtgttggtgttgaatccttagacctgagattatcatggttcccaacatgtgtagtagcttacttagagactgctaaacgctactccgtaattggatagttataaaagtagtttttgggtatgctatgaaacatgtagtgggatatgaataatcaagatgggatttgcccctcctatggagagatatctttgggcctctcgatgttatagattataaaagtgcatggccatgccaaaggtgattgaggagtcaatcacaagttatataatctatcacaggttcgagtgaatgattgagctattagaggatggcacatatctagccttgagcttaattgatatcgtggcaaaagggttcatacaagtatacactagaggttcagccgatatgatctttatgtatgaccggtgggtcaatacattctgctaggggccgctgttgacatgtggaccgaaaaggagttttcgggttacagccgagtgtacatgaacctatagggtcgcacgcttaatgggccagaataaggggattggatatagatccaatatgagcttaattcggatagggatccgaataggagtcctacgggccttggaggcccgagtgatggatcctatatattcgtgaggggtgtgaccggcggaggtattgcatcacgtgagaaaccctagccgccattttcctccccgagcaaaaccctagtagcgtgcgggtgctagcacatctgcgcgtggcgttccatccctatacgtgtggataccggtagaggcgccgcgccgttggtttgcggtgctgatcggcgtgggagtacggcaaggaggacgaacgaggaggagaagatcgagccggtgcgatcgactacttcctctacatcgacgcgcgctacatcgcgagggttccttcgaccccttagcgctttcttccgctgcgcaacgtgtcgagtggtaacgatctatgatctaaagcttgcatggtttctggtttacgcgatagaaaaattttgatttatgctatcgtagcctacgtgtatcccaacaaagaccacatcattgatcaaataaacttgttcaagtgtcaatgcacctggtaagagctgccagcctactccatacatgcatattttgcttgcttgtagaactgaaaacagaaacgcataacacaagccagaggttgttgctatgaacatatcagattcccggaacaagggaaaatttcatgaggcataatggaagctgtcacctcatgagcgtccagccccaactgagactttcatgaacaaatcaagaaaactctttctaaagaattaagaaatcaagttttacacccattcccattgaaaacaagcatgagaatgaaaagaaaaaaaaagtgttttgttctgtgcaccagcaccgccacctcgcccacatccacattttttaaacgaaaaacccatatccacattcaccagcccgaaaaatagatcgattgaaactttagaaatgtgttaaagttttgtatatgtgagagataagatactacggaagatgatctattttaccaaggatggaggctagacaaccttaatttggttgtgacctgcgactgttattggtcagaaaacactatatatccattgaaccatacatgttacagagtttctaataacatggttaagctgtagtattgctccaataactgaacaatatttaattcattttgttgaaaacctagatgaagaaaagggaaaagaagatggttgttggatttattcagaagctgaaagtgggtatcacagagtcgccccgtagaaaaaaagaagaagaaagtttcacgtcttatgtcaggtaaatgaggcaatcaagtcatgaactccttatcaggtggcagctagaaacacatgaactatcacttgcacaagttttcacagttcacaggtgcaaaatacaaactgtcaaacccaaaagcaaggtgcaccagtgaatcacattgcactatccaatatagagagttctaagcataacttccattctctagccacttatttgctaaaagaaatttgttctctgagctgctaaatagtaagtacacaatcaatcaaaaggcaggcaatcaggacactatggttgcaaacctttataaataattttaccagttaattaacaacaactttaatttggctcctagaactaattgaagttatacatgttctaattttactacacttcagctttctaaataataatagcaaggaaattttacttacaaaatacacaccagtgatgaaatacaatataactgtgatccttctaagtgctatctactgtccacaaatcgtatagagaaatgcatattttctgcaatatatatgatatatgagatcaggtgaagaggcaagaataacaaaggagacctgcaccttactgtacatgagaatccttacaattgcactggtggagaaaccatctttggttggtcgcccgaaatccacaatagttccggttccacaaaaaaccgggactaaagatgatcttttgtcccggttggggctacaatgggcatatgtgatctttagtcccgattctaaagttgtcaggccccccgggatctttagtcccggttggtgttaccaatcgggactaaagatcctaactttagtcctggttggtgctaccaaccgggacaaaagatctccccctttatatatgtcttcttcctcctccagcccgagcaagcttcaaaatttctccaaaaaagaggggaggtcatgccaaaatttcttgcgaaatttttttagtgataatatacaaatcggaggtgtctaaaaggttagtaacttcattcttcaatgttttttgttgttataatacttttggagctatgtttcacacattttttttttgtctctaaaacgttgttgtaagttgatgagagagaaaatttttgtggggaagatgaatatatagaaattttgtttgtttacttaaaaagttttattctcatagtttaaaatataatgaaaattaatcttaaaaatagaaaataaaataaattgaaaattaaaagaagtacaacattaatattagtttagaacttcaaaaataatataatacaacattaatattagtttagaacttcaaaaataatataaaagaattgtttgttggattattttataattattaattgtatgagtaatgatatgtcattattgtatgactgtttaaagagtttttaattattttatcattattgtatgactgtcattattgtacgaaaatttatttatgtacgattttttttcatttcatgtaagatggatcggcaatggatgtacgctgaccggcggtccaaagagtttatcgatggcgtgcattattttttgagagtggccgaagctaacaagcataagggttttatgtgttgtccatgcaataagtaagaaccagaaggagtattctgcatctaggactattcatttccacttctttgagtcggggttcatgccaagctataattgttggacatcccacggtgagcaaggggttgaaatggaagaagatgaagtggaggatgagaacattccggactaggctcagtacgctggatttgaatgaaatcaaacgggcgaggtggacagggatgatgacgataacagcgttgcggatgatcttggtcagatgttgtaggacgccaaggaggactgtgaaagtgaaaaggatgcccataaattggagcatatgttagaggaccacagaacttcgttgtacccaggttgcgagcaggggcacaaaaagttggataccactctagagttcttgcaatggaaggcaaaaaatagtgttagtaacaaggtatttggcgatttattgaaactcgtcaagaacattctttcggagggaaacaaatttcccgagacaacgtacgaggctaagaagatagtctgccctctaggactggaagttcagaagattcacgcatgtctgaatgattgtatcctatatcgcggtgaggagtacgagaagctagaagcatgccctgtttgtaaagcactacgatacaagattagacgagatgatccaggtgaagttgacgggcagccaatgaagaagaaaattcttgctaaggtgatgtggtatttccctataataccacggctacggcgtttgttcagaaacaaggggaatgctagaatgatgcgttggcacgctgaataacgtcaacaggacgggatgctgagacaccccgccgatggttcgcaggggcgaaacatcgacagaacatttaaagactttggaaaggacgcacgaaacatacggtttggtttaagtacgaatggcatgaatccttttggagagatgagcaacggccagcggccatagcacttggcccgttacgatgtgtatctacaacctccccccttggctatgcatgaagaggaagtacataatgatgccgattattattcaaggcgccaagcaacatggtaacgacatcaatgtgtacctaagaccactgttcaaagatcttaaactgttgtggaagaaggaaggtgtctccgtgtgggacgaggacaaacatgaggagtttaacctacgagccctgctgttcgtaaccatcaacgattggcctacacttagcaacctatccggacagtctaacaaggggtacaaggcttgcactcactgtatggatgaaacagaaagtacgtatcttaagcactgtaggaaggttgtgtacataggtcatcgtcgattccttgctgcaaaccacccagtacggaagaaaggcaagcactttgaacataaggcggaccaccgtacgaagcctaaacattgcagcaggaaaacaatttgctatggtgaaagatcttaaagtagtgtttggaaaggggcctggcagccagcctatagagagcgaagatagtcacgcggcgatgtggaaaaagaactctatattttgggagttaccctattgggaattcttagacgtccgccatgcaatcgacgtgatgcacctcactaagaacctttgcgtaaacctgcttggcttcctagctgtatatggaaagtcgaaagatacactggaagcacgtaaagatctgaagcatatagaacaacgcggcgaccttcacccggaaccaaaggagaaaggaagccattacttgagtccagccagctacactcttagcaaggcagagaaggaaagtatgtttaaatgcttgtagagcatcaaggtactgtctggatactctatgaatataaagtgaataataagcacgaaggagaagaagttcacaaacataaagtctcatgactgtcacgtgttgatgacacaactgctaccagttataattcggggtatctttccagacaatgtccgggcaacaataacaaagctatgtgctttcatgtacgcaatttcgtgaaaggtcatcgatccggatagattagaagcccttcaaaatgacgtggtgcaatgtcttatcagctttgagctgatatttccaccttcatttttcaatataatgacgcatctgctttgtcaccttgtcaaagagattggtattctcgggcctgtgtacctacacaacatgtttcctttcaagaggtacatgagcgttctgaagaattatgttcgtaaccgtgctcgtctagaggcaagcatcgccaaggggtatggagcagaggaggtcattgaattctgcgtagaatttattgaagaccttcgcccaatcggggtgcctgaatcacgccataaagggagactacagggaaaggggactctcggaaggaaagcaataatgacggtagacaacaatttattccgtaaagcccatttcacggttctgcagcaatcttcattggtggctccttacatcgaggagcacttggctctagttcgcgccagaaacatcggtaagtccgatgcatggattacacggcatcacattgatactttccccgtggctgcgacaacatctcatggttaacgaaacgattaaccaacaactggccttcctggcgaggagaccatccggctcaattgcgacattccagggatatgagatcaatgggtacacattctacacgagagcccaagacatgaaatccacgaaccagaacagtgctattcatatcgatgccatgggacacgatggtacaactggcacgtattacggtgccatcgaggacatatgggaacttgactatggacctctcaaggtccctctgttctggtgccaatgggttaggttgaccggtggaggcgtaacgattgatgacagtgggatgtcaacggttgaccttaacaaggttggatactcggacgaaccttttattctcgccaataatgtaacgcaagtattttacgtgaaggacatgtctagcaaaggaaagaagggaaaagggcctgacgagccgaagcgccacgtggttctcccaggcaaaaggaaaattgtcggagtagaggacaagattgacgaggattatgatcagtttgatgggcaaccctctttcacggtgaggattgacgctagcatcctcctatcaaatgaagacaccctttactcacgtagcgatcacaaggaaggaacaatagtgaggagaaagtacgtgtggtcaaccgtcaccgtcgatgtattgccgtaattgttgtgtacacgatgtaaactattttggatatattgaatatccatataaattaattgttgtatggcatatgttaattatgtatgattattagaatttttaacaaatttaaatcatgcatatgctagttatatatgataattacagtttttaacagttttaaatcatgcatatgcatattatatttttttttgaggaaccgacggcaggagtttctcttgccggagtatatagaggaagagaattggcccagttaataagggaaactggacccaaaaaccgaacaagcacggttaattaatcgggaaaccggcaaaacctatacaaaaaaggaaaaagaagacaactattgagacctcacaaaagtcgtcgttgccgagcttaccaaaggcaagcagcttcgataacataatgcaaacgaggcctccagaaccaccaaacatcctctagtggagcagaaaccttctaagcgaagccttcaataagggaacaacatcaaggatgctatcaacacccgttccgaaaggaacccggttttcacctgaagggagagagagccaacatgacgatacctccaaggaggaaacggcgcccataggcgtcgatatcatcaacctaggatacactaggcaaggttttcacccgaggctctctcaaaatgctccacctccaaaccctcgtcacattgccgggacatctgttgggggtcatcgttgccgagcttgcaagacaaacagctccgactccgcctcaacattcaatcacactacagctcgaccaaagaccacctcacccacaggaacccagctgcagcaaacctacggcgtggccgatgaccagacaggacgccagaatccaattccgcacgccatccctaccgaaacaaggacctccccggcatcgactggaagcaccctagcctaagaagggaggagcacctaagaagaggggagcgggcgccgcaccgccagtgaccaccggaagaacaaccactgaagaaggggagaaaccggatctagaggaacaagactcccgtggtatatcgcgtggattcgaagtgtagtttatcttctattttgccgacgaaccctagctctttcgccgccgattcccctcgtatccgagccgatccccccctcctttggcagcccctcggcctcctcatccgtttcctcctttttttttgaatttttccctagccctagagccgccgccacgctcggcttctctctcctttgccggccgccgctccagccacgtcgcgccgcctcctcggtcatcccagaactgcgccgtcgccttcctcggcttcgcagtgaagagctctaccccgtccaccggttccttttcgccaaatcccgccggaagccgcttgccgacgcgaacccgagggtttcggcctttgccgcttctccagccgcacatcgccgtcgactccgtggtcgccgaaccccgccgtctcctccgttggtatcgcagcgccaagccgaagcctgttcacccatgcgctgccgctgcaaaccaccggagcttcgacgttgctgtcgatcagtacaccgtcgtccccgtgaggccgatctattcgatcctcagccaagctgcgtcgccgttgccgtctccgctggtcatcgcagaagcctgcgtcggcatcgcaaggtcctcaggaagcccgtccacccatcctttttccccggagttcgccgtctcaatctcgtcgccggccatctcccgtcatcgtctgtggtcgtgccgcccctcggtgagttcgtctcgtcgtcctattcgcgttggtgcactcggatagcccgccgagcctcctagcgcttgcgaccttgcggtccggtgcgttgccggcgatgatgtcatcgctgacgtcagcgtctatttttctgttccaaataaatcgtaattccttttgctaaattatattaaatcttgtaaaattcatagctaattcatacgaactcattcgttcaagtctcataattcatctaaattcaaactctacctactgtttatttggtttttatttgtgtttttccttttttgcgttctaggtttagttttcgatcatttcgaaggattgttagttcgttgaagaagttcctgaagacgaattgaagacgcttgtttgcaaggcaagtcatacaaattccaaacaaccctttgagcatgttgaatctgtttaaagctattgttttatttcaacttatgcattattttcgaatgtcatcgggtggtgagcctttcccaattaattatggccgaagatgactttattttcctatgggtaataaattgattagtttagaccttatatattggattgattcaggtaaatgctatatatatataattgcttagccatgcttagaaacattagctcattaatgggatgaatcatactacattattatttatggttatatttaatggtagctcacgatggttaattgtgttatgataattaattgataattaaaacttgacaatggtgggttgttagcacatggttttgaaggtcgtgctcatgacaattaaggactggtttgcgagctactgttgtgaaacattaaccgtgccaaccacaagccagcatgggcaacggctttaccttttgtatagcatggttcattacggggtgccagactaagaagcggcgagaagtccgtgggggtcgctgggagtccatgcctctggttgtagaggaggtgattatgatctaggaacggtgcactgtggtgagttgtgttatgcgaagggtattgtcacgatttcccccttttagtgccgtgggggtacttcggggcatggcaacatgtgtggaatcgtgtcttgtgggtacagtggtatatctctggccagagtaaaactattcgaatagccgtgcccgcgattatgggcaggtctaacaatgttttcgtgattagtcccacactactcattaatgttaataatgtgataattaatttgactcttggtttggaatggtaaattcctagtttggaggattgatctgtacgaccggggttggttgttcaggtttggttgggcctaagcagcatgggtgcgctgttcagtgttgattaatattgatgattaattactctgctgtgttactactcttagatctttgctaaatgttgttttcgcaaatgaacactatattatgccatcctttagtatccttgtgcacttgcatacttgctgtgtggcttgcggagtattccatgtactcaccttgcaatcatcatcaaatctcaattgaagaaaaaggatccagaaggagaagacctttggcttagatcccagttgagctgc

SEQ ID NO: 29370 - DNA, 676 bp, Oryza sativa
ccggctgatgaggcatctgcgataccccagatttccgatctaccgagtgagacagtgtggatctgtttgggaggctcgggtcgaggttcacacacgagttccttcagagtcagactaccgcttcccgacccgccaccgtcacgacttaccggagaccgcgatgcaggatgcagcccgggaggccttcctccgacttagctctatccaccgagctgagttggtgagtactgagtttgctcaccacctgtttcgagaggagagcaactccgtctgcacagttcaggacacaccttgctgctacaacccgatagtgaccctactgtcacgatgggctgaggcagtagacgacttttacgaggaggctctgttagagatcgacgaccagcagaggcatatgggagagttagagaccgaggtgactgacctcacagtgcagcagcttcagctggaagaggagcaccaggcttggggcagtgagatagactcactaaaggcacagctccaggtccacggcgaccagttccagcagttatctgaccagtacaacgacagccgcgggatgatggatacacttgaggagcagctgagagagagtcaggagcacgtcagctagctggaggagcagcttcgagcagccacggtcagcaccataggagcttctacttccacaacagta

SEQ ID NO: 29371 - DNA, 687 bp, Oryza sativa
ccctcgtttttataacaggaatcaatcgtgtaaacagtactatttccctggatcaagtagtctggtacacacgagttcatagcctggtgctcctcttccagctgaagctgctgcactgtgaggtcagtcacctcagtctctaactctcccacacgcctctgctggtcgtcgatctccaacagagcctcctcgtaaaagtcgtctactgcctcagcccatcgtgacagtcgggtcactatcgggttgtagcagcaaggtgtgtcctgaactgtgcagacggagttgctctcctctcgaaacaggtggtgagcaaactcagtactcgccaactcagctcggtggatagagctaagtcggaggaatgcctcccgggctgcatcctgcatcgcagtctccggtaagtcgcgacggtggcgggtcgggaagcggtagtctgactctgaaggaactcgtgtgtgaacctcgacccgagcctcccaaacagatccacactgtctcactcggtagatcggaaatctggggtatcgcagacgcctcatcagccggtgtagctcaatgacgtatccctctgagcggggtacgcccatctcccaggtagcggatgaatcctgatctgccatctaattttaaaaaacccaaggtcagctaagagtaaaactcgttttgtgaagaaaatagttaagagta

SEQ ID NO: 29372 - DNA, 493 bp, Oryza sativa
gctcgcaacctgaatacaacgaaattctctgggcctgcaacatcttgtccaatttatgggcctcctttcactttcgcagtcttccctggcgtcctgcaacatctgaccaagatcatccgcaacgtcgttaccatcagcagctatttctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcacatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgcacaca

SEQ ID NO: 29373 - DNA, 298 bp, Oryza sativa
atggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgctcgcgctcttcctcttcattgggcacgggcacatccaaggctacatccgtatctgaaa

SEQ ID NO: 29374 - DNA, 10939 bp, Oryza sativa
ccaccgtcctggtgttagtcaattaaaatataccatctagtgggctgtgggtgcatggttgtgatggtcgcgcccatggcacttgaggaccggttcgcgggaaaccctagaacaattcctcgtacttaccacaagctagcgtgggcaacggctgggcttgtagtgtagctttcctctagttgacgcatccaggcaagggtgggcgtgatggtgcggggcgggccctgcgacagcctctgtcgctttcggattcaccgaggcacgagaggggactgtccgttgcccgctagggacgggggtgaaacctgaggtgtggtgtgcttggctagagggggttatgtgaagggtcctgtcacggcctctttccggtatgtcgtggtggcatgtcggcgcacggaaacgtgtcgtgggattgtgtcttgtgggtatagttgtacacctctgattagagtaaaataaataccctttgccgcggattgatgatctgtttgatcagctgaaaggagctagggtgttttccaaaatagatctgcgatcaggctaccaccagttgaggattcgggtagaggatattcccaagacaaccttcaccactcggtatgggttgtatgagtgcacggttatgtcttttggacttaccaacgcacctgcattcttcatgaacctgatgaacaaagtgttcatggaatttctggataagtttgttgtggtattcattaacgatatacttatctattcaaagtctgaagaagaacatgagcaacatctccgtctggtacttgagaagttgaaggagcaccagttatatgccaagttcagtaagtgcgacttctggttgtcggaagtcaaatttctgggtcacgtcattactgctcaaggcatggtagtggatccatcgaatgtggagtcagttaccaagtggaccccacctaagacagtgtcacagattcggagtttccttgaacttgcgggttattaccgtcggttcattgaaaatttcttcaggattgccagacctatgactcagttgcttaagaaagacgagaaattcaagtggacagctgagtgtgacaagagttttgaggagctcaagtagaaattaatatctgctccagttctgattctgcccgatcagacgaaagacttccaagtctattgcgacgcgtcctgtcacgggcttggatgtgttttaatgcaagagggtagagtggtcgcttatgcctcgcggcagttgcgtccacatgaagaaaactatccaacacatgacctggaattggcatcggtggttcacgccttgaaaatctagaggcattacctgattggcaaccgctgtgaagtgtatacggatcacaagagtttgaaatatatcttcacccaacctgacctgaatctccgacagcgaagatggttggagttaatcaaagattatgacatgagcattcactaccatccgggcaaagccaatgtggtggcagatgcattaagcaagaagagctattgcaatgctttgtgcaccgaacgcatgtgtaaggaattgcagcaggagcttgaacatctcaacttgggaatcgtagaacacgggttcgtggctgctctagaggcacggcctacgctcgtggatcaagtcagagcagctcaaataaatgatcctgagatagctgaactgaaaaagaatatgagggtcgaaaaagcccaggatttccttgaggatgaacatggcacaatctggatgggagaaagattctgcgtacctgctgacaaagagctgaaagatctgatactcaccaaggctcatcagactcagtactccattcatccaggcagtaccaagatgtaccaagatctcaaagaaaaattttggtgggccagcatgagaagggaaatagttgaattcgtcgcactctgcgatgtttgtgagcgagtcaaaacagaacaccagaggcccgcaggattgttaaacctctccagatgccggaatggaagtgggaagagattggaatggatttcataacaggtctgcccaggacatcatctggccacgattcaatctgggtagtcgtggatcgactcactaaagttgcccatttcatcccagtgcataccacgtatacgggaaagaaattggcagagctgtacttagcaaggatcatgtgtctgcatggggtacccaagaagattgtatctgatcgagggagtcagttcacctcaaaatattggcagaaactgcaggaagaattggggacccgtttgaatttcagcacagcctaccacccgcagactgatggccagaccgagagggtcaatcagatcttggaggatatgttgcgagcctatgcgcttgattttggcagagcttgggataaaagtctgccttatgctgaattctcttaccacaacagctatcaggccagtctacaaatggcaccgttcgaagcgttgtatggccagaagtgccgcacacctctcttctgggatcaaacaggtgaacgtcaattgttcggaacagaagtgctaacagaagcagaggagaaagtcagaaccgtcagagaggctaagaattgcacaacctcgacaaaagagctacgcaaacaaccgccgaagagagctcacttttgaagcaggggattatgtgtacctccgtgtcactccgctccggggagtacaccatttacagacgaaaggcaagttggcactacgcttcgtgggaccatacaaaatcttggaacgacgaggaaaagttgcctatcagctagaacttccatccaacatgatcggcatccatgacgtgttccatgtgtcccagttaaagaaatgcttgagggtacccgaagaacaagccgattcggagcacattgacatccaagaagatctgacttatgtggagaagccagttcgcatcattgagaccagtgaaaggtggactagaaacaaggtcaccaggttctgcagggttcagtggagccaccactcagaggaagaagcaacctgggaaagggaagatgagttgaaggccgcccatccgcacctcttcgccagctcttccgaatctcggggtcgagatttcgtttatgggcggtaggtttgtcacaccctgaagttctttccccaagcctaaattggatttataaatcaccgagagaaaatatcggtgtaaaagcaagagagaaaccctaataaattaatgcaaataataatcggaattggcatgtggaatttttcttgagttctacatgttgaaatatgctaacaagatttttggaggaattttcagagctctagaaaaaattttaaccaattaaaaacgagcacaagcaatatttaatccctggaaattcatttcccttttcttttttcctttttccctcctttttcccaatgggccgctatcacgtcctaataaattcatcccaaaataaaaatcattctctaaaaggagtaatagaattaattaaaattcgaaaagaaattggcaagcactaaaatacgtataagaaaaatttgaatgtggtccggagaatttttgttaaattctccttggtctaaaaggagccctcaaattttacttgaattttcagagcaacggaattatttattaagcaacaacaacctttatcaaagtttattaaaaagaaaactaaaaataaatcctccttcctcctttgggccaagtctggcccaaagcttccctctctctctcggcccacggccaaagtccttccctcctccctctctttttccttccctctctctctcttgggccgccctccctctttcccctcggcccagctccctcctcctccctctccctcccgagctgcctctccctcctcacctcctgggccgcctccaggcccaagccgagcggcgccctctcgcccgtgctgcgcacgtgcgtgcgctgacgacacacgccccgcgtgggtcccacccccggttgtctccttcctcccgcacggcctcttctctctcccgtgcaaaccctagttcgttcctccctcgaatccgcgcgatttaagcgttggattccaaaattaattagggggttttaatccccattccttcctcttcaattgcctctaattttctccttgaatagcgccttcaatcgccgggaacggacgcgccaaccccggccaccttccatggccgccggccggcttttccgccgccgttccccgctcctcccgtggccggctccttccctttgcctataaaatggaatccccatcctccgatctatcgttttagccccctcccgcgttctcccgtggcctcaccacctctccccgcctcctccctctctctcccgtgccgccggccgacctccagccgcccctgccgccgcctcagcacgccggccggccgtgccgtcgccttccccagcgtcgcagctgcctcctcttccccggcgccgcctccgattcatggggaaattgccggagacgcggccccgccggcttcaagtggctttgcctccactgtaccatctccagccatccctgccgcctcgcctgagcgccggccgacgtcgttgccacctctgtcggtgctgctgcgccatcctcttctccggcccggctgtggcgtcgcccgaagttcgccggaacgccgccgccgcgccaactgcctattcctcctcgtcggctcgtcgccccgctgcaccaccaccttcaccaacatcgcagcgttgtgttccacctccgcgcagccgctgctggctgccatcgtcatttcctcgtcaccgttcgtcctcgccgatcgacgtcccatcggtcgcccggctcgtcgtctcgctgcaccgccaccgtcgtcggcatcgcagcggcgtgttccacgtcatccttgcctctgtgcagctgctgccggctgccatcgtcatctcctcgccagccccggtcgtcatcgtcgtctcgttgttcccggtcgtcgtggcgttcgtccctccgtcaagccgttctcatccgtcgtccgcgtccgtcaagtgtgccgctgcaaccccatcgtcgtctttgtcctcgcctccgcgtcatcaagctctgcgccagccacgtcttgccttcgtccaaggatcgccgccgaagtcgccccctcgccgttcgtctccgccattcccgtccatctccgccgcgcccgttcgccgtcgtcgttcccacgcctcgtcgcttggtggtaagggtccgtcctctcgctgccccgtctagtcctttcagtgtcacccgtgcccgttgtgcggctgtcgaccccggtacccgtgtactggtgtcggtagttgttcgcttgtgcgtgtggtgaccgtgttagtgtgcacgctcggtagccacgtggtttccacgtgtgcagcccgcgtggtgtctagtggagtccgtttgtcggccactcgcctcggttggcacacggggtccgcttccatcgacccgtggaccgtctctgtgtactcggtctaccgtggtcccttaggttgacatgtgggatccacatgtcaacggcgcagccttcctgtctttttgtcacgaccggaattgacccaacgggcgttccttacgtgcgtgtattattccttgtcccaggaggcaaggtacaccaaaagttgatacatttcagagtttatcaagcggaagcgtaaatagttaatttattacataggcagcgaaggcccagcacacacaaagacaaacgagaaacaacggaagactagggcgacgaccacaggcgcttgacggcaggcacgagctagacaccaaagccttcatcttccagggactcctcttctgggtttggaaaaattgagcaagactgagtacaaccaccgtactcaacaagacacacccacaagtgcaggataaatgtaaaggagtagaagggggttatgatataaagggttagggtttgcagtaaacagcattaaaagacacttagttgctcaaagctattttgtaaacacgtttctagagctatacaatattattaatcaaggcggtgaacccacacgagcctgccttaacccaaggcctctgatgattcagaccgaactggtaacccgaccctgggtaccagctcgtcccaagccaagccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtagccacgtgccacataccaccacggtatacggacggaagacgtgacatagtttccaacccatcctagccatagacaagagtaccgacccaaccccacctacggccggaacccccgggacaggtaggcaggactgagcccctagcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaatagaggcccgaagaccggtccatatatggccgaggtgctactatcaaaaccatgcaccccgagcccagcctaaaaccattttggggattttgaatagagggggcggtgtgaatccaattccacaataatcaaaccattccatagtgtccaggtgatgagaaaatcccacagtctagagttgtaaaaccacctaatgttgcctaattaaccagcgaagcatctacctaaaatcatactagtggtaccatgagtagagtgtccactagttggggttttgtttattctagggtgaacaaggaaataataacaataacaataataaggtcataacaaaggtaaataggcatggctagataaaacagtgataacgcgggaatttaaatgaagcgataatgcaataatttaaatcaaaataattttataaactgggattcaatatgttcaaggatgatgtgacttgccttgctcgctttcccaaacgtcggcttcaacctccacgaagagcggatattccgaagctgcagcgtctacacgaccaacggaaaagaaaatgcttttactctaataaactccacataacaagctgaaacaaaaaacaaaaatgggttcttgacttcttaaggaaaaattagagacttgaacggtccaattccgagttccaatggccaagttatggccatttgaagtttatatgctctttaaatgaatatttgcgaatttcttcatttaaattttaaataaaaaaaggtttattgcgtcagccgaggggaggggcgcgcggaccgggtccacgggagtggggcccacgcggcagccccacggtcgacgatggaccgggcgcacccgggctcacaccggccggcgccgtgggtcccacgcgtcagccgcacccgagggcgtgggcggctgacgtccgggccccacgcggcagccgctcggtgcgcccgaagacggccacgccggcgcagcggcgggaggcggcgcgtgtcacatcctgatttttgtttcaggatttataaattatttaataaattattattagaatttatattaaatgttcattaatttacaagtgaagttaaatgtgggaaataaaatttcctaaatataaagcatggttggatttaatttttattaaattctccatggttaattatactctctggaatattctcggatttttcggagctcaattcctaatttttaatcatacaaagagcatttcagtaattacccacatattaaattaatcattaaatggtctaattgtaatttttttaagtactttgagtgtccaagtattttcaggatttttcttgaaattatttgagcattggaagtatttttaataattcaaagatcatttaagtgattattttaattgggaaagtaataaaatcctcctcctcagcttgggccattttcggcccattccttcctttccttcctctctcttccgccggcccaacctgagccgcctcctctcctctcagcccagccggaaaagtctacttgtcctccctgcgctactgttcatcttccaactcaggcagagcccgagccagccgtgccgtgcacagtgccgccgcctcttccttccaaatctcgcctccccgttgctccttttttccaattttgttgaggggaaatattcctcttatcctcctctatctttaccccaaaaatcggagctaatcgttgagtatcttatccgaatcgaactcgttttcgagtttatctccaaaaccgagtttttgattttccggatcgatttcttgcgggaggagtccgatctcttcaatccaaggctataaataggaccccctagtcctcctctttcgtttgccccctctcccgtgatctcccgtgcctcgtagcgccgccgccacgtgctccaccccgccgtcgtcgccggccgagctccatccgcgtcgtgccgccgcctccgtcgtcgccgcgggtcgccgtcaccgccgtaaggtgcgcgggagggtggagaagcccggccgcctgacccccgaagccgctgatcaccggagccccgtcgccgccgtcgaccgaagccgcgccgccgctagacctagtcgccggccgtcttcgttcgtcgtttggttcgagggtgagtaccgttgggttcgtctcgtcgtcctctacgtgtacatgtcctccaaagtcgcagccgaccatccaatctccggcgaggtcgccatcttggtccggccattgatgaggtcatcatgacgtcatcatcgtttttcttttttctgtttttctaatagattaaatcttcggaaattcataactaaatcatcgtaactcggttttgagtggttcaagttgctaaattcatctaaaatcatctacatgtttgtttactttatatgtactgtttatttggtttttattagtctttttcttcgttttgcgtgttagcttgtcgtttccgtcgttgcgaaggttcgtgattgcgccggaagtattcaagaagattaattgaagaccgattattgcaaggcaagtcacacagatcctaaacacaatcctttgagcatgttgatcctatatttaaattctctatttatttcaactgtgtatttattttcgaatgtcaccgggtggtgtgaacttattcctttgttatggccaatttgcattgattactttattccttgataccttgggttattataacttgactagttgggctttatatattggttcagctagatattagttatgattgcttagccatgcttagaaacattagcacactattgggataacttatgactcactattatttaaggatggcttaatgatagttcacgatggttaatcgtgattggttaattaattacttgccaactaaaacttgatagtggtgggttgtgagcacatggttttgagagtcgtgctcatgacaattaaggaccggttcgcgagctactattgtgaaacattaatcgtgccaaccacaagccagcgtgggcaacggctttacctttcgtatagcatggttcattgcagagcacaagactgagaagtggcggagataagcccacgggggtcgctggggagtccatgcctctggttattgagggggtgattatgatccaggaaaggtgcgctgtagtggattgtgttgtgcaaggggtattgtcacagcccctttccgaggtaccgtggtggtactgaggcacatggtgacatgatgtggggctgtgtcttgtgggtacagtggtacacctctggccagagtaaaactattcgaatagccgtgcccgcggttatgggcgggttgagcaatgtttttcgtgattagtctcacacctctcacaataattatggatgttatacctggtaataatttgcttagctcctggtttagagttagatctgtacagccgggtatggttgttcaggatggttgggcctgtgcagcatgggtgtgctgttcagtgttgattaaaatttttaattaattactctactgttttactactcttaactctttgctaaatgctgcttttgcaaatgagcctatattatgccatcctttggtatccttgtgcacttgcatatttgctgtgtggcttgttgagtatgtcatatgctcaccttgcaataatcaatcaacctcagttgaagaaaaaggatccagaaggagaagacgtttggcttataccccagttgagctgcctgtgggagtggagccggagcttcgctagaccgtaattccgctgcagttttcttttcttttgtaagtatgtaacgctattattgatgattatgtatattaaattgtcagtttgtgtacctcggctgattcctggatgagggttctatgcacaaattagttcggaaattactagtgaatttctgggcgtgccctaggcacggcggagcggcggccgagagaggggagggaaagggggaaacgaagcggcggtccacggctcaccccgggtcgacggcgacgacggaaacggcgaccggagcggaggaaggtggcggcgtggctcgggtggacggggtcgacggtgctccggcggtcggcgaccgaaacggagaggtggacgaggtcggcgaggatgcggcgaagccgaaggaggcggcgccgaggtgggaggtggtccggggcgacgacagcggcggaccggagctcggcggcgacggcggagagagagcgacggcgcgagctcgattccggcggggagagagggcggtgagtggcggaaacagtggtggggagctcggggagggtttatatagggttgggagtaagagagggcggccgaggaggggggaatgggcgcgggagacccggccgccattaatggcgccggcgaggttaggggagagg

SEQ ID NO: 29375 - DNA, 4756 bp, Oryza sativa
atggcccgcggggagaggagagggagggggaaggagatgggccgagccggcctaagagggagagggagggaaaagggactttttagagcttttctttttataaaaccattttaactttgtttatttcttaataattattatttgtgctctgaaaattccactaaaatttatttacgcattttagacttttaggaaatatacaaaaatcctccaagccttatttgacttttaactttgcacattttaattgttggaggctttcacacggattttaattattctaggcataatttagaggatgtattttagagtcgttttgggacgtgacacttttccaggctagcgcttacacatgttttatagttgcaaaacctaactataataatccgcaaatctccatataacagcattaaacttcggatgaccatgtcttggtcatacgagctctgaatcgagccgttcaagtctcttaatgtttgttataacttaaagaaccatgtgctttgttttaatgtgttgttattgcttctttataggcttgtagttttgcttgtgtgcttcgcgtagctttcgtcgttccggaggttcccgaagtgtggttcatggtcgtcgccgaaggttcggaaggccgttctctctgagcaaggcaagtcacatcatccttgagcatattgaatcccagtttataaaattattttgatttaaattaatgcattatcgctttatttgaattcccgcgttaccactgttttatttagcattacctattaatccttgttatagccttattattgcaattgttattatcaccttgcttaccctaggcaaataaaaccccaactagtgggtactcgattaatggttccactagtatgaatttaggtacatgcttcgctgattaattaggcaacattaggtggttttataacttagactttgggaatactcatatcacgtggacactatggaatggttggcttatggtggaattggacatacccctctcttcctctttcaaaacccctaaaacctgttttccggtggggtttgggtgcatgccagttgtgggaagtagcaccccggccaatataaggattaagctcgggcctctgttgcaaagcactaccgtactaaccacatgtctaatgggtaaggcttaactcggtgctcagtctagtcctgaacaaaaggacacggatagagatggatgaagtcgttgcgacgatggatatctctgaggcaaatgaaggctacgcgagctgcggctcggtaatcgagatgtctaggcaaatgaaggctacacgggtcggtgcccattagtcgagatgccatggcactggactagtacacgggtggtctcacccctatgcgtgtggcgcacccagtctagatcctgttgctaggggctcaatcctggcctgcctgtcccgggataccgaccgtaggcagggttgggtcggtgcttttgttcacggctaggatgggtaaaagggttatgtcacgttttttatgatgggttccaattgcaatggaatgcagagtaaaggcgtgtcttgtgggtaaagatgtacacctctgatcagagtataatctattcgaatagccgtgccctcggatatgggcaagcctagcaatgtacccaagttagtggtttaattcttaaaatttgcttaacaactaaaatatggaatggttggcctgggttggcttgggacgagctgggacccaggtcgggttgccagttcggtctgaatcatcgtaggccttgggttaaggcaggttcgtgtgggtccacagccttgattaataatattgtgtagctctaggatcgtgtttacaaaatagctttgggcaactaaatgacttttaaatgctgtttactacaaaacttaacccctatattattaccccttgtacccccttgcattaatcatgcatctgccggtgtggcttgctgagtactgtggttgtactcattcgtgctctatctttccccccttcagtaagaaaagcttgaagaagaagtcctaggtggagtcctggcttatacctcagttgagcgcctgtgaagatgaagccgtaggcccactagtccgctgctgtttatttttgattgtcaggccttaagtgcctttgtaataatgtaaatattatcgatataataaagatgtgccttttgtatcatgtttgtgtggtgtaccccggcttttcctgggacggggattaatacactagcgttcgggaaaagttaattttcccggtcgcgacagccgccagcccattttcctctccctccccgctgggccggctgaaggccacggcccagctggccgcccgagcccccctcctctctcccggggtcgccgataggtagggcccaccagtcgggtcctcccccaaccaccaaccactgccgcgcatcccgcaaccgccgccgccccctcgctcctgtgcctcccgggccacgttgcccacgtcgtcgcccgtgccagcgccgaaacggccgggattcaattttgaatcccaccggccacgcccactcaccccctccccactactccggtgaaatcaggccgctcccggccacgtccgagccccctttgccctatttaagcatccccgctctcccctctctctttttctgcatttcgccgagctctctcgtgccctctatcgccctagcgccgtcaccctcctctccgccgccgctgccaccgctccggtagccgctagccgccgctagctgccgcgccgagccgcaccgtcgccgtcgtcgggttcgcaaacccgagggccacgccgtcctcctctccgccaccgctttccgccacgggaaccccgttcgcaccacgcgccggtgagctccgccttcggccggcgtcctcaccctcttccatcttcctctctctctctctaacccctttcttcgtgttcgctaggtggttccggagctcgtcccgctgccgtcatcgccctcagtcgctcgccgtcgcctatcgccgtcggtgaaccacctcctcccctttctccctctctcccgcaccgcttggccgccacgccgccgcctagccgcttagccgccgctgtcgctgtccacgtcgccgcgtcgccaccgcccaccgccaccggccggtcgccgccttgcaccgccgctgcgtagagccgtgctgccgtgcgccatggccgccgggccggcttgagccacccgtgcgcgccggccacgcgctcccaccgccgtccgatctacccaaccccgccgcacgcgtggctgccacatggccgccacgtgtgcgccgcgtcggcgccacgtgtgcaccacgtggtgcgccgctccttccccggtccgtggacccggtccaccgcggacccccccgagtcactgccatgtggggcccgcatgttggcgctgccctctctctccccgggattttaattattgcgcaataaatcaattaaggatttttctgtttatagtaaaaacacagtgaatcttctaaaattcaattctaattcatccgagctccgtttgagcctattcaagtctcagtaaatcaagaaaaatgcattgaatccattaaaaatggttttgttctctgtttcagtagtcttatagcctgtttgtattatttgctttgtatgtcgcttagattccggctctcccgacgctccgttgtactttgaaatagtcaccgaggttcctccagcagcagagcaaggcaagtcatgcttgtcacttgaacatgttgatcctatattgcaaatgctctaccgttttcccttaaatactgcattgttttataatgatactatgggatgtttacctactgttacagccatgctacttttgtaccatgctcctttgttagcttgggatataacatgactagagattggactagggattgcttagccatgcttagttcaactagcacaccgtgggggaaatcacattaatgcatagtcttcacgttctagtgttggttttggattaaagccaccgtcctggtgttagtcaattaaaatataccatatggtgggctgtgggtgcatggttttgatggtcgcgcccatggcacttaaggaccggttcgcgggaaaccctagaagaattcctcgtacttaccacaagccagcatgggcaacggctgggcttgtagtgtagctttcctctagttgacgcatccaggcaagggtgggcgtgatggagcggggcgggccctacgacggcctctgtcgcttctggattcacctaggacgagaggggactgcccgttgcccgctggggatgggggtgaaacctgaggtgtggtgtgtttggctagagggggttatgtgaagggtcctgtcacggcctctttccggtatgttgtggtggcatgtcggcgcacggaaacgtgtcgtgggactgtgtcttgtgggtatagttgtacacctctgatcagagtaaaactattcgaatagctgtgcccgcagttatgggcggtcaaccagattcaccgtgattagtctcaccctagtctagtctaatggaattgattagttcaggtggatggttgggcctgtcgcagcgtggtgtagcgttggacagtggatggttaatattgagtaattattacaactgttttacagctttcaactaccgtctttaaaatgctcgctttatgctaatgaagcgctcgagctattctttgattataccctacatcataccctctattccggtatgccttgctgagtacggtggttgtacacagtc

SEQ ID NO: 29376 - DNA, 746 bp, Oryza sativa
gtggcagccacgcgggcggcggggttggacggccccgatctaccgggtagatcggacggcggcgggagcacgtggccggcacgcacgggcggctcaagccggcccggcggccaaggcgcacggcgacgcaaggcggcaaccggcggcgaccggccggcggcggagggcggcggcgtcgcggcgacgcggacagcgacatcggcggcgtcgcggctaggcggcggcgcggcggctaagcggcgtgggaggggtggaaggggaagaggtgtctcaccgacggcgattggcgacggcaagtgacggagggcgatgacggcagcgggacgagctctggaaccacctagcgaacacgaagaaaggggttagagagagagaggaagatggaagagggcgaggacgccggccgaaggtggcggccatggcggagctcaccggcgcgcggtgcgaacggggttcccgcggcgtaaagcggcggcggagaggaggacggcatggccctcgggcttgcaaacccgacggcggcgacggtgcggcggctagcggctaccggagcggcggcggcggatatgagggcgacagcgctagggcgatagagggcacgggagagctcggcgaaatggagaaaaagagagaggggagagcggggatgcttaaataggggagagggggctcggacgtggccgggagcggcccgatttcaccggagtagtggggagggggtgatagggcgtggccggcgggattca

SEQ ID NO: 29377 - DNA, 2377 bp, Oryza sativa
tggttaaaattatttctagagctctgaaaatttcactaaaaatcctgttaatgaatttcgacatgtagaactcaagaaaaattccacatgtcaattccgattattatttgcattaatttattagggttttctctcttgcttttacaccgatattttctctaggtgatttataaatctaatttaggcttggggaaagaacttcaaggtgtgacaggcacccccttgtcgaaacctcccaagcaattggtgcaagctcgctctagattcatatcctctcgtggtggcgctctagcttctgcaagttagccacgtcggagggcctagggggagagcggttccattcttctctctcaccctctttccctcaatcccaaagatttggatagagtgggtattgtattggttgtaagggtcgggttttgggcgatctcggttgcattccgttgttggcctagtggcggtcggtcacgcttagcggcggctgacccggtgctagccttcccctaggtggtggtatacttttttcattttcctggttacgaccaatagggttgtaatcttgtaattttttcctgctttataaacaaaacttcgcactatcgggtgtgattcgttcaaaaaaaataattataaattttgaaatcatttaatcaaaaaaaacatataattgagaaaccaaaccgaggacaactctatattcattaattgtaaattttagaactattaaaccatgaaaactataattcaaaatttgaactgagtacaacttaatatttattaattacaaatttaggatatattatatcatgaaacatataatccagactacaaaacagtaaaaatcaatatttattaattacgattcaggaattattgtatcattaaaggatataattcagactacaaaaccgagtacaactcgacacttataatttccaaatttctaaactaaactatgtagtataacatactaaattgagagtacaacatgcagcatgagtccaaagtagtaatatttagtaattttgattttgaaaaaaaaaataatttaatgcgatagaaagtaatggaagaaatattaggacagattatataaattaattactaattattttttaagtataaataaaataaaatcgttcggctattaaacctttaatagagttacgtattgaacaaatatttgaaatttttaatatttataatatcagtaataataactactcgtatgaaaggatccctttaggcacacacgtacctcctctcaattactttttctccttttttcttcctatggaaatatttgcaacaatagcttttaaataaccataacttctaaattatatattatttgtaacaatatattttaaatcatcattttttttaccttttaaatcatgcaaatggacatcaaaacttttgaaaaaagtgataactagattgtatcgattattatgtatcactttacaaacattcgtagctaaactagatataagatgtcaagaatgtaaagcttgcactagtattctttatgattaattagcagtttgacaccagtttacttcctttaaatttaaaaaagaaactgtcttggttcatattttaactcttcaagtcatttaaagccagctccagtgatcttttgactctcaaagaaatcatttgagatataaatcaaaagataaacttttttttaaaaaataaaccaaaccaacacctagaaaatgcactaagtgaagcacaaagaagcaaccaataccctgacagtgataaatttgccatgtaaagctcgatgatgatttatggcttagccacatcatggtgaagcactgcgtggcagcaggagcacaaccatggatgtacattgtggccaaagctaagggtgctcatcactagcaacttgtcgaacaaggaaaagagcaatatgatcgactaaaattagctttaatattagaagctataagatgatataagaggatacgggagatgacatatatatatatatatgtatatatatatatgtatatctatgtatatatatgtatatctatgtatatatatatgtatatatctatgtatatatatatatatatatatatgtatatatatatatatatatagtgccagggtactatatataggggtttgtttttcggtggttgacaacggagtccgtcagaggattgtatttggcagaggcagcagcatagtttaattgtgtgagagagaaagtgttttattgactttggttatgagagatgagtcctcctccactgaggaagatgtatggtgatttggattatatcactggtgcgagaaaccatctttgatcggtcgacccaaatctacaatagtcccggttccatttaaaaccggg

SEQ ID NO: 29378 - DNA, 12688 bp, Oryza sativa
gaccatttttactgctgtattccctctttagtcccggttggtaactccaaccgggactaaagatagcgatctttaatcccggattcgtagtcccggttggacaaccgagactaaagggggttatgaaccgggactaaaaagcacttctccaccagtgtatatcaaacaacaaaactatgaaaactcaaatatttatattgactacacgtgatacttgattctatgtttggtgaatgaaggaatacaattcgtactaaaccaatatattatataatagttcataagatagaatatactctcctagaattcacgcaacaaaagaagactaattcaaatgacggaaatcaacttttgtttatggcactctagcatttataagtgctctgcacatagttattatattatacagttgcaatattattacatattaaattcatcttcaaataaaataagaaagatgatgaaaaaaagaaatttaaatccaagatatgctaactagctagccacacagttatgtggatctttatttacttacgtactttatatgtaaaaggaagtccatacaacgactttgaattagatggggaaaaaaacaaattgtgggaatattttagagagagaaaaaaaggcaattttgattttgtatatgtggcgtgggcgtgaaaaagacagtgcaaactaatatgaatggttttagagaatagtgattaaaagtgagaacatctaaacattcatgtagaacattcatgtagaaaataacagcattaattacatctgtacttcaatgtaaatttgttagaccaactttttaagtcttaacagtaagaagaacgtccaaccacgtaattgtgcgggctatctttctagtttgtcatgttgtcatgtaatggaacatattttttttattagtccataaggatacttcaatagtatgtgtttacgtattcttttttataaatactaatttataattaagtaacgtgtgaatttgggaaggagtatagtgacagcgtgagtcaaacttactgtatatttattagtccttgaatcgatataatgtcaacgatcaaatatggagtacacggtgagagcgtataggccgggctgctaacataccttttagggtacggcataggcggtacataggccgtgttcagttcctccttcaatttttttttttacatatataaatgtacatttgaagtattaaacatatactaataacaaaacaaattatatatttcgtctgtaaaccacgagataaatttattaagcctaattaattcgtcattagcaaatgtttatcgtagcaccacgttgttaaatcatggcataattaggctcaaaagatccgtctcgcaatttacatgcaaactgtgcaattaatttttttatccatatttaatgccccatgcatttgatgtgacggaatttttggaagtttgaaggtaactaaacacaaccatattcgtccaagtgattgggatagctgattgacatgtttctagaaatacattgtcacataccaggggtgtgtttagatcccaaaattttttagccaaaaatgtcacatcaaatgttttgacacatgcatagagcattaaatgtgaacgaaaaaaacaattgcacagtttgcatgtaaattgagagacgaaacttttgagcctaattgcgccatgatttgacaatgtgatgctatagtaaacatttgctaatggcggattaagtaggcttaatgaattcgtctcgtagtttacaggcggaatctataatttgttttgttattagtctacgtttaatacttcaaatgtgtatccgtatacttaaaaataattttggccaaagaacaaaacacggccttggagtagaaccatgttcaaacatcctaatgagagatgaaattatcatgatatggataccacatacttaataatagtaggttactaagctcggcagggcccaccacataccatgtcttacacggaaacaaacctcgtatatagaaggagttccgaataaggaaggacaagaagagttctacatggaaacgacaaggattacttggattatatccatattgatctccctaattctacttggacaagggggcatctatgggtataaatacaagcctccctaggaagagagggaacaagccacaagacgcaacatatacacaagccaacacacatcgcccgatctcgacatcagagattagactaaacatactccatccggtacctacggaggccggcaagagggatctagctctatctctgatctcgacaagttcacgctagaggaggaagactaccctgtcgtcgactactagttggttatccatgccgccaagtccacgacaactagataggttatcccaattattgtacttgtgtgatcaagatgaataaagagcaacaccggcttcggccaacaggatgtagggctattacctgtcagataaggggcccgaacctatataaaaatctctgtctccatctcttttacctcaatctcgcatataccctggtaccaacgatccccataccatccaaataccgtagtcgtgatctcaaacgtcgacaatggcaccagtggcggacgcaggattaaaataaagatgggacgaagatgctcgtctcaataagaacaactaaacgcaaaaaataccatatttatgttgtaatcatataaacatatagtataatcaataaattaaggcaaacaaaaaacaaaaatgatattaaaataaagtaataatttttgcgccatacataattcatcatacataaaaagatactagtaaacatatcaatttgcaaatatgagtcaattcataagccatggttgatagatatcttttaaaaaataaatatatgagaagatatcgcatgcccagaataagatgattattattttgcttagaagggagagagagagagaaaaacattaggcacctaactatagtaggggacgggggtaagcagtgtcaaggaattgactcaggaaagcatcacatacgcatgattaaaattacacttgggcagcttatttatgggacagttgtgaatcggatgtggtggtagctggcccaagaaggatatggagggttggggcagagcgggccatatgatgaggatataactacctcggatataaccatgactaccttatgtattagtcaaccaaatgtgcatatgttctacattagatttacttgttatatatttgaacaaatgttactacacaatgatcaacttcaaacggacctaggcgctgatctagaaggaattttggggcccatgagtacttgttggaaagcttatggagtctactttcggatggttttggtcccatgtcaaaactcctaacgagctgccgggaatctgcaaaacaagccacgtacctcatccagtccgaatctaattttgagttttgggctctgtaattgtgtcgtgcgttagcccaatggggtgtgtgccctacgaaaaccctaggacgtccctaatcacatttattcagtagccgtcatcgtttaaagtcgggtttatcttagattattctgttgagaacagtttcgccgctagatcggtttgtggaaccccaaattcgagtgctaaatcaatctatcttgttcttgcttgtgttcttcgattcgcatgcagggattagccttctcggcgaggtcaactagatttcggcacggttgataaccagaggagacgtggtgctgcgattgcggggctcagtagcgtgttcattcagaagccggatcgagttgtgtcgcgactctgcccaaatcgactgtttatcagtacctattggaagatcgggacctaacatccctcatcagttggtatcagagcgtggatgcccgttaggtaatttatctttccataaccagaaaattgccacacaaaaatatttatactttacctagataatttgagccgttgcattgttctattagattttgctttgttgaattctagattgcatcgttatgtcaagtgttagtttagttttacatttcatttttagttttgagtattgcatctgttcatcacttaggtctagggttcatcactcaagtctgtgagttgtacgtcagttttgggtctagtttttcatctcgtcagttgttgccaggaccttgaaaaattgaatcgtctcgtcgtcgggtttccgtttttgtgatttggagaaatttttatcaaacggttttgaagatgcttgcgtgtactgtgcgcgtgaggagagactccggagttgccgtactgtgcgcatgaggggagtactgtgtgcgcgtgaggagagactccggattagatcagatctatccatgactgtctgtattttcctctttatagaattgttaagtagtggatttgagatatttttataaaaacggaacctacatgatatgagcaatctatttttgaggtgatccaattttagttttgcactttgcatttgagtccctgtaatattcatatttatatttgagtccatgttcgaggtcagtggttagttcttgttaaaaaaatatagtacaaaaactaaagaaagaaagaaaaggcacaaaggtgcaaagaaaaaaaaagaaaaagccgcacctaaaaaaaaggcagaaaggtgcttgaaaaaaggcgcaccaaaaaagaaaaaaaagatgagaaaatttagtgattcttttgagttgtatccagagtgcagagttgtggtttgagctgcttctagtccttagtattgtcgggtgcttgcttgagctattgttgagtttaggttaggccagcacattgactagaactttgaactattattcaactttgcattttcggattagcacaattgcgttcctttgctactatatattacacctcccaagctacacatatatacttctggttagcaccgctttgatccttgcaatcgccatatcacgtccttcaaggtgtcacgaaccagccaccggttgtaccgtccttagcattactggtaagacacttatacgagcttgatatggtgctccatttggctgagttgttgtgaggcaccactacaccgcgtagcagattattagggataaccttcactctttgctgttgtttttgtgtttgcaataacaggtatgagtggcgctcaaaatcagcgataccaacaaggtgcacgtgatgaaagtactttggtgcaacaagtgctaagttctcaaatggagaaagcggagcaatggtagtaccacgaattatttgaaacaaagtttgtggttaaggatagagcctgtcgtactataatcgataatgagagttgcaataactttgtgagctcagatttggttgagaaacttgagttgcctacacaaccgcatcctcatccatattacatcaaatggttaaactcttggggtaagttcaaggtaaatagaattgtgagactgaacttttcgattggaaattaccatgatactgccaattttgatcttgtccctatgaaagcatgttctttgttgtttggtcaaccatgggtatatgataataatggttcgcataattttgttgctaatacatacacatttagacataatgggcggaaaatgaaattggtacccatgagttttactgaaattttcgaagataatcttgaaaggatgaagaatggaatcgaggaaattttcaaaaatagtgctgaaaggacgaaaaatagaatcgatgagattttcagagataccaggaaagatactaatattgtgatgccttcaactaagtctgagttattacaaaatgaatgtattgttctgcctattgctttggatactaatattttgcacgcatctgagaacaaccaaggtaatgtggaagagaagaaagatgaagaggaagatgaggatgaagagtttaattttctatcttctttaaatacttggggctatattcaatttgatgatctttgttcactcaactgtttagagaaaaattatttgctagatttgaattgccatgcccttctaatgtgatttttcatgttattggcaattatgatagtaaaggagaatataatgtgcatcgagtatatatttgttcaaatttgaccatacctccttttcatgatgaaatgtattgtctagaggaccacatgcgtataagtcattctctatctagttcctctagttgtttaaatgagttacatgttggcttgcaagaaggggagtgttgtgattttgcgactacaaagatttcaggatccaaccataaagccatcaagaaatgttcctgatcggatgttgtgatagataaagataagttcgatacgctccatgacaaggtgaaacagaggacggtttctaatcaagaaggggaggatgatgaggacacaattagctcggatataaccatgactaccttatgtattagtcaaccaaatgtgcatatgttctatattagatttacttgttatatatttgaataaacgttactacacaatgagttttgtgtgttttcatttgcacaattacttgcttgggcaaaagaaaagaaaccgaacgtaaggaatgtatgtatgattaaaggggttgattggggaccaaacaaagaccttctccaagtctacttccatctcaccacgtcacttttgatccatagaagataagagataatgttctacatgttttggattcggattcgggcctcctgacagcatcaatttcaaacggacctagccgttgatctagaaggaatttcgaggcctatgagtacttgttggaaaccttactcctaccgagctaccgggaatctgcaaaacaagccacgcactgtcacgtcccaaaacgaccctaaaatatatcctctaaattatgcctagaataattaaaatccgtgtgaaagcctccaacaattaaaatgtgcaaagttaaaagtcaaataaggcttggaggatttttgtatatttcctaaaagtctaaaatgcgtaaataaattttagtggaattttcagagcacaaataataattattaagaaataaacaaagttaaaatggtgtaccttgcctcctgggacaaggaataatacacgcacgtaaggaacgcccgttgggtcaattccggtcgtgacacgcacctcatccagtccgaatctgattttgagttttgggccttgtaattgtgtcgtgggcttagcccaagggggtgtgcgccctacgacaaccctaggatgtccctaatcacatttattcagtagtcgtcatcgtttagagttgggttttgcttagattattctgttgagaacagtttcaccgctagatcggtttgtggaaccccaaattcgagtgcttaatcatacctatgcaatttggttgcaatctatcttgttcttgcttgtgttcttcaattcgcatgtagggattagccttctcggcgaggtcaaccgggtttcggcacggttgataaccaaaggagacgtggtgctgcgattgcggggctcagtagtgtgttcgttcagtagccggatcgagttgtgtcgcgactccgtccaaatcaactgtttatcagttcctatcggaagatcgggacctaacatccctcatcagttggtatcagagcgcggttgcccgttaggtaatttatctttccataaccagaaaattgccatacaaaaatattgcatcatttacctagccaatttgagccattgcattgttctatttgattttgctttgttgaattttagattgcatcgtcgtgtcgagtgctggtttagttttagatttaatttttagttttgagtttggcatctgttcatcacttaggtctaagtccgtgtgagttgtccgtcagtttgggtcctgttttgcatctcgtcggttgttgccgggacctttaaaaaattgaatcgtcacgtagtcgggttttcgtttttatacttttgagaagttctgtccaccaattttgggagtgctttgactagggtttgggagctaccatcagagtcgtgtttctgtgcgcagaggaagaagatacatggtgggtctctgttggaagttgtgtaaatagcttggtttcggctaggagtcaggagtttggtagtttttttccatcatacttggactccctcttctagtctgcctgtgggtcgagtccaccgtggtggtttaggccgagcgcccagccaccaagctagtccgactcctctcctgcctgccgtgtgcacctccagaatcagtccattggatattttggcaaaaaaagaggaaaatttcctttagcagatttgaaatatttttgcaaaaacggaatctacgtgacatgagcattccattttttaggtgatctaattttagtttttcactttacgtttgagtccctgtaatattcatatttatatttgagtccctgttcgaggtcagtggttagtttctgttgaaaaaacacataataaaaaaagaaaaggcagaaaggtgcaaagaaaaagaaagaaaaagctgcacccaaaaaaaagaaaaaaaaggcagaaaggtgcttaaaaataagccgcacaaagaaaaaagaaagagaaaaaaagaaaaatcattcatcctttgagtatgttttgagagtgccgagttgtgcattgattcgtatctagtccttagtgtggtcgggtacttgcttgagctagagttgagtataggctaggccagcacattgactagtacgttgaactattattcaactttgcattttctaattagcacaattgcgttcatttgctactatatattgtgcctcccaaactccacatatatacttctggtcagcaccactttgatcattgcaatcgccacatcacgtccttaaaggtgtcacgaaccagccaccggttgtatcgtccggttgtatcatccttagcattgctggtaagacacttgtaagagcttggtaaagtgctccatttggctgagttgttgaggggcaccactacactgcgtagcagattattagggataaccttgattgtttgttgttgtttttgtgtttgcaatgaccggtatgagcggcgctcaaaatcaatgataccaacaaggtgcacgtgatgacaatactttggtgaaacaagtgctaagttctcaaatggagaaagcggagcaatggcagtaccatgaattatttgaaacaaagtttgtggttaaggatagagcctgtcgtactataatcgatagtgagagttgcaataactttgtgagttcagatttcgttgagaaacttgagttgcctacacaaccgcatcctcatccatattatatcaaatggttaaactcttgtggtaagttcaaggtaaatagaattgtgagagtgaacttttcgattggaaattaccatgatactgccaattttgatcttgtccctatgcaagcatgttctttgttgtttggtcaaccatgggtatatgataataatggttcgcataattttgttgctaatacgtacacatttagacataatggtcggaaaatgaaatggtacccatgagttttactgaaattttcgaagataatcttgaaaggataaagaatggaatcgaggaaattttcaaaaatagtgttgaaaggacgaaaaatataatcgatgagattttcagagataccaggaaagatactattgtgatgcctattgttattacaaaacgaacgtaatgttgtgcctattgctttggatactaatatttttcaggcatctgagaataaccaaggtaatgaggaagagaagaaagacgaagaggaaaaaaacctatctatagctccatgcattcttgaggaatgttcaattgaccaagcgcctacaatttcttaagctaagaaaaaagataaagataatggtgctacaactgctcaaggtatgcatagttataatgtgccaactatgtccactacttgtgctatattagagcaacccatagaggaaacaattgttgaaataccttttttacaaaacaatttttttgatgtttcttgtgataaagaagtgttgtgcaatgtttcacttttatccatgccacaactagtgaatgaacatgttagttctacagtagagccaccatgtgttgagtttaaacatgttattcacattgctagcgagaatgaagagcttaaattgctatcttctttgaatacttggggttatattcaatttgatgatctttgtccactcaactgtttagagaagaaactatttgctagattggaattgccatgcccttctgatgtgatttttcatattattggcaattatgatagtaaaggagaatataatgtgcatcgagtatatatttgttcgaatttgactatacctccttttcatgatgaaatgtattgtctagaggaccgcattcatataagtaattatcaatctatttcctctagttgtttaaatgagatataggttggtttgtaagaagaggagcgttatggtttttcgactacaaagattctaggatccaatcatatggtcaacaagaaatgttcagcataggatgttgtgatagacaaagataagtacaatacgctccatgacaaggtgaaactgaggacggtttccaattaagaaggggaggatgatgaggacacaactaggtcggatataaccatgactaccttatgtattaatcaactaaaggtgcatatgttctatgttaggtttatgttaggtttacttgttatatatttgaacaaacgttgctacacaatgagtttcgtgtgtttttatttgcagaggtagttgcttcggcgaaagaaaagagaccgagcataaggaatacatggatgattgaagaagttgattggggaccaaaccaagaccttctccaagtcttcttttatctcaccacttcacttttggtccatagaagacaagagataaagttctacacgttttggatttggattcgggcctcttgacagtatcaaattcaaatggatctagccgctgttctagaaggaatttcggggcccatgagtacttgttggaaagattatggagtctactttcagatggatttggtcccatgtcaaaattcctaccgagctgccgggaaactgcaaaacaagccatgtatctcatccagtccgaatcagatttgcgttttgggccttgtaattgtgtcgtgggcttagcccaagggggtgtgcgccctagggcaaccctaggacgtccttaatcatatttattcagaagccgtcatcatttagagtcgggttttgcttagattattctgtcgaaaacagtttcgccactagatcggtttgtagaccccaacacgtgagcttaatcattcatatgcaattttggttgttttctatctcattcttgtttgtgttcttcaattggcaaacagggattagccttcccggcgaggtcatccacgtttcgacatgggtgataaccagaggagatgtggtgctgcgattgcggggctcaagagcgtgcgcgttcaagaagccggatcgatttgtgtcgcaactccgcccaaatcgttgtttatcagaaccttttggaagatcggaaccctagtgcacatcaataacaatcaaggaaaaatcaatctgaactctagttattatcaagttaaataataatccaaaatagaatcaattgcctagttgctgatcttaaaatctaagtgaagaaccaagcaactcacacgcaacgatgatggcacttaatgcaaccaaaggagtataagccacgaagtaagcaagctcgtgttgcacaagtgatagagagacgctagctatgctcaaatgtaaattgggctacaatatttgcaccgaaataaccaaaggagcagcaagtaaaaaattttgattttttttaaccaaccgtagcacctttttttcttttttttctttctttctttctttcttcctttctttctttctttttttttcaattttctttttaaccacggttagccaaaaataaggtgtttatatactgctcaaaatatttagtaacaagtgcaaagcccaagagcaaacctatagctagtctcaaataggatcaatgtattaagttgtatgcactagccagttgtacataaaagcctaagctgatagggaaaggcgggccattcactttatacactccaacactccccctcacgcgagaacccctcaagtctcaagcgtggaatattggagtgggcaattcacttttatttaattgcacgccagccaggattcaaactcgagacctctgaccctgataccatattaagttgcatgaactagccagttgtgaaagtgcattaatccccctagtgggttttggtgattaactacaaatgtggttaagggactaatgagttcattgagttactttcaggtgtattagtccaaggtgtggaagatggatgccttgagaccccccaaaagtacaaaataaaagcggaacggaactcgggaagtgcatagaattgtttatttatcgcaatcgagttttcaggaaaaatcgtactattaagaggggttccaggtgatgctctgagatatgtcatgtgctcttagtgtgaaccaagtatcaagtttccctatgagtcattcttgccaatactccatctgtccaaaattgcaagtctggaacttcctgtcttccaggtccggaagttccggtcttgtgaaaaagattttcctaagtgtagtctggaaattcctgtcttctag

SEQ ID NO: 29379 - DNA, 2665 bp, Oryza sativa
ggaaaaaattgctcttgtctctttctgtgatgtttctgtggatgtttctgtgatctatcatctgcttagaatacctgtgcatcatcttgtgaagattggcttagtctcctgtttcgaaatttgaatttcatcctttgttacgttacccagaagttcctgtcctaaaacaccggaagttccgggcctggcagaccggaagttccggtgttccttaccaggaagttccgggtctatttgaattttaccgctgcgatttgttttcaagttttcagggacagcctattcacccctcctctaggcttcgtcagcacgttcaattagtattagagcaaggtactcttgattcaagcttcaccgcttggagtgatccacaatgtcgcatctagagggaaccgaagggttggatgacaagggagacgcttctagcaccaaggatactggacccaagggagctactattcactttgattacaacaaacttaatgttcctcctcacaactttgtctccgtgccttccgggcgtgctcctcaatttgatgggacacattacgccgcttggaagcacaagatgaagttgcatttaatctcgttgcatccaagtatttggaaagttgtttgtacaggtattgatgtaccccatgatgacatggagctcacctcggagcaagagcaactcatccactgcaatgctcaagcttccaatgcaattctctctgccttgagtctggaggagttcaacaaggttgatggacttgaggaggccaaggagatatgggatattttgcaattggctcatgagggatcacccgccgttcgtgaggccaagattgaattgttggaaggaaggcttggaagatttgtgatggatgacaagaagacacctcaagagatgtatgatagaatgatgatccttgtcaacaagatcaaaggacttgggagtaaggacatgacaaatcactttgtggtcaagagacttctccgtgcttttgatccaagaaatcccactcttgtatcaatgatacgggaaaagaaaaactttaagaggctcaccccaagtgatattcttggaagaattgtgtctcatgagatgcaagaagaggaagctcgtgaagtaaggcaaatggtgaagaatgccgccatgatcaaaaatcaagaagtggctttgaaggcaaaacaagaagaagagtcaagttgtgaagaaagtgaagatgaagagatggcttttattgtcaagagattcaagcactttcttcgcaagagtggctatggcaaagggaggaaggatgatgacaagggaaagaggcaatcaaagagagcttgcttcaattgtggcgaatatggccacttcattgccgattgtcctaagtcaaatgaagctaaggctaagggaggcaagaagaagccggagcgtgctcatgtgacagaggtaaacatggcggaggtgtggtactccagagatgaagaagatcccgaggtcaagcccaagcccaagctaaaagacaaggttgaaggagaaggtggtgatgctaccgtcgccttcaagtcatcctcttcaagcaagcagcgtctcttcaacaacttgagcgatgacgagacgactcctaccactactcatgtttcatggcccaaggccgcaaggagatgactcaaaagccctctcacacttctcttgatgttgattctagtgatgaggaaagtgataatgaattagatgatgtgcttaagagctttagcaaacccgctatgcaacatttggctaagttaatgagagctttggatagtaaagaacaatcactcgaaaggcaagaagaattgcttattcttgagaagaaaagaaaccttgccttagaggagagcttagctaaagaatgtgctaaaaatgaacaactagctaatgagcttaatttggctaatggttctctagctagccttagggatgtcaatgaaactcttcaagagaaatttgctaatttagacaaaagtcataaagatcttgacgttcaatttgacactctttggaatagcacttctcaaccaaatgtggtttctaattcttccaacccatctactagcaatggttgtgctaggtgctacaacattgatttgaactcttgtactactaatgttgatgctatgcaagctcttaagaaagagaatgagaggttgggcacattggtgaaatatggatgcataaagacgtaccattcaaaagatgccctttacaagaccatcaccgctcatcctaacaaggatggacacggactcgggttttcaggtggaagtcctgtgtctaagcgtgtgatggtaaatggaaaagaatgcttgatgtttgtgagagaaggtaaaactccacaagcaagtgaggagactcgtcccttcagtggtcaacacccggaagttccggacaaaatgatcggaagttcctgccctgtaagacaggaagttccggacattttgacaggaagttccgggcttctgataggccgaaggggctgaccagaagttccgggtataataccaggaagttccggccagagggtctttactatgattcatatgtaatttccaataattcagagggcaaggtggttgcttactttaacgggaattacaatgatgagtaccacacttgtgtgtgggtgcctaaggctttggtaactaacat

SEQ ID NO: 29380 - DNA, 25903 bp, Oryza sativa
tttggcatctcttctaaaaggacaacacattcttggtttatctaatgtttcttttgagaaggatcgtgtgtgtagtgcttgccaagtcgggaagcaagttgggagtccgcatcctatcaaaaacatcatgactacaacaagaccactcgagcttcttcatatggacttatttgggcccgtggcctacataatcattggaggtaacaagtatggttttgtcattgttaatgatttttctcgcttcacttgggtgtactttctccatgacaaaagcaaagctcaagatgtcttcaagcgtttcgcaaagcaagcccaaaacctctatgatctcactatcaagagggtgcaaagcgacagtggaggagaattcaagaacactcaagtggaggaatttcttgatgaagaaggaatcaagtacgagttctccaccccctatgatcctctccaaaaaggcattgttgaaaggaagaaccgaaccctcattgaagccgcaagggcaatgcttgatgagtacaagacttcggatgtcttttgggcgaaggccgtgagtaccgcatgtcatgccatcaaccgcttgtatctccacaagatcctaaagaaaacttcatatgagctcttgagttgtaagaagcctaatgtttcatattttcgtgtctttgggagcaaatgctttattttgagtaagaggcctcgctcatctaagttctcatctaaggtggatgagggattcttacttggctatgaatcaaatgcacatgcctatcgtgtcttcaacaaaacctccggtattgttgaagtcactagggatgtgacatttgatgaatctaatggctcccaaggagagcaagttgttgtacatgttgtaagtgatgtggatccaagtcaagctataagtattaaggctattggagacatacgaccagtcgagacgcaggatgaccaagaagatagggatcaacctccgtcatcaacatccaatagccctacaagtgttgtgtctgctgagccggaagttccgggtcctattgactggaacatccggacatctccaggcccggaagttccgggttctctagtccagaacctccggaccagtggcagtgaagacgtgccaacggcgcaagtgaataggatcgatgctgcgggcactttagagcatactgattaggctcaggtccatgattatgtccaaagagatcatcccgtcgacaacatacttggtgacataagaaaagggtaactactcgctctcgtgtcgcaagtttttgtcaacactactcgtttgtctcttctttggaaccaaccagggtggaagatgcgcttggtgatccggattgggtgatggctatgcaagaggagttcaataacttcactcgcaaccaagtatggactttgatggagagacccaagaaaaatgtcatcggcaccaagtggatctttcgcaacaagcaagatgaacatggggtgattgtaaggaacaaagcccggttagttgtgcaagggttcacccaagtcgagggtctcgattttggtgaaaccttcaaacctgtcgctcgccttgagtcaattagaattcttttagcctatgccgctcaccatgatttcaggttatttcaaatggatgtcaatagtgcctttctcaatggacctatctcggagttggtctatgtggagcaaccaccggggttcgaggatctaaagttgccaaaccatgtgtacaagctccacaaggcgctctacgggctcaaacaagcccctagagcttggtatgaatgtctccgagattttcttttaacaaatggttttgaaattggaaaggcggatactactctcttcacaaaaaaatttaagagtgatttattcatatgccaaatttatatcgatgacataatatttggttctactaatgcctctttttgtgaagaatttagtagtatcatgactaaaaggttcgagatgtctatgatgggcgagttgaccttcttcctcgggctacaagtgaagcaagcacaagagggcaccttcatctcttaaaccaagtacatgaaagacatactcaagaagtttgggatggcggatgccaaacctatcaagacacccatgcctactaatggacacctagacctcgacgataatggtaaatgtgtggaccaaaaggtatatcgctccatgattggatctttgcttcacttatgtgcatctcgtcctgacatcatgcttagtgtttccatgtgtgcccgttttcaagcggagcctaaagagtgccatttgattgccgtcaagagaattctaagatatttagttcatactcctaatcttggcttgtggtatcctaagggttgtgactttaagcttttgggctattccgattcggattatgccggatgtaaggttgatagaaaaagcacaaccgggacttgtcaattccttgggtggtcccttgtttcttggtcctccaagaagcaaaattctattgcattatccaccgccgaagccgaatatgttgccgccggttcttgttgtgcccaattccattggatgaaacaaaccctaaaagattttggctacaacttctccaagattccactcctatgtgacaatgagagtgccatcaaaatagccaacaatcccgttcaacactcaagaaccaagcacatagatattcaccaccacttcttgagagatcatgaaactaaaagagacatatgccttacccatgtgagaaccgagagccaattagccgacattttcaccaagcctttagatgagaaaagattttgcgagcttaggagtgagctcaatatcttagactgtcgtaacattaggtgatgggtggttggctaattcatagccaaacatgtatcactaaaatgtaaattaaaaaaaatgagcttttgtgtcttgagatcacttcttgtgtagaagatagtcttgataccaggaataaagctcaaacatttcccctcttatccaaaaacccttttgtgaaaatttgcgaaaatttttgtgtgtgtttttattgcgaaaatttggtttttatcactttcttgtgatgtattttgaccattgttatgaaatgttgattgttggctagtcgtatgcatcataagtctttgcttgtccttagttctccaattccattcgttgttttctcgtctattcctttgaacttgggcctgactgccctctgttctgtcaggccggaagttccagccaccctagtctggaacttccgagggacgggggtataaatacccagggggagcccaagcctgtcatctctctcctcacttcttctcctccccgattcccaaatcctagccgccgctacagtgctcctctcggcgatttccacttccaaccgtggaaatttgattcctctccgtggaatcaaccacattggtggctaggaggttcatcccgcgatcgatttatgatttcctctctcaaagtagcacttttgatcttcccttttggttcatcatgtttttgccccgatctctaaatatgtgaacccagggagaaaaccttttggatagaattgttcctgctaccttgtagattgccgatctataggattttatcacatgcactgacattctcttggacctctgttcttcctgcttgtaggccggaagttccggtgttcttggcccggaacttccggtctctgtccagccagcccgcaatccttgattcttcaaatttttcatttaaccattgcactccaattttgttgattcttgttgcagtggtcagtatgcctcgtgagaagagacagaagctgtcacaggatgttccctctgactcgagtcccctggttcgtggtcctagggggagattgggcaaagaaaaagtgggagatttttacagtgggagtcagattctgattcattccaggagggctggtagcattgtcattcgtgatgctccccgctctccctctccagttgcatctgagtcagacaatggtggaaatgaggatgagcctggttctgagagcaatcctttaaggctttacaagacgagggctgttgatcctgatcctagacatccaagggtgaactatctgaagaatttgctaaggtgtgcaaaggatagaatggtgagtcctgatacaatgactgctgactctcaggatgacagattcaggaccttggtgcagattgattggtacaactctatgatcatgcgaagatcttatccagtggtagagatgaagtggctagactggcagtacatgtcctcaaagaacaacttggttttcaatgaggtgcgcaaggtgtgtgagcgcaagcatgtggcagatctgttggccttgcagtattcctagaatgaggaagttattggtcagttctactccaccgctttcttcggcaccaccaagaagggaattgattttgtgaagtggaccattcaggggcaatagtatagggtctctatggcacagtttgctgcagctttggggttagatgatgatgaccttagtcgtccacatatctttgtagagaatgctttgtcagtgacgagcactactttcttgtatgagaaggatgctcccaaggattgtttggggactactcgtgggttgcatccatactatagagtgctttattctatcttcaggtggtctttgctccccaaagtgaatgatgctacagctcttccaagtcggcatgcgctccttctcagtcgcatgcgctacaacaagccagatttcagcatcatgaagcttatctggagtgagatctatgagacagtgtgagccaaagaggggctgcatctatgctccttatatcatgaagatgattgaggcaaagactgggatttgttatttcaaggacaaccagcacaggtcttttcgtcctcatgctcccactacttcagctacttcttctgccagggcgactcgtgcttctacctcagctgctccttcgtcctctgctgctccacagcgctctgagtcttcctcccccataaagaaggctctccgggctatcttttgcatgtgttctaagacagcaaagaaggtgaagaagatagagagacgtcagaaggaaagattggattgcagcaggcaaggaggtctctgatatttctgatgatgaggagttcgttgatccttttgctgcttatgaggctgctcgagacattgctaatggtgagggtccctctggcactactcatttcttcaatgaggagtcctcctactccgaggagaacagcgatgatgaggagtccgatgcacctactgagaatgtgcctacagatctagatgaggcagtggacgccgctgggcaagacattgactctcctgactccggcgacaccgagatcatttcttctgatggagatgatgatgaggcttgatcctcttcttcccttgtgattttatctctttttggtgccttgatgccaaagggggagaaaattgcaatcgaagggggtcaaaattttgttcttgctgcttgctgcctgatctgtctgttcatccggaagttccggacctggcaactccctcgctatatattcctgtcagcttgtccggaagtttcgggtattttatctggaagttccagacctagcagtcctttggcctctactcatatggacttgtggacatgtaataattctcgatttgtgtttggtcctttgtaatgactgttagatgctcttagctgctctttatatatattgcacttcatttatgctatgagtgtcttatttgtttgttttttgtgatgtgatgttgattttatccttttgagtgctcaccatgtcatatcatttgcatatcatatctatttttcttactgcttatttgcatcccacgaatgagcagggatgaaggaaactctcctcggttgctcccttatatatatgcatatgagtttcactcatatcttccatatgcatacactaagggggagtttcattcacctctaaccattcaaaacaaaatttatatcaatattttgtaagctttaaccatgttgtcatcaatcaccaaaaagggggagattgaaagtgcattaatcccatagtgggttttggtgattaatgacaaatgtggttaatggaataatgagttcattgagttactttaacgtgtattagtccaaggtgtggaagatggatgccttgagaccccccaaaagtataaaatcaaagcggaccggaactcgggaagtgcataggatagtttatttatcgcaatcgagtttttagaaaaaatcgtactattaagaggggttccaggtgatgctctgagatatgtcatgtgctcttagtatgaaccaagtgtcaagtttccctaggagtcattcttgccaatactccatctgtccaaaattgcaagtccggaacttcctgtcttccaggtccggaagttccggtcttgtgaaaaagatttttctaaatgtagtctggaagttcctgtcttccaagtccagaacttcctgtctagtttccagttcaaaattgtgagtaacggcaagatgatgtcacctagccgttatacataaccagctcgttcttttggccattccactttcagttttcgaacatagagctgttgctagcctctcccaagtgtttcttgccttctccactcaatctagagtctaattcttgtgagaaagggagattgagagggagagaagaagatttgaagatgtgtgaagactaggatcttgggtgagcacttggaatatctcgtgggctgtcatctcggtgcttattactcttggagatgatctcctagacggttaggtgttgtccgcgaggatccgttgcatattgtggatgtcccgggtaagtttgtgaaggatctcctctcctccgaaagggaacgagataagttaatgaagttcttgtgctgagattctagaggctttccaagtagagcaacccacacttgtggcggatttctagaagtaggttgagttggatcttggtggtcactcaattctagaaattcacctaggggtgtttagggttgaaggctgtggattttctctggggtttttgcacaagtgaggcaaggggttaatcgagacccagctctttggagctcctcaacggacagtaggatcgcaagatccgaactttgggaaaaaattgctcttgtctctttctgtgatgtttttgtggatgtttctgtgatctatcctctgcttagaatacatgtgcaccatcttgtgaagattgtcttagcctcctgttttgcaatttgaatttcatcctttgttctgttactcagaagttcctgtcctagaacaccggaagttccgagcctggcagaccggaagttccagtgttccttaccagaaagatcctggtctgtttgaattttaccgctgcgatttgtttttaagttttcagggacagcctgttcacccccccccccctctagacttcatcagcgcattcactttgtagggaaaggcgggcaattcactttatacactccaacataacgtactcgcaaaaggaggttattggttcactaagaaataagtattgaaactctattttttttaagtaggaaatcaaacttcactcactgtagcagacgtgtgtagctagcaaaattgatagtggcgtgacagccaagtgaaataaatcaattacttgcaacacagtcaaaacagctgcactagtactgaatcttggctataacatcagatcaggagtccggacgtgcacttaataaaaatagaaatcaatctatggatgcgatggtttacaggctatgcaaaggaatacagacaagcaactgaaacaaagttctaatggatcaaaaaataacaagactcacgagagaacaggttgaaacaagaggcttggttagggatgatttttttgtgtggtaattttctggttatagaaagataaattacctaacgggcaatcgtgctctgataccaactgacgagggatgctaggtcccgatcttccgataggtattaataaacagtcgatttgggtggagtcgcgacacaactcgatccggcttctgaacgaacacgctactgagccccgcaatcgcagcaccacgtctactctggttatcaaccgtgccgaaactcggttgacctcgccgagaaggctaatccctacatgcgaatcgaagaacacaagcaagaagaagatagattgcaaccaaattgcatatgaatgattaagcactcggatttggggttccacaaaccgctctagcagtgaaactgttcttgacagaataatctaagcaaaaccccactctaaacgatgacggctacagaattaatatgattaagaacgtcctagggttgccctagggcgcataccccattgggctaacccacgacacaattacagggcccaaaactcaaaatcagattcggactggatgagctatgtggcttgttttgcagattcccggcagctcggtaggaattttgacatgggaccaaaaccatccgaaagtagactccataagctttccaacaagtactcatgggccccaaaactccttctagattaacagctaggtccgtttgaagttgatcctgttaggaggcccgaatccgaatccaaaacgtgtagaactttatctcttgtcttctatggaccaaaagtgatgtggtgagatgaaagaagacttggaaaaagtcttggtttggtccctaatcaacttcttcaatcatccatgcattctttacgctcggtctcttttctttcgcccaagcaagtacctctgcaaacaaaaacacacgaaactcattgtgtagcaacgtttgttcaaatatataacaagtaaatctaatgtagaacatatgcacctttggttgattcatacataaggtagtcatggtaatatccgagctaggtgtgtcctcatttccgtagctgggccggccgcccaaccccgcctaatgggtggtaccgcccctgagtggcacgccaggtagaaagatttttggtgcttcaaggtttcgacgagatggattcaagagatgaattcttcaacaacaagttactcgacgacttcggctgtgagaagatctaacctgaccggatccaatgagatcggaaccatcatcaccaataattcaatctgtcaagatcgcgcaagttacgggacatcgccgtcgcggaggacattaattcaatgttttttgccacgacatcctcaccaaacttttctgccgtattaccgccagctgagttcgattgctttgaggccaagtgctggagtgttccgtctcagacacaaagtgctactgacaaacagaatgctattacatgtcgcctgtattgtcttgccgtggtcagattggatcgatctcaagtacagcagcaggacagccaagcaagaagatggccgactacttcacgcgttgacacatatgttagcatgcatgcggtgggacccatgtacggtattgcatggtgtgtaccgaaggctatgttagccataggtatgcacacataggtatataggcaggccatccacacgtgctaatcgctaaggataatttagtttggctaaaaggtaattagtggattgatttattaaattaatttattaatttcgtagcggcatgtatctacaaaggtacgcaatattttatatatacaatttatcgtacctatttttcagatatataaaatattgtcaggtcaataatttattatgtttatttagagcgtgtttttatacaatatctattgtgcgagagttttcaatgttaagccaactacggtttaatactaggggcttgctctattttcttcaatataaatcatatttgtttacgattttcataatgactgatatttaatttgctcattatatcctgataatactagaagattcatgcagttttttgagtacatgctctatattctctgctatatatcttgtcttctagaaaatatttttcaggaacaattgagcactcgagtaggatgtggtcgagtacaccccattatcgaaaacgttctcgaaaaatgctgagttgtcgcacccaacctatcaacaaaaactgacgacttatcttatgtatagcgccagctacggctagactatttgagagaaaattgttaacggataattcctcacgagcgttgtcagcttgatcacccgacatgattatgaacaagtatccggacatactataagttggatatgtgagtcatgttgggcacatgagatgcacgtataataaccaactctagcacccttataggtgattgagagatgccgctgctggttatcgaccagatagttatagcgacttctcgccgcctatcaatttaaatccacttgtggaccgttggactccatctatcattgtcgaaaactccatgtctctacggtcttacaccaggatcgaccaagtgagtatggcaaatattgataaggggagtcgcggataacaagagatgctttcgcgaatacgttttgtttccgtatgccaatcagttccctataggtgatcaagatacgcctacacctggtcctcgaccagtagattgtagcgatctctcaccacctaaaaattcatcttcaggtgatcgagatacgcctactcatggtcctcgaccagtcggttacaacaatctctcgacatctaacacgataatcaacatgatcgtgatagcgacaaccaagaccgactagatcgctgttgtcaccaggacgacaacgtccaggactaacgacatcaggacgacaacggacaaggttaacgacttcacgacatcacacgacgacgacgacgaaactcgagatccctagactcctagagggcccaaggacgaggccgtaggtccaggagccgaacctctgactacgataattcctcattgtcttcgtcgtcattaggaggcagttctcgcaggtcacatgaatgccgtccatctattactctggattccctttaagtggtcgagatacgactacgactggtcttctactagcaaagtagcgatcctcgcaccacgacttttaacagtcgaggtacgactacgactggtcttctaccagcaacgtagcgatcctcgtaccacgacttctaacggtcgaggtacgactacgactggtcttctaccagcaatgtagcgatcctcgcaccacgacttttaacggtcgagctacgactacaactggttttcgaccagcaacgtagtgatcctcgcaccaggacttctaatggtcgaggtacgactacgactggtcttcaaccagcaacatagcgatcctcgcaccacaacttctaatggtcgaggtacaactatgactggtcttcagccagcaacgtagcgatcctcgtacctcaacctcaaaacagtcgagagactcctccttgttctcaaaccagtaagtcatagcgatctctcgtacctccacttcaagtggtcaagttatagctacaactggtcttcgatcagcagtgtagtgattctcccactacttctgcgatttgttgagtacaactatacacctagtctttgcccggtgtggtggtcatctcatcatctacatcaatttctgtaagtgtttatctgtacaatatttatctgttgatctcctcttcttatatcacctcatcttgaaggcagtcctattgtccctttacgctattctgacaaggctccgagtaagctaagggaatttcagcgggggacgcctagagcagataaggtcttgtcagattctaagagccaaacgaccatgtaaaacatggttatgtaagagtgctcaatagatgcgtattaaccaagctgtgtaatcgaaaattgatttttccaacttcacggctgggggctaggatctatcagtttcagcatggtttgttataagatttaagctgcctttgtggaaaatggcttttccataaaaacagctgggggctaggaagaataccaaacttcgtttgttgagggcaactctagcgagcgtactcttttattgtcacatgcaaatacaatttattttcaatttttccatacatagtatagcatgttacccttgcgcgttcgctcgggggctatttctatctaacaatttgttctgagtattgatttcagaaaaatcatatatcggaacaatcaaggaatatggaatgaagcgatagtgtacccgccgagacgaaatttattgacttcaatccaaattctcgagtacagcaagacgggagacttagtcgcatgctccataccttctcggtctgcagagtatgtaatagctaactagtatacttttcctgacgtaaccaagcggatccaaattaagaagctgttttccacatcgaattaatgatacagccacggtcacagtgatttttgccatcgaagtcgaagcgccgtaatcgcacaaatgtgtggcagatatagaattgtgtcagcaagaaaaataagggatttatagctggttatataatcagttagagcacgacagacacaggtgaaaaattattgactctcatacaaaagccaaatttacacacgtggttcaagagatgaaataattatatagagagcagataaaacttgagacacaccttttatactaaactactccctccgttttaaaatgtttgacaccgttgactttttaatacgtgtttgaccatttattttattcaaaaactttaagtaattatttattcttttcatatcatttgattcattgttaaatatactttcatgtacatatatagttttacatatttcataatttttttaataagacgaacggtcaaacatgtgctaaaaagtcaacggtgtcaaacattttgaaacggagggagtattatactaccgttcacaattataagaatattcaagctttatatacacatagctagacaaatagtactcacttagatgtataaactttaattccttatttgtgcacgggtaactctaatagtatttgctagctctaacacccatatttaaatagccttatataacaagttaaatagtagagccaactattagacatggagtataaattatatcggtgttatccaaaatttgtaggagttagctattacattgtattagctactcaataatcgatttttacatgcggtcaaaattgattttcgtagacagctaggtgactcgcttgcacccatgtgtctgcgaaaataaatttttgcatgtgggtagttcaaccgttttcgaaaatacaatttttgcaagcaaaaccgtctgtctgcaaaaataattttggcaaaaaaaatccaaaaataaaaaatctagaaaccccggaatctaccgccgccatcaccctcggatccgctgccatcatcgtcgtgccaaagccgccaccatcgtcgcattgggatccaccatcatcatcgcttgaagccaccgtcatcgtcatcgctcgaagtcaccggatccgtccctcccatcgcaccgttatcgctcaaagtcacaagatccacccctcccgttggtggatccgcgtgagaggggcggagagacgacgggcgagggggaggagacgtcgaatccgcccctcccatcacacccgccggtggatccgcgtgcatggggtgcgtaggggtgacgggatccacacgggaggggaggggctgcctataggatcaagatgttgaccaaagggggtgaatagacgatataaaaaaataaatgacacctaatcaaaactaacctaaattgctaggcttgatgagagaaaatactaactaagcaactatattaagttttgcaatcctagaatgataagggctcaaatagtccctataaaacaaattgcataaatgtaagtgcgataagtaaatgagatatgagacatggaaattttcacccgagattcacaaaattgacaatttcctaatctccattgagacgagctcaacttcaccactcaaaccacgatgccaccgaaccccttcatcaaggggtgggcaaggtgggagccagtcttgaagtaaactacccaagcctcgatcagtattgtagtcatttcttcactctgaaggtggttaactacaaaccaatcacaaccaacaccgggactcctccacataccttcttagagaggtcaccgagcaactcctccaagccgtctacgaggtagcaaagtagcaacctggctcggagatgatcatgtggcatactagctcaatcaatgatgcaatgcacttgtcttggctcaatctaccgtcaaacacccgcaatgaatggacaagtgctcaagtggtgtggaagtggatacaaggggtttatgcaaaatgaatagagtgacaagagaactcgcttgctgcttgtgggggagtatttatacccctaaccaccaaaacaaaccgttggggctaaaacaccaactcatatgactatacataccagcctccagtgatgaaccctgaggtcctctcgacactcaaggctgttgttggcccgatcttttggtgagttatgataactacgatttgggagaaacgttgacgatccgactacaaccgtacgagacgttgtgttgcgcccttagcgatcgatacacctctccgtgagttattgatcttgtcggtgcagatcaaccctattcctgcaagcaaatcgaagaaacaagcaagaacaagataaaagcaatctgatattgcaaataggaatttaatacgaatgataagttggggttccgaagaacaagcagacggacggtctagccgacacgcgcgctgcaagcaagtagcaatggctaaactttaatctaacaaaacccgagaaaccctgaaggggtaactagctatatataggggtgggaggacgacctaggggtgcctagggtcgtgctccaccagcttggggcgcaccccacatgggccccacctggaccggggtcccaaatgaagttacaagcccataggcccattataggtgatgcaacaccttgttcctgtgattctggccacacgagatagaattcagagaagaggctggatccgttagaaagagggctccgagagctttccattaagtactcacgggccgaaaacggaggtcgtatgcagattcggtggccgtttgaagtcagcagtatagtaggtggccgaatcggattccagcacttggagtacttgatctcgatatcttcttgttcatccatgatgtgagcaatggttgcatccgtggtagccatggtcacatcatcctccccttcttcacggaaaaccgtccttggtttttccatatggtgctctttgcgtagtccatttacaacaatctgtttcttccaatcaaaacaaggcaaactcgagacaatttggttagcaataacatttttctctagcttgcatattttatccacatgtacaggaggttctaaatccgagcagatgtaaactctatgcacaaaatatattccaagatcattatattcaccaaagatgtgaaatataacattggttggatatggcaaatcagacttagcaaataatttctccttgaaattatcgagctcacaaaaatcatcaaactgaacatagcccaaagtatttaaagaagatctcaattcacgctcctctacttcattagcaatgtgaacaacatgcttaaaatcagtgcagtatgaattaacagtaggaatagcatgttcattcacaagttgtggcatggatataagtgaagcattatcgcataactcttctttatcacaaggaacagcaaacaaatcaatttgtgacaaaggaatctcagcagttggttccactaatggttgctctgctatagcatgaaaagtggacaaattcaattcattaacaacacactcacctttattaatttcagcaccattaagtttacctttgatgccctcttcagataatggaggtgcctcgactttgagtgtgatcaatgggactggcggctctttcatgtctctctcctccttttcatgattatgcacttcctgcaaatggttagtaatagaagacaaaaacatagcatgttgcttcttcatgtcctcctctattttactttcagcattgcaagcaagttgtaacaaatgagaaagagatgtatatctttgacaatcaagcatgtcctgaatttctttgttaagcccacataaaaacctcaattctttagcttcttcgcattcatctaaaccacaacgtaataaacaagcttgcatatcatgatagtatgaagtaacagttctggtatcttgttttaaacattgcagtttgttgaacaaaatgtcagcataatacatgggaacataaacatctctgaaatatcgtttcaggtctttccaagattgtggtattttgttatgcctacaaagatgtttccaatcattagaagcatgtttaattaaaacactagaggcacacataaccttttgtttctccgacaagacatgcttttgaaattcactatcaaccgctagctcccaattaatgtaagcacgaggatcatagtctccctcgaaataaggcagtgcagatttgatcttacctagaacatcatcacttacctcataatggtcatgttgatccctcctcatgtctcgacgaagatgtcgatgttgagcgcagctatccccaattatcttgcgtatccctgccattgttagtagaaaacaagaaacatacacaaaaatatgcgcgttcctattaactactaggtagtggcagctcaaaaatcgcacacactcaagcttttaaccaagctcttacaagatcttaccaatgcaagtggaatggtgacatacaccgactcaaccaagcaccccaatgaaggttggatgtatcgatgccttggcaaacacttgcggtagagctgtaatcaaatatgtggagctctgggtaggcttaaatatgtagcaaaggaatagcaaatgctcaaatcagataatgcaaagttgaataattgttcaaagtcaagtaccgtgctggtcctaggctagacgtactagagacgcgagcctagacacaaacgataccacaagatagcactaggaacaactcatgcacaactctgatatatgaagttcagctcaaacataacagtattttctcttttctttctttcttctttcttcttttctttttttttctttccttttcttttctgttttttttttgtgcggctttttttttctttttttttttttgcacctttctgcctttttttcactttttttcttgatttttttttaacaaaaactgactcaaggaccttaatgtaagattacagggactcaaacataaatataaaatttatagggactcaaatgtaaaagtctaaacccaaaattaaaattatacaaaaaatggaatgctgaatttatgccgattccgtttttccaaacagatctcgaaaccgacaccaaacaaaaattcgccaaggtgtttgacacaactcggaaccgtggaagagagggagggagtcggactcggccaaaggggcgagtgggactcggccaggaggtggagtggctggcagccgaatttggtgtatgggataaaaaggaaactgatttttaaccaatccaatctactatatctttccaaaacaatcttgactacttccaaaatcagatatggtaattcaccttcctcctctcgtgcacgacacaggcacggccaaaacaaacacacacaaggatcggcaaactctagatgcaactcaagaactccaaaactaaccgacagaaacttctgaaaactacaaaaatagaaccgtggcagcgagccgattccgttttcgtaggtcccgacaacaacagagacacggtggcagcgacgactgtggtacaaaacgtgaccagaactcgaaactctaaacgaactagacgctaagaccagcaacacgacgtgacgatgcaacacaaaattcaacaaagcaaaaactgaaaagaacaatgcaatggcacaatatggctaggtaaatgatacgaattttttttgtatggctattttctggttataggaagataaaaactcaccgagcaacgaaagctctgataccacctgatgaaccctgagttcctctcaacactcaaggttgttgttggcctgatctttcggtgagttgtgataactacgatttgggagaaacgttgacgatccgactacaaccgtacgagacgttgtgttgcgccttagcgatcgatacacctctccgtgagttgttgatcttgtcggtgcagatcaaccctattcctgcaagcaaatcgaagaaacaagcaagaacaagataaaagcaatctgatattgcaaataggaatttaatacgaatgataagttggggttccgaagaacaagcagacggacggtctagccgacacgcgcgctgcaagcaagtagcaatggctaaactttaatctaacaaaacccgagaaaccctgaaggggtaactagctatatataggggtgggaggacgacctaggggtgcctagggtcgtgctccaccagcttggggcgcaccccacatgggccccacctgggccggggtcccaaatgaagttacaagcccataggcccattataggtgatgcaacaccttgttcctgtgattctggccacacgagatagaattcagagaagaggctggatccgttagaaagagggctccgagagctttccatcaagtactcacgggccgaaaacggaggtcgtatgcagattcggtggccgtttgaagtcagcagtgtagtaagtggccgaatcggattccagcacttggagtacttgatctcgatatcttcttgttcatccatgatgtgagcaatggttgcatccgtggtagccatggtcacatcatccagtcactcagaccaaccttggcttgctcagaccggtatcggctctggtggctctagattgccaagtcatttatggccgcccaactgactcgctaggcgcccaattagaccgagtcgggctcaatcagactggcccagacactacgattagaccggtcagattctccgataagacctaccggggacataaaagatagatgaatgaaaaacgaaccaagcaccctcatgcatatgtcctaatgtggtattttgatcacttcgaagttactacccatcttgagagtacgtcaaaactagaaataaaacctagcaaattcaatccctcaacatctcgatcaataaaaacgaaaagcaagattaatcaacaccacaaatggctctccgttgacgatttgtgtttgaagcccgacactgatggctattgtcagtgacggcatgaagtactagcccgttacggaggtgttttgcccaaactaatggcctgtttggggagctttagattctgagaagtagctgtttggtagccagcttctgagaatctggaaaagctctaaaacccagcttctaacttcttagtttatttttcagaatctataactacatattctcagaagctgtggactgtttgaggcagcttctagcggaagcatcttttgggaaaagctgcagctgggacaagctcccccaaacaggattgcatcattcactattcagatatagccattggctgtgtttgcaaccccacgttcccaacccctctcgctcatttttcacgcgcacacttttcaaactactaaacggtgtattttttgcaaaaattttctatatgaaagttgctttaaaaaatcaaattaatccatttttaaaaaaaatagccaatatttaattaatcatgtgttaaaaggctgctccgttttgcgtgcaggagggatgggccatcttgcacttgcgaacacaccatcgtcctccagccgacgccctcgccacccccgcttcgttctccaccgagttcggcgacgtggcctcgtcctccactgagcccgaccgccgctaccatgttctccctcgagctagcccctgccacctcgttctccaccgagcccggtccccgccaggtagtttccaccgagcctcaagtcaatgtgccacgtgggtgcctttagcttaaaccgtcatccaaaaccatcttgggactatatttgcactggttttaataaatgagggatgcattatacccagttttgtggttgagggatgagatccaatctcgagacttagacgagagggacctcaagtggacttattccttgtgcagatgattacctatcctggactgctgggctagacatggtaacttcatatggaccggttacttgggccaccactcatcacagcggattgttgtaatccagcaactttcactaacgtgtaatccaatttatgcgcgcacgttttctcctaaccagcgatcaattaccagtcgtccgatgcacacatatatgttgcttccggaaatctaacttaattagtgcacagtccatcaagcaagcaaaatatatatttctaccacctaagcttcaaaaaaaaatttctcttaacctacttatctaatctacgatccgattacatcattgtgttagctacaggtaatttttaataacaaaatttagatgattatattttaatcaaagattagagattacttttataatatatttaaattactttttttgacatataaaagtaaattcaataaagtctaaaagtaatttagatatataataaaaataacttaaaacaaaatgagagtacattcttacggtatttaaagtaaatctattgtgggggctaaaaacatgtatctaaaacttaaatttaattaacaaattgtattacttaccaataaagtaaactattcacaacattatcaatgtcgaaaaagtaatttaatcaaataaaaaagtaatattttgtttcttttattagaatataatcatgttatatctttttataaagacttatttatactgaatatgatgatgtaattggattgttcatttgataagtaattcatggacattttgcttgaaatcctaggtgttaagaatcttttccttattatatgaatgtatactctcacttaggaatgtaagaacgagatacatgttaactttattatatatcaattgttaggatagtagttggttaacactaattagtgcacatacaacctgtcacttcactaatgaattaattaccaatctaagtaaaagcaaaaaaggagaaggagaaattgcaaaatactcacttgtaatttgatattctatcccataagtcattttgttgcaaatactcgctagtccctactctgttttgttgttaaaaaaaacatcctagtgcgcgcgtgcttaactgaataagctcggtgtcactgagatagaataggctaagctaaccaagtcaatcttatcgaagtacttgtattagatttattcttcatgtttcgttgaactttttttttggatatagcgaaactcagtttgacagcatttaagctctcgtcagcatttatatgtgagtaatctcttaaaaagtggcaagactatgttgcagaagtattaaatttttacaaagaacatattgactgctcataacttatgaaaacatgttgatggtttttgcacaaaatgaaataggtgggtgggcatttgtaataaaattacttatgggtgaaataccaaactttaagtgacttatgggatgattttttgcaatttttacaaacgagaaagaaaaagaaaagaaaagagcatgcaaatcatgcgggcaatgaaaattaaccttcggaggggccaccacgagcaatttgcacggcatattttgccgactgcgcaggacagaattaggacagccgtacaggtgcaattaagcatctttatcgctgtccattttaccgtacctcgtacaattttaatgccaaattatgtatacctgcccacgacctaaaagctgatacaactgatgcttcttgttaacaagaaaatctagcgattgcatcagtgagcaagaaaaactatacttgcttcttgttcaagatctgtaagcattggtgtatccctcttttattttttttcctttagttttggggaaaaaggaagccgtctaattaagcggttatacaagagtacatattaaaaagaccaagagaataaaagaggaaaagataaagaggaattagaggagttcgaagaaccacttggacagaagctgaaattaataaggggatatatatttcatccttgacaagtataaaacttcctccgtttcataatgtaagtcattctagtatttcgtatattcatattgatattaatgaatctagatagatatatatgtagattcattaacatcaatataaatgtggaaaatgctagaatgacttacattgtaaaacggagggagtagcaaattctccctgaaattacacctccaaggatcaccatgtggctgatgaatatactaatatgaaattaagagccctgcttccaaataacgccaggaagttattaagaagattttcctaaaccgtttcactttggatcttattttttgtaggtcgcttttgatcttcttttttattaagtttggtattctttcgctaaataaagatataagaggtgtttttttatgctatcacaaaataggcacacgcatgcacacgactacacacccactcacactcgcgcacccgcaaatgcacctacaacacacactcaaaaacagattggaaatagtgtgatttaattactctggtggcatgttgtgatactatatacaagatgtgagctgaacatctggtgaattctttcactgtaggattgcttaaagagaattcatattgttggacaatcgccatcatatagtatgctagttaaccatagctaagggaatgtcatgtgtacttttcccacagcactattagcaggcaccaatagtgcaactgtaattactccaaattaaaggccatgtgctaagtacaacggtacaaggtcctccgtaagttaaacgagatccgacatgctagaatcactgaattgaatcgtgtctgtcgctcgacaaaattgctatgcaaccatcagctgctttatgatcaatgtgtatcgtacagtcctctaagtatttagattttacaataaaaattttacctcaggtatccgaaggtaccaagttttacactatactcttggtatatctgtattttctaaaggatggcaaaattacctatttgattaactgaaaattgtattgacaaaatcaaatcaaaggagttatcaggctgttacagtgcaagactaatcacttaggacttgttcggattataagataggaaaaacatacgatatgaaaaatataggaataggaaaggaatctagatgtaaaatagaggaatgaaaaacaaaggaatacaaaaattgagagcatttggatcacagaaaattgattgccaaggatttacatacaggaagtgaaaaaaagagcttgaggtggatggatttttcctgtgaaatcagtatcaaaggaaactttcctttggatttcctatgaaaactaaacaaaggaatacaaaaattgagatggatttcctatgaaaactaaacaaagaaatacaaaaattgagagcattcggatcacgggaaattgattgccaaagatttgcatgcagaaagtgaaaaaaagagcttgaggtggatggatttttcctgtacttttcctgtgaaatcagtatcaaaggaaactttcctttggatttcctataaccagttttcatgatccgaatgacaggaaatgaaaaaattcctatgcacagtattcctccaaaaatcctatgaagatcctctaatccgaataagcccttaatttcgttattaatacatcattgacatcgttgaacacagtttattttgatgaacccccaaaaggaccaactatgattgtccatctctctgattgttatatatgcaaatccatttggcatctactgatataaaaaagaaaaaaaactgattttgtaatacaaccatttctcgtttcatctcggttgagggatcaataaaagttactttgacacagcattatctttacatgtgacaaaaatgatcatacaaactatgacatgcaaatattgtttgactcaacatgaggccaggatgaagaaattcatttcatcttcttattttttaacaaggaagaaactcattctacttcttaacaagtaagggccccacattatcacccgttgctttgttgtgcttcacatggcttccatcacaaaggggaaatgtgcctgatctccagcacctgtaacgtgacaacaaaatcaatctatatcagtaattcagtataataccagttggaacttggaactgaaatgcaaatgaagttcctcagactcaagagaaatataaggtttgtattctgaatcactatcgccatgcagaattttcacaaatgcataaagcatgcatccacagaaagagcattgcaaagtgttctctctatcactctgtgtatgtgaaaccataaacagggcaaaactcatacattcataatagtacgattcagtaaaactattggtacgcgtgattatggttgctggcagttacaaactccaagggaaacatcatgatctgaggttcttaccatcctaagatcgaaaggatcattcatatgaatgcaataattcctttagagatctaaggccttctcggctggctgtgctgtggctgcacccctaacataccagagcatagaaatgtcttgtactatactggcggaaaaaaataacacctcatacagtcacagattcacagtagatgaagtgacaaaaaaagatggtctactttactttactttgattattataacttctataagatataaacgtatatacatagaagatggccaatgtatttcttgcagagaaaaagtgttgggacttgtgagtgaaagtaaaactagaaatatctctaatataacaaataagagtatcatacatgagtacatgactatcttctgaatctgtttttttagaaaaaggtttttttttacccggcctctacatccaatcgagatatatgcagccattttaaattagcaacttagccatcaaataacccaatctaaaattcgctcctatggagatttaaactcaggaccttagatgctactcagattactacaaccactaggctacatgctctttcactaatctgtttatttttaagggtcaatctcaaagtaaactgaaacaaaaaaattgcttctgttttatcctaaaaataaagctatctatgttcgagtactgggatcgcactcggttcaagtcgcactgaaaacaaacgcctacaaactctgattatcttacgagccagcaatttgctacgagtaccctctatctttgaattctcgattaatttaccaagcgcgctgatttagtcattttaaagaggtaaaaagcagagcttagagattagattatacaactggctcatgttgaatggttggtgattttaacgagagcgaaatcactccgatcgacgaactgaaattcaccgaacccttcccgattggtgcaccaaagagagcgaggagggtggggtggggagggccgtaccggcagtacggggtgagcggcttggagagctcgccggcgaggacagtgtcgaccaccttctcctcctccttccggatggacgggtttatcccgccgacccccgcctccgcgcgcaccgccaccaccaggccacgccgggcgagggcgcgggcgcggccgggcgccgacggcgccgcgttgggcggggagatggagaggcggcacgcggcggcgcagaacggggtcgccatggttgttgggtttggctcgcgcaggggggtttcttggggttggtggatggatggagtgatcggtggggggagacgaaacgtggatgggttttgtgagtaggcgtggccgcgcggaggatttggggtgtgtggcgagcacgggccgcgggagaggcacagagccagatgggatggattggcgtcggcttcgtctccgatcacca

SEQ ID NO: 29381 - DNA, 42615 bp, Oryza sativa
  unsure (1)..(42615): unsure at all n locations
tattctgttaagaacatgtaacggtgttaactgaagctcaaccacaaaatgtctctttatgcccttgcttttttaaccctattatacgtgggacccacccgtcacttctctattctctcttctcttctcttctcttctattctccactccactccactcgcccgagcaccgccgccactcctcgtcgccgcttgccacagcccgagcaccgccaccactcatcgttgtcacctgccacagcccgagcaccgttgccgatgaggaagccatcgtctgtcacgcccagaaatttagcccaaatttccagactattttgtgtattaaatctctgtccaggaccagccagggtacacaaaacgacaagtaatacacagttccaaacgtaaataaagcgtaaaatacttacagaagaggcacttagtcctcacaccgaaacaaaagcagcagcagcggaaaaaaaacgatcctagcgggccttcagctccactccacaggcaaaactcaactggggtctgagccttggtcctctaactccatcttcagctcagaagcactacacttctgaaaagggggaataatagcaaggctgagtacaaccaccgtactcagcaagccacaccaatgatgcagacgtgcaaagggatacaaggatggtttgtggctatttgcataaaggcggttgtaaaacattttatttagcaaacagtaaaactgttgaataattaaagtaacattaaaatctccactgatcaacgctacaccacgttgaacaggcccaaccaacccacctgtactacagtgcattgggtcgatttattaagtgtgagactaatcacggtgaatctggtcgatcgcccataaccacgggcacggctattcgaatagttttactctggccagaggtgcacaactgtacccataagacacaacccaccaacatgtcaccgcgtcatcatgtgcccatgatgcacacgtcaccgtgtcgagtgattgtgatgagacccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggcaagcgctgtaagtcttccagggtttcccgtgaaccggtccttaattgccatgggtgcgactcacaaaaccatgcacccacagcccaccattcagtcgcattttagttggataattacgaccataaaacatggccagatgtctcgagcacgcggctcaacaagatactagaatgtctaatactgcaattatcccatcgactgagctagtggtaattaagcatggctaagcatatagttctagctaggtcacataagtaacacgagctagtcaatttattacccaaggttgacaaagaacagatatcaagtaaacatggcacaagcgagcagataggtaaaccctgaccccgtgtaattagcaaaacatgcatatttatttgtaaacggtaaaacatttataaattgggatcaacatgctcaaggagaatgtgtgacttgccttgcttcttcactttgatcttctaaactcttttcctcgcgaccgcggacttccgaaacgacggaaactacacgctggcacgcaaaacgaggaaaaactctaataaaaaccaagaaaacagtacataaaaagtaaacaaacatgtagagcttaattttagatgaattttgcaagttgaatggctcaatttggagttcgaatgaattagatatgaattttagaaggttttgagccattttaatgaatttctagaattattaccgatttattgcgcaatttaaatcaattatgacgtcatccgacgggggagaggtggcgccggcaagtgggccccacctgtcggtgactcacgggtggcgggcgcaccgtggaccgagtccacgcacgcgctggtccgcgggcgcaccacgtggcagacacgtggcggccacgacggacggctagcggaggtggcgccgacgtggcgccacagaggcaccgacgcgggcggcacgggaaggccacgtggacggcccagatcgccccgaaggaggatcgggcggccacgggcgagctggagccggctcaccggtcggccggccgggagcgacggcgcacggcccgatggtcgccggcgacgaccaccggcgcgaaggcacgcgcgggaggcggcgaaaagagggaaaagggagaggagacggagggggtcctcaccgaggagcgccggcgacgggacgaccatggggaggcgaccggcggcggaaaggatggcggcggccggcacgggaggcgacgggaacggcgttccgacgacgcccgaccatggcggagccgcggccgagggccagcaagacctggggaaattattagagcagttagggagggaaataggcgaccggagcggcgagaatacctcgccggagaggagaggaatggtggggctcaccggcgaccgagagataccacgttccggtgggtttccggcgatgaacaatggtgaccgaggtgctgcacggcgctgcaaggcgagaggtgaagacggagcgacgcggcggcggctaaggcgacggtggcacacggctggaggcggcgtatggtggaggtggctcgggatgcacggtggaagggtggttgcggtggtggaatggggaaacggagcggaggccggggtagatcttggcacggcgttgccgacggcgcaagcggcgaggtgcggcgacgactaacgcggcggcagcggccggctgaaggcggtgtgtggcggtagtggctcggcctcgtgatgggaaggtggttccggcggtggaggagggagatggagtggatgccggggtgcggcgaggcgctgtgatgctattggtggcggcggcgcagcgcggcagcgacgggagcggcggtggcgggcggctggagatcgccggcgagcggcggcgaaggggatcggcgtggagagctcggtagagagcgtgggggactcgggaaaacggggaaaaaggaagaggagtccacggggattgattctatagctcaagggggcgatgatagggccggggagcggcggatttcgaggggaagcggggcggcgtcgcgggggagagagacgcgggaggcggcgacgtggccggattttgcggggagagtggggggaaacggcgcggacgtgggcggcgaggtcccacggacaaacgcgcgcgcgcggggtggaggaggtgggcggaaacggcggcgacgttggacggctcgggcggccatggcggttgctggcccgggccggaggttgggggtgaccccgacaggtggggcccacctgtctgcggctcggggagaggagggaggatgagggaggcgaagcggacttgcgcgaaggagggggcaagccgggccgacggcccaaagagaagggagtaggggaaaaggagggcggccgggcccgagaggatggagagggagaagatcttgagccgaaagcggcccaaagacaaagaggggaaattttatttgttttctttttattttaattgatgcaatgatctttgtgctattaaaactatttctcgagctccgaaaattcacggaaaattccggagagtacattagggcacaaagaatattacaaaatattcccggccaatgatttttaagggaaaattttaattctcccaataattcacttgattaaattgcttaactttttttatttatattctaggaaatgcattatttaatgatttttaaacccgaacgaaaatcggggcgttacattgtcgccccttccccatcagatccagtggtcctagctcgagctctaccgccgagcccaccgccgcagttcctcctcatcgtcgctgagctgtcatcgccccttccccgccggatccagccgtcctagctcgatctccaccgacgggcccatcgccaccgctccttgtcgtcgctgaaccgccgtcgcccctccttcaccggatccaccggtcgcagcccgagctccgcccgggcctgccactgccgctcctcctcctcgtcactaagacgtcgtcgaccctccctcccccgccgcctcacgaacccgagcctcggccccactctccctccctccaagccctaccgccgccaccctacctccacgagccagcgctggcgcagatcccctcaatccgggccctaccaccgtcgccgctccctccacgagccgccactggcgccggatccactcccttcgcgccccccgcgacggcccctccttccacatgccggtgcaccttgttctcctccatgcgccgccgccgctggtacgagagagagagggagagagaaacgggagtacggaactattctgatagggttagacagggatagggttttctcgagggtattttggtctttacgaataataattgtatttctttattatttttaattcaaaccataacgatgaaatggaaacagggtcagacggtaggttcgttttagaaaagcagggtcaaaaacgcaaagtacaaaaagaagggtcagattgaaagaagggtcagattggtataggcatcgaaacggagtcaaataagcaattgtcccatactaaaaatgtttgtaggatagtaaagaaaaaagaaaaaaaactcgaatctataaaaaacatggtttcacaagtggtagtatactgcttggaagtggacgtagctcaactggttaggtttcttattgtggaatcggttcatccaggtttaagctctagattttatacatatactcgtatttacgattattattctttcagtggtagatagtgaggcatctgttgtgactttgttagtctcgagatatgtcggtccagtctatgtgttcatagcagtgactgtgtgcatgttatgaacgtctactttgtactccctccgcccctaaaaaatcaatctattatcaaacgtgacacattctagtactaagaatatggacatatctttgtccaaatttgttacagaaaccaagttaaacttgtatttttgagttttatctatactaaagtaaaaaacagagccgtcatcctcctctcctccctaaccatcacactttccccacactacaaacataaataactggaagggtcaattaggcctggagtagggtgaattggtgattaattccgaaaatcagagataaagaaaaaacataaagtcaactagatatagctaggcactagtaaagtaggaatgcacaaacagagtctacaagcggtagaagggagaaaagctagaggagtaagagaaggatttcaccgagattgttgcaagaccatgtgttcccgaatttcgaatccttgaggggattctactattcattgaggatctcacaaagagtagggccttctccaaccttttcctagaggttgcacaaatgcattcctcttccactactcgtatcccttttcctttcggagatgagatccggcctttacaaacttctgtgaccaaccacaagtagatcggtggctcaaaggcaacacctagccatctaggagtcctcaacctccaagagtaaaagatgaagcaaagatctcgtcgagatgaatcaagtgcttaacaaatcttcatgaagtcaataccaagcactcacacaatctctgatgatgctctctctcgtggcccgatcttctggtgagggggataactcttgctttgattgagtgcgacgtttgcgacatggctaccaaccagaacaagtccaggacgtcgtgcaatcgctacaccacaaatgatgtcgtaccaaccgtgacgcgcggttgatgatccctgcaatgcaaacgagagaacactgcaagaacaagataagatgcaatctaaatattgtgaataggtgattaagtacaaagaaatagttgcgattgaagtgatagatctaatcgacccagcaaatcaacacaccaactattggggactctgaatcaatagtcgctgactaatcaagcgaggactagagacaaagtgaatggcacttggcaaaattcaactaaacaaaacccaattgtttttgatgatgtacaaagctatttatagaggaaaataaagctagggtttagtgctaattcgtggaggtgggagacacttccgagatgggcctagtctattacaaggcccaaggcccaagatcggtttcaacaacagcactgtcttgttttggagattcccgttgactcgagatgaatttggacatgagaccagatgcgtttgaaaggtagcgagacaagctttccatgaagtccaagatcacccaaatcggagtttgcatgaaagcgctaggtccatttaaagttagtgctgtctccggaggccgaactggacttggacttggaattatcattggaacgtgtgaagttatgagtgtatccgacgaagtgatgtcctcatcaatctcaaatcaatcactctctctctctctctctctcacacacacacacaaaaccaaaatgagaaaacaaggctcaaaatgaatctcaaagcaaagcaagccaagggaaaaaagttttcaacggagcaataaccctagcttggaggtggagggggctatttataaaccgtaccctcgtatctgcctattttgaaggggggagtgattccctttttagaaattccgaacaatataaagtcacaaaacctagacaaatcaacattgcgaaagttccaaaaatattttcggaagatttgaaaatcaccagaagcaaaactgcactttcgaaaattacgaaatgaattttccatttgaaaaatcaccggagagcaagttgttggccacgacactttcagaaattccaaaacaaacttccaaaaatcaccaaagagcgaattcggagcttttgaaaatcacttttggaattttcaaaaattaccagaagcaaaatttcaagaatgagaaatacttcaacaaaggttttgagcaccaaactcattcatagacatcaaggcaacatccctcttaataatacgactttgctattgattgtatgaaaaaaaattatattttaccatttgaatctttgccttttttcatatccttgcaacacaaacagttatggccttgaacatcgactcatagaggactcctctgtaattgcttcacatatacttaaataaaaagttagtcattactaatcgcattgtcattaaccaccaaaatgattaggaacctaggtgcactttcaataaccaatctaccaagaaaactggtgatcctagtaaaaatcgatccaccgaaaaatttggatagaaaaaatgaacacccttaagatcatttattcatctttcccccgaccccattgttacacacgaaaaattgaacacccttaagatcacttgttcgtctttcctccgactccgttgttacacacatgcatggcactagggatgaaaaacagatggaaaaacagctctctaccattttcgtttcatttttttaatcagaatagttatcaagaaccccggataaaggttggaatcaactattatcgaatacagatacgaagcgaatgcaataaagattatttattggaacataactctaactggccttctcaaatcaacgatgagatgtagctcttttttttaaaaaataatatatcaacatttctattttttttatcaattcatgatacaactagttgtacatttcactttacataagaactacaataagcaagaattatattcataagtatggcctggctaattaaaaaaaagtcaatgcgtaaaagaaaaacatattaaagcaccggattagaaaaaaatatttccattcaactaaccacctcaatactcactacagttcgaaaactttccgaaccattttcatccctacatggcactagtttttatactacatatatcccaaaataattataattctaggttatttagcatatattgaggtttgaaagaaaagaaaagactatggtgccactcataaaatggtgtataggtaagaatagaagggtaattgagggtaaaatcaaaataaatttgaaggagaagtggttgttggggtaattagtagtctagtgtgacaactgttttggaataaatttaaattctagaaatataattattatcagagtaaggtagtaatggattagaagcgtcttgggtctgctactttgtaactccagaactagagcatgccattccacccttttttttatgaatattccttccataaaaaaagaatctagggctaaatgcgacacgttgtagtataacgtatgtctagattcgtagtactagaatatgccacatacaatactagattggtttttttagagacggatgaagtaggtatatacaccctttatgccaattgggttttatttatcaaaaaattagcgaaatgatgtccatattatctcctgtccttagttgtttagtccgcgactatattcaaagcatccaatagtgtatactgatttgtagggttaattagatgtaaatttcaatatccattattatcctcatgtttaattagctatttgcggtattgagattttatctgacctatggtttatacgatattgcttatggtgtggcattgtataacgtgctatacttgttctgtccacttcgtcgacgccgaattcgatagagcaaaagttatcccctcatgaaaggttaaggccacgtctgtttcaaattattataatctaaatcattaaaaataatatgaaataaataggtaaattattatgatagattattataatatataagctggattagtataatctggtaatatattctaaacgtgtgttttttcagattattgggtggctaagtacccaccacccttaaaaattttatgtaaattaccaaccaccgctatgaacccaacagatgaagcgtatctacttcctctctcccttggccgtgcgtgcatccgcttcccctctctctctagtcgtgcgttaatccttccccaagcccccaccctgtgcgtgaatccttccccaagccccacattgcgccccggcttcttccccaagccgtgtgccaccgtcgtcgtcgcgtcgtctcatcctcctcccactccgcaatagccgcgggcatccaaaatagctaagagcattaggacatcaccaatatatatagcaaaagtggtctatatagattggacccacataaatgaactttaactatgtcaatcctcacaatgtatatggatacaaagtaatattagaagaagagagaaatatagatagataatattatttatttcatatgggtagtccatatgcatatgggtacctttagttattttctttatatggactagttaaacaatgttattaggtaactgaatgaaatagtttatttcctatggactacttgtgtgctatattgtggatgcccttataaatattagacttttaaaccaaataatctatgcctcccacaatttagagaaacgaataactcgtaacttattctactgtagcttattacaatctagtttatagtaagctgacttaataatttagattataatagtcttaagttggaacaaagtgggcctaagccacaacagtgagcgcgtcatcgctaaaaaggagaacgagagggcttgagccggactagcttttgctgaattttactattgttgtttgatctgtatttgtaggtgtttccagcgctgcccgtccatgtgtatacttacagcgttggtagacgtgcgtgtcgagaaaaagaaaaccaaaagcagtagtactacattacagcgttggtggctttggtgcaccgctctctcaggccgtttgcgccactctccaaaccgctcagcagaggcaccgatcgagcgagcaaagtcgacacgtacaactcctcctcgggctcgcctagctgttgatgcgaatcacaggcgtcacggacgctaacggagagcctctctgcccgtgcccgtgccgctcagcgtgggcgccccacaccatcaacaggaaggcgcaccgggcctccaccagtggatcgccaggcacgggcgacgcccccgcgcgcagggcaaccggcaaccaattaaccagacgcgcggcctgggcggacgtggtggtggtactgtggtggtggactgactggcaacggggcgctgcagcgtgcgcgtggcttggctgacggcgcggaccccgttgcgcagcgagacagcctggctgcctggcagcttgcctcggtcgcgtcgcagcaggtggcgtttcccgcgccctagaaatgcgtcgccacacgtgtgtcactggcaggtcggctctgttgaccggacctcttcctccttcagggcaagttttttagttgggtggctatcacatctaataaacatctatgtgagatacgaggtaatatatataatacatcacatccacactacctctagcatactaacccaaatgatttttttatttgtttgtccaatcaactcttcccttcatctctttttttttgggatttgtgtagaggttgccccttacatgaggggtggctcacattctctttcctcacttatttcttccacctcaccatcaaatcctatgtggcatatttaggggcaacatatctatcattatagtacttaccctgactagacggacacgtacacgaattcgttaggagtttattcctactttcttgatgaatgatgatgggaaaagtttaaattaaacccctaaattattgggtgagtacgagttacccctaaatccgaaaaccaaacatgtttcacccttttcaccattaactgtcaacaccggatgccccccacagccaccacatagctttgcaagcggttttggtcctatatggcagtccaatcagcaattcttttattaaaaaacgatgggggttcacatgtcagatctctcttctctctatctctttcctctctcaccctcccccctcatgcgtcagatgccgaggatgagtcgtgcgccacgcaccggcgaaagccgaggacaagccgtgcgtcggtggaagccaaggacaagccgtgcatcgacagctacaagcgtcgtcgagcggctgtggaggaggggcgtgcaccggcagaggccgaggaggagctgtctccgccgctcgccgtccccactatgcggcaccacctccgtcgctcgccgtccgaaccgattgacagaaggggacggaaaagagagggggcgcctccgcctccgttgcttgccatgagatggaggtgccgctgcttgtcccgagctccgccttccgcccatccccttcgccgccccgagctccgcccaccgccatcctcgactccccctccgccgctgcttctcggtgacagagagatggatgtgccgctgcttgtctcgagctccgcctgccgcccatcccctctgccggccaccgtccttgacagagagatggaggtgaaggagggagaggagagagagagagagagaggattttggaagaaagagatagagaggtgaggggaaagagggagggtgagagacggataggtggggcccgctgattaaaaaagaattgatgactggactgctacgtagtaccaaaaccactccggattgagttagggggggtaattcgttcagtattaatagttgagggtgaaagatatctggtttttgggtttaggaaggtaattcatattcacttaatagtttgggtgtaattcagatcttttttttccaatgatgattgatgaatgcgttaagaaacaagcacagagtacagattggaccaaatcctacgattatagcgtcatcttctaccgagcacaattactactgcataatcctatatttgtaattgatcatctgtaacggctcgggtagcatccttcatgacgaatgtcataatttgatggttcgaaccgacaactacaaaatctaacctattttgttttttttatggcaaaatgatatcaaacccacgtacaattcagtatgtgagcatatggcgtataccatatatgggttatgtatgtgtgaagcatggcatggcatatagcgccggtattggaaatatgaacgtgcgctaagaggaggcatgttcctgaacatttgcttatatgtctatatgcctatgcaggtaagtttgaccggcagagacgttaggttctttgataggattatgtgacatcatgacctaattagggtgtgacctataagtgatgtgtgcattttattagtaccacattactagttgagtaagagtaaaccaacttatataatgtcttatccctccaatcatatcattttttttgttaaccttcttacacaaagcgaaaacaaaagtataagtatgttgttatgtgtcagtggatctaaatgttagatgggttggactgtgtggtactgaattgcgggctattacaatccatgtctaacaacccaagaatcaggggggccttgggattcataatttggaaatacaaaataaatgtcttttgagtaagtggttgtataagttaataaatgaggaaggggtttggcaggacttattgaagaggaagtatctttataataagtctataacccaagttgataagaaacaaggtgatttccattttttatcggggctcatcaaagtcaaaagtactttcttaaatatgggttcttggattgtgaatgatgggggacaaataagatttttggaagataaatggctagataacttggctttcaaggataaatatccatctttatatgctatattccgaaggaaatcatcctctattgccactatcatgggatctgttccgcttaatgtttcttttagaagaggtttagttggtcagaatcttgtatactggcatgaattgtgtacttctattgtacatattcaattgaatctttcttctgattgttttagatggaattatcattagaatggtaggttctcagtaaagtgtcaatgtatctagctttaattaataatggttatgttgagaagaataagtgtatttggaagcttaaggtgccgcttaagattaaaatctttatgtggtacttgcttaaggggttgtgttaattaagaataatttggcgagacggaattggaatggtagcttgaggtgttatttttgtttgaaaaatgagtctatccaacatctctttatggattgtcattatgcaaagttcatatggagagcagttcagttttcttttggttttaaccttccaactagtatatctcatatttttttatgggtgacttttgcgggttgacaagaaaaagagtaaactgatacttgttggagcttctgccatttattgggctctatggttgagtagaaatgatatggtttttgacaaatcaccatctatttcctatatgcaggtaattttcagggcaacacactggctttggttttaggcacaactacaaaggtgtgatgatgatggggagattctaaaagttgtatgtcgcaagttagagacgatggtcatgtaactttttgtcaattatggatggaggttcacaaatagacttgaataaatgtgttctccttattttggcttggtttcctctgctttttgtttggtgtgttctattttatctgaactacgcttttttctggagtgttactttataataattggttgtagctctttttaagtaaaggccgggatattatattacattatctaaaaaaatgtctaacaattcataatttctgaaccgttatatggtcttaaaccattatagacgactgactggccaactgttataggcttttcactgcaacccaactaacctggatatgctaccacaaccaaaaccaaatatttcgttgcagtcatcatacattttgatgttagtacgtcagtcacaatgtttatggtaaactacttgtcaaaacacacatataattgcacatttaaatgtaaccgggtgtctaaatagtatcgcatcgatattgtaatcacacgtggctgagtttgaatcagtttttcgatttgactactatctcattatccgtaagcatgtttttcgaaccatgaaacgatacgccttttacaaaaactttttacatataaaattagtttaaaaattaaataattttttaagtttgtaactgttattactcaattaatatatgttaatgactcttaaagtttcttctagttttgcatgccatcggaaagatcggcccaatcccctaattgaacacagccaagatcatgaccctgcattgcaaaatattcttagagtatagtatatgataagcctagctcggttgatgattacttaaccctatatgaataacagagatgagagaaaaggaagtaagcttgtatgagcgtctaggcacacaaaaggcaaaggcttgcccatgtaccgatctatggcaaggtaaggtgaaggacagagagtgagagagattctgtgaaatgacataagatactagcaagggaagagaaatgttgccaatctgaatatgctaaaatgaacatcaccataaaccaatagtgaaggagaaaaaggtggtgatgataaatggggtgcgagaaacaatggtagagagagtgtgtgacaatgatggtcaaaatagggaagagggatgatgtggcagctgatgaggggaaatggcatggcaactaattgacgtgtgtaaagagggggatacgacattagccgaagaatctcctttctccttcatttccgttgtctctagttgtcgatggggaaggagggttgaaaaagcagccgtgttggtcccatggtcgggttaatcccgatgttcctcaccatctttgttaatcccaattcttgtgcagatcaaagtagtggttgtcatccatgatctttgtcctagcggtgcctggttgtcacaatggagtagctagaggcccttttgcacatatcaaccagctggaggtctccggatctaccaacgcaagccaacctttatagatttttggtcaatgatgtggagccccattgcctctccccctcttcatgccagcttaacctcggagcaaccatcaccattgtggctgctcatgccactttcctcatgtcgctttcacgtcgtacctccctctcatcacggcagcttgatatctaagcagccatcgcttttgtggccgctccatgttgtgattgtcacgtagcttttcctgttgcccctccccttcttcatgctggctcgagctcatagcagacggatccgacaggcccaaactcagcaccaacagttcttcggagaaggaaggtgaggcaagacaatgtggcaggatggcttgggccttggggatgccatatgcttcagctgctttgctgcatggatgatgatgatgaaggcagaaacaattgagagaagaaagaggcggacatggccacccgatccgctgcctcggcgcccgttcatcacctctgcgtgtatcttcattgtggcaagcgtgggagggggaggagaaagggatggtgacgctcaatgctggtctctgaggatcaagaagactagggctatgggagagacagaggtaaaaggagttgggggacatcaaatgagatgaagaggtagtaatactatgtggatattatttataacgattaaaagtaaaagatatggaaccagatatctataacaactcataacaaagaactgttgcaaataaccttctatatacagtgactcttcgttatgagctgttatagatgaatagctccatatttgtaacagctccacacattaagagccatcacagatgtgtggtcatcactaatgagtattagcgcctaccattatcttcagcattcagtatatgcatccgttgcagattagttaagtaatatgtaacaagttttattgatccgttacagataaagggatctatagtagtgactggtttagacatcaactatccaactatatggatattatcagatgatagtttaaaaaatggcgggaagataatactcaccatttgatcgctaacttgagcataacagtatgctaaatgtttataataagagagtaacttgggacacaacgcctactacacaactttatcccatgagaggtactccctccgtcccacaatgtaagagattttgagtttttgtttgcaacgtttgaccactcgtcttattcaaattctttttgtaaatataaaaaatgaaaagttgtgcttaaagtactatagataataaagtaagtcacaaataaaataaataataatttcaaaaaaaatcgagtaagacgagtggtcaaacgttgcaagaaaaactcaaaatcccttatattatgggacagaggaagtatattaaggaggttggtacacacactcgtaactcatcgtgtttgttgattattaaccgcaaaaataaattaaattttaaagcttaatggcagagttgttttgggtctttttttcatcatattctatttttccgtattagcttttaaataatgcataaccgtatacaaaagttttaacataaaatatttttgttattcattcatgtttttaccgcttatcaaccgtagcttaactagtcaaacagaaaatgaacacgtgtagcctcttaaggctgtgttcgttccttcatgttcccaactcactctccctcgtttcccgcacgcacactttccaaattgttaaacaatgtgttttttaaaaattctgtacatgaaagttgcttttaaaaaaatcatactaatccattttttttaaaaaaaagttaatacttaattaattatgtgctaataggtcaccccgttttatatgcactgcacgttagtcctaactaagaagaatgaatacggcctaaaatggcatacctatgtgcagcctttactcttggaatggcatacctagccagtagccatccggctatgcacctgccatcttaccaaatactacctcccttctaaaatacaaaggatttggattaatttatattttgagatggaagtcatatttgtttgtaataaaatatttaaaatattgcatgacatgtagtaaaaaaatatacaccagggctaatgcaggccctaattaattttgttgagctcagtgtagaatttagaaacaattgtgtaactagaaaaagaacaggaactagtacaatctctgaaaggtagggcggggcaccgggcaccggttgttgctttctctccttttctttatcgggttcggggctggccatgaatgtgtgttgctaaggctgacatgtgaggccaaaattcgcagagacccaaccaaagctctataaaaacagttcgagtttgactacgctcacaccgagtagctaggaggggaaagggatgtcactcttgtgaaatcaaacctaactttgcttgtcctaaaaaaaagacctaactttggtagcttctgatcacggatgttttcagtttatgataacagaacattcactaaaagtacttctttttagatggtttgactgatcctagctatatagaactagaactgtagtagtttctttttttttctttctttgaaaaatctgaagtcactctaaaattcaacatggattgtagttttgttctgcaactgtcttgtaggtgtaggcatcatcactctaaaagtcctataaggttttctttgataatttatgtactatatagattaccaaaaagatgcaaagtagaaattgcttatgtcagcataccatattgacaaaaggatggtttatgtatgtatctttcatggtttgatttgatctacagattccccacacacaaacattagatagaatagcggtgcatcggccgaaccattgacaatctagccagtggcgaagctaggatttgaggttaggggggtgtggtggaggaagccataagaccgattaaccaatatggatactaaatgagccaaatagtcactaccgacaataatcaatgtgtatataaatatagcttcgttgtagctagattacaaaaccatcatatgttatgtttttttaaaaaaaggttcaaatgttcaatataacaaggcatcatatgttatgcctaaaaaacttgaattcagttctttaataatattattgaaagtttagaactagtccgtgttgctaaattctttcaatgtaaactaccaaatagtctcataaataagcattttctgttttactttgaaaagatgaaaattataagactaagtactaagagtatgactataatctaacgtgctaatggcctaacagtggatgctgcctaattgcctaaccatgtaatatactactagcagccaccgagggggggggggggtgttcgggatagggggggtgctgaccccctccggcacccccggtagcttcgccactgaatctagccaaaaagcattatgaaaggcttgaacttacaataaagcagcataatgaatcaagcagtagtctccattattaacgtcacagtaggtgcgagatgatatatgtaatacaaaccatcgcatgcatgacgtacacgatgccagtattaagattgtctacttgtctgccctaaggtgtaatattttcatgatatttatcgacaatactaattcttttaaaaattataacataattaacatctccctagaattcgacgtgagctactgtattactttgttctttatcattatgttgtaggtatgatttttcttattatctttatttttttatatatgaccccctatagggttcgtttgagaaattacatattactccctctgtcctaaaaagaatcaaattctggctatgaacctggataaatacttgtctaggttcatatagctaggatttgagtttttttaggacggagggagtatatgatacttccttcgttttatattataagttgttttaatttttctttaagtcaaactttttcaagtttgactaagtctatagaaaaatatagcaacaattacaataccaaattagtttcagtaaatctaatattggctatacttttaatagtataatagtatatttgtagtgtcgaaatattgctacgtttatttataaacttagtcaaaacttatagaagttttacttaagaaaaagtcaaaatgaactataatatgaaatgaagggggtataatttaacacccccacccctcccccaataaagtaatccagttctagcttacatcaacataccatattgaacaaatgatttatatatgttttttaatcaccagattctcagtatgcaaacattagatataatagcaacgcatcgttctgataatcagacaaatattcgaaaagcattctaaaaagcttgagactactataaagcaacataatcagttaagcggtagtctcccatattgatgtcatggtaggtggcagacgttgcatgttttgatatgtaacgcaaccacttgcatgagtgtacgcgtggtgcaatgctacgttttgtcttctctaaggtgtcaaatagagctagttttgcaaaaaaatttatctacatacgtaaatcttgaaagaactaagaaaatgtaacaattaaaattgatgatgtttgttagttttattagcactatctgatctgaagcaaaaatattgagtactaaatagaaatgagaatccttcaccatatataatacaattttagctaagtaatactcttatatcacttgtgagtgaaatataaaaaattaaacaaaacttactataaaaaaatcttacataattatacaacacaatatcaaaacaattttctaaatcacatgaaaagaatattaaaatttacacgggtccttaagcaaaacacatgattgattttatggagcttcacgccatatatgtgtcatcaatactatcttatttttactctcacactccggatataataataaaaaaagtgttttaagtactactaaacacgataccgcgccgatctattttatcctgaaacacattattacatataaaccatgcctaaaacctaccatattcaaaacacacatactaccaattagaccggctcacaccaaccattaaaagaggacattcaatataatcccacaaaaatattcctccatcccctctcccaaaagtagcaacttctaaaccctggtgtcaagtgtcaaccaaagcacaaccccccatcaacccccaaatccagcacctcctatatacacacaccccccaccccagggggggggggttgtgcacataccaatttcgcctgcacccacacctgatgccacaccaccactccccccatcttttttttttggttcctcttttggcccccaaaaaaaaccaccacgctcttcgcctcctccctccctcccccacccccgtcaaagcgagagctcggtatcaccgccctctttcccttcccttcccctccgatccaatccccccttctcctcctcggggcgctcgctgagcatgtcggcggagggggaggccaaaaaggacagcgccagcaaccctcccggggtagaagtcgacggaggtggagggnagnagnagtagaatagcagcctggctgtcggggagccggcggtcggggtggccgaggctggtgtaggaggaggagaagggtagaaggcggatctataggagcaggagggaaaggagaatgtgtaggagggcggcgtgtgtaaggatctggtgctcgtcgagaacgccgtccccgtcgaggatccggaggaaggtacccgcgccttgcgcttctgctctcctctttgcgggatttcttggtcgcggtcgggaaaatctcgcggaaaatcgagtgaactagtattggtctttcatcttgtgtgacgtcgtggagcaggaaatagttgcagtacaagcagaatagcagcagaagcaggaggaggggggagggtttggtttggttgatgctagggttggtgctagcttttgttcttgcgaattaattgtgcgaatgcgtttttttttccctctcgcgaggctgaagaaaaaactgtctgttctgcagtgcgagtgctgttttgttagctacagatttataagtgtacttcggagtccactagtatggggggatttaggcatttagtgattctttttttgttcgttaatactagcttttttttccctgctgctaaatgctaacgagtcattcaaagattgtggatactgtctatccaaaataaaagatttggggatcctgtcagtccacatatcagttttggagcaagtcttttttgaactttttctcctttgttaactgtggttgacttgtaatcctggaagacaccaaattgaaaccaaatgtctcctctctcttttttctgcctttaccttttgttgttttgctaatttttattaatacttgccatgcaaaaaggagtagatttggactttgtttttttttctatcttaattttgtcagtacttgcaatgtcaagctgctttactattcattagaattaagtactcatgcctgcatctacttatttcagggcttatgcttgattgactgtgcaaagttcttagctgaaaaaagtttgtgtttgtttggttcacagccgcagcaactgcagcacttcaggaagaaatgaaagcgctcgttgaatccgtcccagttggtgctggggcggcattcaccgcgatgcaactacaggagcttgagcagcaatctcgtgtctaccagtatatggctgcccgtgtgcctgtgcctactcatctcgtcttcccaatatggaagagtgttactggtgcatcttctgaaggcgcccagaagtacccgacatgtaggctcttctaacttgtacaataatctatgttccttttgcaaaaactcagatacatttttttttgtatgttcaaccatgcatttctcagtaaatatgctagctatgtgcagtttttagggcgagtttttaatgtaatttcaagcccgtgattttacagcagaaatttaattttatacatgcagtaatattaaggtattaaagaacttattgaagcagacctttacaacgtcatgttagatgcatataagattcaaattcttccatgtgctgtttagagttatttgaggcatttctaattgatttacaatgctgaattgagcagtgatggggttggcaacactctgcttggactttggaaagaacccagaaccagaacctgggaggtgccggcgaactgatggaaagaagtggcggtgctggagaaatgcaattgcaaatgagaaatattgcgaacgccatatgcaccgtggccgcaagcgtcctgtacagcttgttgtcgaggatgacgagcctgattctacctcagggtcgaaaccagcatctggcaaggccaccgaaggtggcaagaagactgatgacaagagctcaagtagcaagaagcttgcagtggcagcaccagctgctgtggagtctacatgattgatgcagcatttaggagctgcataaagagcataactgtgctggcaattagagttcgcttcttattgtaatcctgaaaagactgtagtctggtctagctataacctcatcaagcaagaaaagtgtctgtggaaagaagccacaaaaactttcatttagctgtcactgaaattttcagtttaggtgtatagtttgatttagctttgccgtgccctctgccttcaggcagatgagcggcattattggataaatcctctctgactgacaatatcgcattgtgactcaagaagccgatggaaggatctgcgagactagatacgaagctatttgttgtgtatcattttatatggcctgcacaattgtgtgattttgtcagttgcataacatgtggaagatccataattttatgcactatggagattcaattaccttcctgaatgtctgagcttcgacatgttattggttattgtaacttaaaagcaacctgagattcaatgtgaaagggttttagattccagcttctgaggtgtgatttcactttatgttgatctcattcttagatgagtagtgcttcaacagtttcaggtatgatatttccagtgtttgatctccatatatgatatgattgattggtgtgtgagatccatcatggttactggatgaaattctgaaaatcaaaccaattaaggtcgaatcatttggatttcactccccatgattggatcctcttggatgcatttgctcatacaacaaacacaaatgtctccattgagcatttattttgttagttctgtactggaatcgagttcaatgcttttggttgcatgggattctaaggtcactcttgaatagtagattgtttgcagacaagtcagttaatttggcagaggaagtctggtgcttttgcagcatcatttaccactgtggctgccaaagtgaaacctgtaatttgctttgtttggagaggtactacagaatcaatggaagcaagggagatttatttctgtacctggtacttgttttcttggaggttaatggtgcctgatttcaaataataataataactgatccacacataggacgctaataagctgcctagaatggatgaattttgtcagggaactgacgtccaatctgtttggatttttgaagaaaaacaacggccaggattgagtaagatggctatgtatttaagtgttataatcaattgtttcttgataatggaaatcaaataaagcctctacattttcttttaaaaaaaacaatgctctacatagaaattgtatccggccaaaggttttttttttttagaagccaaggatgttatagtcattgcgaactccatatctattgacttccttcacctttaaaacattgagatgacacttgaaatcaaggccaatggcgcttgatgattgcttcattgatccgaagttcagttttgagattttgtactccatgtttaaagcacccgtcacaaaacaagaacagtagggtaaattattgcaaaagtttagtcgtagccagtaacttgattttgaattgaacttattccttttataatggtagtgtaaattttgctgtctacagtctacaccaaccaaaaatgtacaacttggtatggattcatgcgtccaaaactctatcaccacattccagacagaacttgaaagacttcaaacctaccttgagatttgattagtcatttcacttctttacttacctaaagatgccgatgtggcagtccataaatttaattgggtagttaattacatgaaatgcattttatgacattctactacgagatgccattgcccctgcctcctgaatcacaatgccagagcggaagaactagggttatgttccactactacctaaaactaggagggcaagttgcattgcacccttggcctacttgcgatttgcattagtagaagtcctatcaccaaagttaataaatcagttatttgccactaaaaaagctaaattattcataatgtgtactccctacgtcctaaaaaaagacaaaccctgggtttccgtgtctaactttaactgtctgtcttatatgaaatttttttataattcgtattttcattgttgttagatgataaaatatgattagtattttatccgtgacttgtctttttaatttttttcataatttttttaaataagacggacggtcaaacgttggccacggaaacaagggtttgtctttttttgagacgaagggagtaggtatcgatgatatttcccttcacccttcttcctcatggctggaatgtcagatcaatgcgcatttccactcattttggtgaaagatcagggaagaaattgcagcacatctgtctttgctgtatctagtgcttgttgcctgctgctaacattattcatttattatttatggtgtccgttctgagtgcctgaatttatgtttgcacttctgagcagttcacaagtactgcacagcgaggagtaaaccaaaaatgaagtgacagctacttgtcctgcaatatcctcatttgattttactcgtgagacatggaaataccagactgtcatttcgaccaagtgatcctgataagaacatatggatgcattaagagccatgttggcaacttggatcacgtattgaacagtatgcaaggagatgctgcctgtcaatattgatgctagtactttcttctgataagtgcattttctgttctgatgaggatcacaatcaagaaacagagtggatgaagttacattacacggaccacggttcaataaattgatggaagttgatagttgtagcagcgttatctacaaacatttatgttctaattaggatcacaatcaagaaacagtaacagatgtttccactcgagaaagcagcagattacgaatttacattgcaccacagaccacggttcaatacattgatgaaattgatagttgtggcagcactttctctacaagttaaaaacaaaaacaaaaagagaaaaaaaaaagggggagtgtttttctggttctctattttctctttacagttgttgcagtaccctctctcagatcaaatgtagtcaggtagcagacactagaaaccagattagtagcacctctgtatatatatagtacattttaaggaaaaactagcaccaaggtctgatccggagtaggatctcctgtgctcatcaagagtcaacacagctcatcatctgcttggagtttttgaagtgctttcttcgcataaatagttattgcagcggtagaaactgcagcaactgagaagccaaggccgttgtaaattatctgatctaccgacaagaatgaaccttgggtagtagctacggctaggctttggagaagtttcccactgttatcacaaaattgaacaggttaacactagataataattcagtaataattaacaaagtgcgtcatatctgaataacagaacagggtgcaatgcaagaggtacaaacctgtatattgcaaggaaggtttcatgtaccgttccagccattgaaccagcaatatatggcccatacttgacatttgtagccacagaggcatagttaaaaactagatatggaaatggagagatcctaagtaaggcaactgctctaaattgatggaaccaatccccttcaccagcaagtctaacaaaagctgctttcttcggccacttctccaaccacctctgcagaacaaataccattacaattttgtagaaaaaaagaaactcttgaacttatatgtgtaaaatgtgaaggaggttaagatactcacgtgtattttagaatggaatgcggaccctataaagaatggcaacgacatgcctatgctcattgctgctgtaattatcaaaaagccatagaaatatccaaaggacatccccgccatccacataaaaggagaagaaggtagcaacacacttgggaaaaaagcgattgcgccgaaacatatcagagcaatgactggcctgctgaaagttcttgactcccattcaataaccggagcaatcacctgccaacgacagcaacatgcagaacaaggtcagcaagacaacaataggagacttgcaaaataaatatcacagcatcacaatcaacataagcataagtaacaaggcaatcataagagttcaaatattcattggattggacctagtaaaaatgataggcctttctggtttccagtcagatcatgcaacaatatcttgataacataatatcaagaaccagcagcaatttcagactattcctatcagttccactttcagcgaaagcacacagagcatcaaccaacacagaccacttgttagcccatgtcaaaatgccatccacaagcaccgactggcatttaactgaacatcttggctcattctgcccatttaacagacatcgccatccaacatcctgatattcctttctgctacgagtgatatccttgaatacaaatgaatagttatctaacgagccagctatatcaccaaacagaaaactcgtcatccagcaccagtgcgatatataggagccataaaatacatctcatttactctcctcctcctacaatagccaaaaacatgaccatggaaacagaccaggggaaatattttccttgtaactacttctgggcaacaggctggccccaagagattgctttcaagtaacaccaacctgcgggtccagcccccaaacaccagcacatactgaacttgcttgttgtgtccattccatgtgctcttgtaggtatgcttttggaagaggtgggctgatataatttccatgttattgagactaacgaacagttcacttcctgacagccaaaaatatcaggaaccaattgctttgtgatattattcctacccatccacctagtagtgaaagctccctaggccaccaaagcaccaaaagcttgcagaccccacatatagagccactgtgcaggcccagcataccaattgacaggctctggccagtattagctgattgatatttgatacctccgttccttgcaaagaatatttactatatattacgcatggcacagtgtatataatccatatccccaattgcgacgttcccatttgatccagccgtccccataactttatgagaaaatctatgaacattccatattccactagtaataattcagatcctgcaggccgctataacttatttacttttgtaaaactatgtggaactaatcgtccagcaccaccaccattaatcacttcctccaatccatacggtggtaaaattgaattaaacatctataaattattcatttcgaactagacagaactgggctaggataacaatccaggcaaaaaaaaaacagaatcaatcctaaagtagttcaaggaaagaatagcgcgaaatcaacaaaacatgtgcaaacatcaacgagcgagaagcaaagtaaactaggaggggggtaaatttgcgaacgttttgctagcacaaatcaaatcgattctacagcaaacatcctgagcagaatttgaagaatagaggagagatctgaaacatcggtgaagaacccctctagtcggcaaggaacctttccccaaccaaaaggggaaggaaggaaggggggaggggagaaggcggaaaaggcaagctcgcacgcacctttttaatgacgaggggtccgaggaagacgacggcggcggcggccgcaccggcgaggaggatcccgagggcggcgacctgcgcccaccaccggatcgcgcgccaccgcagcacggcggggcactccccctccccctcccccttccccgcctccttccccaacccggcctccacgtcctccgggatcctgatgtactcgccggcgccgcagccattggtggcccccgacatccccatcgtcggctcgtcggtgcggacaaggtgagccgatcaggcggcggcggcgacgaccatgccccggaggaaaaaaaaacgcgcagctcgctccccgccgccggatccccgctgccccgccggtgtgggtgggtggggaggcgaatccggctcgagctggcggattccgatggggctgggaggctagggtttgggtcgcggaggcgagggcgaggcgaggctcgcacgcgcttatgagggggagggggagggggaggagagaggcaacggcattggagcggagtcggagaaagaatacagtacagcctttttttttctttatttgttttcttttatttcttctgtggatattttaatggcgtttcggttggaaattcggaaaggggaaggggaaggggaaagggcaagggattagagctctggattgaccagtttgccctttaggtgttgtatttctacccgtgttcgtcccaaattaaaggggaaattctaaaaaaatcaaaataccattgtgagtttgagattctgactcgtatgactcctaaatttagtttcagaaattggatctggagtaaagttgtggagtagtctaaactcagctgcatatctctagtttattttgaaagcgatccacccagctccgctcctattttacatggagctgaaactgtttggctgggctccagctccaggagagatagatttagagttggagctacaagcccctaattcatcttggcttgagatttctttgtatttggtgttgctcgtgtattttttttcctttgttccgcatgtgttatatgaattagtatatctcttgatggacatgactctaaacacatctgacccatgtgaccatggctactcgccaattagtatccacacgatccatgtgtggggtttgtagctccgagaatagccgagcaacggtaattgagagaatctcaaataaagattaattagaaggggctatttgcaacaaatactcttgtaaagaagaatctcaaactcatgataacactcaaggtggttttgtaattttctccaaataaatcttttttaagtttaaactttgtttcaaaatttatttcccacctaattatttttgaaagagggagtatgtccgaggtccattcgaatttaataaatattttactcgattatacagataaattaaatattactaatattataaaccaaacaaataacttagataagtgtctaaacaatgtaatataggaaagatcttttgagaaaatatatatttgtaatacatttgagcaaaggtatactaatgctcaaatgtattataaatggtccattacttttacaaatgttttacagatatatatcgtcaaatttgtgtgggaaaagatgagaaaaacacttatataaatattctatatatgttgatgtgttacaatgggattgactcttattttcttatatatatatatatatatagcttccaccaaatcaaatcaaacggctaaaaagtatatatttcttagtatgagttttgtactaatgttttaattacgtagaacactgctttattcgtcgctagatattgttcatccttgaatttgatcactttctttgattattacttcccctgtttcacaatataagtcattctaacatttcccacatttcatatttatgttaatgaatctagacatttcccacatttcccacagtcagtctagattcattaacatcaatatgaatataggatatggtagaatgacttacattgtgaaacggagggagttctaagtttatattgttgaggtgatatgtttcgaatttttaccgtctaactcaagttgtgtgagttgtgacacaaaatatctatatattgtgttaggtagtatccctccgtttttttatatttgacaccgttttttctttacaaaagtttgtctaattattattattattattatgatttgttttatcattacaattactttaaccctgacttatatttccacacatctgtatgattttttttaactaaaacgaatgatcaaatgtaaatttaaagagtcaacaatgtcaaaaaaaaaacatgggggaatgtatgttttgatgcgaaagagaaacataaagataaatacagatctgccaacctaatttacctatcgaataaaagcctagctcatttttggaattgtcacacgtgtatagtgcaaaccccacgagtacttatatagtttagttcgtggtgaccgttccattgacacagccagggtgccagcatgaagtttgcatgacttgcacacatgagttatggacgtcacatgctttttttttccaggtgaaaatacagggcagacttgaccaagaaaaggccatggccagttccgtaatttcgcacgattaattaccagccattttcccattaattaaacaatcaccatatatcctactactactaccactgactgggaacgccccccggtcatgaggtgggcccacgagtccagcgacgaggacctcctacccgtgggcccacctgtcagtggcggtgggcagctgtccgcccgcgtgaacgaagctcgtttggcccggtcggccgaaagcgaccgcccacgagccgcgccgggttggtcacggaggcggactggcggagtcaggctcagaccacccatccgttggctattttcacttggagtctagcgctgagtggatgacatgtgggtccggatagggcgggcccgctgttgtcagtggcgctgggtcgttgcgttgcgttgcgttacctcgcgggatacggcgcggtcaaaagtcggattcgtttcacttcgccggctcgctcgtgcggccgtccaaaaaagtgaatgaaacaaaatatatttaaatttttctcattaatttcactcggtttttttttcttctttacttttgagattcgattctatggcggtagggtagaagccaacacgaaatgcaccgccgcgatacacacggctggtttattttatcgcaaaatctaaaccgagaagcctctcggtttagtcttacagcgcgacaccgctgaagctattactctactcaaaatatattagtccatcaagcaaatagtaataatctatgcttcaaataaaattttctcttaaactactcatccgatctacgatccgattacaccattgtgttcgtaacaattaaatatttataacaagatctcacatgattatattttgatgaaaaaacttgctctaatatggcatctcttcttccttttctcctgcaagcaaatggtgataacttttgtactcccgtgcccctatgaattgtatgaatagaaaaaatagaggaatagaaaaaatataagatttttaacataaatataagtgtaaaatagaggattacaaaacacaaaaaaatactaaatgatcgtttgattgaaccgtatgataaagaaaaaaaatgaggagagataaaaactcaaaggaaatatttcatgaggttctgcctcatgaaatatcctccgaaacttacctggaatgagacatttcataggatgtcatatgatttattcctagtaaaaaaataaaatcctccaaaattcgggacatttaacttattgccacttttaagatgtggcaattaattatttatcactcgctgtctataacatgtggaccctcatgtgtctatgatatgtgggtccagtggcaaataatttagcaccgctcgtaagagtggcaaatagttaattattccccgaaattcctataatttttctttgaatcgaagggggcctaaaaggaaactttccttgagattttacctcgtgttaaatttctctcaaaacttacatggaaagaggcatcatagaaaattcataggattacatacagttattcctttgattcaatggttttatagaaaaaatttctataagaataaaatcctctaaaattttagcctaaaggtacgaagcactgtgcacatcaagtgcaggctgtgcacacaatttttccacaagtccttttcaagctaagaatcaatgtcaaactccacctgataaaactccaccaaaagcatcgggtacatccttgcttggaagcaagataatttcgtctttaaaaagaaggaagcaatcggatttcatattgaaaaaaaagaagcgacctaattaattctgatccactttttcgctggatctgaaactgaaacggatggttggaacctaatttcctctgcgcctaactcgtttttttttttatttttcctaccagttgaagcagcaagtgccaactccatcaggctacgtgtgatgtgagatggcatggcttaaaactacaggaaaatttgggtcctgaaaaaaaaatgtaatactaataatgaaaagggacgacaccaaatcatgccctggctgatcaattgattgaacgtgctacagatcattgtttcagtcttcatgacgccaatccattgttaatttatttattgatcaatatcctctcatataaaaagggacagtattcattgtacaacctagtttcgatgatgacaccatgtggcttccaatgatatggaactaacaaaaagaatgttggctttcatggcaaaataatgaccgaactgaacttgaggactgagcttaattacttgcaacttgactagttatatgaattagaatttcagtcatcaagtgcaactccctttgtaaatatttaacatgtaagacaaaaaatagaaaaaaaagttaaaactcttctcaaacgattagttaaaaaagaacatatatacacatttatcttaaaatactaggtgaaaccccgcgcattgctgcgggaatttagtatgataacaataaaaaaataacgtgtaagatagctagataacatcaaattaagtaaattaatgtggtttatgataattcaaatttaaatagtatgtagaatggtgattcaaacgtaaaaagtaaggtgttatgactttatggaagaagaaaagtagagagatagtttggaccgtagattaatcatctaaaggctaaaaacaattgatgtgatatgacttaattagaggaaaaaaggaaaaagataattcggaccatagattaatcatttaagcactaactaagtgaggatgaactatataagtatataggatatcataaaacataataaagatatacattgaaaaattatgtgaattatgttggatgataatttaatttaacatgtttgtatttgaaaagctcttaaattataaaaactataaatatatagcatgtttgcatgatgtttaaatatgatgattgttagtggatgatgatgtggcatcttgttaattagtggatgatgatgtggcatcttgttagtggatgataatgtgacatctttacatgttaagtttaaggagttagtgggggataactttacagtaaaataggattctatcaggataacataaatttatctcaataatcaacttatattttttttattaaccatcttggttggtttgtaattgttttctgtgtatttgagcgattctgattctttcgctgttagctcatacttaaggcctcatttgatttgcatgaaaattatagaagcatatagtagtagaaattatttgggccaatggtttgtatagatacatcagtattttgctaatttattgttaggggtaattttattttctttaatcatactgttaacaaccaaatttgatacctagattcgagatatgaaaacattgctaaaatttacaaaggaccgggtttcctttatgaagccagtctaaccgccgcctatgggctgatctgaccgatgatatgggtctagtttgactgtcggtatgtggccgatctgaccggctaagtctgaggccaagttgaattttgtcgggtctcaggttttcttgcttttgaaggtatttttcgagttataattggtctctaccccgagtttaacatggaggagatcctgtaggagacaagaccaacctcttttataaaggctatggacggttcaattggacacacaatctactttcaacacaattagccaattgaatcgttttttcaatatcacatctacttttgcctagttctagcgtagtttcattcatctttatcgatttacaccgtaaatcgtccgccttcgctacgagagtgcgaaatccttttgtagctttgtcccgtaaaccttgtttatccttgtttatccctgtccgcccacgaaactggtgtttatccttgtttcatctaaattggctttgctagccggtttagttttaaaaagccatcttgatttagtttttgttagattgaggtgattggcggctccatattatcgcaagacgtttaggtgttccgattatgattgtcaacttgccaaaaaagttaccaacacgtaacgtaagtcacccgtatagcagcgatggcgactcttcattctcacgtcgcctcctccatccgtcgctgccattgctgttgccatttgatctccctgtctagacgacccgagcgcccaatccctgcataggaaccatgactggcgtcttcgtatggcttaagtttggatttgcatgcttaagtagttttgccctgttggtccatcccaaattcgtgatggcttcatgttagggttgtggtcaatttcaggtagcacatctacaatttggttcatctctcaaacttgtttgcactcatgtgatctgttaatcttctaaatggttgaaaaaaaatgttatttctatcttagcccttgtctaaagtctgaacttgttttagaacaaatcatattgtttctaaggcttctgcatgggttttgctctagtatgacttaatttggcctttgttgatgattctatacctatatgtggcactataaattgcttcaccattaccgccatagattggcgttataaagggggcagtaattcaggattaacgtcttgttaagatggttgctgcaacactacttaatttcatgctcaaagtcagagataaatgagacgctaacttctttggaaagtacggcctaacttagggtttccaactgaactaagacatgtaaaatcactttacccctccaagtcagcatttctacgggtgattctatcctcctatgtttctatcagcattaattaaggtagtagtataaatggatctgaaactttcgataagaaatgatcaacggcttagatttaacttataataccagtagagagcaccgtagcaggcttttgaaataaataattgaatcctatctatttatttaaatatttatggaatgtataatcctataaaaattttgagagaaaattagcaagagcttagatctctttaaaaaaaatcttttgagtatctcttaaaaaaatttctttgcgtccatttctctctatcatattctgtatttttttatgtgggctaatcaaacaattatttctgtaatttttttcgtggtttgtaattcattgttttacacattctatgtttttttatatatttgtttttaatcttgtgtttggaaggagctgcccttgaaggaaattccggtgatcccagtagtgcgagcatagcggatttcccaggttgcaacgggtcaacggcaccacaaagtggacactggacagtgacacagtggagatctgtcagcatacgtgcataaccattactacgtccattctgtacggtgatcgatcgagaatgtacagtacaccggacagcgagccacatgatcgagcagatgtagcgtacaatccacgtaccgtcatatccggctccaggtcccctgggcctccgttacagttggcgatcaaaggaagttttccacttaaaaaagaaaagaaaaggaaagaaaacgatcagacaaggaatcactcatcggcaaccaaaaccagacgcaaacgccaaccccggccacaacgaacgagcgagcgagacagctgctatcttcgtcaatctcgtcatacgcctggtgagtgcgcgtcgttgccgtttttgccccccaaaatccgcacgcaagcaagcaaagcaaagcaaagctagcgtgcgtgacgtcggggctcggctgaacggccaccacgagcacgagcgaaggtggcaaggcaagagagcacgatcgcgtgggcaacttggccgcgccggcgccgtagccgcaggacgcatgattggtttgcgcgtttcgttcctcctcgtcaagccaggctgtggccgcgccgtaggttggcgaggccgcgagatccaccggggctcgtgtcgtcctggcgtggttggttggggggttccggtgccggtttgtgacccaccgacagggacgcgttgccgatccaatggcatatcccccgcccccggtgcggttttagggaccactcggatgctatactaaatttgtcaccattcaccatacttttatgccacacttatcaccttagctactaaaataggattatgccacactctattgagttgatgacatgtggggccataatagatgggtagaaatcttaccacaaatatggctatgaaccaaacaatatgctaacttggtcaaacttgcataacatgaggtgtggtaatctttgtcaaacttagggagcaaaccaaacaaccccttagaccggtctaccatctcatgtatagtacgacgatcaaccgggccgggtcggtctgtctgcttcgcacatgtaaggagcgtgctactccatccgtcctagaactggatgtgacacattctactataacaaatcttgacatatgtatattcaaattcatagtactaggaattgtcacatctaggactaggttgattttttatgcgacggacagagtactagtatagtacataaaatgggccatgattgattgaaacacggtacaaacataggcgttcacgatacgtgtacgctcacctctataaacgtatatacgtacaccctatctctgcgggtagttgtagtatgcaactgttacatttactttgctaggccaaatgatgaagcaaggtatatatgttctgaaatgaacaaaagcacgtgtgttagatgctcgagggagagcggtcaaaggtatcaacgcgagattaaaagccaaaatttttggcgccggacaaattcattttgtaaatgcagttaacgtttctcaaatttggtgaatacctctgtattaacattcgtccgagtctactgaagcatatcactaatttacgactcaatgttaaacctcgtaatagctactaaatctgtagaggctgctggagggattgtcgacaggtcaggcaatgtgcacatctcaaaaggtccttggtgcagtcatcgttgtatttgccctggttccccatgatttcatcctccagtaatgtgttatcaaaattgcatgtttgtgttctttatatatctttaattacatcaagatcaatcctaatgagatgtgtaccggggaatttcgattcctcctatatatacattgtgctcaacctttaatattcttgaaaataagttccactatcctttagaatttttcacacttcatgttttatccattgcttatgtattctttgtggtagaatgaaagtactcaagatcgtggtgtttttttgtacttgatagtaaaatagaagggatttcccatactacttaatttaaaaatttactgctaagagatgagtggacagagtagaaaagtcactcatttttcatgtgtacgtgtttgaagcctttaggcccccggtgttaattttggtaattaatgacaagcactaattgtggactaaccgttgtctttgagctatacattttaagttaggtccacgtcatatgtgcgcatggatgattatcgatggattaaaattgacggcgcaaagcaaaggggaagaagacggtaaaactagcgctttaatttagaattgatcgaggtgtagggcgatcaaatttgctagtttaattttagtttcgccgtactattaagaggggtaatgacctagcaaagagatgattttaattgccacattaggtcattgcattttcatttgtgctctctttttcattacacacatattcacttgcaaattcactgggttcggcctgaccaggggcggtcagaccggccacatagtggcggtctgaccggcgtgccctgcccggtcagaccggctacatagtggcggtctgaccggcggcactttcccggtcagaccggccccctagaggccgagatggtgctgctcgggatggccgatacagagccgatggagccgtattcggtcagactgagccgaggccggtctgaccggccaccccatgccggtctgaccggccaggccgatggggccctctgacagggctacaacggctagttttctagccgttgcaaagtagcacggtctgatcggccacatacctccggttagaccggcagagcacagagttgggggatttcgcccccaacggctagttttggtgggtgggagtataaatactcccccaccagcagcaagggggctctcttggcacccaattcaattgcatacaccccttgcacctctctcacactcacttgagctttgtgttcatccatctagtgtgttagagagttgtttagccaagagtcaagtgcatttgtttccattgtagagctagtgtggcacttaatcatctccacaccgggtcattgcttgttactcttggaggttgccgcctcctagacggcttgtggaggagttgcccagtgacctctacgagaagattatggaggaggcccggcgccggtttgtgagtggtttggagttcaccaccttcggagtgaaggaagaactaccccgagtgattgaggcttgggtagtcctctccgtgggccggctcccaccttgcccaccccttgacgaagggggcgtgcggtggcttcgtggttgagcggtggagttgggctcgcctcaacggggagtaggaaaccggcgagtttctgaacctcggtgaaaaatctcttgtctcattgtctcatttgattgtcgcatttacatttgtgcaatttacatttctagagacacacttgagatcatatcaccctaggattgcaaaacattgacatatgagcgtgatttactttcctagagatataattgagccactatcaccctaggtttgcaaaacataacttagttgcttagttagagttcaccctcaccaagcccagcaaattaggttagatttgattaggtgttatttagttttaaatcgcctattcacccccccctctagtcgacatctcaatcctacagtgttccaaactactaaacggtaccatttgcaaaaaaattttataagaaacttcttttaaaaatcatattaatctaatttttcatacacaatcaatcatacactaatagtatatatatctcgttttacgtatcttctcgatcttctttttcccactcctatcaaacttagccttagggcctctttgattcgtatgaaaaatcatagaaatcttctaggattcaaatcctataggaaaatttcctatgaaagcattgtaaaatcaaaggtgtttttaattattattctgtgatgaacaattgggcattgaagattattggttttgttatttggaatttatttacgaagtggttttggagaagattggatttcacaggtgaatcacaggtttgttatttcatatgaccggtcagaccgggcagtgtgtgccggtcaaaccggcggtgatcgagcggtcggaccggccgacgctgagtcggtttcggtttcgggttgtttgtttggatatccgtgattatttcatgattatggcttctagatggatactatacgtatgtaatactgttgtttgctactaataagtcaagttggagatagcttggtctcggaatatggtttctttgtttatttcatgtgtaggtgactcgatgcctcaggagagtatttgcggtgatggaccgggagtcggcttggggataagatgacgtccgtagtggtcagagatcatgcgggatacttaggctagagttgatgcacgtggttgatggagatttcatatggcatacgatggaggtattgtgtgcgtatgggatgcggagtcgattttggaaggagtccaaatttggtacgattggttatgtaaagtttctttcttgtactagagagtttcctaaggtgtttaggactcttagtatgagtttggttcgtggttttaggctgcctacctcatgtataaatagagggggagcgtgaggcttcccagtattgcttttgagagcaatagagttgagttttgagttagggtttcaagtttagtcaaaatttttgtaaggagttctgttggtgcactttgtaaacacagagagaatcaataaagttgtcatccactttaagagttcttcgatttgtgtttcaccgggtttcggcgatctaaccagcaactcaccggcggtcagaccggcggcaagcggcggtcagaccggcggcggcttcaggcgcggcaggcgacatcggcggtcagaccggtggcatccacacggtcagaccggcagatcaatctcggtcagaccgatctctgtcgatttcaagggtaacttttatttccgctaaaagttttcggtttttgggtataccaaccattcacccccctctggttggcttagttattgtgattcgatcctacaattggtatcagaaccttgttttcttctttggatttttatcgatctagagtttttgccatggctactcttgctaggttttcaactaagcctcatgttttcgatggaacggatttttctcattggtgtagtaggatgcattcttacattatggctgaagattatgatatttggagaaaagtttctcatctttatgtgattgctgaagctattaatactgctgctgaaaaaactgcttttgaacaaaattgcaaagctcgcaacattcttttgagtggtatttctcgttctgattatgattgtgttgcgcactttcgaactgctcatgaaatttggaatgctttgagtaactttcatcaaggaacaaataacattaaagaacttcgatgtgatattttcaaaaaggagtacattaaatttgagatgaaacctgtagaagctttggatgactatctttctaggtttaataaaattttgagtgatactagatctgttgattctttttatgatactaattatccacaatctaagatttctcgtcactttttgaatggtcttgatatgtctatttgggagatgaaaggtacatctattcaggagtctgttttaacatgtctactttgactttggattcactttatacaaaattgaaaacacatgagatgaatgttctttctcgaaaagttgattctaagtcgagtgctttggtttcttcttcttcttctttggatgttgatgcttcttcatctaagccttcttttcttgttgtttttaatgccacatccgatgatcaactcgaacagatcgaggaggaggatttggctttggttgctaacagaattgctcgagctatgaataatgccaggaacaggaaaagaggtggtccaaatcgttactttgaatgtggttcaattgatcatcttcgttcacattgttctaagcttagaagaggcaaaagagaagacaaagatggtgagaagaccaacaataacaagccaaagggttcatcccaaggaaggaagctagacaatctcaggaaggcttttcaacaagtttgcgccgccttcgagccactaagtgatgtagatggtgaaagtggagatgatgataagggaaagaacatcaccgatgtttgcttcatggcgcgtggtgaatctgacatagagtatgaagataatgaggctttggtggcaaggaaggagaatgtgtggatcgtggattccggttgttcgcggcacatgaccggtgataaaaattggttctcctcactcaaaaaggcatccaagactgaatcgattatctttggtgatgcttctacaagtgccgttcttgctacatgttttgttaaggtaaatgaaaaatttgaattgaagaatgtagctttggttgaggacttaaagtacaatttgctttcagtttcacaaattgttgatgaaaattttgagattcactttaagaaaactgcaagtaaagtttttgattcttgtggtgattctatattgaatatttctcgctatggaagagtgtttaaagctgattttgaaaatcatgtttcacctgtgataacatgtttggttgctaagtttgataaagatgtgatgttttggcatcgtagacttggacatgttggttttgatc

SEQ ID NO: 29382 - DNA, 862 bp, Oryza sativa
  unsure (1)..(862): unsure at all n locations
gcatatggtattttcttgtgcatgctaacaaaactttgaaggtttatttgtctctagcatagcttgtatgtattctagtcttttcatgagatttatattttacttttaagggagatgatacatgacacttaaattctacttgaattaagtaaatatgcaatgttgatgctatcatatggtttgatttataaatgctctatatatatgctttattgaattgttattcctcaaatagctttaattgctcattgtgaaaaagagaataaaaaatatgaaaaaaatgaataccgaatccttggaaatagtcttgatgacaaggacgtattcgatgtgagcaaaataatgggtgccaaatccttggaaacagtcttgacgacagggacgtacccggaataaaagagaaaaatatgagcaaaaaggctcaagaaaagaaaaggttcaaaaaaaattctcttggttattttgtgctaaaggttatttgagaaagagtgataaatgcaatagatatatgtgtttagtgtttattcttcaacctatgtgcttgttaagatgttgcattataaatcgtatgaaatcatgaattttgattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 29383 - DNA, 445 bp, Oryza sativa
tttgcatgcattagtccaaatgcaagaggagatacatttcctgtagttttatgcaattgatttataaaccaggtccagttatcactagtttcagcatcaatgaaaccaaaagcatcaatgaaaccattagggcagttgagtctatactgaggtatggcctacatccaattagaagtccaataatgcatgcacaaaagaatctgtgaaaataaacattcccatcaacttcctttgtgtcaatttcaataacactaccaggagacctctccatgattgcaaccctccacctatacaacaaatggaaattatcttcccaactgccatgcaactagatcatagccaaagtcccacccttagccacagtatcataattgattttgtatttctgatcctcttccaacttggtttgcagttcttcagggcccatacttgaatccttcctaag

SEQ ID NO: 29384 - DNA, 1187 bp, Oryza sativa
actatagggcgaattcgagctcggtacccctgtcttctcctgtaagcttgtttacgccacaagttttctttcgtgataagttatcttttggtataaactttcttctaatgcaagcttctttctatgctgacttttcactcttgtcttaattcatccacataaaaaacatatttcataacaatattgtgacatttatctgaatatattttggagtggcattttaaaaactagttaaaaccatatgatttgccgcggatacatggataattgcacggtactacctctgtctcaaaatataaaggattttgactagatatgacacataatacgaatctagacaaggagtttgtccatattcatagtattaggatgtgtcacatccgaccaaaatcccttatattttgggagatggaatatatattatagaaaggaagtgtcagggttatggataccacatacccaatagtaatcgactaagctcggcagggcccaccatatacgaagtcttataaggaatcatacctcgtatatagaaggagttctggataaggaaggacaataagagttctacatggaaacgacaaggactactcggattgtatccatattggtctccctagttctacttcgagaaggggacatctatgggtataaatacaagccccctaggaagagaggggacacgccacgagggcacaagatacacaagccaatgcaaaccaatatgtcaccagataccgacatcagagattagcctagacaaacccaatccggtgcctacggaggccgacaagagggattagcgctatctctgatctcgacgagttcatatttgaggaggaagacaactctgccgtcgactacgtgttggttatccatgccgccaaatcgacgaaagctagataggttatccaaatattgtacttgtgtgattcagatgaataagagcaacaccggcttcggccaacatgatgtagggctattacctgtcagataaggggcccaaacatgtataaaatccttgtctccatctcttttacctcaatctcacatataccctggtaccgacgatctccatactatccaaataccgtagtcgcgatctcaaacatcgacagtgtaagggtatacctgagaggctatacccgcctacagtatttgtatagtatgagaatcgttggtgcaag

SEQ ID NO: 29385 - DNA, 672 bp, Oryza sativa
gatgccgcacgggatatcagtgccgatatcaccgcagtccaagtgaggttgaacagaggtttgcacttgactgacgttgagcagagggtgaccttcgaccggatgcaggagaagatgcgtgcggtcatgcgcgtcttctcctgtcgcagcgccgtggacgtcgtacctccagctggtccggtacaaccacggcctcgcgcgcctaccgtcggagcaggacctcgacctacggcacctatttcgcacggtactgctcagcccagaggtttcttaagttttgtttatgtttttgtacgaaaacatcaccccgtcgtaacttgatgttccatcctcgcaggacctcgtttgccttcgagcgcccctagcttcagagcagtgcgacctacagcaccggtttcgcacggtacagttcaacccagagattagttcatttttttttcagcttttgcacgaatatgtcaccatgttttaactgcacgtttcctcatcgcaggacctcgtctgccttcgagcgcgttcgcaggcacgaccggcgcttccgcgagctccgcaggggcgttcgccacctcttcgggcgcgttcggcagctctttctcttacggagcgtcgatccctcgcccacacggtactttactttttattaatactattaaaatacatgtatgaaactga

SEQ ID NO: 29386 - DNA, 522 bp, Oryza sativa
ttgggtgccgcttgttataaataatcgacacatataagcccagccacgtggcatgatggtccagaatcggtaccaataaattggtataggtgtcggttcttgatacaaaaccggcacttacatatattataggtgcagattttacgaccggtgccgatatccgaagtcatccatgccgttatctgggtgttggttcgaaaaaccatcagctaagtgatttctcgttacctatggtgtagttgaatgtgcacccagtccacctggtcatcttgtatgagcacatacactaattaaaatctttgtgattagctggctggtttgcaatcccattggatgagtttctagaagaaaaaaaaactatcgatttttttttcataataactccgtaataaaaaaaagttctaaaactactggattgacgaaaaccaagcagctttcacggtttttttaatcggtaatgaccccgacgtctttttttttttgctccacccctgacggcagtatagatctaatctaacggta

SEQ ID NO: 29387 - DNA, 873 bp, Oryza sativa
aaaaaattcattgtcctattaaaattttaaatagaaaaaataatttattacatttgttttattttcaaaatttatggcaaaattttatgctctaattatttagtctcattggtttcataaaatgcatatatcgtgtactcaaacaaaattttcaatcgtttttcaagtttatattcaaacatacatcatccaggtcgatctaaaagatcccctttgcaaccaaacttaacagtgaaacgaaggaaaatgtaactgcagaggcatggaagaggatcaagttaaaatttcaggggtatcgaatggataaggtaaatttcaagggtatgaaagggattgtgtttgttttcaagggtatatagagaatttagtctaagaaaatctaacctggtttatattttagcttacttattttattttaaattatctattcaccctcatcaatgtctaagtgaccctttcaaaggtagatcgacgtctacccatagccattataccttgacacctttgatatcttggtatcatggtaccgatatcatttctggtatcgacagtatcatgtgcggtataaatagttatcaaccagaaatagctgctaagagcaggtataatagcagactataagccagctataaacatattttaagaagataaaaaaggagagaaaagacagcgggctacagatttgtagtcagctgcagtacagactctaagacgcatgtgtatataataggtgggaccagatattgattgtgtagtaataggtgggaccagatattgattgtgtagtatatgtttatatgtaactattgtagaattggctattaagttatagatgatttatggccagcagttagctctactattaaacttggg

SEQ ID NO: 29388 - DNA, 698 bp, Oryza sativa
cttatgaatagtaggatcactaggattgctgaatatatgctttgttgtacataattctttaagaaagtgtgtataaatttcatttctttgtgggacactaagcagcatttgtttttttttaagcaaatctgcgtttgcttattatgagttaattcgtacttcttctcaactgcaagtttcagataactatgacttggtactattttgcagatctatattcttttgtacaaggaagtttctcttgcattgaaaattaacagcatgtacagcaaacagaggcttttaaacattcatgagaatgttaaagttctgcgataccctgatcatttctcaactggcatatacttatggtacggtgagaactttacactcatttacactatttctgcagttaattagatccttatggttggctattgccttgaaggtcacatcatgagaaaatcgttattgttgataatcaagtatgctatattggaggccttgatttatgctttggtcgttatgatactcctgagcataaagttgtggatgttcctccttcaatatggccaggaaaagattactacaatcctaggtaatgttttgtgctctcatcatatttttatctcaagatttataggatagtgtttcctaatttaccgaacacgattaatgtttcctaatgattctaaaacctttttttttgcctatctaat

SEQ ID NO: 29389 - DNA, 678 bp, Oryza sativa
tactaggcattagatgatctcagccctttccctgctgaagctggacaaatggtaaatcccttgatcggtctatcccagcctcccaggctcgccgctaaacaactttaattaatttatctaaaataaagaggaagcatatcatcaactgctatcctcgtcacctctcccctcccgagttgacttcccctctcacgcgtattcaggttggttcgccatgccggcgcgaatgtccatcacatcggcgtcgcgtcgtctccgatgagtaaagctagtcggcggctgaaacaggaagggcgccttaacgtacgagaggacacaggtacaaattgttgtgcttttcaaatttgggcctagtttagtttctaactttttcttcaaacttttaacttttccatcacattaaaatttttctacacacgtaaacttctaactttttcatcgtatcgtttcaatttcaatcaaacttccaattttaacgtgaattaaacataccctggttcaactcgtcagcatggcaggggtttactctttgaaatccggatatctccctcgctttcatttcttctcgcttacgttttcttgccctttggtatgggtatttcatatcatctgaaattgactttcgagattttgaagaaaacaggatgatcaaacatatatgcaagaccataaccatat

SEQ ID NO: 29390 - DNA, 493 bp, Oryza sativa
gtacagaagttcatcaaattcttctgtgctctttattatcctctgctcttcccttctcttctcttctcttcagttattctagggccggtggcgatagagagggaagaggcagccaacgagcccagccgagctccgccgacgactagccgtcagcagggagaaacacaatgaccgggattcccgcggcgactcagtacgccgagagtgcggcggaggtgtccctcgtggatgcgcaccagacgtcagcgatgggacggaagagcagcgcatggcatacgggttgttggggtcgccattgggagctagagggaacggcgcgtaccatgcagagaaaggcacgatgccgcgtagccttcttgcagatgttctcattggccgcacgacggagcttgatggcggcattgtcagtggctcaacgaatgctatacgcggtggtgcacgcatctcggagggggaagctgagtggtggtgggagaggaggaaggagagcgag

SEQ ID NO: 29391 - DNA, 7516 bp, Oryza sativa
atcaaaggcgcataacttagtgcactattaagactgcaaattcatagaagaaacagacaaagctctttgtatatgaccccatttttctaacatatggattgcatgtatcagtgtcactcttgaaacaggccaaaaccaaaatcttttattttcataatgtggtatctaccaaaagtgcatcctcactaatcaacccataattccaacatgtgaattccattatatcattataaatcataaaagaggtgaatatctattatttttatcatgtagagactatcaaaggtgcatccactccatcataattctaaaggatcatgtgaactatactataaaatagctccatactaagcttaactaagtacatgccatgccgagtacctgagggaggggtagaacagcaaagacatcaatcagaaaatatgttgacaagtatcgctttgctattgcatatctatcctcaaccaagacaccccgatcaaaagttgtaggagaagacgcgatatagcctgtcctgaactgaaatatgatatggagtatatagaagatatctgtgaaaaagcgcaggacacttgctgtgatttccaactttttatccaaataccagcatgtattgttttcattgataaccgggatatagaagaacaatggatccacagaaactgcaaagatacatgacaaaacaaatatcttgttccagctttgcagaaatggtccctgaggatgaagagttccagttgtcaacttcatttcatgcagcaccgatctctctaaggtttcagaatgcacaaggtttcctaggaatgcaaaaattccagcagttctttccttaagtgaacttaaagcattatgcctcgcagtgacataacagactgcttggatctccagtcctcaaatctgcatacatggttaaaaaaatacagaataattattacatcgagttttcagtagttgttttcaatatttactcaaaactttaatggatcccaggactttaatattcattgatcaggtccctagagacccaaactttttttctctcttctctcttctctcttacttcaactacgatatttttaccagcagtcttcattatttactcaaaaatttaatcagatactggtgctgtcatttccatacatttatatgtcagacttcttgctgatcttgaaccgaagctagatttctattttggaaaaattggagagaaattattgcattcatgtttatatgctgcaaaagacaaggaaatgagcagtagcaatcgttccaacaagtcaatccatgccagggtctctcagaggccaaaatgtccaaaaccatcatgtgatgaaagtagaagcactgatttttttttttcgaacacgcaagagatatgcatatcatttcattaagagagagaaagaaatgcaagggatgcaagatttaaacaaaccctgacacccacccaccgaaagtcttacagaacacaacacacacccactcaaaaactgaagaaactcaagccgacctctctaggacgcaagaactacttagacaacagcttttggagtttcaaagctcccgccaaagaccaaactaccaaagtgtggcctcattattgacagcttggatcacatccaccacactagtgtagaaccaccgaattaccattgctctttagaaatcatcaaactctctccatgtttcatgtcctaaacttgttactataagttttgacacaaaacatttgacaagcctttattctttgtaaactaaagaaattctaaatcaagcctccctgaagattaacccacccagttataaccagggttcaaaattccggaatttcggtcaattcggaccctcccgatacgatacgaaaatattttgaccgaaatttctaaattttttatgaatttggtaatattttgttcaaatttaaccaacatttgttcaaaattttggaaatttcggtgacctccgatagaatcggccaaaccgaaaatttgaaccctggttataaccatggctttgcctgaaaggcagaaaactccgcagccgcaaaccgaacccccaaacctgctgacgccgcgctacctattctagagtctagacacacgagaccacaaaatgagaaagcaagcagggcatcgtagcgattagcgaagaatcagtaacaaattaatagcggcctaaggcggcgccttgcccgctcggctggctgtggagggagaacccgaggccggagcaggggagcgcagaggcttacctcggaggtggtgcgcgcagatttgacggaggggtgggggaggaatttggtcctcctccgcgtcgcggctgggattgggaagccggcggcgtccgcacggcggaggtggaggtggtggtggacgtacgtggtggtactggtagtgcggtggaggtggagatggaaagcggaggacggaaaggtgtgccaacggtcccccgctttgcttcacggctaggtcctaatcgtgggttcatttatatttttagtaaatttcaaagtaactacaacttgattgaccaacctatcaaatctcttctctaatattataaaaattaaagatatttttgtcggtactttgctacatcatctgtgtatgaaaaatgttttcgttggtactttggtacgccatccgcagtttttaaattcgtttgcttttgaaaatacatgtctgtatttgagtcggtttttaaattcattcttttttgaaatacagaagaagccgtataatgaatctctttaaaaaaactcgcatgctaatttgagatgatcaagctcctaaccacagcttataactttcacccgttgcaacgcgcagatattcttctagtagtaaaaaactagaaaatctgcatttgacgcgccgatatatgtataatcttatttagagctcatatggaatatataaaatttacgtacctcttattttagattatttatcactctaccaaatttcgtgtcagatgaggggatgcggcaaattaccttatcatgctcatttagtacattctaatagtagttatgttaactttgattactggatatatgtggcattgatgaaaggtggagataggggatcatgatctaaaaattgaaatgtgggaatgaccagtaagttggaactgatgaagtaatatatgtttacacgagttagtttaacacccttaaaaaaatctttcaaaagaatggaatttaattttgtgtttgtcccagacgaatggaatttaatttaatgtttgtcccagataaatgaggaaaaccaaagtatcatgtaattagtgtatgcaactaattagacaaatgattagagatgctattagaaaaaaacttaatgtttcctcaaaattgtggcaattttattaaccaaaaaattgtgcatacggtatccataataaaatgcacattcgaagaatattatttcttagtattgcaaattttcattcaatctttcaccatatttctattatttagtttttttattatttattttgtagaaatataggatatcaatatgactcaattttcggttttaaccataatgtattttattttttcagataaattttgcaaaattattcatatttttctctttgttatttctttacttctgtttatcctatttatgcttggttctgtgtgcccattagcttgagaaggcaatttcttgtgttgtagcaacggcgccagatcaccaggtcccagggcaggcatgggtgactgggctgtacacgccaatgcaccttttctttctgttctttttttcatttcacggggaaacgtctaggctgtttcctctaaatggacacgtggcagattcctggagggggcattgccaaatttaaagagatccacctggcccaataggaagctagagtttggtccctgaaatcgattttacagatagtttcaacttctagaaggttcatggtgttttatgggcttacgaataattggacatgggacaaaatcttcatgggcctagatgataaagctgcagtgccgctgtttcttttaatcacgttcacgaaaaaagaataaattcaccagccgacccacaaaatttacgtcgagtttgtataacatccctaatctctaatacaaaaatcttcaccctaaactatataaaaccgtgcactttcagtcctacactaatatgaatctctagttttgctgacatagtatcctagtcagcaaaataaaaaataaaaaaattatggcacccacatgtaagtgaaaaaaaaaagtgggaccctcatattttctttattgtcaattcttctctcctctttcttatcctcttctcttcccttctcttctcttctcttcagttattctagggccggtggcgatagagagggaagaggcagccaacgagcccagccgagctccgccgccgcctcgccgccagcagggagaaacacaatgaccgggattcccgcggcgactcagtacgccgagagtgcggcggaggtgtccctcgtggatgcgcaccagacgtcagcgatgggacggaagagcagcgcatggcataggggttgttggggtcgccattgggagctagagggaacggcgcgtaccatgcagagaagggcacgatgccgtgtagcctccttgcagatgttctcatcggccgcgcgacggtgcttgatggcggcattgtcggtggcgcagcgaatgcgatgtgcggcggggcaggcagcgcggagggggaagtggagtgggggtgggagaggaggaaggagagagagtcggcgtgcgcggtggctgccatggtggtggggaaagttagggcggcggcggcgtgagcgtggcgaattgtaaatggacaatgctgcaaataacatctccaattatcaacagccatcataatggccaaaattatttttcataaatagagagtttctgattcgttgggcctaaagtcttgttgtaataagccacaggatgaccatgctgactcaaaacagccccaatgccataagcaagcatcagtctcaagcacaaagggacgactaaaatctggtaatgccaacacaggggtagtggtcatagcttgtttcagttggtcaaaagccagctgtgctgcatcagtccaaacaaaagcttttttcttcaacaaggttgtcaagggtcgaacaaaaatactataattcttcataaacttcctataataaccagtcagtccaagaaacccctcaaagcaataagagaagttggaacaggccaagccaccattgttgcagttttctcaagatcagtgcccacccctttaacagaaatgatatggcccaaatattccagctgagagcaagcaaaggagcatttagattgtttagcatacaatttgtgttgcctcagcaccaagaagacttgctgcaaatgagctaaatgagtctacaaatctgggctatagactaagatgtcgtccatgaaaacaagaacaaacttcctaatgaaaggggtaaaaactgagttcattaagcactgaaaagttgatggagcattagtaagaccaaaaggcataacacgaaactgaaactggtcgtgatgtgtcttaaaggcaattttaggctcatccacttccaccattctgatatgatgatccagccttaaggttcaacttagaaaaattattgtgtaccagcaagtttatccaacaactcatccacaatgggcatagggaacttgctctcaatggtaatagcattcagtttgcggtaatcaacgcaaaagcaccaagtcccatctttcttgttaaccaccgacacaggtgaagcaaaagggctcatgctcggtgtcaccaagcaagaatcaatcatttctttcacttgtctttcaatctcatctttctagagaggagaatacctgtaaggcttgctgttaaccggtccagcatcaggcaacaaggagatgcaatggtaatacactttgtgtggaggcaatacagttggttcctaaaaaatgtcatgaaattccaagagtacctgattaacagaagaggaaagtggatgtgcaagactagcagaagagtgctgcaacattgcagcagcccatatatcacaacctttctgccacttcagaatctgaaggagagaaactgactggagttcagttgtgattgcagaatctaccacaccctgcaatgaaatctagctaccttgataatgaaatttcaaagtcttccaagcccaattacaagtcatatcaccaagtcatgcccaaaatagcatcatgaccacccaattcaaccactctcatatcaaaaacaaaagtgtgtccttgaatccaccaagtaaagttaggtacaatatattgacaagtgagaaaatccccattagctactctgaccatagaaggagatacagattacaaaggtaatcccaactgctgagcaaagtgcagatccaaaaagctatgataactaccagaatcaaccaacattaacaacactttgctatgcgccaaagctctcaatcgaaatggctcgaggatgatgagcacctgacagtgcattcagcaaaacatgacattcatccacttgatcagattcttcctcagcaatcactgcattcagcaaagcatcttgaatgatttcagtaatctgcattgctttgatttggcccagcacagcacacttgtgctcagatgagtacttttcaccacacttaaaaaaaacataacccattatccttgcgaaaatcactcaattgccaagccttccacggttcagcttgttcaggcttcagccccaaagtctcagtcccaactagccgttccacttttggcacaaatttcttagcaggcaagcgcttcatagaaggggaagaatccagtagcagcccttcctgagtcaaagccaccgcagtagcttgttgaatagtttgtgacagctgaagcaaaaccgcattgcgaacttcctgcttaagccccaaaacgaaacgagatactaacatcatgcctcccactgaaggatcaaacagtctgacctgataaacaagtgaatcaatttgttgcttatattcagccactgtaccagtttgagtcaacaaccgcagagctaaagttttctctcggtgcgtgttgccctcaaactcatgaatgactacataacggaaatgagcccaatcactgacatcctccaccagtttaacagactgataccactgcgctgcattgccatacatatgcaaaatagtagcagacacccaaaaagtagcagaaatttggtacatcttaaaataagtctcacacatatcaatccaaatatgcacatccggcccctcaaaacgcagaaaatccattttcggcaaatacgacttagcccgccccccatcctgagctcgatggccctcgccgtcaacccaatagtgtgcgtgggaaccaaatcgaggaggtggtggtggtggcggtagtggtggtgttggtggtgcaccagcgcccgaacgcgagaccccagaagaagaaccaagaatactcacaagatcgcctgagcccaaggatgatgac

SEQ ID NO: 29392 - DNA, 1916 bp, Oryza sativa
atcaggcggcgtgtcgcctgacaccccctgtcacgtcgtgatgatgagaggctgcttagcctcttatcacaaccggagacgacttgcctaacccggtcagggtagggttcccgtttcccggcgcaggtgaggacccgaaagtcttcactcattatgacgtgcgtgtcccccgtgtcagccggacagatttggcaagccccacgctgcagcaaggcgtgcaagagacttccaaggcaagtaacaagacatgcatttaatgtggttatcctccctgaataggctaggtgggcccatgtggtatcccttgagatataaaaggagttccaggcctacttaggaaggagatgggcccttttcactagaggagtctcctgcccctcaccatcaacaccttctactccaactaggagattttgtaattcctcactcaatcagctaagcacgggagtaaggtattacgcttttcaacagcccaaacctgtataaaccccttttgtctcatcattcttgaggggcccgaccccctctacaccgcctttctcaccgagtcctcgaatctcacccacttttcccggccaaaccaataagggggacctcactgccctccacttgcggagttcaccctccgacacggcctcacccaagggtagccgtcaaccggaacacagggattttaccagccggatcgagagaatatgagaacaatgcaaccacgaacagcctgaatctgataccactgtaacaagtcgccgccgccttcgcctctgatttaccagattcgatccagattgagaaatgaggaagagagtttggggaagaagacagcacgagacagaggtagaagaagaagacagaaatagagtagttgaggaagagacgtattcttgatttcagctattcgataacgtttacaatactccttcccacattatagtctctcttagatgggctcacaggccagactttcatgggctcgcaggcccagcacatcgacaacctcttgcgctcactgtaacccgtcacacaggcgtgacaagttctacagtagctacctactatggataaaacccaccgtatggaaaacgcatggtacacgttgataactgattaataaagtacaaaggggtatcaagacaaggataccaggcttccagcggctagaacatgcattgctttatgacttcacacaaggaaaccagcagtgcacgctagactgtgccggaataaaacagggacactttcttttttttttcttttgtctaaaatgagtggttgacaaatctttaacaatccattaattctatatcatgtcaatatatgtgagttaaaacaagtgtctccgttacaatgtgatcttgctccgtgcctggacttcaagagcctgatgggaacacgggatggaatgctcactacactactataaacacaatttgtatataaacacctgatgaataataattacacgtatcacctattatcatacacgaacacatatacagatcttacagaaagatacagacacctattgcgattttttcctctccttaatttgtaggtctagtgtcaactgaaagcaaaaacatcagcaagtaaaaaatgcacaagccatgcacaaaaaattccttacgcattcgtggtaaacagaactactgctcttctgcagcaaagttgggttctgctggtttttgtaacaaccttgcaggcacactttccttcaaccgagccttgcgggtggcatttctcctcaagatccgcatcatgttgccagcgaaacgcgaagcatatatcgctgccctgaagctgagagttgtagcaccgtcattaacgattgcgaactgcaacctcttctccttctcgcgtagagagtcttcgatcttctttctgcagtacctatgccaggctgcttgtatgaaaca

SEQ ID NO: 29393 - DNA, 2979 bp, Oryza sativa
acggggggagatggtttatgtccatccatagcagggagataaatgatctacattcacacacaaaagatattaacacaacggttactgctgcaacagattcaaggtttccctggaacatgtccccaaagaacctccctagattatggctccgtttggcattgttgtcctgtttaatttactcctagttagttagaagagttatttactaattccagtacgattttgccattaatgctccaacaaaattttatacatccaaaaaaaagaaataaacacgtgaccttcaaagccacagccaaactgatgacttgctatggtgctactaaatccaatgctgtgaaaaaagatgcctataagcgtaaatgaagagcatttcagatgcatagaaactacagaagttggatgatggagctgatttccgattcaccatgtaaaccccagtgaccctcgtcctttacacccttcccactgcttcccagtttagtaatgctttctgatgtctgaacccagaaccttaaaatgtgaaaagatgacccataactagtacgccaatggttttacattacttaattttccagtttctacgtgagtacctcaaacacatttcatgcactgaaaatttcatgctagattactggtgtgcacctaaagcacgcgactattggaagacctacatcaccactttagaggtaattggcttaggttcagagcaagaaacaatgacaccttgcaacacataagcaactctacaactattgaaaagaaggtaaaagaagccttaagctttcatttatgtgccttttggaacatggtctttgtcattcttgaacaaccaggatacttttatgtcatcagcaattgtgaggaagatgcaattccggttttaaacaatatagcatgatgagctgcatggactgaaaatattatgctacaataagtagaaaacaaatggtgctcagccaaatctcagatcatatttcttgggtctgctactgtaactagatttggctgagctacgtgaaaatggccaaattatttacttaaccaacatattttctgcaattggataagacacaaaaataagactactacagcaggttactctgcaaaagaagcttgtgagaacataccctcataagaagtgataagcaaagatgccgttttatagccctcctaagatccttggggaggttcataagcaagagttcttcatcaaccccgctcgtctggtgccatctatatttttcatgacgacgtattcgttccttgagattctcaggaagcagtcgatatgacatccattgatctgtatcacggcttttcactctcatttcttcttctctcagatgggctgactgcaaataggtctgtagaagtcacaaaaaatggaaggatgagttagctacccaaattacgcatttatcattacgcagcaaaaacacctaatttcattcaatgtcagggatcctgtgaaacattctttgtagtacaagacctgaaccattttgtacaaagactactgttgcaaataaggactgatgatcttattcctaccaagattatgctagtcttatctccaaatggtattggaatgaacactcgaaacctagcacaaggttccatatctttagtttcatatccctaggagataaaataagttggactcatttttctcagaattaatttgatttattatttttaagttttccataattcactcataaaaatattctctgttgttctggggtatatctttagcagcagtatatagcattcatgttctcttcaattgattatgtaggcattagacacataacacacttaaaattttagcatatttctgatttgcaatgcaagttctattatgaaaagcttgaataataacataaatcaagaaaatgacttgtaaaattaatagccaatgaagctaaatatgcgtacctgcacattaccaattagcagtgcaaacagaaccaagcctgatattgagacaaaaactgcaaacagattctcccatgcataagtgcttgtcttaaggttttggcccagagagctgcattaaatagaccaacacataaatataggtggcatagagaagtttattggttcaagcagaaaatactttaaatgtttctgttttgcacaaacctaagattttgcagaccccaccaaacacaatagaatagttttgccaaaaaattagttgattgcgagacattatttagagctggcacataaattccaaagttcggatctatatcgtttgagtcgattggaaggcaagcagtccgtaagatcgagttttccttatccccacagtacaaatatgcctgattacagactgtactattattactacacatgtctctccagcaggcatctttgcgttcaatggaaagcaagtaccagagtgctccaaggacctgcagcagttcaaagatttgtcataaatatataaggtgcatggaaatatttaattatatccaatttagtggcactgcagttgcaaaagtatcccacttatgaatgaagtcaactagatggttgcatgggccactaatattttaattatttgccaatttagtagtatgaagtcaagtttcataggccattctttggttgtgattgtccatgacattccaatttatccacccagtcctccaagttttccgactatgggtcatgattgtccttactcctttgaaccagttgaagcactacaaggacatgcatatcaaacgaattggccaagccaagagatcaagggtcaacaccgattagtcctgtacaggcgctgctcccggtggatccaattttaatttttaatgaggaaaatttgaggacacacacacatctggatgatacatcagagcccaacaggagcctcaagcaaaacttgagagaccaaagtgttgttacccataaggatattatagccattttttttacagaaaacaaaatccatgcatattattttct

SEQ ID NO: 29394 - DNA, 6686 bp, Oryza sativa
tttgctgatgaaaaccacaaaacaagaggtgtttatggctctggtttggcaaaaaataaaaaaaaatgagactacacagtgctattccacccataccacacatcaaccaggttagccgaatttattttgatcaataataaattcatgtaatctttacaggaaattgatcatgttttcagctttccactattgcagttaaatattgctctagcaaaggacagttgatttggcattgttgactatccagagttattgaatagaatacttacatgactggcgagcaagtaaattaaaaggttcaaaacagcaccagcccatggtgtctctgtaattaccccagcagaccttgtgatttggagatacagtggccttattcggatcagccgaggcacatattggcatataactataaacatcaagatatttttggcttttgtaacctctgagcctccaagattaggtagcacaaccaaaataaccacctggtaacaaaattgaccatgcttacaagcttgactgagaaatcaaaggcgcataacttagtgcactattaagactgcaaagtcatagaagaaacagacagagctctttgtatatgaccccatttttctaacatgtgaattgcatgtatcagagtaaaatcaaaatcttttatttttctgatgtggtatctaccaaaagtgcatccttactaatcatcccatgataccaatatgtgaattccattatatcattataaatcataaaagaggtgaatatctattatttttctcatgtagggactatcaaaggtgcatccactaatcataatttatatgtatatcaccaacataccatcataattctaaagaatcatgtgaactatactatgaaatagttccatactgagcttaactaagtacatggtatgcggagtacctgagggaggggtagaacagcaaagacatcgatcagaaaatatgttgacaagtatcgctttgctattgcatatctatcctcaaccaagacaccccgaccaaaagttgtaagagaagacgcaatataacctgtcctgaactgaaatatgatatggagtatatagaagatatctgtgaaaaagcgcaggacacttgctgtgatttccaactttttatccaaataccagcatgtgttgttgtcattgataaccggaatatagaagaacaatgggtccacagaaactgcaaagatacatgacaaaacaaatatcttgttccagctttgcagaaatggtccctgaggatgaagagttctagttgtcaacttcctttcatgcagcaccaatctctttaaggtttcagaatgcacaaggtttcctaggaatgcaaaaactccagcagttctttctttaagtgaacttaaagcattatgcctccgtggtgacataactgactgctcagatctccagtcctcaaatctgcatacatggttaaaaaaaatacagaataattattacatcgagttttcagtagttgttttcaatatttactcaaaactttaatgggtcccaggactttaatattcattgatcaggtccctagagacccaaactttttttctctcttctctcttctctcttacttcaactacgttatttttaccagcagtcttcattatttactcaaaaatttaatcagatactggtgttgtcatttccatacatttatatgtcagacttcttgatgatcttgaaccgaagctagatttctattttggaaaaattggagagaaattattgcattcatgtttatatgctgcaaaagacaaggaaatgagcagtaacaatcgttccaacaagtcaatccatgccagggtctctcagaggccaaaatgtccaaaaccatcatgtgatgaaagtagaagcatcgatttttttttcgaacacgcaggagatatgcgtatcatttcattaagagagaaagaaatgcgagggatgcaagatttaaacaaaccctgacacccacccatcgaaagtcttacagaacacaacacacacccactctaaaaccgaagaaactcaagccgacctccctagggtgcaagaactactgccttagacaacagcttttggagtttcgaagctcccgccaaacaccaaagtgtggcctcattattgacagcttggatcacatccaccacactagtgtagaaccaccaaattaccattgctctttagaaatcaccaaaccctctccatgtttcatgtcctaaacttgttactataagttatgacacaagacatttgacaagcctttattctttgtaaactatttcaaacaactggtgatggaggaaactgacctcacatatttgtcctctcttcccatcatcattttccaaaaatccaccaaaccaaaggttagctgctagaacagctttattgattctacaagggtggcgacatttgcatacatggagttccctgatgattatcaagcataattgagtaagggaagtaacgcgtatgcacatgaatatggacacagaacaaagaacagcaacataatcaaatggaaacagtaaatttaactttgttatgtcacaacagtcagcttagattttgtgcatggacaatcactcatcacacctgacaggaaatgtccatttgattgttgaatattgaatgattgcatttagctaactggacaatagatagaatgctgaagtggtgatttggtgtttccctcgtgtaggcaggctccatttggtattgcggcggactgtgtttcatttagggcaacagctttttgggtattccagtgtttggtaaaatgcttgtatttaaatcaaaagttaattttgagtttcaaattatgactattttttaattcagatagagcttattacttctttttagtaatcatgttaaaatcagcttcccactataatacaaagatgttctaaatgataatattattatgttgtgaaaatatgaaataattaggagagacatgaaagttggatgatatattttatcaaactataatttgattgatcccataaaataaactaaacagctatagcttataagaatcatttccacagcaaacctagcctagcctagccttaacatatataactctgtatttctatccctctctgttatttcggagggagtcgccatcaaatacatggtggttaaactttgcaaagcatagataaggtatggctgccgagtatctcaactcccaaagtgtcacaccaatttcaccccgatgaacagataagcaggaaagtgacagttagtatatgaaacatcaattaccaccagtgcccatagtcgttccgattaacaaatgattagaattaccaattgtgacctatttgttccctgtgatgataggtaaaagcaaccgatcaagcaactaaaaaaattctaacccacccagttataaccatggcttggcctgaaaggctgaaaactccgcagccgcaaaccaaacccccaaaacctgctgacgccgcgctacctattctagacacacgagaccacaaaaattcgctaagagaaagcaagcagggcatcgtagcgaagaagcagtaacaaattaagtccggcctgaggcggcgccttgcccccctcaggcggcctccctccctctgcctcgcatgacgccaccgcccccctcggctggctgtggagggagaacccgccgcgcgacggagcagggggagcgcagaggctttacctcggaggtggtgcgcgcggattggacggaggggtgggggggaattcggtcctcctccgcgtcgcggccgggaagccggcggcgtccgcacggcggttggtggtggtggtggtggtagtgcggtggaggtggagggagcgatggaaagcggaggacgaaaacgggtgccttggtttcgttcgtgcggttgggtgtgggtggagttggactccacggcatggcggcgacgactaggccaacggtccacgctttgctggcctgtacagttttgtcctaatcgtggattcatttttaaaggatattttttgtgaaaattaattaggtttagatttttaaaaaaagtaaatttcaagtaactacaactctattgtctaaactataaaatagtatgaaattttactacatagctacaatgttaatgaatacaattatcccaaaaatacaatcttgttacagtgttaccttctaatgttactaacatcatagacctaactatcatacaaatagaatttggctagagcgaaactggacaacttgttgatagtcaccgcggtaacacatcctattgtagtagtatgttacgtcatacaaacgcgagcgtcgccttggtcataacttggtaaaaggaggaggcatcacttctcccgagtcatggccatagtgagatgtcaaggaagagaatatggaaggaaaggaagaagtatcactacctccttccattcccttcaaccgtatattgaattaaacgagggaaacatagtcgaatggcacgtgtggagtttactcctctctctactggttagttgctattgttgtgttgcaatggcggacccaacattttaaacttgtgtattcgaaataggaaggggtaaaaaaaatttgttcgtacacctagaaatataataatttgcttgtatagcatcacacactaataattatataacataaagagaatatagcatacaattgaatataagttcacacattgatataattcaccatcagttgaaattgtttaacatataaaaatactagttggtgaatgtatcgaagtgccaacctaaataatacataaagactagaaaattataaattggtaagaaatcttacaattttgagatcaactttttgatgtttgatattttaaaaataagtgataatgtccttatccttaactttcaagaagaaatccctttcaatcaatgtaactaaacaatcattcaaatattaagagattttgggattttgctagccggttaggggaggggaaatggactgagttagtaagttgcggcccaaagtggcaaagcaagtgcgggctaagagcctgagagagaggaaagggggacgaaagtgggaaatttaggcccaatagtggaggaagggtgaaacaaggcccaagataagtagtttaaggctttttctttatttttttaatgcatatacaaagtatatatatatatatatatataattatatatatatatttatttattatctaaaaatcttggatatacatctgaatatccttgaatctataatacgcccaccctaatgtgttgttcttttttctcttctctctcgatgtctaagcatgttatctcacaaactttattctcctgtccaattatattttgtatttgtaccaatttagcatgtaaaatattatatatcatcctgaacttaaattagatagaaaagtgtgatgtaggatatgacatgatcattatctgcctgaacttttatttcatgctattttgagattaaaaattcattaatattttctatgtgaaactacttgggttaaagatatccatattttcattccataagacagacaaggtttcttcttattcgtgtggaatataaagaaacgaattattcctttactctgatatcgaggaaacctatttcaccacttcaatgttttatgcagtacgactattggtattttttttattattgtaaggccctgtttctttcagctttggattattataatctagattattgagccagattactatagctagattattataatctgtagtagaataagcggttagttgtttctttcctaaattattagggcctagattattgggtttgcaagtctaaagagggagtggggtggcatggtggttaattttttacccaataatctgaaaaaagctcacctaaatgagcttattagattataatactctggagactatactaagctattttaataagttgttcgtctctttcaggttactttcaataatgtagattataataatgctaaactgaaaaaaaaacagggccactactaatatttcagttgcataaaatggatcgaactattcaatacctaattcacgcgtgtcaattgggtgcatattagttagggtcattggccacacattaaagtatgataaagctgcatacgaaatatgcatacatggatattctttactggcaggattttcgctaatattcagctcatgagtaacaaatatccaatgacatttatttccaaataaagattgtggatcaaaccaaacacaaccaatatcaatctgtatcacaaatttctaattaaaccgacgaatcattttccagtaagaaagtgtaacgtttagtaatatcttcttccttcaatctgttcattacaatctctctctctctctctctctctctcgaattcgcgaacacgcgacgcgacgtcattttctcccctgcaccggataaacaacgccaaaaagtttgttttatgtccccgcccaggcctccgtcgccgccgactcaccgctgcgccgcccgcgaaggccgaagcggcggagggggcctcgccggagcgctgctcaggaggatggcgcgcgccgccggcctgcgggctctggtcggcattgaggcggcggggcgtgggcgccgcgtcgccgactgcccctcccccggcggaactccagcggcctcccgcgggctccccggctggcc

SEQ ID NO: 29395 - DNA, 3824 bp, Oryza sativa
accggcggctccgcgaggtaataatcactaaccaaggtccaattattgttcaggattattcgctgattacgtgcgctgttagcagcgcgatgccgtcgctggtgatgctcgtggagaatgatgttccatgagtaatagtgattgccttgatgcttacgggggaatatataacttggttgttgtcgaaacatgaattcggcaataataaaatgggtagcgcacgagacctaaaagtggatggatgcggagacaaagtatttagacaggttcaggccctctcaatgagaggtaataccctactcctgtttggggatttgaatccgccgagtgtgtattgatctgacgatcaggttgtctcatgcccctagaggggctccctgcccgccttatataggttggggggcagggttacaagatagaaaccttaaccaatacggtatcggtttcctaaatctactttacaatcttatcaaaccaggactttaggccgttccataatatacagggaaacgtaatacccaagtcatgatctgttacatattttatatatataagttatcccctataactagtcggataaccatgccgtgtgggtatggggtacccataatctccacagtagcccctgagaccttcacagtcagaaagataatcttctctcgaactagattactccaaagccgagtgcttcaatcatcctcgccatgatctcccgagtacttttaccaaatatgaagactgtggagggctgaaaaaataaagtcagatgcatcgactagatgcacctaataggtgtaacccccgactatgtggtttaattgaacaaaccaaacatataatcaaggaataaataatctaaccaaccgagtggtttcgataattgtagtcaaccaagcgacttaatattaatatgtagcatatgcggtgtgaatccctgaataatatgatgatccaagtgatataccgactgctttgtaaaatatgatgagtgtaacctaaagttgacaacatctttgaaaattcacatagcaaaacagctataaagaagcttatatgctgtgaataaagaaatttccaaagtattgggcacacaccatgcgcacactgctttaacagatgtgcttaagtccctaaaagacacatggtttcaccacacccggaaatatatggcatatgtggtgtaaaatccgagtaaataaacttataaaggatttaccaaccgcctggaaaatgaccataatatataatcagcctaagcaataatattggtcaataaaaatacacacttacgtggcaaaaagcaatgatattgtatccaatcaattgcttaaaaacccaaacagcaccttgacttatataaaaaagtcagcgggacagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatataacatgctcccgagtaataaatcttccgggtaatatagaccaagcgtagctcatatgaatagcttctgatctgagtgattatcccttatgggatactccaaaatagatgtaacaattgaatcccgactggcgcaagtattcagttgataacccttacggggaataataaatagtccagtctttgagcatataaaatagacccatgatcatgaattcatgttgcatatatccggagcaagtccaaattgaagatataatacttgtatttgagctagtaagcccctgagcacgtagtcacaattgttcattgatggtagctgacgcagttggcatagagacaagacgaccaatatagagataatattgcccaacagaggtggcaaaaatattggtggtagtgaagatagtgataccaatcaaaagtgatgaagttgcacagccgtggaggcgaagaaaccagtcggcaacagtcaggtcagccatcaatgaagatgaaggcgcccagcgataaagttgtgtagccatggcagcgaaataatcagtcggtgacagacgaggcagatcaaaggcgatgacgaaatccaccaatcatgaagatgaggaaaatagtcggcgacgacaaacgtaaccgacagtaatgatgataagcatcaacagagatgatcaaatatgatgacgaagttgcctatcaatagcagtagagtaagctatgataaagaggtttgacaggatgttgatgaagatgacgatgtcggtgatccagtcaatagcggtgtaatagccgatgataatgacgaagacgctcatcagcgtttgcatagtaggtcaaccgtgaaggcggaatagcaagttggcgaagtcttagtcatccattagcaacggcggaatgtcagagccgatgaagcagatgtgctggtgatgatgtcagtgacaataatccatcaaactgttgtagatgcttcacttggaggaaagtatatgctgttgttcaactcattgaatctgatatgagttgattggttgatgactccaaactcccagacatgtaaatttaatcttgacctactgctctgaagcgaagacaaaattgatgactcccagagttgacttgttggctgattaattgattgcttcatcttgacataaagcttgtcaaattttgagccatgtatttgtgtagcccccgactctttgattagttgggaaacaactgaacatagagtcgagaattatagcttcttgttgtcgagtagtcatcacttgattgaagatatgtgttgaagatgtccaagtagaaatcctgaatattggagagccacttgttgtagtaaaataacatggcattgcatgccgagatgtcgaggttcacaaagacgtcgtggttggtgaaatagtaaaacttgcgaagtagcaacaatagagtttgccggtgccgaagataataaagatgaagtcgctccaccatgatgacaaagttgtattgccgtaatgaagtgaacacaagtcggcggcaacagaagcaaaccggtagtgaagacgcgcagttgtgaagataaaagcaccagtcggcggcggcataatcagtcggcgacggaagatgatgatgtccatcagtagtggtagctgtataaaccagacgtagaggcgagggcactagtcagcagcagacgagacgaccagcgatgaagatggtaaggccaatcaacactggcagaatcatgcagccatggaagtgaagaaaccagtcggcagccatgacaaacgtaggcagcttgtgttgaagatactgatgcctattagtagtgacagcgatgtagccagccgtgaagaagatagcatcagttggcgttataacaggccagccgtgcaggcggtgacaccagtcagcggcggatgcggcggccggtcggtgaagacgtagacgcccaacaacggcagcataataggccagccgtgcaggcggaaacaccagtcggcggcggtcgaggcggccggtcggtgaagacgtagacgcccaacaacggcggcataaaggccagccgtgcaggcggaaacaccagtcggcagcggacgaggcggccggtcggtgaagacgtatacgcccaacaacggcagcataataggccagccgtgcaggcggaaacaccagtcggcggcggtcgaggcggccggtcggtgaagacgtatacgcccaacaacgg

SEQ ID NO: 29396 - DNA, 15316 bp, Oryza sativa
ccggtcggtgaagacgtagacgcccaacaacggcggcataaaggccagccgtgcaggcggaaacaccagtcggcggcggcgaaggcaagccggtcggtgaagacgtagacgcccaacaacggcggcataataggccagccgtgcaggcggaaacaccagtcggcggcggcgaaggcaagccggtcggtgaagacgtagacgcccaacaacggcggcataataggccagccgtgcacaagccggtcggtgaagacgtagacgcccaacaacggcggcataataggccagccgtgcaggcggaaacaccagtcggcggcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcggcataataggccagccgtgcaggcggaaacaccagtcggcggcggtcgaggcgagccggtggtgatgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgtccgactagtcatagcccccaagcatcgggagtcgacctaggcatttcccaaacatgcatatgagtgatatgagttcgtcattaatggaacaaagtttcacggattagaatttactactcaggtacttttgcaattattaagagcagaaaataaatttatctcatctctatgcttttgatttattccgaataatacttagcaccttgcgttactcggtccatccaacgagcccccaggtgctaggaatcggcccaaaggcaaccatccattggcaaaccaaacggaaagcataggaagatagaactccataactcgataggtacttttgtactcagattatgtcgcaagcaatcaagataaatattatgaaaattgtttaaaaaatacgatataacatctatagcccccgactcactagtcaacggcgaaccagttgatgtagtgaggcaaaggaaaagacaaaatatcatataaagaataaaataaatgatgacttagctttgtcgtattccctcgatgacagcagaagtagccgatgtgggaataaagcagtccatcaatggtgacaaaaataccagtcggcgccagtggaaccaagccagtggtgtagatgatgaagcccattaacagcggcggagtccgccaaccgtataggcaaaaacaccagtcagcggcggcagaggcaggccagcggtgaagtcgtagacgcccaacagcagcggcataataggctagccgtataggcagaaacaccagtcggcggcggcgaaggccagccggtcggcgaagacgtggacgcccatgaatggtggtgtgaccaaccaaccgtataggcgaggacaccagtcggcggcgacggaggcaggccggcggtgaagtcgtagacgcccaacagcggcggcataataggccagccgtgtaggcggaggcaccagtcggcggcgacggaggcaggccggcggtgaagtcgtagacgcccaacagcggcggcataataggccagccgtgtaggcggaggcaccactcggcggcgacggaggcaagccggcggtgaagtcgtagacgcccaacagcggcggcataataggccagccgtgtaggcggaggcaccaatcggcggcgacggaggcaggccggcggtgaagacgtagacgcccaacaacggtggtgtgaccaaccaaccatataggcgaagacaccagtcggcggcgacggaggcaggccggcggtgaagtcgtagacgcccaacagcggcggcataataggccagccgtgtaggcggaggcaccagtcggcgatggtgaaggcaagccagcagtgatgatgaagatgcccatcaacggtggaggtgacgtacccgacgacaaataaaacgggtcctctgcgttgaactatggtaggtgcaggtcattgccgtggccgtgtatatcatccgcacggctcaacctcaatccaaccaatatatgcaaacacagaaacaccaggaagagttgattagcgatcaaaaatataaatgcttaatatctcatatgcatggcatgattagatgaattgtgcacgttgatccatgcacgtgttttgatggcatgattttgctagccacgggagctgataaggccgtgtcaattgcttgtcgatcaaatgctggtgctttttctttgcccgagtcacagcaaggctgaaagcttgacgatacatgatcggactcgccaacaatcgacattaaacagaagacaaaggaaagtcaggcattaacccgtgattagtcatcaagaataaaatattgataatcaatatagaccagaaggattaaattaaccagggaagggaaaaacagactcggactaatccggtcagtatatccatccggtggcttacgcggccttcaacatcagacacccggtgggtgaggttcgcacgacatctgcccagctagttggctcggtttcgccgactcgacctcccggtgacatgtctatgtgaattaaatcccggtcgccggcagtcccgagtgcaatcagcaacaattgatccgatgttctggttgctggtcgtctcgatctcagccggtgtataaaaacaagagattaacagtagattaatccacaattaaaaaatcaatctaatgaaagttagattggaacgacaaaccaggtcagagatttgagtcattgaaattgatctcagtgcttctctttgaaattgattccatcgcgctcgtcgacgaggtactcggcgctgcccctacctggcgcgccaactgtcgaaacatgaattcggcaataataaaagggggtagcgcacgagacctaaaagtggatggatgcggagacaaagtatttagacaggttcaggccctctcaatgagaggtaataccctactcctgtttggggatttgaatccgccgagtgtgtattgatctgacgatcaggttgtctcatgcccctagaggggctccctgcccgccttatataggttggggggcagggttacaagatagaaaccttaaccaatacggtatcggtttcctaaatctactttacaatcttatcaaaccaggactttaggccgttccataatatacagggaaacgtaatacccaagtcatgatctgttacatattttatatatataagttatcccctataactagtcggataaccatgccgtgtgggtatggggtacccataatctccacagttgtgttcagtctatgatggggactgcgcctaatgctgccttttctgaacttgtggttgacatgtagttcgattctgtttcagaagctgtactaaacatcttacatattttagttttctttatttatatgattgtaatatggacctcaacgcgatattatgtatgtatttacttgctggcattcgaagttgcttgtccgtgcaatttcagaatttcttgaacttcctgtagttgtggtccttttactagatatttgagacggcacatggattaacataatgtcaatgacctttttggtagtgaggatggtagacttagctgggattattcaagtttcaaggggaggaggccttctatggaggatcggtttagcataaagatgactacgatcaacgaacagacagtcagcctatttggtgtatttgatggtactgtccttgaattttctttcattaagttattttcattccctaatatgtctttgttcctaacatttcatacattaggtcatggaggatcacttgctgctgaatatcttaaggaacatttgtttgaaaaccttgtgaatcaccctgagctccttagagacacaaagcttgctataagtaatgttctccctcttgctccagctgtacttcttccgaacattcaggtccagtgctacagtactgatgttatcattttcttgaatgcttttgcaaaatacaggccaaacgttcctgaaaactgatgctgatttcctagagtcagtgtcttctaatccttttagggatgatggttcaacagctgtgactgctattttggttggcaaccacctatatgttggtaatgttggtgattcacgtgttgtcgctctaaaagctggcaaaggtaatatttgattggttgtgtttctttgttagtgatgacacttcacttcagatttccatataactataaacggttgctatccagtatgccctgaaacctttctgtcaactgaaaaatatcaaaatatgacgcactaccggattctaactttcaaatgactatttctatttttcctgagttacaaaggattatgtcacatgtagattttatcaatgacactgaggaattgagcactaacttttgatatgttgctatataccactttaataagttacagcatgccaaataatctagaaactgtgaaatgacatttattctcttgtttgtttttccgttaaaatctcgtttctttccatgcttttttagctgtcccactgtcagaagatcataaacctaacagaaaagatgagcagaagagaattgaggatgccggaggtattgttgttttcgatggtaagccctttaatcatgaaaatcctcctgatgtatttggccagctttagcttaatctaataggaagtatgaatgaaaacttgagaagtttgatcatgtcgaagcagatacatggagggttaatggacttttggcaatgtcccgtgcatttggcaaccgtgcattgaagcactatgtgaaagcagaaccagatattcaggtatctttttaaagtttagttttttgcactggatccccgccccttgcatgtttacatttttatgtggacaaggaccagcttttctgtactggttttgtcttactaaaccataatacccatttcatatgcacttgggtatcatgaaatagtctgtacacatcatcaacctgaatgaaatggatctgctgcaatgctaaacagcctgcaagtgcagtctatctgggaaatgttgatgttcctgattgatcactttaatctcacctgtgatctgggaatgtcgatgttcctgattggtcatgagaaaacccatgtaattcagcatttcaaattctcctgctacatgttcctcctttgcatatgatcctatccttctacttaattgttcacgcactgattccttatatgccacaaaacctgttaatggaaaagcctattgaacatcacctatgaatcttttgtgatgttttactgtaaatatgcaggaaaaagtggtcgatgaaagcttggaatacctgattcttgctactgatggcctttgggatgttatgcgaaatgaggtatcatttgttgaatccctgtttgttgattatgcgacctagaaaaaaacagcagaaatatctgcttacatgaaaaccaatgaatgacatccactatgttcacccctgacacacagctttgccctcgtgcgagcgcgtatctcattcggtccaatgctaactagcattttacatcttttgtcaacaaggatgctgtttctcttttgaaagcgcaagatggacccaaagcagcagccatgaagctgacagaagtcgcccactctcggcttaccttagacaacatcacatgcatcgtgctgcagtttcaccatggaaaatcaaccaacagcaactgatgttaacaaagttttgtcaccagatatcttgaaacgagagttggtcccctgatccgcggttctacaagattattactagattggttgagtcgtttttttcgtcatgtaggaagcttttaaatctgacgtgcacagtttactagcgaaacgtcttatggttgtttgatttcggtttcggatctcttgctattaggggtagccggccctgaaatattaagttatctatagcataagaaatgttctaaattttttaggtggctaatgatttaatgtctgtgcctatatacttcattagttattgtttgccaaatcccggcgtcgctaatagggatgaaaaccgtatataattttttctatcataccaatatcatttttgcaaaaaaaataatattatttcttctgtaattttttttaatttctctatacgtcatattaaaattatcactaaatatttaattttattaatataaaaactaaattcctgaccgttaccttttttaaaaactaataaaaaataatatcgttttcgatttttcatgcctatttgctagcagcagcagcaagcatcgcaagcttataatcacgattgcgaagctctttcttcttcaaaactcatgtttcacatgaagaacctttattttgaaaggaaaaaaatcaatatttattttgaaaggaaaaatcaatatttattttgaaaagaaaaaaatcatctcttttgcacttctgcttatgtaagtagggtatatgtcctgtgaaaacacgtgaaagttgaacataaaaagttttataatttcatgaaaaaatactagagataggtattgatatgaatacattctcaccaaacctcaaacttatactattaacctgattttttattctttagaataaagttgagcttagacttaagatttggtgggaattatttcatattatactgatctctgtagtattttttttattaaattaatttttttattaatttagagaacttctaggtctggtttttacgggttttactttttttaatggtaagtatgttcgtaacggcttacactgcccaagcaatttaagctgctctaaatcaagactctttcttttgttttgaactttgcttcaacgatatgataatgcaaaatatccaaaatgatttattaaaaaaaatcaaaaaaggactatctaaaaactaccacaagttttttgagtgaaaaaaaatcaaatctaactatagtatgatgtaatttcaccataactatatattataataagataagttgtataaaaaaatatatgtagctttatacctaagttatacagaggggaaaatataattaaaatatagttgtagggtaattatattataactacaatttagttacaatttaattaaaatatatgttgtataattatattacagtaaacaccataactgtagtttctattctactgatcagcacacaaacagatgaacacagagctgtagaccacagaaattataagcgagtgaaagccttatttcttttgaaattgattacaatctacataaggagagtcgaggtgctccaaagagatctatctcgccttaaccttgagggtcctatttataggcggagaaagctgatgatttacggtgtaagctgggttctcctaaaagctaactttttggcttccactacaagttgctggcttacgctgcaagcttccttccgtgataagatatcttttggtttcttctggcgtaagcttctttctatagtaagttttccactcatacttactggttctacttgatcttatttatctttttattctatttatggaatcgtccaaccaaaaacaaaaaagagtctctaccgccatgataaagacgcacggaagaactttgatatatgactagcgtagcacgtggaggatccattcgttgagagtgtccattgtctcagtaggaaacatcgtccacaataaaatatgtttcataatagttatatttttaatttttttttaaaaaaagttctaaaactcccaaaaaaaaattttgaagggaacttttgcgacagttgtttagcggttgcaaaaagaaaaatcgttaaaaacctaaacccagggccgctgtctccgcctccgcctccgccatgcggcgccaccacctcctcggcctcctccgccgcgccgcggcttcgtcgacgtccgccgcctccagccgcgcgggcccacaccccagtctccatgcccctggcccgctgcggaatggcggctccgccccccgcttcttctcctcgcgcggcggcgccggagctgcttcgaagggcctgggcgacgacgaggtcgagctctactcgctcctcctcggcgtcagcatcggcgacgaaggcgaggcatcctcacgcggaccggctgcctcgaggggaggccggagggggcggaactcgaagcggcagccgccgaggtcgagatttgacggcgatggagttggctgtaggtgtgtattttacctgctgcccagttgaaattggcttatctgtgcaatttcagaattccttcgaatttctctacttataatccttctattagagatttgagaattgagaggacatgatatcaaatacttttttttttggcagtaaggatggtaaattgagctggggatattcaagtttccaggggaggaggccttctatggaggatcgcttgagcataaagtcaaccacggtcaacggagaaacagtcagcttatttggtgtatttgatggtagtgtattcaatcttttctttcattaagttgcactagtaattttgttccctatcatatctttgtctgaagattgcatacattaggtcatggaggaccacgtgctgctgaatatctgaagaaacatctatttaaaaacctcgtgaagcatcctaagttcctgaaagacacaaagctcgctataagtaatgttttttccccttcatttcggctgtacctcttctgtatgttctgattcagagccagaaagtaataatgttctcatttcgttaactgcttttgcaaaatgcagaccaaacgtttctgaaaactgacgctgatttcctacagtcgatatcttctgatcgttatagggatgatggttcaacagcagtggctgccattttgattggcaaccgcctatatgtagctaatgttggtgattcacgtgccgttgctctaaaagccggaaaaggtaatattttattggttgtgtttctttgttagtgaagaaactcccattcaagttgccatattgttgtagctataaatggttacttttcagtatgccctgaaacctctttgtcaactgaaaattaagtgtttcttttttttcctgtgttgcgaaggatcttgtctctagtagtttttatcaaattgcaccaattttgatatgtttctataccattttcagaaattggcacgttccaaatactctagatactgtggaattctcttttttgttcttacatttcaatcttgtttatttccatgctttttagctgtcccactgtctgaagatcacaaacctaacaaaaaagatgagcgaaagagaattgaggatgctggaggcattgttgtttcagatggtaagcacttttaactatcagaatactcctaatgtatttagccagctttaatttaatcgaatacgagtaagaatgaaaacctgaaaagtttgatcatgtcacaacagatatatggagggttgatggaattctggcagtgtcccgtgcatttggcaatcgtttaatgaagcgctatgttaaagcagaaccaaacattcaggtatcttattgaagttcagtttgcagaggttccctgccccttacatgttaatagttcagtacttcagttttgtattggttttgtcttacccaccgtttcttatgcacttgggatcatgaaatagccagtatagatatcatcaacctggatgaaatgggtctgctgcagtgcttaacagcctgcaaatgcagtctatgtgcgaaatgttgacttccctgattaatcactttaatcacacctgtgatctggaccactgatcgctgaatcaaacagttaaaaattagtaacatgttgtaacctatgagactcctgaaaacttatgtaatccagcatttaaaattcacatgctatgtgtttctcccttgcatatgattttacccttctgaaaagttgttcacagtactgatttcttatgagccacaaaacttgttcatggaaaagcctgttgaacattgtttatgaatcttttgtgatattctactatgaatatgcaggaaaaagtggtcgatgaaggcttggaatacctggttcttgctactgatgggctttgggatgtcatgcgaaatgaggtatcacctgttgaatcgtaattgttgattatgcgacaaagaatacgacatcacttaagtaatactattgtgctctctactagagccatatgaatatttgcacttacataaaaagaaagaatttccattcactatgttcactctcacacgcccacctgcccgggtgagtgcacgcacgcacacacagttcacgaaagctcgcatattggttgtatctcatttggtccaatgctaactagcgtttacatcttttgtcaacaaggacgctgtttctcttttgaaagcacaagatggtcctaaagcggcagccatgaagctcacggaagtcgcccgctctcggcttaccttagataatgtcacatgcattgtgctgcagtttcaccatggaaaatcaaccaacagcaagtgatgttaacaaagtttgccatcagatatcttctaacgagagttgctcccccagatcctcagttctacaagaattttcagcaagcacgaattattagattgattaactctttttttcttattattatgtataaagcctttacatgtgacgtgcctgtttaaattgcatctttcacgagctataaacggctgatgtttgttttaatcggcgctgtaaattttggggaggcttatgatatatttctgtgcctatatatatactactacttcagttattttgtttccaaatcccggcggttgccacaagctgtaaccgttggaagcttataccaaattcatatgttgcattaagaactcaattatttcttaaccttccatcaaggatatgacaatgcacatgaccaaaatgattcccatggatatggttgtaaacaggtaccgaaggttattcggcccatttctttacatgtcgacaccgttgttgattgcttccgtgcttagccctttcattgttcacaatcgtcttctctcacttcaaactagtctgagagagagctcgaggtaaactcacttcatagccacgttggatgagtactacctggctgatatggtctaccgtaaatccacgtcaaaataaatgggtcaaatctcaaaactagtgaccattgaaatggtttatgctgttttaccaaattgttcatttcacttatctctttaatgaaattaaggaatacattgctaccacgtgtggcgtgaatcaaaggggccaataagaaaaaactttgtacatagttgaattctccaaaatttctatgccaattgtcaattcctatgactggctggaagttcatgtaaaatactgccaaaccacagacttacataaaatccaaggacgtgaaagtgcatgtgtactagttattcttaactggctgccattctaacctaccataaaaatagcatgcatctctttcccacgtgggagtatgcatggaaaatatattcctaaaatttacttttgaattacttatccgacctacaaccgaattatactattatattcgttgtaatttgttgtaattcaatctttataacaagattttacatgattatattctgataaaaattactttaattagatatataaattactttcaaatttgatttatttaataattagttattatgaaaataaattcaataaagcttaaagtaattatcataaatcataattacttctattttttcttatttttttgggaaaattgtttcttattttaaaattatcttgcagtgtaggtattttgtcgaatgtttagtcctaactctaagaaaatattactacctccgttttaggttataagaatttctagtattgtccatattcatatagatgttaatgaatctaggcacacagattcattaacatctatatgaatgtgggtaatgctagaaagtcttataatattaaacggaggaagtaatattttctagagctacttttccctagtagtgtactacttacttataataacttctatattctcttataattacttcatatatgaagataaatttgcttttctaaaaaaagacatagtgatacattaaaataacaaattaaattgtatttactcgtgaatcttctctacattttactttgcataatgccttatttcaacaccatccactacatttactttcaatgctatgcagagttacttccattataaaacctaattatttccacaatttaagtaaattacttttgaatgtttgaatacaatcaatattggactcgttctgttacatattttgtgtggagtacgatggttcaaatggatcttaaaaataatacaaggtttaaagaatatttatcgccaaagattccatacccaaaagaaaatagactagtgtaataaggattcaattgttaattggttggtgttgacctccgcatgtaaatatgtgccacgtcaactagatagcgccgatcggactttgcatgtatctcgcgataaacctaaatagtgtataactagaatttacaaaaatttcaaataaaatctttaaaaaagaaacgatcaaatctgaagagtcgagtactaaatctgaaaagaaacgatctttaaacctgaagtgaagtgacttggataatttgatacagtactagatctgaaattctgaaccgtcgcggctcacaatcggacggttgctagatctgaaattgatagatctatcaaatcggacggctcacaagctctccccatttcctctcaaaaacccccaattcctcagcccgctgtcctgtgttaaaccctaaacccagcccaccgtccatcctccgccgccgccatgcggcgccaccaccacctcctcggcctcctccgccgcgccacggcctcgccgacgcccgcctcccgccgcgcgggcccaccactccccggcctcctccaggacccgctgcggaatggcgccgccgccgctggcccccgcttcttctcctcgcgcgccggccccggcgccggagctgccgcgaagagcctgatcgaggacgaggccgagctcagcgactggatcagcgacctcaagaccgactcgttccacctcggcctcagcagcggcgacgaaggcgaggcctccacgcgcgggccggctgcctcgagggaaggccggagggggcgggcctcgaggggcccgccgccgaggtcgagattcggtggcggtgatttcggcggcgataggcgtgggtttgagaggagggggaggatggtgagtaataatgagctgggtgacgacgatgatgatgaggatgaggtcgggtttggtcccgcgaggggaaggcgggatcggggagggagacagtcagaattttcacatagaggaaggaggggaaatgatcggggagggagacagtcagaattttcgtatggagggaggagggcaaacgattttgatgatgatggtggtgggtttcggtctacaagggggcagcgcggccgaggtgggaggttggcaaatgtgtcgcggaggggatatgattttgatgatgagcctgggtttcaatctccaaagggacagcgcggccagggcgggaggtacagtgatttggatgatgatgaaggtgggtttgggtctctgaggggaagacgcggtcgcggtggaaggatgtctggtgtatcgcggagaggtgggaggggaagtgatttagatgacagtgaggatgatgaatactcaagaggttcgtctccaaggggaagacgtggtcgtggtggaaggatgtctggtgtgtcacggaaaggtgggaggggaagtgatttagatgacagtgaggatgatgaaaacgattctattgactctagaggcagaaggcgcgaccatggcacgagaggcaggaatgtgggaagtttgggaccacagagaggtgggagagggggcgatgcagattttagcgataggcggtcgaggggtggtaaaatgtttgattttggcttgtcagaagatgacagtgagctgggggaagttgatgaggatgatggtccatcaggcttcgaggatgatctctttgatgacgagggtggtgagaagaatctggtggagagtccagctaaaaattcagctccttttgagtcaattaaaggagagccaattgatcaggagggtgttgtgcacaccagagagagtggaggtggcgattcgtatttgagccagacgaggtagctccacctttaaatgttttctgatgcaatgttgcctgttttctttgattcagctctgaaaaaaacttactatctccatcccaaaatatagcaacctttctagttcggaaggagtagatcagtagtctataatcatctaggtttttatggttgggctaaaagcttacatcattagtggattgccacttatttgatgaagcaacaaattatgcatttctaatttgtccgatccttgttactggggctgctacagtctgcagcttttccttaacgcaaattgatgcttccacagtttgatgtcctacttgatgaaaaatgttataaattattgaatccaaagtaagttattgctatgcttgtctcagtgtatttgtgaataatatggctatgatctatgattggcattgtgcatagatcatctgctatttctctgaatagttgcaagcatgtactgaaaatttgaaacactgggtacaactgatgattatgcacgtattaatgttggtccttttggatgttctcacattttacatgataggtttgatgaatgctccctgtctcccttgacactaaaaggtgttaaagctgctgggtatgaacggatgactgcagtgcaggaggccactcttcctattatacttaaaggttgatcttagtagttcttctttgttatgtgctcaacattgtagttttatctatagtatttcacattttcttttgcaaacttgtctcaagagtttataaatctatcagactcgtattcactaacttccttcacatttttaatttcgaatctgctatcttcacatatttattgaacttcaaattcatgtttatgtttgttaatttacaaacatcatgtgtgaagacaacgtattagttcccatcctgtgcatttgcacccagtaccacacaagcagatcacacaaacttgacctactgagctggcatagaaaaggaaaccac

SEQ ID NO: 29397 - DNA, 31999 bp, Oryza sativa
aaaatcatgtaatataaactgttcatattttctaagatatttctcatgattgcagcttgaattgcaacttttctagcccataccatgtactaacaagccttatatatataggtaaggatgttcttgcaaaagcaaaaactgggactggaaaaactgtagcattcttggtaactaccctgcttgactactgaatttttcttgctcttttgttgttctaaagtctgaacctgcaaaatggtaatttgtatttgtgaatgttgtatgtgtagcttcctgccattgaagttgtctccaaattgccccctattgattgtgataaaaaaaggcctcccatcagtgttgttgttgtgtgccctacacgtgagctggctgatcaggctgctgcagaagctaacaagctcctgaaatttcatccatcaattggagtgcaacttgtaataggtggcactagaatggctctagagcagaagcgaatgcatactaacccttgccaggtgattggaagtaacttactgaattatcctggatatttctacatttggattgtgtgatgtaaaaatgctgctgatgtgcagattctagtagctacaccaggaaggcttaaggatcatatggagaacactccagggtttgctactagattgatgggtgtcaaagtccttattcttgatgaagcggatcgcttattagatatgggattccggactgatatcgagagaatagtggctgcactcccaaagcagcgtcaaacacttctattttctgcaactgttcctgatgaggtattgccactgctataggtcaacacttctgtttggtcgaaatataatcaatttctactctcttttctaggtacgccaagtatgccacattgccatgaaaagagatcttgaatttgtgaacaccgttgaagaaggaagtgaggaaacacactcacaggtattttttaaagcatatgcatgctgactgtttttccagattccaagtttctataaattttgatcagacatgttaccttttgttaccatgtttttgagcaatcttttgttaccatattcaggtgaagcaaatgcatgtagttgcaccactagacaaacagttttctatcctgtatggtcttctaactgatcatatttcagaaaatgttgactacaaggtaagtgaattggcatattttaagtgtctcctgtaaatatgcgtacttacaatgagaaaaatgcaggtgatcgtgttttgtacaactgcaaaggtaacaagtcttgttgctgaacttctgtctgaattgaagttgaatgtacgcgagattcactccagaaagccacaaagttacagaaccagaatatccaaagaatttaaggaatcaaaaggtcttattcttgttagctccaatgtatctgctaggggcgttgattatcccaatgtcacactagtcgtccaggtaacgaacttctttatggtagttattgagctgtttatttgttgttgcctatcttctttgctatttgatatacaaatatgtaaaaactccagatcgtccagcactggaagattttctttttctatattccgcttgtaaacgttttgttgaaacaaatacgagcatgtgcatattcttttcttttatcatatcctgcttatataccaatgtcagctgattatcgtcgttattgcagatgggagtgcctactgacagagaacaatatattcatcgacttggtagaactggccgcagaggaaacgaggggagtggaatcttattattggcaccgtgggaagaatacttcttgagaagtatcaaagatctgcctattacagaggcaacattacctttaattgatctggacactaaaagaaaggtaattaagcttatttactagttcagatatgatagttggtgcctgtttaaggtaatcaagcgtacatgcaatagtaacgatcatattgttactatttgaaaacttttttgttaaaattctgaatttcgtcatgcctgagaattgggcagttggttctaattgatgtctgaataatataatctttcgactatctaactaatttccattcaaataagtatttaaaatccacaaaccacagatgcaatgtccgccccaatcttgaggtgtgttgacttgtagattgtgcaaattggttggttcacactattttttaaatgctggttcatcagcacttgtttacctagcatataaaatctgcatcatgaagagaaaatacttccaaatatgctattccaccagttagaattttggtattgtcactattatgcatgactagtgtttggatttcatggtgaaattgagcttgacaccatggcttcgttgtatgcatttatgcccttcagatgatctgagtcttacaatgttgctacttgcagtaatatttgcttaataggccagccaaactatgcaaatttcctcttaatgctcttctgttcatgttagaagggatattgtttgacacaaatatatcaactgcaattctgatttttttttggtttacaaggcatagttagtgagtggtacatatatgtgtgcttgattctgtttccagtaatagatggtgatgataaagccagtttttgctgggaagcatcaccaggattcaaaccccatgtttacacacccgcaggtggactttagtaggaattttgtgaggctcatgaatttatccctggtctacccttcatctgtttgagcttgtgttcaaggggcatactcacgggtctttgtgcatgtatgtgttcttataattgcagaaaaaaagaagtaaaaaaaaatcactgagcaaggcatgatattctatattgtgggataattcttttgtacgtattgttgtttaaccatcaaaaggctatgcttctgtaatgatatgtgtttgtcagtggttctttgaccaaagatattttttaacaacaaaacatgataattgactgagggctcatttgcgattgttgcatcgggctgtggagctagtgaagggagtcataccaaatactccctccgtcccaaattatagggcgcccactttttaaggaaaattaaactcggtagtttttgactaataatcatactaactatatctatactaagtatgatgcatgttatatcactagattcatattttgaagtactttcatgtgatgctaatttcatatttgttgggatcatagaataaaataaaatactggtcaaagtatgttatggaagaccgtgtaaaaaaaatatgggccttataatttgggagggagtaacaattatactaaaaagaactgttttgcacctaaaactaaggctgataattgattattgtatccaaattcaagaatagcgaaatgaatgtgatttgaaaaagcaaccgcaatatcaaatgtgaccccatgcgggttggctgtaggtttactgagttaatgatgtgtgtattgtcctatgtctggtgattgttcttgcttagcttcatcatgcactgactgttatactttgtatgccatttcccgttcaaaatactaagaatgatatcctagttgttggtatttggcataatgctcagtattgcattttcttattgtttgtaggttgaaaaggctcttgcacatgtggaggttaaggataaggaacttgcctaccaagcatggctcggttactataattctaacaagttcattgggcgtgacaaataccagcttgtatcacttgccaatgaattcagcagaagtctgggcttgaataaccctcctgcggtgcctaagcttgtccttagaaagatgggactgaacaatatcccaggtctgcgatcaaaatagtcttcctcgaaccaaagttttcttgaatacacataccacaatattatcgtgcttcacagtggtatgagttttggagcagtctagctggtaaactaataaacagctatgattaaaggtcataatgggctactgggagcacaactaaagcttcagtctcaatttttttctcctgcaacatggaaaatatgccttatgaaggtgaatctgtacacaagcgatatgtagttttgcatgcccagtactgtgatgtttaaagcctgaccatgcatgatcaggctgatgtaaacatctgagttggtggcacacggaattttactttctttccatttttgtgtgcccgtgtatctattggatagaagcacaatacccctgtgcatgcgctatcgtatttattggacaataccattgtgcatccgctatctggaagattgtgcaagagctctgttctccatttggcctataaatatggtatttgtgtaatgttgatcaccaaattgaacatataatctctgttagtctaccttttttgacaggatagggctacgtagcctgtgaacaaatatttgttagttttgtagcatgcattggctacgtgtcgtttttgtctttttgtagtgtatgctacaactcttggcactttatacaaggtgaaggtgagaaggcaaaacatgcaagaggctctctcgatacattatctatgagttgtttgtcagcctatcccatgatttgaatatttgagttacttcttctggcttgtgcctcaggacatgagtgtccttgcgctaaaaaatataggcaatcttagcatccgttaaaataaaaaaactatttttgagttagtttttcatcatatatgctagagccaatttttttttctaacgctctaacactaaaccttagttttgttccaaacctaacaaaaaaaagacctatgtttgcaatggttaaattcaattctgagaggaaaaaaaaatctaacaaagaacaggttaggaatataataatattattggaattttcttttaagaaatgtttttttaaaaggcaatgggcattattaaatcgtaagaaataatttaaccagcggaggtgttgcaatcaaacaaaattcttgcatccaaaattgtaacaaacctgaatttgtaaaatcatggcaaattagagtaatcaaaatttccaatttatatttattgtggtgaaacctttgtttttggatttctcatgcatcatatgtttcattttgcgtacattgatttatcttcgaaaatagaacaacaaatctctatgttcagcccaatggaaaactcggtgcactgcatgttctaagcctttgcatgcattagtacaaattgcaagaggagatacatttcctgtagttttatgcaattgatttataaaccaggtccagttatcactagtttcagcatcaatgaaaccaaaagcatcaatgaaaccattagggcagttgagtctatactgaggtatggcctacatccaattagaagtccaataatgcatgcacaaaagaatctgtgaaaataaacattcccatcaacttcctttgtgtcaatttcaataacactaccaggagacctctccatgattgcaaccctccacctatacaacaaatggaaattatcttcccaactgccatgcaactagatcatagccaaagtcccacccttagccacagtatcataattgattttgtatttctgatcctcttccaacttggtttgcagttcttcagggcccatacttgaatccttcctaaggatatgcatggccttggaagcaacctagtcgctggttggtgtggtagtcttccttctgccgccagatgtacacgtgtggttgttaataaactttgttacttgcaaaaacaaatcaaataaaacatggcattagagaaattttttttaaataacatacaaacaaaaatattaatgacatccgctaaaaagtaccattgtggtccactcgtcagcctgtttacgcccattaacatgccaaggacaatcaattgcccctttgcatcctcctacaaatctagtacgatctctcgcctttacccaaagtttgaactccccattgatggcaaactgtctaaccgccaacgtaaagaccttcatgttgggatacatagtacctttcaccaaggatgagttattcacgtcatacaccatcatcctttctcccgcaaccttggagtatcaaccacaccctcattttcatcatcattagcatttttagcaccattggcatcggtacctctagcctgatcatcattttcagttgtagcctgagccaccgctcgtgcatactcggcggcttcatcctcatccctcaaacccaaaaatcacgtgcaacaggtccccatccacgatttttaatcttcctacgacatctagtgattcatcgatatgtaggttttcccaatcaacaatcggtggttgtggttgtggttgtggttctgggtgtagttatcctccttgagtaggaggagaactactacccctagcaggttcataaacaggggattgtacaactactaaacgactctcaggctcctcgagcctagagaaaacaaaacaaatgattgcaaatagtcagatctgtatatcccttactcccatgacatgagagagagagagagagagagagagagagagaagtgcataccttccaacaaaatctagccaagtggagtcatccatggagccaaaccctaaccacacaaacaaattcagtgagtgccaaatgggcactgaggtcggttatagatgaatgggggatgctaacctggggcctggggtaccactatttgccagctccattgcatccgcagatgtcgacacagattgtcgccgtttgggttgagtgggcacctgataaaccctgagtttcactcgatacgctcaaggttgttgttttgtccgatctttcggtgagttgagataactacgatttagaagaaacgttgatgatccgattacaaccgtactagacgttgttgtgttgcgtcttagcgatcgatgcacctctccgtgggttgttgatcttcccaatgcaaatcaaccttattcctgcaagcaaatcgaagaaacaagcaagaataagataaaagtaatctgaattgcaaataggaattcaatacaaatgataagttggggttccgaagaacaagcagacgggcggtctagctgacacgcgcactgcaagcaaatagcaatggctaaactttaatctaatagaacccgagaaaccctgaaggtgtacctaattatttaaggaggtgggaggacgacctagggatctctagggtcgtgctccacctgtttggggcacaccccacatgggccccacttgggccggggtcccaaacgaagttttaggcccataggccgattataggtgacgcaacatcttgtttctatgattgcagccaaacgatatggaattcggagatgaggctggatcccttggaaagaggactctgagagctttctatcaagtactcacgggttgaaaacaaaggtcgtatacagatttggcggccatttgaagtcagcagtgtagcaggttgccgaatcggattccagcacttggaggacttgattttgatatcttcttgttcatccatgatgtgagcaacgattgtatccatagtagccatggtcacatcagcagcggtgacacgaatgaagggatggcagcggcatgaattgagggatggcggtgacgtggtaggtagaagtggaggcagattaggtggatgagggtcggtgccagtgccacggccggcacctgtgcaaaggaagggttgagtgggcagcggcggcatgaatagatggatggcagcagcgtgagtgaggtaggaagcggaggcgggagaggaaggaggcagagcaggtgggggaggggcaggggtcggcgccggagctgacgacggggtcgtgcctcccggaactggtgcgcaatttggagaagtgatttgctgggcgtgggaaaaaggataagaaagagaggggaaggggtattttggtctagagaaaaaaactaaaatagagcaaaaacatttgtattaaccaaaaagaataaaaatggcattttggtcaacaccctcagtttaggatggcattgtaatgaatcagtttgaagcgatgacattctagcgaaaccactttttttgcgatggtgtaatcccaaatttctccatgacagtggtggtgggtggtggcacattcaccactcaccacaaccattgggtttttttaaaggagtgtagataataattaattgcgcatgaattaattaactaataaatctattctggttgttatgaaattgaggaggatgccactgagagcgtctagggctgcgttcggcagccaaggttggcaactaatcacttctgcacgaaaaacagaacggtctattagcgcgtgattaattaagtattacctatttttttcaaaaatggatcaatatgattttttaagaaactttcgtatacattttttttaaaaacacaccgtttaatagtttgaaaagcgtgcatgtggaaaaaaaggggagtgagttgggaaccatgggtactgaactcagcctaggtatagccattgtaccaaacaatgtctagactaggactccgatcgatacaaaagaaaaacgatgtgccactgggtacatgttacaaacatctaatataaagtccgtattgatctttaccttttcagagaaagagaaataatgtcatatagcatgtgaagaaggtatagttcagttttgaatgtagcctgtactgactgcctccctacctagaattcaagtttgaagtgaagtgttgttcatccttgtgcagggcatgctagaacccttgacactttgtacaaggtgatagacaagagagggttggagcatattaaagaaaaaaggtaagtggttcctgtagtacttggcgctaaaaagtatgagcatgagatagactcgcatatatctctcaacctttgcaacccttaaaaaaaataaaagaaatacttctaagtttgcttttcgtcatgttagaggcaaaaaaatggttttctactttatgcttcaagcctccaaaatcttaaccttggattggattgaaacctaagaaaaaaaagaagtcccatatttgcaatggtcacacttgattcgaagtatatatataaaaaatcttatgttctcctatctcacatggctttaggtgcatataaaacagtaaaaattaatgaaatatttgacaagttagaatgcaacaaaaacaaaattggattttcatcgagaacaattataaactatgcatgattcttgcacaccatttcgatctagaaacaagttgttattaagaaggctctaggatgactgaactagttttgggctgttagcctgttatgctaagaaccagttaggaactcaataatttcattggaatttttttaacagacggtgggcattatatcagggaaattaatttaatcagacgaagtattgcaatgaaataaaattcttgttttcgaaatgctgttaataatatcaattttaccattttgagttttgagaccaaactaacaaaagatatggtcgtgtcctaggaaaaaaaaatcaaaatgattgcaataaacagcctgggatggcatgtgactgccaacagtttggtcaattatgtattttttttataacaaaagtgtgcaaaacatattcagtttttgtacacagacacatttggttaattaaatgccttgcacacttccatgaacccgtccgactagctttcttcccccaccgcctcacataagtacatcaccatggtcaagctcatgacattccagcagctatcgtggaggcttcaagacaagccatgccacagtttgcttcacacaatgacgaagcagatcaccgaaagggttatgttgcttgtcatatatataccacccttgtgcttgctcgcctgttccattccacctcaacagattggattcaagagctagcagtcatcatcttcccctccttcctagttggtgttgctgtgtttctactgcctaccggagatgaacggctgtactggtggtgctggaggagtggcagcagggaggctcccggcggtgagcctccagcaggcacagtggaagctagtagatgagcgatgtgagctccgggaggaggagatggagtacgtgcgatggttccaccgctatgagctcgttgcaaccggtgcaactccttcgttgccaaacacatcagggtgcccctctaaactgtaagtagtgataataataacaagcatcatctcgtttttttgatcatgtagttatatatatatatatatatatatatatatatatatattgattatgatatggaattaatgcatgccatgtgctatatgtggattttttcttcaatgattaggtttttaactattttgtatttttaattatattgggattggggttgcgctaccctaatagggatagggattctattgttaactattttgggtggtcgatatatgtgatttcattgcacgattcagtttaggagaataattatacttcacatatagtttgataatgcctgaattttagccttgtagattttgagtttgcggattaccatgctaaaatactatcttatgaaaattgtctatatgctccctcctgttacgaataagcgacctttgggatagtgacacggtcacgaccaagacaattgtatgattactaattactagtgtaatatgtatggaaaatgtaggaaggttataatattctgatactatttttaaagaatatcagtacataccaaatttaaaagttgaatttgaaatactcaaagtgatattgttggtataattctaaacatgttgattacaggcatttcagaacatcagctaattgtgactggtcggagtatatgtacttatattatgctaggataataaatatgtattgtaattagagttatataagattacatatggatataaacttttagttgttagcacctgtgtaagtgtatatcctatatacaacatatatttttttaaagtaatagtgttgatctaaaatgccaaccaaaaacaaatcatatttcatcttgattaagttgatgaatggttttcaatctgttgtccgcaacacacttccatacagaaatgttttagtccttcataatttggcgtagtgaatcttccatgtttgtctttatatataattcaaaataaagggatcctttaaaaaaaaccttaatgaattcaatgtggtaagtgcacaatgcagattgatgttcaaattgtatttataatgtcaatacacgtttaactgtattaatatatgcttgaattggtaccaataattgtttttagaattacataaagtattatcacttggcagtaggattggttctcaatacttctttcaaatatttaatatcatttcagagaacattatgtacatgtttatttcaataccccacactcgcacgtgcgtgcgcgcgcacacacacaaacatttggacatgcagcttgtgtgttgcatctaacatagactttggggttttccctccaaaaatgatttactttgaagctagctaattctcctttgccatacatgtgaaaaccactcaaactaatttttttttgcaacttctgtgaaaactaactgatgatactagttatgttttttttatactcttcaatctcatcattattatataggtttggtcaattgtgaggaggtttgatccgccacaacttttcaaaccttttgtgagaaattgtgtaatgtgaggaaacattgagaccaaaagtgttagggaggttggcgtcaaatagagagtagcttaaacggaactcgcacaagaggactgccctaataaaataacttaatactgttcaaagtgggctcccatccacaaggagaattgaaaggttagggttccctgatgataatgatcacaccctccgtgtcaagtttattggtggtgatcacatgctaaaggtacaattcaatatttatcaccattccaagattttcctgtgttttgttattgctatcaagccaataaatttgatacacaatatagatatttttatttgagataatggaaatatatagctttttatggataaataaataactgtaatattctatatgtgccttggcaccatatccttacttgccactagaaaaccgggtcataccatacttgtccataatgtctcactgaaatgtgggccttagacccgcatgttgtttagagaatggcatcaaataaggaaacatttcaactttaggggcaaaaataatgattttatcattttttatttttgcatgtattttgttgaagatctttatttgtagtggtcctgacagtcgatttttttgttattattccaggactactcatccaccttgattatccacttggaggtcatcgatggccagctagtaacactagtgattgagtcatttgtggtggacattctagaggggaacaccaaagatgaaataagctattttatcgagaacttgctcaagtttaacctaaggaccctccgtgtctgaggagagcctagccggtccttgatctcacattccttctttggtgattgttggattaatcgagatatcaaattggtagaacttgttaaaactccgagaaacaatgcagctctttgatcaacactgattactaaagcttcttctaaagaatttagttaccagtgcaatcatagcactcactttagtttactacatatacatatccaactttcatgtttatttcgctttggtgtttgaaatgttgaactaaaatgaaattacaatattttgaaggattgttgccggacttcatgtgcattcatgtgtcttacacttggctatttaaataatgtacccatagatgcatgtccctcttatcaccgagttccataacttctttgaattcaatataaacacttatttgatttattgtcttaaccatggcacaatatgtcaaaatgcaccacgcacattgtattaactaccaacactactttgtgcttagaagaaaaatagatcgtggcatcagatttcaagaacaaaaagaaaacttgaatataagcatgtagtacccgatagtgtggagatcttgtcctgtggacaccgaagaggacggtcctcatctacgtgctcgtcctacctctacctcttcatcaaagacccaacagtcagggtgctttccacaaagctagggcatccagtggcctctgcctcctcaccgtgagatctggcagtcccatgatgaggggcattacatgtgggtctcagaaccatcgccatcatgcaccatcactggtgatttttttttgggtttataataattaattacgcctgaattaaataactaataaatcagttgttatgaaattggggagggtgttgctgagagcgtctaggtatggacatgatagcaaactgggacactgatcggtatgaaagaaaaacgacgtgctacttggtacatgttgcaaacgtcccaatataaagtcaatattgatctttacctttttagagaaagagaaatgatctgataatgtcatgtagaatgagaagcaatttttcagttttgtacgtagcctgcactagctgcctgcacacctaggattcaagtttgaaccgaaatgtcgttcatccttgtgcaatgcacgctagaacccttgacactttatacaaggtgaagacaagagggggttggagcatatttaggaaaaaaagtaagtggttcctgtggtacttggtgctaaaaaggtatgagcatgaggtagattcacatatatcacgcaaccttttcaaccttaaaaataaaagaaatatttcttagtttgcttttcatcattttagaggcaaaaaagcttttctactttgtgctccaaacacccaacaactgaaccttggattggattcaaacctaacaaaaaagaagtcccatgtttgcaatggtcaaactcgattcgaagtagcaaaaaagtaatcttatgttctcctatctcacatggctttaggtgcatatcaaaactaatgaaatatttgaccagttggaatgcaagaaaaaacaacattggattttcaccgaggataattataaactatttttaactcttgcaagttcttattaaggaaggatctaggataatttaactcgtttttggctagttaaccctgttatgctaaaaaccagttaggaacatactaatttcattggaattttcttttagggatttttccttcaacatactaattgcattttattagacgcagtattgagttcaaatgaaattgttgcaatcaaaatggtgttaataataccaatttaaccgttgtaagtttttggagaccaaatgaacaaaagatatggtcgtatcctaggaaaaaaaactaccaatatgattacaacaagcagctcgggatggcatgggacagccaacagtttgatcaattatatattattttagaaaacaaaagcgtgcaagacacattcactttctacacacagacacatttggttaattacataccttgtacacttcaatgaacctggccggttagctttcttcccccgccacctcacgtaagtacatcaccatgatcaagctcatgactttccggttgctatcaccgaggcttcaagacaaggcaagcacatagtttgccttacacaatgacgaagcagatcactgaaaggtctatgctgctggtcattatatataccactcttgtgctttctcccctcttccattccacctcaacagacctgattaagagctagcagccaatctcttccccttctcttcgctggtgtcactgtgtttctactgcctaccggagatgaacagtggcgctggtggtgctgggggagcagcagtagggaggatgccggcggggagcctccagtgggcacagtggaggctagcggatgagcgatgtgaactccgggaggaggagatggagtacatgcgacggttccaccgccacgaaatcggtagcaaccagtgcaactccttcattgcgaagcacgttagggcgcccctccaaaatgtaagcagtgataataatagcaagcatcatctcgtttttcttgaaccattattaggtcattatctattttgtttttttaattatattgggattggggttgtactatccattgatggagttagattttattgttaattgttttagatggtcgatatatatgattttatcacttgattgaatttaggaaaataattataattcacatatggtttgataatgcctgaattttagccttgtagattttcagtttgcgggttagcatgccagaataccatcttttgagaattgttcatacgctctctcctgtaacaaataagccacctttgggatagtgacattgtcaccaagacaattgttttttttattgaaatgaacactactggatttaccctgcagttatgattctataaatagaagaaaaaaactttatgttacaaagtaaaatgagaaaaagaactatactgattgtaaccagtctaaaaagattacttttagcttcattcatcctgcaagtatttaagaaaacttcctttttaaaacttgctagctatctgcccatatttgcaggatttttctaaaaaaaaatctgggaattctactgcttccgaatatgccaactggctatgattaatatgtccatgaaccctttcatccggaactgtatccgtgcaagaaaattgtaggaaggtataatattatgaaactatttttaaagaatatctacccataccaaatttaaaagttgaattcaaaattctcaaagtgatgttgttggtcaaattttaaacgtgttgattacaggcattccagaacatcacttattttttaccagtgggagaacatcacttatttttgaccagtgggagtatgtaagattacatatggatgtaaatatttagttgttagcaccttagtaagtgtatatcctatatacaacatatatttgatttttaaaacagtaatgttgatctaaaatgccaaaaaaaaaaacaaatcataattcatcttgcttaagttgaattgttttctatatgttgtccacaacgcacttccaaaaaaaatgtccttcataaacagatgtagtgagtcttccatgtttctctttatatataatttgaaagaaagggatccatcaaacataccttaatgaattcaatgtggtaagtgtacaatgcacgttgatgttcaaattgtatatattacgttaatatacatataactgtatttcagctatgtttgaattgataccaaaagtaaagttgtttttggaatcgcatgaagtattatcacttagcattaggattggttttcaatatttatttcaattatttgacataattttagagcacattatgtacttgtttatttcaataccctacacacacgcacacacatgcacacacacaagcacacacaagcacacatacgcacacgcacacgcgcacacacatgcacacgcacgcatacagttttggatatgtagattatgtgttgcatctaacgtagactttgggtttttccctctgaaaagggtttactttgaagctaactaattctcctttgccatagatgtgaaaaccacgcactcatactaatcctgtcttactataaagttattccccactaactccttaagcttaacatgcaaagatgccacatcatcatccactaattaacaagatgtcacatcatcatccactaacaatcatcacatttaaacatcatgcaaacatgctatatctttatagtttttataatttaagaacttttcaaacacaaacatgttaaattatcatccaacataattcacataatgtttcaatgtatatcttcatgcaaagataccacatcatcatccactaattaacaagatgccatatcatcatccactaacaatcatcacatttaaacatcatgcaaacatgctatatctttatagtttttataatttaagaacttttcaaacacaaacatgttaaattatcatccaacataattcacataatgtttcaatgtatatcttcatactaaattcccgcaacaatgcgcggggtttcacctagtttctttgtaacttctgtgaaaactactgatatgatactagttacatttttatttgatacccttcaatctcttcattattatacaggtttggtcactggtgaggaggtttgatcagccacaaatttacaaaccttttgtgagaaagtgtgtaatgcgcggaaatgttgagaccggaagtgttagggagatcattgttcaaagtgggctcccagccacaaggagcattgaaaggttagagttccttgatgataatgaatacatcctccgtgtcaagtttattggtggcgatcatatgttgaaggtacaattcaatatttataatcattccaagattgtcctttgttttgttattgctatcaagccaatatgtgaaacacacaatatagacatttttcgagataatggaacaatatatgtacctaattatggagaaagaaataactgtaatattctataaataccttcgcaccatatccttactggccactagaaatccatgccataccttacttgtccctattgtctcacagaaatgtgggccttagacccacacgttgagggaatggaagcaaataagaaaacatgtcaactttggcagcagaatcaatgattttacaattttctcaaagttgcatgtatttccaaagatctttatttgtagtggtactaaccatcgttcttttttgttattatgccataactattcatccaccttgactatgcactctgaggtcatagacggccaaccaggaacagttgttattgagtcatttgtggtggacattccagaagagaataccaaagaagacatatgctatttcgtcaagaacttgctcaggtgtaacctaaggaccctcgctgatgtgtctgaggagagccttgccagtccttgttaaaactccaagaaacaatggagctccttgatcggcgctgattactaaagcttcttctaaagaatttagttatcagtacaatcatagggctcacttcagtttactacatatacatatccaactttctgatttagttcgctctagtgtttgaaaaatgttaaactgaaatgaatttataatattatgaaggattgtcgtcggacttcatgtgcattcatatgtcttactcttgtgtttccaaataatgtcccgatagatgcatgtccctctcattatcgtgttctattacttctttgaattcaagacaaacacttatcccatcttcttatatagttgatacccactacaacattaactcctataaagcaagcatcaggtgaagccacgtcatcagttctttacagctgtcggatcaacatttcaacaactaaccaagtgcaaattgctgtctactcctgctggtcaggcccagctcctcagcccaaattgctctttgtttagctgacctcggcccattctcatacggtgatggaaagcttccccgccgcctcgcatccgcatatgttcgacatccagagcactaacacaagtcgactgttcaaatccacggcaacacgaggaaggaaccgaagggacatggcagtggctccgtttccgcttcagcttttgcatccgattcatctttagattctgccataatagctgtcgggcaaagtaactgtgcaccagaaatcaccgccatgaatgggggagtctcaatacaaccatggttaatcctcctagcctttttcagttcaccttccaatcaaacgaaccctgactccctgagggacatgcacccagggagctggtttcagatcctcttggttcttgccatgttcacttgctcgaagggtagtgtcctacctccatcggagaaggtgaatgtctgagtgccgcgcggaagcaatagtgggcatgggcaggaagcagagcggaggtggcatgctatggtagtatggcatatgggcgactggcttctcaccactgccagaaaataacgaatcaagagcgagctttgtagcctttcaacaatctgactattgcagctttctaggtagaggagacatactatgggcgattctcttcggtcttgctccaactattgcagtcttgcagcctcggtgagctttccaggctttcaaagaagatctgaagtccaatatatttcttccattcttcgtgagtattcttctcccattcattttgttcatcttctatctgcatagtttgttgattgcaacaattatcattttacttggttaaataatagatctgttaatccctttatgtcttgaaccacattgaacaaaatgtaagctctgtttcaatgcatgatgccattcactgaaacaacaatgtggttcactgaagaaatagcactgagaagtaaacgtttcatgcgggaacaaattagcaagatcaaggtgagtgtttttcttaaatatttattttgatcatgaatggtttaacaaaccagttggtagaggcccagagatgccttgactcagcatcagtatggttgtgctatataaagatgttgtccgtattctctcatcttttgtataatccacttcttttagacatttggtggaggcaaatagattgcagcttaatatttccttctatttttagttatctactgacgtacgttctcaatcattcaatactgttggcacatctacaggcatggttctacatgagttagctaactcatgtagaaaatgaagaagagatttactgcattggaaagcataatttggtaccgaacgctttacgccatatgatgtccaataacaaaaggacaaagtctctactcattgttgtccaaccaggtacctatatttcccaaccggcacccaggaggcggcactgattacccagggtcaaaggtgctagttccaaaactggcacctttgaggcgtccatgagaaaaaaaaatcggctcaattcatcgagtcgatgcattgagccgtccagccgatcccatctaatacccaaataccaaaatttcctcaaatccatgaacacaaactagtcaataatcctcaaaaaaacaacacatcaacatcacattcatcaagagcacaacaagaacgaacacatcaagaatcggatggaggaggagggctccactgccttcaccaccactgccactgccgccactgatgtctccactgccaccaccgttgttggatggagaggaggagggcaccgctgccttctccaccgctgccgctaccgagggaagtcaccatcgccacctcctgggccgtcggaccattgccgcctcccctcctgccgctgagccgtcgccgggccgccgccgccacctcccctcctgctagatctagcggaggggagggcgccgccgtcgggccattggatcaccgctgtctcccctcccgccactgacccaccgccgccgcatccccttttgccgtcgggctatcgacgccacctcccctcccgccagatctggcagaggggagggcaccaccgccacctcccggtctgtcggaccactgccgcctcccctcctgccaccgagccgctgccgccgccgcatcccctcccaccgccgcacactgtagcggccactgcctccgggtcattgccgagagagagagagagagagagagagagggggaatggataagatgtggggaggagaggaggggataagatgtggagcagtggaggtcagttcggctcggctcggctcaaatttagggggtgtcagtttttaattaatcgacacattgaacatattaaatgtttgtcggttattatttagaaccggcacctataattgtttaaaggtgtcgttttttgcgatttcaacccgtggaggtggggaaaacgcctataggttccggttttagcacttccggcacctatagtgccgacatctatttgatgttttgtagtagtgattgtacaccacatagaacaagttgatcttctatcttccaaggcttgccccatacgcttctttttcaacaaagattgatccttattaacccatgacttcttatagcctcgattggtacgtcggtgttgtaccaagcacttactccttcaacactacattgagtcctcggtgccaaaactctgcttgtccttctcccatgcatgttccattgcgtcggcatgtattaccaacatgcttaccacatcacaacgaaacctcattgtatttcttcttctttatcatctcatcatcatcttcttcatcagactgatcccctatttatacactcaataagcacattagtcccctaatcgtttgtcatcaattagcaaaatccagtaggggcctaggtgctctttccatgcccttggtagatgttctcacgaaatcaaccaaccagctcgagatataaattgagctactcttccctgaatttaatcgttctttcaaactaaaaaggcttgaagatgacgacgatatagaagacatgactctcagactttgcaaaccatcggattgacatggtacattaatctcataatttttgtttatatttttttgaattgtattaaaactaatagtaatttaatttctaatgtgtagggtgaaacttctaaggtgctaacgaaaagctagcttgcaatacatcttacttcatgcgatgaatgagcttgggctacacattcactccacctaggcctatttggttcaacgacttcaaacgtactagtcctacatctattttgtgttcaaagcaacatctatactaatataaaaagaaggagttgcccccctctaatcctactagccaaatcatctcatctaatctcttccatccatccaccatctcatctcatctaattcgccaatcccacttattccacctcccatcatgcgagataactccgtcctggcgcacgcgatgactccgcccccgagagcgcaatgaccagtgttgtggaaaacggatagtacggccgttaatacgtccgttaattcagtaacggtgagcagtccgtcacgacatggtgatacggccttcattacttggtaaagaacgcgtaaaccccataattagcgactaatcggacgttttctgattaatcggccgtataatcaccgttattacatggcccagcccacaacaacccaacccattactgtgttctgtagtatgtagctgtatatttgcccttccgaatttcccgcaactcacagcaacatgttctttccatctaatcctctaccaaatgtaatacgatatccaagattttatgttaatcttttgtttaaatttcaaataggtctcaagaaaaaaaatctcaaatatatatgaagttaatgtattttcctctcctaaaaaggcaaactattatcaactaggtacatatatttgtacaaacgttaaatttccgttaaattccgattaatcgaccgtattccgattaatcgtttgacggtaccctctccgtccaacatccgcataccgtcttccacaacactagcaatgacaacgccacgccaatccccgtcgcctcctcgctcttcctctcagccgcgcaaatccccgccccctcactcgctccgcttgattccccccgcggccgccacagtccacagtcctcagcggtgtggcgcagcggtatccggcgaagtccaatagacgtgcaggcgccgccgctcgtttctgactgaggcgatgcgaatcggcgagcgagctctccggctcgacgtggtcacgaactcacgaagacagcagcggctctcgatctggcaacatgcagcaacggcgctctaccgtccgttggcttgaacagcggcggatgcactcgccggcgcattgcatcgacgacaacggcagtccaagctgtggggatctcacatgcatcttgctgtttcattctcctgtgttccctttcttgctctgctactccgttaaggtgtaggtcaattttccccaattttgaagtttaaattcaaattttgcttgaaaatttcgtacgaaatttctgaaaaaaaatccgaaatttcggtaatttcgtaatttcgctgacccccaaaatttttcctctttccgatagatcaaaccctggtcatgcctccatcgtcggaccatctcactcgctgtcgtgcctcctcgcgactcctcgctgcacgccaccgcatcgtgcccctgaaggcgccgtggtggttgccccttccgccccagcgccaccacagttccatgcaactcagtttctcacgttcaatgagtggatgacaagtgataataacatggtacatttgtatatatatgtttttccaatgtttcttgattcattatttagtttatttgcttgattgagcagcttcttcaagtaattagtcatatgttgactcggtttgattgagatagatgatgcattatcagtttttgaccatccaaaattctctttagtgattaggatgcttcagtcttctgctctatcgacaagataagtgtgtgggggcatgtttaagaagcttctattcagttcatcaaattggcttccaaaatattaggcacaccaattgatgataagaggagctcagattcttcattatttttgcagactaaggatgcaaaagaattgtgcccaacataattttgctttgtataaacccttctgaataagtaataataaatctgaaaacaaatgtgaaagagtgcatgagatttgactattttcttttttactcattttattggctacatggatttcatgtgcacccttactattttcttgatgcattaatgttgtgagtcgtaagttgtatgccctcagctatatcagtttcaaaccatgaattcattgcttcattagcttaattgttctgtaaaaagatttttaagaaaaaaatggatctgaactttattggtgagataaatggctgtagctccatgttactcggctactaatagatacttagtactagggtgatcaatgaaaagaaatgataattagttctcccgtaattgttcaaccaaacattcatccgcgactttcacattgttttagactgagaaactgcaggttactgccccatagtctgcttaactgtaaactgtgacctttcattgttttaggcagtgattgaaattattttcagcactgaagtctgtgatcaactaaccaattcttcatagttcataggcataaagaaaagaggttgccccatgatcagctgagaaagtatagagattcagttcaggggaggcaaaataggaggaaaataatttgtacctataggcatgttttaagaatgttgctgtcgagggaggacacatctatactaatataaaaagcaggagttgtacctttgcaatcggatggccaaatcacttattcccgctaattcatccatcgtgcaacgcagtaatccagcgcgcgcattcaccgccccatccccaccgacgtacattcatcacgcgcttccggttgcccacccacgcggccgcacctaacctcctcaaacgacgccgagatgccctcctctctgcccctcccccgtcaatcacgctcggccggcattactccctgccgcgctttgtggcttcgttccacatctcccggaccttccatccgcagcctgacgaccagcccttttagacgtgatatccacctccgggcaatgcccttgcccttgttgccgccggcccgccgccatcgccgacatccatgcatggaaccatctcagccccagcccctgtcgctgttgcaaccaaatcggactccagtactccagcggctctgccttgctgcgctgcccggctgtacagaactcctgtcctacgctctgcgtggtttgatttgtcgctccgacgacctcctccaatgtgcggccgatgctgctgcatcgaggagggaggcggcaggcggcgtgagctccatacccaagggtggggctgtagcgaggaggaagacgatgtgcgacatcacaaacttgatgcgcacatcagcggccgtggagcagggcgggacggtctgtgccgtggatgcgggcatggaaggaatcacgcggctggtcaaggatctcatctctctctaatcttctcaatccctatgactgcttctattaattttagagttggacctgtttgctaaacggtgatgtatttttctgtattttgtgccaattcctgaagaacttggaacttatgaggctccttgaggagagggagtacgtccctcataccaccttattcttgtatgaattcatctcttttgttagaggctcttatgcatctgattagccacattatcgtttttcgtgaagctaaagcacatcagcttgcttgctcgagagctattagcacagcaaaaatatcacaatcagaggtttcaagatgcccctgtagtggctggaactggtcacaggtggtaagattaattattttcagttgtgatttgccatcttcagattaccatgctttttgtgataaatcaatcttcaatggtattataattttttttctactcttccgtcaataaaaacggtggcacacgtttggtggagctgtataagtgcatgtgctcatacttcataccgtcacaaggggcacattgcagagaaaaaagaaacagatttcagtatcaattggcatgtgaaatagattttagatatataggaggagatcattccgtgaaaaataacccgaaatttttttattatagctcataaacatgagcttgtgacttggcagatgctatgcatattctgagtatgtaggcttggcggttgtgggtttgacgctgttattcctgtaggttgatggtcagcattctcattctatactccctccgtcccacaatataagagattttgagttttttattgcaacgtttgaccactcgtcttattcaaattttttttgcaaatataaaaaacgaaaagttgtgattaaaatactgtaaataataaagtaagtcacaaataaaataaataataatttcaaaaaaaattgaataagacgagcagtcaaacattgcaagcaaaaactcaaaatcccttatattataggacggagggagtatgtatgagttgtatgtgtcgtgctatgcatccttactctcagtagctctgtactctgatggcagattattttcgatagcagcaaaaaatatgtttgattgtagacaacaattttttggttttattcaaattggtcgctacgtgcattgcacgttcaggattactagtcaattcacaatcttcggagatgtaatggatcagtatgttggagtaaaaaaaagtgcttacatgcatgcattaactatactacatagatcatctttggagttgacatctagatagaaattacactttatatcgatatttgtcaatatatattttgtttctaattgtttgtatggtgtatgtctatgatcgacttgcaaataatactacctctttatctatgtgaatttgtaatgtattgatgtctctatatgctgataaaaaaatatactagtttcgtatgagcatgcattgcttcatagctgctgagctacacgtgacaaatgttgacataatattgaatccgatagtcctatatatgtagaaaaatcaatttgcacgagaattaacaaaaagacaaaaataaatgcaaaattagcacgtgcatgatgagcactagaggcaaatctgaattgaaactaaattgaatttcatctcgcaaatgcagacacactcgtacacagagagcccaacacgtattgtcgactctagtgctcccttggctgttcgctctgtttctgctgcatgctatacttaattaatttcagcttcaacagttggtcggtcgaaacatgcgtgagtcatgtgaacgtttgctgaatcacctgtaccaactcttcagcgctgagctcgcactcaattccaatctgcccaaagatatactagaaaaatgtaagcacagtgaagattttataatttaccaaaatattaaatcataggaatgttaatttcatcttataaactaaaacttatcacatagcattccatatatagtttcttcacagaaaggaagtgctttcatgcatcaacccaagagcaaaacaattacaatctaatggtccaaaaactaaataagatgacgtgaaagcgtgacaacactgcactaaatggaaactgacatatatatgtttacatgatttacataggtcatatttaattgatgcatgatgttatggccctatttatgaaaataaactaaaattcagcccagtataatctaattaaataggatggaagcgaagaaacccgaggaatttttgtaagaatgcctatataggaaaaatatataggagaaatatgcagcggaaacctgaaaactaccgtaggataaaaaatgttacgtgtaagatttgtcaatgtcatgataaactttcactcctagatactcgaagatgccacaaattttagtattaaatttgtttccaatacaagtgtaccaatatattataccatgaattaatgtatgttaccaattggcacccatcctgaagaactgtgaaaatgcagatataccaccatgtaacagtgaaggcatgcagtgaagtaccagtacactgtctggtctctgatatatatactatactaccatacagatgtccgggcagaacatagacatttgtataccctaccacatttatgagcagtgcagcttcattgcttcaacatgcttgggcagtactagctgttaagctagccatacatgcacttcatgggaaactcacatgaaacaaatgcatttcttttgatacggcactgtaccctaaacagtttcctttcaaatgttccattcacatttactgtgtcctccacacggcctcaagcagtgcactcatctatgagatcttttgttcatgtgtacatatcaacaatcttagtgacaataatatggttaattatatgaaggcttctgttaattataaatggtagagctgaaaatgttgcaacgattacacttgcgacttttgattttcttttctaaatgaaatgcagagctcgtacctttatttaaaaaaaatactaattatgagaaaaatttgttaaacattaattcagttttaatttttttaaataattgtgattaggacacatactctctccattttaaaaaatctagcaactttcagtgtactattagaactttgaccactaattactcttaaattgttagattaaagtgatcaaaagtttcacacttaataacccttatagtgtttgtaaatattttgcaaagaagacaatttttcaaaattttaaaaataaatagtgcacgtatccggtgtcaatcatttaaaaatgaagggggtaataataatcacataatgagcgcaagagctgaaatagctgtgccatgcagtagcagactagcagtacacaccttgacagtgaaggagttgacggcggtgtcatcgacggtgctgatcttggcgtgaagaatctccagcgatcggccctccagggcggcgatgatcttcaccgcctgccccggcgaccgctgcgacaccgtcttcagcaccaggttcgcgccggcgaactccaccttcacgtcggggaggaggaggccgccgcccagcgcctgcctgctggcgtacgccgacagctcggcggcgatggcgtccagcgacggcgccgccgtctcgtggtgggtcggcgtcatcgccggggacgcgtagttggagccggacgccgggggcggcggcggcggcagccggaggagcctgtagggactaccgggcgtcggcggcgtcctggggctgatcggcacggcgagccgcgggctgagcggcggcgtggacttgagcagctgcggcggcagcctggggctgagctgcggtgggcgcgggctgcagcacgacgccgccaccgtcgccggcggccgtgggctgagcacctggtcggtgtagaccttgcgctgcttcttggcctccagcgagtgcaatacttgctgcagctccttgatgtagtccaccactcctcctatgatggatgcctggtctccctgatcaattcaaaatttcaaattaatacatgtcaaacataactatatatatgtatattatttcagagaaacaaatagtgtaacttggtctaacataactatatatatgtatattatctcagagtagttatctattgcaccaaataaataaatagagcctaagatgttaactatatatatatatatatatatatatatatatatgcatggttgcattatattccagcgctggcaaggcaaaaaaaacatgctatctataggagtgttagtttcaattgagattctctacttgagtatatgcattcgtagaatccctgctctttgcctgtacagctgattgaattaaagtctaaactgagaattttcacggagtaggtcggtccatataccatatgcattgatgcatgagacagtattggtagtactgtcgtactacgttacgtaggaccggatgcctgtgccaataagtgatgtgatatgatcgactagctagcagatagatggcatagtgcgtgtaggatcataaatgattgatacccaatccatggagactagttggagaatctaacttgttcgtgcaccaatcacattagctagctagatattacatactttctcaatctaaaaaaatgaacttctgactagaagtaaactatgctattccaaaagttcaactcaggctatatattatatactttctttgtcgtgaaaaaaatagcttctaattagaagtaaccgtaggctatgtccagattcatagcaagaaagtttgtatacattggttttttaagacacatggggtagatcacttatagttagaggcttatatcgatgtgtagacgatcttacccgcttgacgtagaagcatggcatgagggagcgaagcacggcgaggttctcgttcatctgcttcctccggttgcgctccacggcgatgtgcgccgtcttgggcgtcgtcgccgccgccacgtccgtcgtcgaagactccggcgagcagcacttgcgcctcttctgcggcgaaccgtcgtcgtcgtctccgtcgccgtcacggtccgccacctcctcctcccgccgcttgttattggtggctggcacggtcttcgcggcggcaggttccggcagctgctgatgattctgcccaccaacaacgccggagatgcaggcagcggcggcaataggactacctaacgtcgtcgtggtcgcgggggcgccgccggcgacgacgttggcgcagccctcccacgtctcgaggatggtgaagaggtcgtcggcgtcggcgtcggcgtggtgggggatgaactcgccgccgtcgctgtccaccaagaggagctgatcacacagcgcgtctcccatggatgatggatgagtctagctacggtcaccaagggaatgttgcttttggtggcttaatttgtttcaagctcgatcgatctgatggtggtttgaggtcgaccgttgtttgatgacaagcgcagggtggtatgtacgtagtcgaaggcgaggtgacataaatataggaaacggcgttgaggtacggtagaaggagggaggagagccagagtgtgtgggcccaccatctatggtttggccatgcatgcatactttgctgcctgctgggcacgattgattcgatcgatccgtcaaataaggagcctttcctcatctaaaccttgccacaaatacagaaatcgtcaacaataccagttgaaaaggcatatcagtgccggtttcctaaccgacactacagctaattaggcactgatgaaggggttgtcggtacccattttaaaaccgacattgatgtgttccctcgaataaataaaaacatagaggatggcttgaatcaagtcgatgcttcaagcggctctctaaaattcacagcccagcacatcgatgccctcctattccgcatccacaatacaaatcaacaacaagaacacaagagcatccgtgtatattccattatctaaaaaaaaaaagagcaaccgcacacatgcatcaaggcatcattgcaatattcagactggaatatatgaggaaacccaccggtgatgatgttcaacatatcatagaagaagtggaagaagtgctcaaacagttagaaagcaatgtacacacatggagactatggtgcagcaacaatcatcgtggaggcagtggcatcctgtgaccggtggatttggcattgtttgttcggtgtagcaggatcaaatgatgagatcagtgttttgaaccaatcccatacattcacttattaactcatgggtatatcgataaggatgcgctacacagtggaaattaatataatttgggatactatacgccaatggaatctatctagaatgggcaactcttgttcagtcgatctggcatcgtcaattggagaaggaaaaaatgtttcctcttcatcaagaatcaacgagaaaagatgttgaatgtgcatttggtatattaatagcctgtttcgaggtggtcactactcttactcacttatgggagcaatcgggcattatcaatataatgacgagatgtattataaaacacaatatgattgtgaaggatgaatgtcacctagggcctatggacgcacatgagtttgagcaggggcggagctagcacaaaataaagagggttccacttgcttgctttactctgatttgaattaaatttagcttgatacgggtgtctaattttgaactaacagagtatatatatggtgaaaatagacaaactatagctaaaattttttttaggcaaaatttgctatatgacatccaaaaaacgtgtaattagctggaggacaccgtaaaaacgtgtatttgctgtagggcatcgaaaaaacaagtaattggctgctggacactcgcagtattattttattatttttggaggaaaaggaaatgattaaaaacaagattgccttggctcatataactccaacgtgggccccacatggaagtcccctctccttctccttcttcccagacaggtctggtagcggagcggcgatccgtggccgtggcaacagtgacgatcacgttcgttgtcgggagggcgcccggggggggggggggg

SEQ ID NO: 29398 - DNA, 9655 bp, Oryza sativa
caggatcgccgaggaaggtgtcaggtcggcgctgcggcgggcaccgtcgatgcccgtcacgttgtccgcgacggtggcgcgacgacgacgccagccgcgaggatacagtgccggtggccaccgggtccacgacgccgggcatgtccaggctcaagcacgcccacagcacgctggagagacactgccgctcgcacgcgcccaccccaaacgccattgaccgccatggcaatcgatctcgacatggatgatgaattgatgattgatctgagtttaacccattgatccatgcagactgaccggacgccgagaacgtcggacgatggccatcgaaggcagccgcctccgccgggaactcatcctggccgctgggaactcattgagagagaagcaagaagacagaacagagaagagagagaatgagagagaaaagaacaaagaaaaagaaaagaattcaaagggtagaaccgtatttacatggttgtttctctctcttttccttcaaaaataataaaataatgccatgagtgtacaacagctaattaccagttttttacaatgccctacagtaaatacacgtttttacggtgtcctccagctaattacatgttttttggatgtcctgtagcaaattttgccttttttttaactaggttcctaggcacccccctagctatatgtagctccgccctgagtttgagggtgactacgagattaagtccccataacattatgttgtgctaattcagcgaaattttgctatgcgaaaccaagacacgcacagccttgttaaaagagatttggtggagcacatatgggcaaggttcggtcatcagtatactgaataaatacttcactactaacaatttatgttgtgctaattcatcgagattttgctaagtgaaaccaaggcacgcacaaccttgttaaaagagatttggtggagcacataatgggcaagtttcggtcatcagtatactgaataaatacttcactactaacaattatgttttccaaataggttcagggatgcatggggccaacttgctctccacattgccctgcgaaaatattttcgcaagtgacccttaagaggtgtgcctgtgataatgcatcttttatcgcacgagggcatcttaagaggccggatgcaaagatagattttcaaatgtggcccttaaactatattttttatgcatgggcaactatggtccaactacaattcagagggggtcttatccgaaaaaaatctattatatagtagtgtacaaaatataaccactagaaaatagattcgaatatgaatataataattatttcataaaaactatactgtaataaagtatatcttatattctacgtgacagtgcaacaagccgactcatttatatgccattatgtaagagcccctcgagcgtgaccacttccaaatgctcctatgttcatcaacattattctagctgaacatgtatgtaaattaagaggaagcaatgaaggtaattgagtgatacatgcatggacaggtgcgcacgatatacctcgggtttacagcaatgctagctccttctcattattatgtctctcatctttgatattacttgtattaactctctttcgagcctggcctgcatgccttaatttcacacacattcttaaattcatactccatttgcacgctgccatacagacgtgtactgcagcaaattaaactagatagtaaatctctcatttaaggcagactgcatatgaattattagtacttaaacatgacattccttttgctctacagatactataaggttgagccactgatgctaatctctttatttgcacaaaaatctgatctagccttccgagccacccctcccccccccccccccccaaaaaaaaagagaccagtataaaaaagctgtttacacacaatgaactgcaaaaatcaaacaagatggaattcatcctaggcttgttcaacaaattaattagttaaactcaatttaatttataaagttgtgttctagcaccttatgcatgtctctttgtgtgtgtcctattgctttcaatttgtttctcatgatctagtggaccaccactctaaaagatgcacattagccctcctgtacgtacgttcgtacgtgagattgatgagctgctagcttgcaagaagataaagacaacgaatgcatgcacatgcatatgagtcgaagataagtggcatatgctacaaatattttgttgattaatccatattcttcgatttgttctccattaaagttgcatattgcatattgcccaatgtaatattccgcacctttgcctaattgcctcaatcatgtatgtctctatctttgttgcaaaccggtacaacgacgacacatttactctcactatcatttcggcatttccaactcgcccaccactttacgtgtgattatcttgtcaccggtacacactgagacttcaaccacatcgattacggtaccctatgcatggccaccctaattaccaattatatatgcccttcatttttggttatcttgactgttgtcatttcagctctggactctagtctaagtatccatatttgtttgcgtgcttagactaatgatgatgccagaatatatggttggtagttaaaaaggatattaggattggattgctaagttttgaaatcgtctcttatataaaccgcatacctatgctcaatacaacatcaacatatatacacaataaatctcatatctctcttacatgtttttacccagatcttgtgaaagtgcttgtatacctgttgacgaaaaaatcgaacacactggcctgggagatctgtttagctcctgtgcaggtccaaatcttgatgggatgcgggcgtgtcagtcagtttgatcctgcaactgacaagatatgcaaatagtagatcaaaacagctgatcggctgacaagccgatagagtagtttcagccgatagccaataatagccgaagccgataccagccgatagcgatagggtttaagcaatcagctatatgtccaatgtagatgatgatataaaggcaatcggctgatgatgatgtaataaaataacaatataatccagtataaaccaatcggaaaataatgatatgataactaagtatcgatccaaaggttaaagcacacatcggttggaggtctgatgtcattaaatccacaagattagattaaacagtgaaacctttgttgtcatcagctaaatccaacttatatgtatatgcaatccttatgagccgatgcaatgtacagataactcaccggctaaaaccccaatgaaacccttattggcaatcaagaagcaggctagagattatggttctaaacacgacttagtagatcaaacttaactgatgcagcactaagtatgaaaagaaacataatatctagacaatcaagccgttgactaagttttcagggtggtagatgtctaaactaatctaatctagcaacgcgatttagccgatatcggcagaaaccctaaaacgagaatcagccgatagagctaaattgatatgctaagactagattaacaaagacatatgataaataggtaggcaaatatatcatccaaaccatagcaatcatggaggtcgaatgtactgatgcagccttgaacgacgccgacgtaaacgatacagttactcgggccggcggaacattggacttaccccttagccggagatcgaacaccgatgcagccccgcgttaggtgccaagtcccgccggacgataaaataaagtagaaaaggtaaaaggtggcgatgcgccgaattgtattgatcgtgaagatagattacatagaccccgggtgtacatatttatacccatgggttaatacaagttcttgttggacaagaaagaaactttcctaaagataaaatgaaaagataaagtccttataggacactaaacacactttcctaaaaatgaaaagaaactaacaaactattcctaattaatagataacttgccatgccgcattctctttgaactcggtctcttctggataagcttcctttagtagatcaatttccttaaccgaatatagcaagaatccgacaactgacgacttgacaactctcatcggctaatctcaggacttcgaagccgatgctgactctaagtcgatgactactccgggcttaccaaattttactgttaacaataccctagctagctacctcatgtgtgcatgcatgcttttgtttcataggtttctccgtatagtaagaaaaacaaaagagaagcactaacaacatatcttatggggtaatctacttctcaagtactgactaaattttccttgtgcatgtatcaaatcactagctttttttaactctactagatcagccataatatctaacaaaagactcatcactttccaatccattggatgacaacctaacacatcagatcagtcttgctcatcccttggatgcatgccgacctaactatactcatcactctggccctctcgtccctaattcaaatcttagaaaaaattttctttgacaaaaagttaaacaacatattcttctaacctagataaagacttgaaaattttgaataaaatattcaaatttagatccagaaaaggtaaatgcactgtaattttaggtctagaaatttattttctaacgtaaataaaaaaaaataaaaatttaaaataaaaaaaaataaaaatttatgtatatgaaatatatcacacgagctaaaaatttgcaataagtcacactacaccccttaactatcttctataaaagaacatggtctctcgacaatatatgaaaccagatattttaaacccctcaattatatatgaaaataggacaaaataccccctaaggcaatacaaccggacttcaaatttctttctatgattttaaaatacactctaaacagtgtttttacttgtgtatataagccacctattaactgtaggatcgaacaacaagtactaagcctaccagataggggtgaatggtagaaacataaaaagccgaaaacttttagcagaactaaaagttaccctcgaagctgatggagatcagtctgacctacatcagatctctggtctttccgctgtagatgtgccagtccaaccatcttggagccggttgcagtcggtttgatcgctcgtatccctaacgtaactgtcgaacccgagcaaacaaaaattgtagatccattgaaagtagattgaactatattgcttctattcgtgtttacaaagtgcaacaacaatagtcctctcacaaaattcaacttatctcgaaaccctaattttctaaactctacccacacaaaatcgataccgggaggcctcaacccctccccccccttctctatttacacccgaggtaggcagcctaaaaccacgaatccaacttgtaacagaagtcctagtccactaggtaaccttccggtaccaagaaacaaacttatcttatcacaactcaaactataatcttttcaaatttggactccatgaaaatttgacacctcatctcatatacacacaatctcccatcgtatgctgcatggaattttcaccaaccacgtgtgttgttctttagcgtaagcattccgcatgatatactgaccatctggatctcatctcctcccaagttgacttccgatccatcatcggcaactctctcccgaggcatcaagaaacacctacacatgaatcaaacaagaaaccatatcccaacttgactcaacattagcacctagcagtattacatacgtatagaaatcatttaaaagtcataatcacaagtatcaaaataaacaatctgaaactaataccgacacagaatcagtcgatcagaccgtcgggctagccggtctgaccggccttcaccacccaatctgactggtcccacaaagacaacaaaaccaccactttgccaaaataatctccaaatatcaaaccaattttctatcatgccaattgtgctcatcataaattaataaataaaacacactttgatttcatatcaacatgagatgcaaggaatatagttgaatacaatgtaagtaaaaatcatattttttggatgcaaaaataatgaaaaccgctatgtgttactcatggagggtattttgtcaagcttcaatagtttagggagaaccattgcgcggaagtattagttatttaggggtgtaataaaaaaccatttaattttgagagaatccactcagtaccactgagttttccccacttctacaatataccactgactttgtcaagttgaataatatgccatcgagttttccttaacctccactgcgtgccatcgccgtccacgagccattagttggcctccgtttgctgtattgatttttctctaaatgactaaaataccctagcacatcatccacaccaaatcgatctgctgctgttttagtcatttagagaaaaatcaagttcatgtgtcggtataggcactgtgattttactatggctggttttgccgatgcttctgttcatgcttctgttggaattaaaatcacagtgcctagcacatcatccacaccaaattgatctgctgtttctgctgcttcactgacatcctcctcagagacaagttcatgtgtatgttcagtttgttctggtggtgtgattgacacttactcacctgttgctagattgaccacaattcgtgtgctactttccctagcagcctcacatggtcttctcgttcatcaaatggacgttaagacagcttttcttaatggagagctggatgaggagatctatatggatcaacctcatgggtttgtagttgaaggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtgtgtactatcgccatggtgggggtgagggagttattttgtgcttgtatgttgacgacatactgatatttgggacaaaccttgaggtgataaatgaggttaaatcattcttgtctcaaaattttgatatgaaagatttgggagtagctgatgttatcttaaacattaagctaattagaggtgagaatgggattacactcttgcagtcccattatgtggagaagatcttgaatcgctttggctacattgatagtaagccttctccaacaccttatgatcctagcttgttgcttcgcaagaacaagagaattgctaggaatcaactggaatactcccaaatcattggctcgttgatgtacctggctagtgcaactaggcctgatatctcctttgctgtgagcaagttgagccgatttacctcaaatccgggagatgatcactggcgtgcgcttgagcgagtaatgcgctatctgaaaggtactgtggaattggggcttcactatactgggtatcctgtggtactggagggttatagtgattctaactggatctctgatgtggatgagatcaaagccactagtggatatgttttcacactgggtggtggtgctgtttcatggaggtcttgcaaacagacaattttgacgaggtcaaccatggaagcagagctaacggcactggatactgctactgttgaggcagaatggctacgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgagaaacctggcagatcccttcacgaagggactatcacgaaatgtgatagacaatgcatcgaaggagatgggtttgagacccatgtgagttatactatggtggtaacccagtctatgtgatcggagatcccgtgaattagatcctgggaagaacaaaccattaataaactataggagagtaccaatatatataccctctccaagtgaagatgcatatactctcgtgagctgcaaggcaggttggctatgccttaatgagttctgttggctttaattagcaaagatgttgtcctgcagagcattcttgaaagaactcacctttgtgagcttgactgttggtcgcagtctatgaagattttgggtgaatcttctaggaagcttactaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtctccatcgaaccgctggtatataaacagtacattggaaaaggcaaatctcagtgggattttgagatttggtgggggattgttggaattaatgaatgggccttagcccactcgaagattaattctttgaaaaatcacaaaagcccacctcatgggatggcatgcatgtggagtttagtaccaccttgcttattctaggagagggggacctccttaaaaggaaggatgccctcctagccacttgaagcatgtgtggtggagagaagaggggaaacacacgcgcgcgctcgctcgcctcgccgggccgggccggcggcgcgcgtgcacgacgtacgcgtcgaatggtccgaaaaattggctcctcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacttgccgtcttcacgcaacacttgcgagatcaatctagggtttgtctcctactctgtactgcgccgtcgctcgtagactactccatcccgctcgccggcgtgcaccggcgatcgggagagcaggtctccggaacctctgtcttcgacgttctgcaccgggagaaggcggcaataaggtttttgggaagcgcttcgcgcgactgctccctgttcgttcgcgacggctcgccttcctcttcgctcgcgtgtttcgtgccttcgtagacacttgcgaaaagtttcgaccaagcagccggtctttccgtcacctcggtacgtgttcaatatgttgcgcatatttgatctgttcatgttatactgtgtagtttacatgtgtagatctaatgatgcgttcatgctagttttcatctgtaatgtcatgatttatttatggaatagattaaatcattatatgtctataatctcaacagtttctcctccccgtgagcggcgctgactccccatcgatggaacgccgaccgctcggctccccaacgacgcgccggcggccgtttgcctacctgacgacgcgcagccggctggcttcccatctacgcgcggcaggtcactggcctcttcatcgacgcgcggcggatcgccgggcttcccatcgacacgcg

SEQ ID NO: 29399 - DNA, 5602 bp, Oryza sativa
tgtgccaccggccgcgcggcatcctggcgtttccttcccctccgccgcaaccaccgtggccagttgccgacctcgcctccaaccacgcgtctaccgccgccggcatcctagcgctttcgtccccaactctgccacaaccgccttctcagtcgtcaccgcaaacaggcggccacggatggcgtcctagtgaatgtataccatgtataatgagttagggacaaataggtctttttacaacactaacggatgctaactgggctgtgatggcacgcaatagaggttaaggaaaactcgatggcatattattcaacttgacaaagtcagtggtatattgtagaagtgggcaaaactcaatggtactgagtgaattctatctttagttttacgcagttgagaggaatgagccatgaattacgccggacacggagaagtcatggcagagttaagtaacacacataccttaaaaatatactactggtacagatgatcgatcgatggatgcatccatttagggggtgtctagatccaggggtgtaaagttttggcgtgtcacaatggttattatacacggtgtctcatgggtgttcgggcactaataaaaaaattaattacataatccgtcagtaatcgcgagacgaatttattaagcctaattaatcagtcattaccaaatgtttaccgtaacattatattgtcaaatcatggagcaattaggcttaaaagattcgtcttgcaaattagtcgcaatatgtacaattagttattttttagcctatatttaatactttctgcagatatttaaatgttcgatgtgattggtaaaaaattttggggaaggatctttatcccatcgatcgaattaaaggcaacagcaacccatattaagtgacgatcagccgtcgtctgacctccacatttactcccacacattaaccatcatcaacctaccagaatgcgtgccaaactttgtttatcatttcgtacgttcctctcatccgtcatgctcatatcctttgtcccgttgtcacatttgcattatactccatccgtaaaaaaaaagaagtgaatatagtactgaatgtgacacatcctatataataaatttggacattgtgatattaaattgggtttttatgggaggaagcgcctttcgtgtgatatcacaatgcgagtgatgtgggagccaacatgcatgatttcaccggtacttataattagagagaaatcataataccatataatatacatgggtatattttcataaggaattaataatattgcgtataagtagaaaatttctctgtgtaccactgaaagttcgcccaaacccatatatgcccttaaaatttgcttattcccttctgtatccctaaatttctcctattctccttctccttcagttagttgacagaattcctatcataaagtgcattttgccctttgggtataaataaaatataaatttatgaagcatatcgatggagtgtataaatttattgtatgcgactattatctatatgagtttattttgtgagatactatttaacaaaaataatttttatctcacataacaactgtaaattatcataaataatagagtaaatttcactttggtcaacctttatttaccaaattttcacattggactagagttagacttatattttcacttaactccatatatagttaccatcatttgcactttggaccgggttttacaaattacacatagtataatagtacaatgattgtagatctgatcttatttcttttttgtgttagaaaacttagaattcaacaatttgtactaacactacagttgggtattgtaaaacatgtaatatcttttctaaaaaaatagttattaaactcaatatttctccaattttgtctctagtataagggttgtgaatgttcatatgtagtagtaatgaagtctcattaattgatagtgacggagctcgtggctcctcaccgggagaccgcacaggcccccctttgccggttcggccgggggcttggggtgaaatctcaagctctctcggtatgtggaaagaacgccagctaggaagaaacgcgagacacgggcgatgtatacaggttcgggccgctgggaagcgtaataccctactcctgtgtttcggtggatttgtgtatgaacaagtaacaaagtgtcaaccagcccccaatcgctctgggatcggatctggagaaggccttgtgtccaaaagtcctccctctatctaagtgggcaatgtcctccttttatatctcaaggggataccacatgcccctctccttctccaaactggactgttcttctcttcataaatggacggagatcggtacggctgctgtccgagtgcccttctgacgggacggcccatacctacccccacttccgccggaaacaggtgcgacgtgggattatggctgtctgttgatgacgcgaccagtgtcagaccggtcacagatcagtcatccttgtccaccacgtgtcagcttagcaacgtgcatgtttgcccttcttcatgtagcatcttgcctgtaatggttgggatgaagcctggtataaatctaaccagggctaacgtgccatctctaagagattacacgctagctccggcttgagacgagtgcctagaggctttcgtcttgacgggatggggcaaggcgtgcgtcagaccgccagtcgccacctaacccgtgatctgaccggtctgtgactggtcacagaccggataaaggaacgcgctgcactacgctgcatgcagcgtgacacgttcgaccagaccgcaataaatgtggttaggtgaggcttaccgtgttcacccaacccattcatgtggcgctaactccacaaggggtcggggcgcctcggccctcggggccggggcaggagtcacccgaccccccctcggggaaatcaggaggagggcggacacctcaccctcgggcccgacgtccccgaaggtgccaggccacgtgggcgattgtgtctgcctcaagcctctggtcacgatactcccggtcccatatcaccgacagtagcccccggcgttatgccagggcgatcgcccttctcaagggaagcggtcggtcgtgacgccactcctaaagcctggtgacaggtgggaccggtctccatggttgggcagaaacccaacggtctcaaatcatgcacatcggtaatggtgacttggctgtccataatgggcggtctcttcaagactgccacatcacttgagcggcgtacgaatctgggtgagccgatttgcttcgcctggagatatggtaacgtcgcttcggtcggcgagcgtaattaacgcgcgcacgatacgatctatctcgactgccacaaccgcatatccacctcatgcgccgcaagcgggcgaatgggattagtggaagcgtgggcacgagaaacgagggagcgagatagtgagaaacgagggagcgagatagtgggcgcgagaaacgaggagccgggcacagcgatggcaagggtatgaagacaccgaggaaaggatttgctcccttcctttcgccattattccccttgccttcgctgcttgagccctaactctttctctgctgcgccctaccttcgccacacgcgctcgctttcaatcacctcttcctccggcgccatggcacggggctccgctctgctcgacggtagcgtactaccgccttcccgcattgtgagcgagaggcatgccgggctgccgcgccgctttatgccggaatctgccaccggccgggagatagtgatgctgggcgagggacgcccggcaccagactacccggggcggtccgtcttcttcctccccttcgcaatggcagggctggttccgccattttcttctttctttatggatggcgctggaagagttccctcccgggaccgaggacgacgcgcgcgcgcgggtccgggatgccgccgaccacatcgtccacagtttcgaggggtcggcccctcggctcgcgttcgcccccaactccgacgaggagggcgatgccagcggtgcagacgatcgtgacgacgaggccggcgacccgggcgcatcggactgagcccccaggcccccgccagactccagtttttcctttttctttcttctaaggccttcatgcctcttttttgtatagatcaacttaatctgcaatcaaaaatgatgaaaaaattcgtgtcaattttattttgctatgcgtatgagatgaggatgatctgtgccgtggtcctcttttgtgtcttagcttgatttaagggctcgtgcccaagtcccagtcctctaatggctcgggtcggggctagtgcctggggagatccacatgtcgaggctggccaggccgggaacgtggtgaccgagggttatgggtgacccgattgtgggtttttgccgattcccccccgaagttcaccacgccccggggcacggctcggttctgggccccgtttggcgattttagctgaccgaaccgagcccccgagggcaaggttgagcacgagtgaccttatttcaagtcaagattcttcaaaaggaaaaaacggcacagacacaacctttaggaaattgaaactgcttttattgaaatgctgaaataagagaaataagaatgtgcatgcgtggtagcccccggccaaccctgcacacccgaggggggtgcggggttggcccgagccaaaacctgacactcgacccccccctcaggggtagaagcgacgaaggtgttcgatattccacgggttaggcagctccgtgccgtcgcccgtggccagccgtatggagcccggcctggggacaccgatcactcgatacggaccctcccacattggtgagagcttgctcaatccagcacgcgtttggacgcggcgtaagacgaggtcgtcgacgcagagtgatcgggcccggacgtggcgctgatggtagcgccgcaggctctgctggtagcgcgcggctcggagggccgcgcgcctccttcgctcttccaagtagtcgaggtcatctctgcgaagctgatcttgatcagcttcgcagtacatggtggcccgaggagacctcagggtgagctcggatgggagaaccgcttctgcgccgtagacgaggaagaaaggcgtttccccggttgctcggcttggtgtggttcggtttgcccagagcaccgctggcaactcctcgatccacgaatcgccatgcttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaatgaatttaagtgcagagtgcttatcgatcttgacgaccggataagcctcgggccacttagtgaacttgtcgatcgcgacatacagatactcaaacccgcccggggcccgcttaaatggtcccaggatatcgagcccccagacagcaaatggccacgaaagtggtatgatctgcagggcctgggc

SEQ ID NO: 29400 - DNA, 13906 bp, Oryza sativa
atctgtgaggtatgcttggatctcagagatccaagcaatcaatctaagggagcttggagcgctcccttcgggtcccgaggcctggactccgacggggctcgggggccggtcaggcgcatccgtctcccctaagaggtcgggtcgcgccgacggctgggtaagcctttcttcaaaggcgcccggtggggtctgggctcgcgagaacgcgagccgtgagagttcgtcggcaaccatgttatcccgtctgggtacatgccgaagctctatcccgtcaaaatggcgctccatacgccgcacttggcgtacgtaagcgtccatctgtgggtcagagcaccggtactccttacagacctggttaacgaccagctgggagtcgcctaacaccaagaggcggcggatccccagtccagctgccactctgagtccggcaaggagtccctcgtactctgccatattattagtcgctcgaaagtcgagacggaccaagtatctgaggacgtctccgttcggagaggtcaacgtgacccccgcaccggcgccctggagagacagagaaccgtcgaactgcatcacccagtgggcggtgtgaggcagctgagaggggtccgtgctggcctcggggattgagacggtctctggagccggggtccactctgccacaaaatcggcgagggcctggctcttgatagcgtggcgtggttcaaagtgcagatcgaactcagaaagctcgattgcccattttaccactcgtcctgtaccctctcgattatgcaagatttgaccgagggggtaagacgtaaccacagtgacccgatgcgcctggaaataatggcgcagtttcctcgaggccatcagaatagcgtaaagcatcttctgggcctgggggtatcgggtcttggcgtcccggagggcctcactaacaaagtagacaggccgctgcacctttcggcggggccgatcctcttcgctaggggccgcatccccggggcgttcttcgtccaagtggcctctcggggcgcactcgtcttctgtgccgatgacctcggggtcggaggatgacaggagcggccttcccacagtggcctcggggccgtcctgggggtcgggggctcctggcgtcgtcggacaagcaggcaaagggcctactccggtcgtcaggggcctcaggcctccgttcggctcgggggcctcttctccctgctttctcccgggtcgagtcagcacagggttagcctcggggccaaagggcgataggtgcggccttcccgcagtggcctcggggccttcctgaggttcgggggcacccagcaccgtctgacaagcgggcagagggccgactccggtcgtcaggggccttaggccaccgttcgactcgggggcttctcctccctgctcgctcccgggccaagtcagcacagggcgggggtgcgcgaaatgaggatggtcttcatcgcgctccacaaccaacgctgcactaactacttggggggtcgccgctaagtagagtagtaggggctcatttggccccggggcgactagaactgggggagagctgagatctgccttcaactgagtgagggcacgttcagcttcctccgtccaagtaaacggccccgagcgcttgaggagcttaaataagggtagcgccttctctcccagcctcgatatgaaacgacttagggcggcaatgcaaccggtgacgcattgcacatccctaagtttgctgggggggggcgcatccgctctatagctcgtatcttctcggggttggcctcgatgcctcgggcagagaccaagaacccgagaagtttgcccgcaggtacaccaaacacgcacttatcggggttcagttttatgcgggcggagcggagattttcaaaagtttccgctagatctgagagtaaagtctcttggttgcgcgtctttacaaccaagtcatcgacataagcctcaacattacgccctatttggctacccaaagaaattcgagtagtacgttgaaaagtaggacctgcattctttaacccgaagggcattgatgtataacaataggttcctacgggggtaatgaacgcagttttttcctcatcctccctagccatgcgaatctgatggtaaccagagtatgcatctagaaaacacaaaaggtcgcaccccgcggtggagtcgacaatctgatctatgcgaggcagggggtaagggtccttaggacatgccttgttaaggtcggtgtagtcgatgcacatccgaagcttgccgttcgcctttggaacgaccaccgggttcgccagccactccggatggatgacttcacggatgaatccggcctccagaagtctcgccacctcctcgcggatgaaggcttgacgttccggggcctgccgccgcactttctgccggaccggccttgcgcccggccgcacggcgagacggtgctcaatcacctccctggggaccccgggcatatccgccggtctccatgcgaagacgtcagcgtttgcccgcaggaaggagacgagcgcgtcttcctatttgccatccagaagaccaccgatccgtgtggtcttggatgggccgtcgcccagggcaacctccttgaccgggacctcggcgcatgtgacaatccgctgcctcggggcggtgggggcggaggtgccaagcctctcgtcaccaccctcgggcttggacgcagcagcgaggtggtccgcgcgctgctccatgcaagcgagcgcgactttcaggtcgccatggacagagatggggccaccggggcccggcatcttcatctggaggtaggcgtagtggaccgccgccatgaacttcaccaacgcgggcctccccaggaccgcgttgtagggcagactgaggtccgccacatcgaagttcacccgctccgtgcggaagttggctgatccaccaaaggtgaccggtaggtcgatgtgacccaacggccatgtgtgccccggcgtcacaccgataatcggttgggacggctggagcaccatccccggggccttgatggcatcaaaagccgcgggggaaaggatgttgagggccgctcccccatctatgaggacacgccccaacttcacgttgcagatggtgggggaaaccaccatcgcaatctgccctccccgggcgacgcacggtgggtggtcggtctggtcgaaagtgagggcaacctccgaccaccgcgcccggcacgtcgcctcatgagtaggggccgcggccagaagctctcgcttcatggccttgaggctccggcgagagacgtgagcacacgctcccccatcgacagtggcaatggtggccccaggttcttggaaacctaggtcatcatcaccgtcatcgatgtcaacagcgggggccttctgtttggcctcacttcgccgtttgccggagggagttgccggcgacttgccctcacggcgttccttcctcctgtcctcctcccacttcctcgttcgctcagccaagtttttgactgcgcgacagtccgcgagatcgtggagggaggtgttgtggacggagcaccacttgccggctgggcgctccctggtgggagtaccagcctctttctttttgtcgctcgcaggcctcccctttcgggtggcccgcggagcgccctcgacggcgaggacatgaccctcgtcgccggaatggaccgacctcttcttcctcctcctgtcacgccgccctgtctgagcggcggatccgggggcggccgaagctgccactccggaaccggaggggttccaggtccatgcttcctccttacgagccactcggtctgcgagctgaaaaagctccgcggtagtctggggctctttggaagcgattttttcgagcatgcggttgtgccgcacaccccccctgaacgcgtagatcaccgcgtgtgcagggatgcatggtatggtattgcggacttggcaaaaccgctgaatgtacgagcgaagtgactcatcatcccctcgctgtaccgcgtgcaagtccgcttcttcgcctgggcgcggataagtgccttgaaagttcatagtgaactgttggcataaatcctcccaagagtggaccgacgcaggtggcaggttcattagccaaccccgcgcctgtcccttcagggccatgggaaagaaattcgccatgaccctgtcgtcacccccagcggcctcaatcccggtcgtatagacctggagaaactcggtggggttgacactcccatcatacttctcggtgatggtgggccggaaccttgggggccaacggacattccgaagactcgccacaaaggctctacagccgacaccaccagccgggggcacggagggctggtcctcacgtccatgtcgaggtgacactctggacgaagaggcgccctccgttgcgcggggagtacgccggctattacgccggcgctcgatgtcgaggcgggcatccggctctccatgctgatcctcccgagtcggaggtgccgacgagggagtggcagccgaatggcgtgcaacagccgccgctcgccgcgccctccggcttgacgacacggagccggtagtgacggcgccggaggtcttggtggtggaggaccgtccaccagcacccaggcgatgctgggctgtcatgaccaagttggccacgtcgtccagccatcgttgagctggagactccgggtcagggacgacgggcgggtgacgtaggagcgcgccagcagcctgaagcgcgccctgaggcgtgctgccgtcgccgtagacgaggaggcgacgctccccatctcgccgttctcctgcatcacccgcgaccggtgatgctgcggatttatcaaccctctcgagcgcctccccctgcttaggactttggtgtggaggaggtgggggagtacgagctcgacggcgtgggtttggctccccgtcgtcgccgctcacactcggagagaggtcgtgcgcctttgctcgctcggccattaggctgaacaaggaaaacttggcgcacacggaggagtacgagagctcagaaaacacacgctgagccccctacctggcgcgccagatgacggagctcgtggctcctcaccgggagaccgcacaggcccccctttgccggttcggccgggggcttggggtgaaatctcaagctctctcggtatgtggaaagaacgccagctaggaagaaacgcgagacacgggcgatgtatacaggtttgggccgctgggaagcgtaataccctactcctgtgtttcggtggatttgtgtatgaacaagtaacaaagtgtcaaccagcccccaatcgctctgggatcggatctggagaaggccttgtgtccaaaagtcctccctctatctaagtgggcaatgtcctccttttatatctcaaggggataccacatgcccctctccttctccaaactggactgttcttctcttcataaatggacggagatcggtacggctgctgtccgagtgcccttctgacgggacggcccatacctacccccacttccgccggaaacaggtgcgacgtgggattatggctgtctgttgatgacgcgaccagtgtcagaccggtcacagatcagtcatccttgtccaccacgtgtcagcttagcaacgtgcatgtttgcccttcttcatgtagcatcttgcctgtaatggttgggatgaagcctggtataaatttaaccagggctaacgggccatctctaagagattacacgctagctccggcttgagacgagtgcctagaggctttcgtcttgaccggatggggcaaggcgtgcgtcaaaccgccagtcgccacctaacccgtgatctgaccggtctgtgactggtcacagaccggataaaggaacgcgctgcactacgctgcatgcagcgtgacacgttcgaccagaccgcaataaatgtggttaggtgaggcttaccgtgttcacccaacccattcatgtggcgctaactccacaaggggtcggggcgcctcggccctcggggccggggcaggagtcacccgaccccccctcggggaaatcaggaggagggcggacacctcaccctcgggcccgacgtccccgaaggtgccaggccacgtgggcgattgtgtctgcctcaagcctctggtcacgatactcccggtcccatatcaccgacagataggatatcctgtaacatgttacaatcattatttttgcgctaagcatatttgcatggcaaaaatttccatatcattgtttcttgtaaaatgcaaagcacctagataacaactcgtgtgatggtaactataaaaccagatccaaagggcaaagaatggtaattatacgtggtgttaagtgaaaacatgagcctagctctaacccaatgtaaaattttggtcaataaatatggtccaaagtgaaatttactctaaataatatcttgcatgacaaagtcataaataatatttataataatttatttttagatatgacataaaaataatatatatataaactatttatttagcacataaataggttttatcttataaaaaatgtcgtactactataacaaaatatgctttatatacattatttaatgataaaaaatattaattttttgttatatctaaaaataaattttgtcatagataaaaattattttgttttgccttcgcggaggtgaaactaaaatattattcttgctaaataatatctcacaaaataaactcataaatatgatagtcacatacaatatatttatacactccattaatatacttcataaatttatattttcttgataccaaagggcaaaatggactttatgatagaaactcaacggtcaactaatggtattaacggaaagggtatagaagggatccaaactgaaatttaggggtatggaagggaatgagcaaatctcaggggcacaaaagggattgggtgaactttcaggggtacacagcgagttttctcatctcttaaatatatatactcctccttaggttaccttcttcaagttccatgtattcagaaagaaataagaaataacagttctatatcgagagaaccatttgggcacatatgtataaatggataaatatggcgtgttttcactatgaataaatggataaatggataaatttagttgggttcatattgttgccatccatattttgtcttaaattggacacactcacgagtttatgcgtgtgagatgtatgtgcatcttctatgcaacaggaaatagaaacagcaaactaagagagagaaagatggggggaacacttacactgatgcatgcataaatatacatggatgcatgcaatataatgcagtggaagtgtgtgtgctttgtggcatgcaaggatgtaccaccatcaccatgcatgcacacactgcgctcagaggagaggagaggagagtactggcactgagatctttcatggcttgtcagggaggaagaagaaaacaacagcgagacgacaaaaagggggctctcctggcctgccctgcatgcgttggcgccggtgaccacgaaacagaattgcaggccggccattgcaacaattgcatactactactacatgcatagtatatgtcagaaaaacttcaattttctcgtggcagaagctagcagtccgtattaattagggttttaattcgctgcgaacatatatatcccgatcgatcgatcgatcgatggccagttatcctttcccgtaaactgttcatgcagtacgtacagactacacagactagtttacgttgcgtgcttatagcatcatatcctagcacagcaactgtatgtacatcagattctactagtgtagtataatgcatatatatataagcaagaatcattctctagtacttaaatcgaatatgcatgcttagaattagcactgtgttaacgccaaatatttgtcatttatatcattaagaagtatgcttaaatacaacatgcatgcttagaaccactgacgttgttatgttacattgataattaatttgcttattttttgcttgtagaacctactgcagaattacttattcctcataagactatggccctgcttagatttcaactttttttcttcaaactttcaactttttcgtcacatcgaactttcctacacacacaaacttccaacttttccatcacatcataccaatttcttcaaacttccaattttggcgtggaactaaacacagcctgtatggctcacctttgtggtccatcaaggtactacacctatgtactactgcatctgttttaacttggtgttttagacatttcacacaattttcagtgcacacatgttctatctttttttccctaatcatatatttgttcaaaagattaaaatatggaaatgtttaacatggtaaatctgcctagattgataaggttttatttatataacatgtttatatcattttattgtacctactcttatattttggggaggcatgaaattgctagctatagggaaaacgcttgcatgcatggaaacatatactccctcgtcccaaaatataacaacttctagcatttagattttgtcccaaaatataacaacaacttctccaccaacgtttttttctcaaccaatcacaaccctccaccatttaattttctcacatacctccacttctcctccaatcacaacactccctcatttaattataccaattttcttaataaccatgtccaattctaaaaatacttatattctaggatggaggaagtagctagctctaataattaagaccctatagctctgtacatagtacaatggtacagtttcggtcacatgtattttcgtgctggttgaagcttcattgaatccaagcttgcccagcgcattgaatggcaaccacgaaagaggtatgacacacatacttacatggagggaagaacttatattcatgcgtgttgtagctagggttcaggagcttggaaaggtttgtactaatgcaaatggggagaatattttcatatattttttcgtcagccacgtactagctacatccatgcatggggagaccatcgatggaggcatatatgcagctgcagctgcaggtccacacacttaatcaaggagcttgaatgggcttaaatgagaggaaatcaagggcgtgcaggagcaggagcagcagctagcactgtatatagtgtagtgtagctcgctagctatagtagcagcatgttgtactgctgctgctgtatggttttgcatatattgttggttggtttggggttcgtcagatgaggagatcagctatgtgcatccgagcttacagctaggtttcgccgggatgaatgtcggccgtgttcaccggtacccaaccctcctatttaatgcgtgaggatgtaaattgattaagatgtgagtcttctgaagcacttgtgatcatggctgatttcagcctctgcaggcatgcatatgggcttctgagcttgtctctcgctgtgctttatggcgttgagatctagtagtgatgagcctcgattctttttcacaatcgtcgacaatgctagatttcttgccaaagatttttttttcctcgaaagttttgatttgtacaccgttagatcgtgttgagatccttcatccttgcatgaagatgagaaaaaaagtcgtgttgagattcgtacaggaggaagagaaaaaaaaatcaaatgtaaggagattctgggattcaaactcccgatctcaagcactagcacaaatgttggtagccaaccatcatcccttgtaagttttttcttttgaccaattacatataagttacactataattatagtataattataatgtaattatactctaattatatcatagttatatataaaatatttttacctaaaaattatcaaatgttatgtagcttctcccttcacaatttggtcccttttcgaacttgtttcacaggtagatcctctgtaaaacttattgtgagaatggatccatatctcgatgcccaaggtcgttattggtaccgaagttgaatgtctcacagccagttggtttggtgctgagccctctgctgcatagaaacaacttcccccactactctctctctcctcctaatcatcttaaatcatgttgatttgctgtcaaatattagaaaattaatcatcactcggttacgctaatttgtttttatttataaaaagggtatctctaactgtcatttgatgtacttttttaccctccttttgtttttctgaatattagatatgttgatattcaacgtgtgggctggatcggtgggtcttaaaatgtgacactatatacatagtcattatttttatttgtttcattttatttgtgcaaatgattttgggatattggtccaaaatccgacatatttgccaccctattttttgtcgaattcttcttagctagtaccttgtatgataagggttcagttcctcactcccttctcctccaatcccctaaattatgcggactgtctatgtgattgcctgctgaaagattttgtttttcagcaggattttttgaccgtacgatggaacgcgtgttcgccatctagcgcctccaaccaaccatgcgcaagagagtgcatgtgttgtttttgtcattttcttcttccgtacgatacaaaagaaacccactaaaataaaccttgggtttctcaattacataaaaagcaaatgggctttcgggtttgtcacttaagcccagaaaaacaggagaaggaataagtctattttgcatccctcaactcttgctctttgttgaatcacatccttcaaccgtaaaaccggggataactcccctgccccccccccccaaacaaatatttgaaaaccggtgcgaattacctcctctggtggtttaggaggcggtgttgactgacatggcaaccttgatcccgttgactaactgtgtcagcttgtgggcttcacttgtcagagacttcttccatcctattttcatcctcacctttcccctctctctctctctcttctcttcccccgacgaccaatgtgctgccgtggtgactgtgtccatgcctgtgaggtcgtgactcttccaacactttcgatggacggcgccgtggcggctgatccaggggggcccgtgtgcagtagtgcatctgtcggtggtggagaccaccggcacagccggctctcaagccctaccactccatagcgtggcccttgtcgttgctatgctccacgtcactggcattggctcctccccctgcgatagctcttgaccccatatcatcgatattgtcaccgtcagtgtaccactgggtctgggcagagttcgaaattccaaaatgatatttccgaaaattcgggtctattggtggaccttgatagtaagtgactccggtcaaatatttcgggtaaaaaaatttaaaagaaattcactggataaccctatctcctcctcagtcaccacatctcccacccccatctcctcctcagtcaccgctcgacacatccagatccagaaactccgccaccagagtcgctgctcgacgcagccggcagcccaccgccacgctacacgcctgcacctgcatgccacccccagccctcgccttctgcacgccgccagtcgcccccatccaccatcacgttgcatgccaccgcatcagcgagcgggcggtagtgcgcctccttcccacgggcacttctccttccaggcgtcccctatggaacaagtggatggaagtggaattcctgcctctgttgggaggggaagaggaaggggtcatagcaccggagatgctctagtggcctcagcatttgggggtttggggaaggaggagaaggcagcagcatcggcacggggtatggaagaggaaagggagatggaagaggagcaggtggcattgggcgagcaacggcggcaacaaaggtgaacagaggtaaagataacatttgtggcttaatcccctatcctagttctggcattgtgcttgctagatttgctgttaaagttttatcaattttggtattagtaattttgtagttgatgttttctaattattttactgcaacaaggattgatattttgtagttgacatatacctggtaaatatttgtctaggtgagcggtgtgcttaattagacagacaaaggtgtgcttaatttagttagacatttgtctaggtgattattgatatgtgctttgataaattactgatttatattttgtagttgatgccctttaaatatttttctacaagctctatacattaattctctagttgaggtcccatttttttcttgggataataggaaatatcagttcaagccgtatttacgatgtttggagccatgggcaaagggttggggtgaatggttttaaatgtttatattgctcttttactggatctggtggagctgttactcggctcagggagcatttggctggaaaaagagggaatgtgaagccatgcttgactgtacctccacatgttcggaaagcaatgtgggctaactcatactaaggaaactataagggattttaaccaaatgcaaaaacaaagggttgaagcaaatattgttgaatctatatacataccttcagatgaagaggtgcaatttgagatggcatgtagactgtcgttgggggacggtactttcactcgtagtgttggtagtagtaggaagagttgtgcttggagtactcctagaatgcagaatagtagattctatcactcctcaaggaaagatgactttgacatagatttggcatgtagccaatcaccaagataactacgggtggacactataatgaataaggatgcaactataacacttgggaaggcttgggcaaaattttgtcatgccaatgatattcctggtagaaagcttaactgtctttactttaaagttgtgataaagttgactcaagagcatggtaagggggtgcgtccaccttctggcacacaagtagatggtgtttaccttcagtcgaactatgaggagttaattgagataatggatggattcaagactagttggaaggattatggaattacggtaatgtgtgattcatggacaggaccaaccatgatgagcattatcaacttcatgatatactctaatggtcaaatgtatttccataaatctatgaatgaaactggtaaattacaaaattcaaatttcttgtatgattgcattagagaggtggttgtcaatgatattggtgccgagaatgtagtgcagctagtaacagacaatggatccaactacaagaaggcttgcaagacgctgatacaagaacataaacacattgtatggcagccatgtgcaacgcatgccatcaacttaatgttaaaggacactgggagtttgtctccagttgaccaagtggtctctagtgccaaaaagatatccatgtttttctgtaaccataataggtgagcatttacaccaaatctttacagcttgcattcaaatcttgtatagaaagagcatctaaattgacttatagttatttcttcctctttgctacatgttattacttgaaaattgtattttaaatgctggtttggaaatcctagcatgattcacttcacctttttattgttttggcatgaccaatatatgtcaaaaattgagacagaatgtagacttctgattacctacaatacatctgacaatgtatagagcaaaccacagaacaacctaccatttgtagcattcactttatttatgcagaattgtgttggcaatctcccacaatcacatgccaaatgccacaatcacatgccatattgtaccactatgactaatctaatacattttattgtttttataggctccatgctgagatgccacaaggtttggtattgtatttatcttcttttaggacctaatggaacaattcaaaaagtggatgatgtcggaagagtggaccaacagcgaatattctattgcggaaga

SEQ ID NO: 29401 - DNA, 6124 bp, Oryza sativa
gataacgagtttgcttgacacgggtttcatgcgtgcaggtttgtaattttccattttgtttgcatgtatttcaattccaacctatgtgtaaattgttggtgctagctgaaagtttctacttgcaaatttacttagctggtggacttgattccgaggcccactacaaatacaagggttatttaattggcaaaccaagctacatatgcaaaagcagtatcaaaagcatttcagaagatggcgaaaactgaggtatatagagcaattggccagttcatgcagttctgcaacaaaaggggcatgttttcctctagagctgctgagattggatcatctagctagtacaatgcatgtacttcaaatctgaattatgcgtaaattgcatgaattccatactgttggtttgaaatatattaaaatattgtcagtttgtactattgcagctgattggtgggaaacttatggaggggactatctagaattgcagaagcttgccaaaagaattgtgtcccagtgaatgtcctatagtgggtgtgagagaaactggaatacgtttgcattggtccacacaaaagtgtgaaaccggcttggttatgaaaagttacataagttggtatttgtgcactacaatctgaagttgtgtctccaacagtttgagatggaagtgatacaaagggaaaaggaggttgatcctttagggatgatgatggatgtggctctttatgatgaagggaatccaatcatggaatggctttctaatgctagaagtgaatctgctccaatactcgatcaatatagttgttcatgaggtgttaatcgacatgtcaggtaccaggttccttgatgagcctaaccatgcatgtgccaatagaaggagagcaaataagaagaggaagaagaatgcaaaaacaacgtatatagatgaggaggatgttgctagtggtgatgtctgatgacacggacatcgactctgatggtacactaccaaactttgcatctagcctgtaggagcaaaaccgtcaggaaaattggttttaccgtcagaaaaaatattcttgtaggtgcaccgtcagaaattgccgacagaaaaattaccacagaaaaattcaattgttcagtcggtttcccgacagaataataatttctgacggccttttcctgtgggtggaacacaggaaaaaaactgagatgccgggtttgagagaacatagttctgacgagtgcaccgtcagaaaaattggctttccaaggcaaaaaaaaaaagagagagaatgctatgcacatgcacttcagattaatacacaagtaaattgatttggatattgcactcatgattagatccatacataattatttacagcaatcaaatattcatagtacaattgtgcacagatacatcaacttcagtgagatatacatatcaaagtttcaactttgtgtcaatcctgtttacaaacactaagaaaatagccacccagtggtaaaggaactgcaagtctccatctatgttacaatttataaagatacacttataaagattcatattttatctttcaagataaaattatccaccaaacattgtatgaaaattctgattgatcaacacctttcaatcagctgcaagcaaaaaggcaacaggtgttgaatgatgtgcaacaaaaataataacttgcaagatatgcactaagatgtggcacttaatctgtacctaagacttcgttgaaatttggcgttcttctgtagttttggaatggactctgcaagatggacaaattgaatatgcaaatcagctatacaaagaatcagtttaggtcatgcacattggttagttatatttagcaacacattcaggcagatcactttactgtaactgatgaagctttgtctcatgacatttaaatataaaccagggaagtttttttttagtagcaagggactctaatgtgggagtacctgttgtggtgccactgtattaggtcttcacaaaatggcttgagagaggaaaattagatggtcctgatataagttgaaacaagaaacaaattatttagatgtaaaatagacattatacactagactaatccaagaaaattaagtttctattatggactaagttacataatgtagactaatatgggaatcaacttttcttgcttaatatccgggaatcagggctgtctcaagggctctgaaaaaaaagagtaggtgaataaaatatcattctacttatacttttaattgatcaactaattcaaaaaagggcacctaaagtcatcagaacatctatgtgtttcgtaattggcacctaaaggtaaagtaattggcaacaatattagtagacagatggtttgctacccgaagcacaataatatattgcaagtcaattaccggtcttgaagtctaattgtctagactatccagatcaagacaaatatccagatcaactatacggtgatcatttactccaaattaagacaaatatccagatctactcttggtaatcacgtactgcaaatccttgcaaaataatccggagagcagacctaccagctgttggacgaggaggcttgctggggatggactgccgcagatccgctcacctcgaggctagacctggcgccgccggagacgggagcctccggatctggaacacccagcctcgggatggctggatccgtgaccatcgagaatggggcatatggatctgaagaccctgaacttgggttggctggcaccgccggggaagagatggctcatcgatggcacaaggcggcggcgtggtctccattcgtcaaagcaccggcgctggtgctggatctactcgcgagtggcgatggggactgcagaaggaggagaggggtggcggcggtggcttgagggattgggacgcgagggatgaaaaactaggttttcttatgtgggctgctggacttctatacgatggatttaggcccacctgtcagtggtaattttctgtgagtactagcacaaccgacagaactatagcgatgttctgtgggttggctgcgaaacgcacagaaaatatcacagcccacaggatagctctaaagtctggtagtggtagtcgtagtcctgaatatgtagagtcaggggatagcagctctgctagtgagaacatctctgatgatgaagatgataatgtggctgccaagaatagaacctctaacaatgcccaagcaaagaactccaaaggtgtattttatattagttcaacataattatattgtttatgtgtgctaatttagttctatactacgtatagcggtccatcctgctccgcgttcaaataggaggctgaagaatatcaacaccttaatagacaatgacaaaggtaatttcatgctactttctttcaaggaggtataaattccctattacttgcactgacaattccctactagtacatttttattactatggctatgaaatcatgtttcccctatactgtcatgtcaaaattacatattcagtatctctctttctctgtgtgtgtttttgtgttcatggctagctcaagctgcactgagatttcatttttttttacaagtactgttcatgtttgcaggtgaaggcaaagtgtcacactagactagcagcaagtcagaaactgcagcactgcagcttcaagatgctattaacattattaacaaagtatccatatttgtagtacttatgtgcctatattttatagtactggactattgatagaatctattatgctcctatatatattttgtagtactggactgtcgatggactgtatatgaatttctagactttattgtgtgttcaaggatattgtatgaactggtaatggactgttgatggacttatatatttttgggttggactgtattactggactgttgatgaactttatatgcatttctagacttcagtgttcaaggatattgtctgaactggtgatggactgttgatggactggtgatagacttgtatatttttgatctgaactttatatgcattgtatgaacagctattatgataattttggctgcgcgcgccgctcgtatgaactgctattgtgataattttacctaccgtgttcgtatgaactactattacaatgatacaatcttcctattttgtttttttttaatttcagaaatttcggccataattttaaaattagaattcaaaatttatttgaaaatttcgtccaaaatattctcaaaatttctgaaattttgggatttcggtgccccccaccccccaccaccaccacgaaaaaaaaggcaaaccgatagttgaaaccctaggtctgggtgctctcccgcacggggtgcctccacacaggggcgtgcctagtttatactacccggtgtcacaggacaccgagtagattattcaaatcctatataaattacactatattaattattatattagtcaataattagataattagtatgtattagacccccggtaacttttgttctgggttcgccactgcctccatagcatgctcgctggcacgctccgcggctatggtaggtggccgtcgatctacgacagccatgggggagacggtggcagttgggaggcgagaaggcggcaaccaccggcttgggccccagcctcctctccacctcgctaggcacatcgacgggagcttgggaggctgtggcggcacgagatgatgcgggagctcggctaggcagcactgccgccatggagcccaacgcggtttgaggcggatagctcccctcgcgcgcgacggtgtgggcatggcgagccacgcggagatgcgttggggttgccgcgacggatggagccgcatgctaccgaggccacccgcgggcggcaggcttgatggagaggaagcagaagcagccttttttgcctttgcagttgcgctttgaggtttggtattggtaggagcaggagcataagctagcaaccttgttggcttgttggccttgttccctttcctgcactactttttcaccgatcaacccttgaaggcttgcaccaagttatgcaggacttccacacaacaacagcatagtatcaacgatggcagtaagacggcagggactggatgtagggagggaaggatacggattacgaatagcttcatggagacaaagtgcaaagtcacagaacctcccgttgccaaataattggtggagcaaaatgtgaaatatttgttagcatctgcagttcataaatttataaacaatcccatggaagcaaatttaggagcatatgttgatcttaaaattcactgcaaatcctatgaatgaaaatatatagctactccctccgtcccaaaatataacaatttctagccattacaatttgtcccaaaatataacaacttctctaccaacgttctcttttcaaccaatcacaaccttccaccattcaattttcccacctacctccacttctcctacaatcacaacactcccctatttaatcataccatctttcttactagtcatgtggctctaaaaatatttatattctgagacggatggagtaaaatttagtaaatagggacataagtaaccgaatctgcaaaaatatagagcctagaggggcgctatgcataaaaaaagcctggcattccaacaaatcaacatgtcccgcatctgactcgcttgatggatttaggtttaatgcccattttgttttgcagaaaataaaaggccaccaacaccaacttatttgggtacgctttcttgggcttaaaaaaaggaggtttaaaatactggatttacttacaaaggcccaacgcaacacaccaaaaaaacaccatataggtgtgagtgaagcccaaaaacataactagcatgaaaggtacattatgaacagaaggaataagtttatctgaggtcccttaacttgtcaacgagtccgattttcgtgccttcaaccggaaaaccagatacaacgggtcccttaactatcaaaaccagtgcagatgaggtccctcggcggttttgagggtggttttggctgacgtggcgcctacgtggcaaatttgactggtcttcatctgatgtggcattgacgtggcgcatacgtggcaattcgatccggaaaaataataaacttcatgagacccacatgtcagtct

SEQ ID NO: 29402 - DNA, 4732 bp, Oryza sativa
agttgacatgtgggcccacgtgggccccaccattcttttattgatttatgtgtgagactgacatgtgggtcccacgaagtttattatttttccggatcaaattgtcacgtatgtgccacgtcagccaaaaccaccctcaaaaccgccgagggacctcatctgcattggttttgatagttgagggacccattgtatctgattttctggttgaaggacaaaaatcggattcgttgataagttaagggacatcagatgaacttatattcctgaacagaacataaacaaaagtagcagacataaatttctcacattggtgcatttaaaattggggtaggtgggggcgagattgctcgtgcgagacgcccccgaatttaccgttttcggcccaggtgatgccggcctgcgagatcaattcagcctgttactcaatttgatccactcgttttcagactttccttttttaaaatttgcaatgggcttcattatttatcacaccgaatcgagcatttttcttactcatgtgtatgaagtttgtaaaaagtctctcctaaaccaaagtttgtatacgtatatatgttttatacatcaaaaatatatgcgtatatataaaatttatatatacggtatatatatacgtatgtatatactttctatacatgtgtataaactttatatatatgtatataaagtttatatgtatgtatacatacgtatatacgtaacagatgaaactaaaggggggagttggtcgcgcgcggatcagcgtcctccagctggtgggggtgtggtgaatcggggtaacagccatgcttagccgttgcaggacaattttgacatcggagtttttaagtagacgagttttgtgctataaattgtttctgcataatacaaagaatgtttcaagggaagggtatggaaaaagagttgaagtttagcattctagtttttcttttttgtgttttctgctcaattatgagttatgggcaaggtggtcaaatatatcgattttttcatacgattttaagattttactaattaacatgtctaattctatagaagcaatcctacttagagcttccaattccaagtcagcatcgcgattttatttaactaccttggtatgcactatcagaaacttacttatgacgggataaaacaaaaacacgtcaggaaaattgtttgtaacgtgtcaacgtcaggaaaatcctcgtcaagaaaattctatttttctgacgttagtacaggctcgtcaggaaaattagatttttcacgataggagccattatacatgtcagtaaaataattagacgtcaggcctagtccggtttctggtagtgatggagtatccatctatctatctatttatctatgaccattaaactttctataaacgctctcaagtcaccacgtggcattcctgcaaacgcttctaagccaccacatggcacggtctaatctcacagttgattttcacttaaattggtggattcatcattttacaccatcaaattgaatctattattaaaaaataataacttcctgtatacggtacaaaacgatctaccgttgtacgtaattcgtgtcgttaatttgggtgttaatgaatcaagttgcatatatacaacgttttgtacggtaaccaaatcaagcatattactcaaacttttttcttgcgaacaaaaaaatgagttcactggtacatgttttttctcgaagtgcaccggtacatgtttgggctgaattacagagttttctatcttctatctaatttatttatttattgtatactaaaagtccattaaactttctagaatcgctcttaaaccggcatgtggcgttcctacaaatactactagaccgccacatggcactgtttaatctcaccatcgattttcacttaaattagtggtcccaatactttttatctttagattagatgaattattttaaaaaagtaataattttcttatgtatattgtgggccggaaaaaataaaccaaacataagtacttcgtgtacgtacttacgtaactggaaaagaatcaacgaaacatacctactgtcacggaagaaaagaaaacctgcatacgtacttgcaataaaaccaataaaaccgataaagtaaaaaaacatacataacatatgtacgtagtgccatttaaaaaaaatcgatgatgattttctactatttaaaaataaaataaaatactctaaaaacttacgcaaatatacatagttaataaactaaatcttctacaataaaaaaataagttgtcctatctttgatatattttaaaattatatatctaatttgtgatccagtcacatgaggtcaacatataataaataatattatgataatattttaaagaaaaaaaatgatgaattataccttgaactattatgctcgattgaattatctccataaacccaaaagtcaaacatctttcatcttcaactattattaatattagacaaattacccgctgactcaacccaagttggttttggtcctacgtgacagtccagttaacattttcttcgaaaacaaattggtgagacccacctatcatatatgtccctcacccctcaccccactctctttcttctccctccacgtctgtcaatcggcaaggctaggggcggtgatcggcggggcaaaggagctcgagtggcaagtggcagaggtggctcctcctcggcatctaccggcgcgtgcctccttgatggccgtgtggcttcccctctacctccatcggcgcgtgaaaaggacaatagcggtggggcgaaggagctcgagaggcagaggtggctgagggcgttgagtggcgaaggcttctcctcctcggctctctcggccaccacatgctcacttcgacggaggccattatctccatcccttccaacacatctcatcatcgtgtgacggccgctggaggcgaggacctgtgctggtcctccatggccaggttcggctatcaccctgccatcgagaactcccccaacaaatgcagtcatggctccatctacaacaacatgccatcccaccacggttcttaatcgatccccaccaccaatgcctctctcctgacgagacagaaagcaccaatcaagaacaacgaggtggatcaatcaagagagcaagagcaatggacagacgaaggagaaggagaacagcagcggggcggcggcgcgcctgcccggccgccccctgcagcaaggggagggataagagagagaggctagggaatgggattaaggaaatgagggagagagaggggagaggggagagagatagagagggtagagagtgtgactggtaggtcccacgtattttattttctaaaaaatgcttactggactgttatgtaggaacataaccacgctccgggttgagttagggggtaattcttttggtactaatagttaagggtgaaagatgtctggtttttgggtttacaggggtaattcgtactttttctgattttaacaaaatttacatcatatttcagatgtcaaatatcacttgacgactatacaatgctaatttaaatctacatatgtaaaataaatgaaaacaatacaatttagttgtgtattttttaagtggatctgatttgattttaatttgttagagattaagattctcaattttttttaatctttagaattatttcattagtatctgataagtgggcaacttaaatgttacatccatgtaaaaaaattatgaaaaaaaaatccaagccaattattcttgctataatacaaccacttaaaccatcatgagatttatggtcatatgtatgtttttctctgtgtgaaatagttttgataacaaataaacaaacaagtaacatatgcaataaactatttatgatatattttcttatacttgaagagttccaacttatcaggcataatttgatggacgtatgccatacaccctattgatgtgactataaagtatacttcaataaattagttattcaataaattagttattgtaaataagtttggaaaaatagattcattctccaaattaattagtaaaggtgtctcatctgattatgaataataggcattggaaaaaaactcaaaattatagatatttgtcaaaatataaccaataatatggtgctttggaaattacggtggtagtatttaaaaaaacctttatccgggttaaaaaatcatatatagtagacatagatatgaaacaactccagcattccataatcatgacacatgttttcataaattcaaggttgtacggtttgaagtaatatgtccaaattagatattaacgaaaacatgtttaaaatagagtcaagatctattttataaatatcatatacacgtaaacattcgtaacaaaaattcaagcaacattaaataagtgtccgcgcatacgcgcaagctattttcctagttggagtataataagtgtttcttttcacaacctttccttgtgtatagccatatttgcacatttatatagataccagattttaattcattattataaaagaaaaagattgatcgattaatctgggtgtacgtggagcacacacctaattaatactctgcactaatattttgaaatggtcaaaccactcaagtcacttaagtgcttactgcacttgataagaaagcatttatacctaaattaacaaatcatcaatatacatcattgtcaaaaaaattatcatcaaatgtcatgtgaataaat

SEQ ID NO: 29403 - DNA, 1379 bp, Oryza sativa
cgcgcggttcatgttgcctccaccacccacttgtaaagctcaattataagctaagctctctcctccttatcctcttttggcgggaaagagagaaaaagggaaagctataaagagagatcgatcggttcgatggcgagagacgtcgtcgaggccgcggcggcagcggatggtcgtcatcatcacaaggcggttgttgcggcggacggcggcggcggcggcggcgcggggacggcggcgctggtgtgggactgcggcagcgcgctctacgactcgtacgagctcacctccttccgccgccagctcgacgccgccgtgctctcctgcggcggcaggtcgctgtccatgccgcacctgctgtcgtcgtcgtcgacgcagcagcagcagatgccggcggggcggaagaagaaggaggaggcggcggctgccggcgatgctccggaggctgttcgggaaggtgctgctccggctgaggttccccgtggcgtcgagggcggcgaggggtggctggtacgactacggcgcccacggcgacggccgcccggggtcgccgtggtccggcgcgctgacgtcgatcccggaggagagcgccagcccggagaacgggccgtcgtcgtccccgctggtcgacgacgacgggccgagcgcgctccgcaaggcgcagtcggagcgcttcgtcggcagcaagacggcatcgtccatggtgcagttcgatgtcgtcttgtagccgacgctgctctagctagtctctgcacgacacactacttacgctgtactatatagtactgttcatgtcacacctgtaaattaaattagcacgaagtaaaaattagtatcaaaatcagtcgctgatttagttgttatggaaagtagctgcaggcttgagggtcttcaagcagtgcaaacaatgggggattattgagacattgtttgttgtggtttgaacaattggatacaggaatacaggtgtggaattttgggagaggttcaaaattctgggtggaaaatttctgatttcttttatgtcggtcaagaagattttcgggacaactgtaatttgccaagtttccatgcgtgaatgatatatctgcaaaatattattgccttcatatatatgaatactatccatgacatgtataaaaacaataaaattataatatatgtaattagtactaggagcttcccaagacaaacgaaattttggaatatgttgttaggtttaaaaatttgcttgaaattttcattcaaaagttttggaatttggttatcctcttctgcacctaccacccagccccccaaaaaatggtagtctagggtgcatgatgtgaaaatatgaaggcgatggagatagagacggcacaggccaaatgggtcacaaaatg

SEQ ID NO: 29404 - DNA, 731 bp, Oryza sativa
cagggtggtatgtacgtagtcgaaggcgaggtgacataaatataggaaacggcgttgaggtacggtagaaggagggaggagagccagagtgtgtgggcccaccatctatggtttgcccatgcatgcatactttgctgcctgctgggcacgattgattcgatcgatccgtcaaataaggagcctttcctcatctaaaccttgccgcaaatacagaaatcgtcaacaataccagttgaaaaggcatatcagtgccggtttcctaaccgacactacagctaattaggcactgatgaaggggttgtcggtacccattttaaaaccgacattgatgtgttccctcgaataaataaaaacatagaggatggcttgaatcaagtcgatgcttcaagcggctctctaaaattcacagcccagcacatcgatgccctcctattccgcatccacaatacaaatcaacaacaagaacacaagagcatccgtgtatattccattatctaaaaaaaaaaagagcaaccgcacacatgcatcaaggcatcattgcaatattcagactggaatatatgaggaaaccccccgttgatgatgttcgccatatcatagaagaagtggaagaagtgctcaaacagttagaaagcaatgtacacacatggagactatggtgcagcaacaatcatcgtggaggcagtggcatcctgtgaccggtggatttggcattgtttgttcggtgtagc

SEQ ID NO: 29405 - DNA, 700 bp, Oryza sativa
ttcctcacccccaactatgcaaaccggacgaattacccctctcgacacaatccgcggtggttttggtctacgtggcgtacgcgtggcagtccggtcagcattctattcattaaaaaaaatgtgggacccactctcttctctctcttactctcactctcactctatgtcatctctctctcacgcgcacagcggcgaggacgaggggccggaggcggaccggagtatcgtactttttcctcttttttttgtttacgagcagttggtttgatagccagaccggagtatcaattcatcatttcattgttgaatcgggccgttcaattcctctattggaattagaaggatgatctgggctattttgattataggaattctataagaaattataggatttcaattttcataggatttattccatctcttccaaaataaatcaaaatttttatataagaatctagagggagagattaagtaccacacttgaaatagcggaacaggggacagaaaatagaaaatcgaaggaatacttccatggatctaccaacatactccatccatccataagagttagacttatttcatattttagtgtttccaaataaattatttctagtctctatacatccatgacataaattgaggggtaaattaaatgttagattagaacccgaacccgaggagctatattaatacttattgg

SEQ ID NO: 29406 - DNA, 410 bp, Oryza sativa
cgggttaggttgacgtgcttcatgatgattgccgtgcatggatagagtcctgagaagtcaattgtatctattaattaggatattttatgtaattttcttagagatatgtttgggcaaaagtctgccgcaaagacttatggtatcttagagtttgttagggataagagtcgtgtccgatatggacatatcttgtaattctcgggtataaatagacccgagccccatgtaatcaaattaacacacgttcaatataatctcggcgcatcgccaccctttttactttcgttttgtttcgacaagttcttgctttcgggttgagctgcatcagttttgatcttcaacaagagataaaacttgttatggcggcttgcgttctcgggattagtgcttccatctttatgatactctaa

SEQ ID NO: 29407 - DNA, 618 bp, Oryza sativa
  unsure (1)..(618): unsure at all n locations
taatttacaaactttgctcaatacaactatggatatatggcaaacttttttcactggattataaatacaaagttaaattagctacaaccactaaatatataattaccatgccaaataaattctatggacgtagttgcatttcaatgttaaaactctaatggatatatgcaagaccacctactttttttttgtatttttctcattttctctcttttttccctatgatatgtgtaagggcaaattgggcatttcatcatatatttgcatcgaaagatgacatggcatgcccacatggtaattttcgatgagccaaggactgtatatgtccacatgataaaatctaagggcttgcttggacaatttgaaaggtcagggactaaaatgatctcatagcgaaacttcagcgaccgtaatggatattctcccatactaaaaacctatacatgctgcactcctataaactttttgcaaaattgatttattttgtgctttagtggaattgtaaggaagacaacccaagcactcatgccattaatagcacacataggtccatccccctaattgggcaatggcaggagcaaaacctttacgtgactttntggcccactctgtataatg

SEQ ID NO: 29408 - DNA, 254 bp, Oryza sativa
catgttagtgaaaaaaataaaaaatagcgggcccacgtgtcaatctcttttccccaaatctccggcgtcggcagtggccggcgagctctctagctcgtccacgggaaggtggcggtcggcgaggatggggcagcaacggcggaggcggtcggtagatgagctcgatggctgtcggtgaaagcggtagctattgcaagcgcgataatggttgacaatgatggggtcatccattctcctcttgtcccctccccctt

SEQ ID NO: 29409 - DNA, 705 bp, Oryza sativa
ctttctttcagatgctagattaatcagttacaagtaaactaactaactttacttggccttgtttatgcagagggaggccacctgttgctttccaatttttctgctgggtcacgcatgaatagccaagacaataatcttaaaaatttctttcagacaaatgggcatgtggtttttcaaagagtggagaacaactgtagcctaagatattttacggaaaatgagatacggcaaatcacccgtggttatagcattttactgggaaaaaggttcattcggtaaagtctacaaaggaatgctggatggtcgatgccctgttgctgtgaagcgatacatacatggaacccggaaagaggagtttgccaaggaggtgatagtacattctcaaataaatcacaagaatgttgttcgacttttgggctgctgcacggaggaaaatgctctaatgatcgttatggagtttatctgtaatgggaacctgaatgatatccttcattgcagcaacacaaatggacgtgttcctttctctttgggcaaacgtttagacattgccattgaggttgctgaagtgctctggtgcatgcattcaatgtataatcccgttctccatggtgacatcaaacctgctaatatacttgtggatgaaaatctttcaccaaagctatctgattttggaatagcaagattgctttgtgctaatggggctca

SEQ ID NO: 29410 - DNA, 586 bp, Oryza sativa
aactcggaaatagaaggatggaacaataaagaatatagagggaaaagatggtgaggccataaaaataaaaaaaatatttatgttacagtaagcatatgattctctattatatatcttagctataatgtttactgcagatgatgtgcccacctattacagccggcaattggctttgttattgatcttgctctaagagagatgggtgctatctctaatcttgaccgtatcatcgactcataaatataaatgcaacatgtacactactccaatatttatttgccagtctactcttactctcttttcttttgtcttgaatttggtgtagaggttgtctagggtgacttattatctctattctctctcatctttttctctcttccacctcactatgtaaacttatgtggcatccaaaagattgtggttggatgcttataatacttgccctaagctcttatcaagaagtccaattaaagattgcaaaaaaaaagaagtccaaataaaacaaatggaacttggtgacattgtattcccttccttccaaaataaataaatttaaaatataataaggtatttcacattacactga

SEQ ID NO: 29411 - DNA, 398 bp, Oryza sativa
aaggagatattttgtctgccccaatgtagacaacgatttcgttgtatgtctaaccatttacaaaatccgctatgatttgcacaaaattactacccaaactgaataacattactatttttacagggcaatccaaggatgggtggatttactcgatggatcgacaatgtcactccatcatatcatggccagaagataacagagtcagaaacacaagtagagtatcaacgattaagggaccacgagaatgcaatgcattctgaccgacctagaagggcccgataggttaccgcatgcttgattcgtcgggatcgacaaatttgtaccgtgtatcgatggcacttctaatctatataatcattacaatgtttaattatggtggtgattttttgaatgcataa

SEQ ID NO: 29412 - DNA, 198 bp, Oryza sativa
ccccaagcatgcctcctatcagcaacgcgagcacctcgacttcggaggtgcagctccaacacaagacaagagctgccatttcagatccaaaacacaaaaacttgcaggtgcagccaaccagccagccagctacaatccgccgcgttcctctcagattcgagcagagcaagcagaccagaaggccgattaacgaatccg

SEQ ID NO: 29413 - DNA, 616 bp, Oryza sativa
tgcatgtgttgtgccaatgactccattgtacagccgttcacagaactcttccctaaatttcatgctgtagttttttgtcataagcttaatttcctcttgtttaaagatttttagattgccaaattgctgtgctgatgacttcacattctttgaaggaattgagttgcttggtgcacttatgttctgctgaatcagatttccctcttcttcctctagagctttcctaatcattcttagactagttgctacttcaaccatttcaggacgcacttcaacctccctcctcaagcatttaactgctaacttgccaatatcttcgaggaagttcatgttttttgtattgttgatgtcctcgtcaaacaaatgcatcaccttcttcccttgttcaacagcctcagtgaaacgctgagcaagggtgatggtcccatccactgctttttttctggtgatgatttccagcaaaaccactccaaagctgtaaacatcactctttggggttagaattccattcatgcagaatgcaggatcaacataacctatagatcccatgatattggtagtatgttgagccccattagcacaaagcaatcttgctattccaaaataagatagcttt

SEQ ID NO: 29414 - DNA, 519 bp, Oryza sativa
tacgcaactggaaaatcatgcataataggcagaagcagaattcaaaagtgatcataattgataaacgcgcttctcttgaagaaaaatgataatagtgctgggctgggctttgatgcacctccattctcttccggaaaaagtacaccgaaggtccctaaacttgtcatcgagttataaaaagttaaaaacatcctcaaactgcaaaaccagatatccgacgtcccttaattaattaaaaccgatcacaataggtcctttgatggttttgatcccggttttgtcctacgtagcggctgagtcagcgtgggacccacgtggccccatatgtcagggtccacgtcatctctctctctctctctcttctccttgctcactcgctgcaggagggtggctggcagacgcacacggcggcggcctactgctgctgctggccaacgccgccggcgacgttattcctgggtcgcttcctccggggcgcggaggcggaggagttgtcgttctcgggcgaggaggaggagc

SEQ ID NO: 29415 - DNA, 197 bp, Oryza sativa
tctcaataatcttttgtttggctctccaggcctttgcatagcttatggtgtacttgaatttattctcgatgtgcctaataattgattttggtttaaagccaatgttaccaacaacactgctgtacatctcacttgccacaaaagcttaagtgatgtttcggtgatacttctccaccccttgtaagtagcacttgtgc

SEQ ID NO: 29416 - DNA, 6770 bp, Oryza sativa
  unsure (1)..(6770): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaatagaataggaaagaccaagaactttatttatctgagaaatatcgatctaatgcaaagttccaaactaagcaaaaggtaaactgcttgccaacagtatagtcgaccaacgtcctcctaggacatgctctaaactagccatacaacttccgttgtcaaagcaacttattagacagacactacaaaccattggtcatcaaccaaaggtcgccatttagcactggatccatccgaggagacgaggacctagaccgggtcaacaccctagtcaagctattggcgttgtagttaagtgggaatcgtgcctattcacagcatctaccctcgggcttattccgctagatttgcctccaattttccggtgtcctcgcaagacagcaggttccaaataatattgagaagatatgtgcacaccaaaggcaaccatataaacagtgtcgttccaccacatggaaaacacttcacatctttcactgggccaggtgaaaaatatctcaaattattgaacctcgcaactccacgattccagaaaattgaggtataatcatttatctccaaatcaaaaaagcgtgctctcaaccattgggaaagcaaaaaatgttgaccgtagtccaaccatactctgattgagatgttaagccactagggggaaggtacaatgaatcccaaacacattgtctaattccacacatttcaacgactcggaatcccattcttgagtgtgatcatagggatagagtggtctacattaatgcccaaagccatacaatagtcattgaaggcttttaagttaaatcacccacactattatctgaatcatttcatgcggttctcagagaacgcaacacgcaaacggacgatatgcgcagtgaattcggcaaaagcatggatctcgtacaacaagtatacgtgactccatcttgtagacacatcgatatcaccaattttgtatggaggagtgtaccagtaaagagtggtcttacccatagccatggatatttaatttcccagaattttcatgcattaggtgattttctgttatttacttggtcttatttggcattatattcccaatatttatgccactcagaaaaacatcacacataaatgcaggaaaataaacccatcataaagcttccaagggggggattctacactatgtgaacacaatttatggaagcatcataacctagaaaaccatctctagattatttagttggaattgcatcaattttaaaagcaaagcaatgcttaaaaaacaccattacatggttatttatgagtcgggagacccacatgcaaaaccaaactatatagggcctaagcaacaagacatagccacacaaacacaattaacataattgggctatagcgtaaaatcccaacactccggaggcttaaacgcaagttgtcaataaaccgaaattaatcgggccgaattaccgttcaggccacgatcttatttgggctagcaagcacagtgtagcccaaaatgcctaatgggtcgaatttccaaaaactctaaacccatgaggatttccaggtttattatttttattaatttgtttgggctgtctcgttactattgggttttattcggttgggcggaggcagaccggcctagccggttcgcctaaatgactgagaaagaggagggggaattagggtttcccctttcctattcattgtccgcaacggcgtccaccacccggcacactggcccttgggcacggcggcggcgttggaggccgtcaactgtcgactttgaagcgatttagggcggcgcacggcgaggaggtcatcgatgacccatccactaccccgattggcaggacggcggtgacgacatcactcccgtgtggcaatttggtgcggcggcggctcggtggcacacgatggagctccgtgtcgacccgtgcatcctcatgacggcggcgaggcgaactcaacgacggcaactgagaccccaacaacggcaaccaaattgcatccggccatatcgtctcggcggaggttaatccggtagcagataaccgacgacccatcatcctcctaccacggctcgacggcagcgtcgatgggaggtcaacggcggcggcgcctcgcttcggcattaactccggcagtaacggcgacattgtcacaccctaaaaatcctaaatatataaattgttgtttaattggaattattagaatttattttaaaagcctagaagagaagatctagttttaattaataaattccaatataaaatggggccagataaaatttcattaaatactttgcttaattctataattcctagatttttctgggatttatttgagctaaggaagtatttttaataaatggaattgcatttcatgaataatttaaattgaaaaagtttgtttaaaagtcttcttttagctttgggccgaaagtcggcccaaaaccctctctctctcctcctcggcccaagccggcccagtcaagccgagccgcccgcgcgcgctcgctgccactgacaagtggggcccacctgtcaggcctgtcgtctacctctggccggccgccgcccgaaccctagcgccgcgccgccgtcgtctctttccaaattcggcagcccctttccttttccggtgaaatcaatagaggggaaatgatcttcgggatctcctctaccttttctcttttggaatcgtcggctaaaatcgtttggaaatccgtggattcgatctcgaatcggattcgtctctctccccgaaccctagaccttccttcgccgtcgccggtcgccgttggccttcgccgccgcctccttgcccctataaaaggacccccaagcccgccgttacctgccgccaccctcgccttagtctctcgtcgccggtaaaaccctagcaccgtgtagcctcgcgccgccgtcgtcgccgccgctccagccgtgcgccgccgtcgctccagtcgtcgccgtcgctcgggaaggccgccgtcgtggtcgccgtcgcgttgccgtcctcgtccgcccctccatcgttgctgtagaccgccggagcaccgccgtcgtcgtcaagccgaaggttgccgccgcttcttcctcgacgccgtcgccgttcgttgatcttctgccgccgttttggtcaccggtgagttcgccgcgtcgttctctacatgctggtgccctccgttcgcgtcgtcacgccgtcgttcgccggcgagcttgtgcgcccgagccgccgccggtggtgacgtcaccgctgacgtcatcgttgccgtccgtcgtggtccggccgtggaccggtcgatctcggccgttcgttttggttaggatcgatctcggccgttcgtttccgtgagccgccgccgtgcacccggtccaccgcaaaccctagccgctgacgcaataaacccctttttccttttcaaaaataattcattattgcgtcataattcaattaaaacccatataagtgttttaatccgatttaatctctaaaaattcataactaattcatcttagctcggatttagttggttcaagtctctaattttttctaaaattgagatctacatgttaaaaatatccacatgtactgttcatgcttgtttatgtgctgttttggtgtttttgctcttttctgtttagattccgacatttccggagagtttgttttcgcaggagaagaatttgaagagttccaagggcagcaaggcaagtcacacagatcccaaacaaccctttgaacatgttgatcccgtttaaagctattgtttctattcaactattgcatttattttcgaatgtcattgggtggaattaacctattgtttggtatagtccttttgttcttgattactttattccttgataacttgggttattataacttgactagttgagttttatatattggttcagctagatattagatatgattgcttagccatgcttagaaacattagcacactattgggataacttatgactcactattatttaatgatggcttaatgatagttcgcgatggtcaatcgtgattggttaattaattacttgccaactaaaacttgataatggtgggttgtgagtacatggttttgagagtcgtgctcatgacaattaaggaccggttcacgagtttcggttgtgaaacattaatcgtgccaaccacaagccagcgtgggcaacggctttaccttttgtatagcatggttcattgcagagcaccagactgagaagtggcggagataagcccacgggggtcgctggggagtccatgccttgtttataagggggtgattatgatccaggaaaggtgcgctgtggtggattgtgttgtgcgaggggtactgtcacagctcctttccgaggtaccgtggtggtattgaggcacatggtgacatgttgtggggctgtgtcttgtgggtacagtggtacacctctggctagagtaaaactattcgaatagccgtgcccgcagttatgggcgggtctaacaatgtctttcgtgattagtctcacacttctcaccataataaaagatgctataactggtaataatttgattagctcctagtttggaatggtatattcctggtttggagatagaactgtgcagccaggattggttttacagaatgattgggcctatgcaacagggtatgttgtatagcgttggattaatattgtttaaattactacttaactattttattaaattctgaaatgtttattaaatgctgtttatgcaaatgaaaccctactatgccatcatttgttatcctgtgcacttgcatatttgctgcgtggcttgctgagtatgtcatatactcaccttgcaatcattcatcagaggaggagttctacagtgatgctgatggtgtggaggattaggtgtagccctggtcaagctgcctgtggagtggagtcgtctgcgccgtttatcttatttttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacagacatgggtttagggctttttctgagacggcggtttcccacgacggcatcgacgcaaggccgacggcgtacccaacagcgacagcgaatgatggccaacatgtctctaagtccgactacacagactgagaatatgtcaccgcgttcccggcgtggtgtcatcagagaaagagagaaacaaagtatcccatcaattcggccaattcggcccagccgaattaggcacgtctccagtccagggtatctcatcaattttagtgatttctctgacacggttttctccagttttcatcaaataaaatagatgcatatagatcaaaagcaggaaattaatctaccactagatcaagggcgggatcaaatctactgcaagtaaagcatctataatatgataaaaacgagaaaatataatcaatctataaaaacatatatatatatagatcgcataccttaatagacacatgtccggatgtatctatgaattagtaaattagtttaggaactaatcttactaattaccgtgatgaagatcagtgcataatgcgtgatctcctaattagtctggtgttgttccagtgaggcgacctatgcgcgcggcgagcagatgcacgactagggtgcacggattgctcctgcatctcttcgcgagcaaacatccatctgtatctgtcgcgtgcttgaccatcgcaggcaccatgcgcatctcagacagtacgtgcaaacaaattaaacaacaagaaaacgatctcgttagtaaacctacatgcatatatatcgacatacgcatgcatgcatgttgcttgctcctgtgcccaatccacacgagccatgcacgcatatgcctgctgctggttccagcacgcatggccgaggcgcccatgcgcattgcgaagcctgttgcgctggggcgctcccgcgcgtgcagcacctcgtgcgccgtcgcgcgaggccacgccagcagccacccgtcatgtggatgcgaggatctgccgagcaggatcactggtggagaaacctagtcccgatttataaccctcctttatttccggtttccaaaccgggagtaccaatccgggactaaagttcgctatctttagtcccgggtaaaataacccggagtaaagatcgatctttagtcccggttggtaacaaagatggctcagtcacgtggctggctgagccatctttagtcccggttggtgttaccaaccgggactaaagatcgagcagacctttttttttaatggccctgttgctgcatggtttatatatatatatatatatatatatatatatatatatatatatatatataaaccatgcatatatatgtttcaatacatatatatgcatacatacatatatat

SEQ ID NO: 29417 - DNA, 12207 bp, Oryza sativa
ttatattatattatatgtatatatggttcagtacatatgtacatgcataatatatatgtatttatacatatatatgttatgcaaatgcatatgtatatatatagaaaatgtgtacacatgcatatagaaacatatgtagtcatgtattaattacaatccattatatgtcctaactagctacgatttcgacgtagtagtagtactcgctgctagctcagaagctaaggaccggtgaattgtgtttccgtcgtagtagaattcacctttgggatcaaggatttcttcgttgatgaatcccatgagttgttcttgaaccgccacgataaattccttgtgtgtggtcaggttatccctcatgcgaataaactatatgaatatatgaaattgattagtaattaaacaagaaatcgttacgtaatgaaaatttgaatttatttgtacgtacatcgagctctcttgtggtgatgatttggtctgcaaggcagtggcaatactcgcacacgtagtagccgcacaagttagttccctgcttttgctttgcgctctacaaataaatgacaaattaacggcgtgagatctaattaatatacacttgtatgtattaatttgaatcggagaaatataaatatagagcatgtgtactcacaggaaatttgaacctccgcctaagtctttctctccagttgccgcggaccaaatgacggaaccgataccaagccctacatggagtgtaaagatatgattcgtagtagaaataattaacataacaagaatttcttaattaacagaggaacttataccaatacctgtctataagttcgaaaaccttgtcaaacgtagactcttttttatccattgagtcatatacgttgacgatgcaggccgacaggtcgaagagtaaaagcacccagtggaatctgcaatgtgcgtgggatgcattacatatgaaacacctagcaagttcgtacaggaatgaaatttattatgtaggaagacagtaaaattaaactaactctgtgttgtacggcaacagtatgaacgtcatgtaatgctgcgccttcaggagatggacgagattgtcctctgtttcttgtggatattggtcgagcattgcgacgtttactctccgagggtcgatgaatccagtatcgaaaaccctccgccgtcgggccctttgaatctccattctacaacgataaaagggagtattttattttatatagtttacttatatacaaggacctaatttattaaaggagacatagtaattaagaaatataactgaacgatatacttacaaaatccagcaactcataatagagacgtcgcgggcatccagctggtatacttcgtagattcccttgaaattgatccagagaatatcatctccttgcaagaagtccgggtccctgatcctcgctccgatcatctctctaccggtggcgctcatctccatgtacagctgatggaacttgtacatttgtgtgggtagggactgcaccagctcgggcttgacaagcggtttaccgagttcgtacatgtatttcaattccgccttttctattggttcaactcctagcaattgatccgtagttagaccggtgtcaataataaattcttctatcgtcatgtcttccccggtcaccaacggctcgatctcctggtttggttgctctccaagctgaggactggtttggactttacagaagatgctttcttcagcattcgctcatagtccgatagcttgatggcctccttgacaggtgcagacatacccctgaagaagttcctgacactggggtctataggaatcttcttttctggacttcgaggcttgaattgtctcttgacttctgatgcaaagctcctcttgcgtgcaatcgtaccccgggtccttgttcttggcggtgtcaacattcgccgtcttcgttgcccttgtgtgggcaggcggtggagctaggggggcccttgactttgaaggtgccggaagaggagcttgcggaggagtaggtgtaggagcccgaggaggagtcgatgcaggatcctaaggaggagtcggtgctagagcctgaggtggagacggtgctggtggagcatgaggaggagacggtgcaggatcctgaggaggagatggcggagccggaggagatggtgcacgagacgccgcttgtcgccctgggaggatgatgtaccgcctgcgccatagaataatggcatggcttgtgtctcatagatgcatctcaccgtctcctccagggtaatccagctcgaggtcctcgtacgcgccttcgaccaactcaacttcgaccttcgagtatcctgctggaatcggcctgtagtggtaagtacctgaagggtccgttgggatggccatgcccgacgccaccttcatgttgtgagagattatttattagtaatcaacatatataagcagcaactagcggaatggctaaatctaaaatatataaactacgaacttacctttattgataagttcttgtaaggaatatgcagctcacatggtgtccgctgagtgatgtcatcaacgggacaggtcgattcgtcctgtgtttgcatggcgtccatgctctgtgatcctacctgccccgttgaggcgcagctgctatggtttcctgacgggcttaccattgcaggaggaatggtcggctggggatcatgggaccgatgtgcggccatgcgttcatcaaccttccttgccacctcctcttgcattctgagttcgtagctcgatacccggaactctagatctgcaatcttcgcctcggtatctctcttgctcctcatccgactcctgtacgtgtggatgtcctccttgaaaccaatcttccaaggaatcacccctttccctcgtgttcgtcctggatgctctggagtctgcagggtgagtgtcagctcgtccctatctctgttcggtcggaacgtgccctgagaggaggcttccactgcatctgttagtcgtcgcacagcctctcgtatctgatcgccaaagaccagtgagccatcaactggtttgagcgttccaccgtgagcatagtaccagaacttcgatcgttccggccaattggcggttgccggttcgataccccgctcaataaagctagcctccatctcctcccacttcggcatcgcgacgctatagcctcctgaccccaagtggtgatagtacttcttcttggcggcattttctttgtttctttccatcatcgcctacccttgtttacctgtcttatatgcaacgaactcgtcccagtgatcccttagctttgggaatgtgtcgaagttcggtgtctgccccttcgggatatacttctggtacagatctctcttgaagctctgaaactgttctgccattttcttcagagtccaccttttcactttgtcctctgtaccagcaggaagggtgaatgtcttgagcattgtggtccacaacatctctttctccgaatctgggacaaagctctcatgatctccgcgtgcccttgttgttcgccagtacaccgtactgacaggcacgttatcctgcacaacccaaccgctgtgatgtacatagttcttggcggcttcggccggggcactaggacgtccatcttcttccacttccattatgatgtgccgaccctcaagcttcttcgctgcacctcgttgcccgtgtgccctcttctgtccaacggagggttgactaccactagcctcctcctcctggttcccctccacatccctttccacgtgcccctgctggttcccctccgcatccctctccacgttcccttccttgttcaagtactggtttggatcctcgttcccctcttcttcattccagtactggctgcttccctccgcgattgtatcgtacaatatctgttcctcatcgcggtcagccatctgttgatacaagaaacatctgctaagttacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccatagctagtaaataattatatactaagtctaattacaaataaaataatcttatattaaaactcaaataatattacatgctaagactaaaatagtcatgtatgctaagtgtttcgtgcgtatatgctaagtctaattaagactacaatagtcaattgctaggagtcgcaccaattccgtagtcaataattacatactaagtctaattacaaataaagtaatcttatattaaaactcaaataatattacatgctaagactgaaagagtcatgtatgctaagtgtaactgtcgtatatgctaagtctaattaagactaaaattgtcaattgctaggagtcgcaccaattccgtagttaataattatatagtaagtctaattataaataaaataatcttatattaaaactcaaataatattacatgctaagactaaaatagtcatgtatgctaagtgtttcgtgcgtatatgctaagtctaattaagactacaatagtcaattgctaggagtcgcaccaattccgtagtcaataattacatactaagtctaatttgcaataaaataatcttatattaaaactcaaataatattagaacactacacaatcttatatgctaagtctaattacaagtctaatattcttaattgcattacaaatataacaatcatttatattattacgtcacttgcctgcacgaattccttctagggctagctcttccactccggcttgagggacgactccgacaacacgtcttttctgcaagatacaaaaaatatgtattaggataaatgcgaagtaacatatatatatatattgcatttcacgttcacgttcgttcacgttcgttcgctcgttcacgttccctagctcgttcacgttcgttcgctcgttctcattcacgttcgttctcgttcacgttaattcgttcgatcgttctcgttctcgctctcgttccttcgatcgttctcattctcgttcacgttctcgcggcaacgtacgttgacgtgttcgttctcgttcacgtgttcgttaacggcggtgtggcggcatcgggccggcgcttggcgcggcagcgtggcggcggcggcggcggcgtggcgacggcggcggcggcggcgttgcgtggcggcgaaggcggcggcttggcgtggcggcggcggcgtggtgtgccggcggcggcgtggcgcggcgtcgtcgtggcgcggcgtctcgtggcgggcggcgcgacggagagagagatcgagatcggagatcgatgaagggagagacggcggcggctctcaccccagagatgcggtggcggcggaagaggcggaggcggcggcgaggacgacgagctcgagacgacggcgagatacggcggcgtcggcgcggggatttgccctagacagtggcagcgaaggagagaggccgagagagatcgatcggccgaaaacgttaagtgttggtggagaagacgagggcgcacggggaaaatatatacccccggatctttactcccggttggatctttactcccggttgttctcatcaaccgggagtaaagatcttttcccgctatttccaaattctttttaaaccaggttaggttaagaactgggactaaagattatagcactgcatattattttcgcttacatatgtgtttctaaaatagaagttaatgcattaacattatttaaagtacaaagattaatgacaattacttcgaaaaattatttttgtctgtaataaattaagtggataaatcgtaataagcaaatgtatgacttaaaattaataaaaattccaataatcatatatacttagcatatgaatgatattattaaattggtaaaaactctaattaagatatgtatgtacaaactgcatgatttaaaattaataaaaattgtaatcattatatatacttagcgtaggaattatattaaattaaatgttaaaaactctaattaacatatgtaaatgccacatgcatgatttaaaccttttaaaaattcgaatagtcatatataagtagcatatgaaagatagtaaattaaattgtgaaaaactctaattaacatctgtaaatgccacatgaatgatttaatacttttaaaaattctctagtcaattataattagcatatgaatgatggtcaattaaattgtagcatatgaatgatagaaaattatgccgtacatcaattggatttatatggataatcactacattccaaatagtttacatcgtgtacacaataaatatggcattacatcggcggtgacggttgaccgcacgtactttctcctcactattgttccctccttgtgatcgctgcgtgagtaaggggtgtcttcatttgataggaggatgctagggtcaatcatcaccatgaaagggggttgcctatccaactgatcgtaatcctcgtcagtcttgtcctcaactccgacgatttttcttttgcctgagagaactacttgacgcttaggctcgtcaggccctttgcccttctttcctttgctagacatgtccttcacgaaaaagactaaaatagtcatgtatgctaagtgtttcgtgcgtatatgctaagtctaattaagactacaatagtcaattgctaggagtcgcaccaattccgtagtcaataattacatactaagtctaatttgcaataaaataatcttatattaaaactcaaataatattagaacactacacaatcttatatgctaagtctaattacaagtctaatattcttaattgcattacaaatataacaatcatttatattattacgtcacttgcctgcacgaattacttctagggctagctcttccactccggcttgagggacgactccgacaacacgtcttttctgcaagatacaaaaaatatgtattaggataaatgcgaagtaacataaatatattgcatttcacgttcacgttcgttcacgttcgtttgctcgtccacgttccctagctcgttcatgttcgttcgctcgttctcattcacgttcgttctcgttcacgttcgttgtcgttctcgttcacgttaattcgttcgatcattctcgttctcgctctcgttcgttcgatcgttctcgttctcgttcacgttctcgcggcaacgtacgttgacgtgtttgttctcgctctcgttcgttcgatcgttctcgttctcgttcacgttctcgcggcaacgtacgttgacgtgttcgttctcgttcacgtgttcgttaacagcggtgtggcggcatcgggccagcgcttggcgcggtggcggcggcgtggcgacggcggcggcggcgtggcgttgcatgcggtggcggcgttgcgcggcggcgaaggtggcggcgtggcatggcggcggcggcgttgcgcgcgcggcggtgaaggcggcggcgtggtgtgccggcggcggcatggcgcagcgtcgttgtggcgcggcgtctcgtggcgggcgtcctgacggagagagagatcgagatcggagatcgatgaagggagaggcggcggcggctctcaccccagagatgcggtggcggcggaggcggcggtgaggacgacgagctcgagacgatggcgagatacggcggcgtcggcgcggggatttgccctaggcagtggcggcgaaggagagaggccgagaaagatcgatcggccgaaaacgttaagtgttggtggagaaaacaagggcgcaccgggaaaatatatacccccggatctttactcccggttgttcccatcaaccgggagtaaagatattttcccgctatttccaaattctttttaaacccggttagggttaagaaccgggactaaagattatagcactgcatattattttcgcttatatatgtgtttcgttaatgcattaacattattaaaggtacaaagattaatgacaattacttcgaaaaattatttttgtctgtaataaattaagtggataaatcgtaataagcaaatatatgacttaaaattaataaaaattccaataatcatctatacttagcatatgaatgatgttattaaattggtaaaaactctaattaagatatgtatgtacatactgcaagatttaaaattaataaaaattgtaatcatcatatatacttagtgtaggaattatattaaattaaatgttaaaaactctaattaacatatgtaaatgccacatgcatgatttaaaccttttaaaaattcgaatagtcatatataagtagcatatgaaagatagtaaattaaattgtgaaaaactctaattaacatctgtaaatgccacatgaatgatttaatacttttaaaaattctctagtcaattataattagcatatgaatgatagtcaattaaatgtagcatatgaatgatagtaaattatgccatacatcaattgatttatatggataatcaatacatccaaaatagtttacatcgtgtacacaataattacgtcattacatcggcggtgacggttgaccgcacgtactttctcctcactattgttccctccttgtgatcgctgcgtgagtaaggggtgtcttcatttgataggaggatgctagggtcaatcgtcaccgtgaaagggggttgcctatccaactgattgtaatcctcgtcagtcttgtcctcaactccgacgatttttcttttgcctgggagaaccacttgacgcttaggctcgtcaggccctctgcccttctttcctttgctagacatgtccttcacgaaaaatacttgcgttacattattggcaaggacaaaaggttcgtccgagtatccaaccttgttaaggtcaacagttgtcataccactgtcatcaatcattacgcctccaccagtcaacctaacccattggcaccggaacagaggaaccttgagaggaccatagtcaagttcccatatatcctcgatggcactgtaatacgtggcagttgttccatcgtgtcccatggcatcgacacaaacagcgctgttttggttcgtgctcttcatgtcttgggctctcatgtagaatgtgtacccattgatctcatatccctggaatgtcgcgatcgacccagacggtcccctcgccaggaaggcaagttgttggttgatcgactcgttacccatgagatgttgtcgtagccacgtggggaaagtatcaatgtgatgtcgtgtaatccatgcatcggacttaccgatgttcctggcgcgaactagagccaagtgctcctcgatgtaaggagctaccaatgaagagtgttgcagaacagtgaaatgggctttacggaataaattgttatctaccgtcattattgctttccttccgagagttcccttttcccgtagtctcccttcatggcgtgattcaggtaccccgattgggcgaaggtcttcgataaattctacgcaaaattcgatgacctcatctgttccataacccttggcgatgcttgcctctggacgagcacggttacgaacatacttcttcagaacgcccatgtacctctcgaaaggaaacatgttgtgtaggtatacaggcccgagaatacggatctctttcacaaggtgacaaagcagatgcgtcattatattgaaaaatgaaggtagaaatatcaactcaaaactgacgagacattgcaccacttcattctgaagggcttctaatctatccggatcgatgaccttctgcgaaattgcgttcatgaatgcacatagctttgttatggttccgggtgaaggtcgccgcgttgttccatatgcttcagatcattacgtgcttccagtgtatctttcaactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctataggctggcttccaggcccctttccgaacactactttaagatctttaaccatagcaaacactgttttcccgctgtgatgtttaggcttcgtacggtggctgttttcccgctgcgatgtttaggcttcgtacggtggtcggccttatgttggaagtgcttgcctttcttccgtaccgagtggtttgctgcaaggaatcgacgatgacccatgtatacaaccttcctacagtgcttaagatacatactttctgtttcatccatacagtgagtgcaagccttgtaccccttgttggactgtccggataggttgctaagggcaggccaatcgttgatggttacgaacagcagcgctcgtaggttaaactccacctgtttgtcctcgtcccacacggggacaccttccttcttccacaactgtttaagatctttaatcagtggtcttaggtacacatcgatgtcgttaccaaattgcttggggccttgaataataatcggcatcattatgtacttcctcttcatgcatagccagggggggaggttgtagatacacatcgtaacgggccaagtgctatggccgctgctcatctctccaaaaggattcatgccatccgtactcaaaccaaaccgtatgtttcgtgcgtcctttccaaattctttaatttttctgtcgatgtttcgccactgcgaaccatcggcggggtgtctcagcatcccgtcctgttgacgctcttcagcgtgccatcacaacattctagcattccccttgttcctgaacaaacgccttagccgtggtattatagggaaataccacatcaccttagcaggaattctcttcttttttagctgcccgtcaacttctcctggatcgtctcgtctaatcttgtatcgtagtgctttgcaaacacggtatgcttctaggttttcatactcctcaccgcgatataggatacaatcgttcggacatgcgtgaatcttatgaacttccagtcctaacggacagactatcttcttagcctcgtacgttgtctcgggcaatttgtttccccccggaagaatgttcttgacgagtttcaataaatcgctaaatgctttgtcactaaccccattttttgccttccattgcaagaactccagagtggtatccaacgttttgtgcccctgctcgcaacctgggtacaacgaagttctgtggtcctccaccatcttgtccaatttatgggcctccttttcactttcgcagtcctccctggcatcctgcaacatctcaccaagatcatccgcaacgtcgttaccatcagcagctatttcctcctcgcccgtttgattttcttcaaatccaacatactgagtaaagtccggaatattgtcgtcttccacttcatcttcttccatttcaacaccttgctctccgtgggatgtccaacaattatagcttggcatgaaccccgactcaaacaagtggaaatgaatagtcctagatgcagaatactccttctgattcttacaattattgcatggacaacaaataaaacccctttgcctgttagcttcggccactctcaaaaaatagtgcacgccgtcaataaactctttggaccaccggtcagcgtacatccattgccgatccatctacatgagtcaaaaaaaaccgtacataaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttcgctctcatcaacttacaactaaattttggagacaaaaaaaagtgtgcaaaatataggtgcaaatgtagtatgaaaaaacaaaacattggaggatgaagttgcaaaccttttaggcacctccgatttgtatgtaatcaccaaaataaattcaatagaaattttggcatgacctcccctcttttttgaagaaattttaaagcttgctcgggcagctggaggaggaagaagacatatatataggggtgggactttagtcccgg

SEQ ID NO: 29418 - DNA, 23093 bp, Oryza sativa
tgaaccgggactaaagatcatctttagccccggtttttattgcatccgggactattgtggaaatcggccgaccgacgaaagatggtttctccaccagtgtcaatcagttaaatttgatgttactggatttatcatttaaaaactatcataatatgcaaatatttttatttaaaacatgttactttcatagatattgttggacaaagttgcatctcagatactatatcaatgtccaaaaatatttatattttgggactggggagtacttactagcgtttgtacgggattcttcatcagataattaattaacgacatacaacgagatgattggtatcaacagtagctcgctgcaaacgtgggagccgggcgagccgcgggaaatatcacaaactagctgcacacgcgaatcagagcaacgggcaggacagccgcggcgatggcacggcgcacagccgctcagccttgggcgcggtgagcccgaacacgtcgtccatgtcgagctcgagcggctccgtcccagctggcagcgaccagtcgaagcagtgcaggagctccgcgaggccgagctccacggcgaacatccccagctgcatccccgggcacgaccgccgcccggacccgaacggcaggtactggaagtccccacccttgaactccacgcgcgcgctctcgtcggcgaaccgcgacggccggaacgccgccgcgtcggtcccccacagcgcctcgtcgcggcacatggcctagttgttgatccagatgcgcgacccgcgagggacagtgtagcccccgatggcgcagtcgtggaggctctcgcggaggaggagcggcagcggcgggtggagacggagcacctccttggtgacgcacctgaggtgggggaggttgtcgaggtcgtcctggttgaccctgcggcggaggccaaccacgccggctagctcgtcctgcgcgcgcttcagttcgtctgggttgcgcaggagctccgacagcgcccactccaccgtggacgccactgtcttcgtgccgccgaacatgatgtcctacacggatccatggaagcttggattagctgccgtggagagttgtgaaaagatggcagaagctaattacacgttacgtgccatgattagccccttgatgttgtctctggtcaggtggaggtcaccgagttcgacgccgtcggctctcttgtgtcgtccgccgggagcgtcgacgaggtacgcgatcatgtcgtccaccatgtcggacgccgacacgtcgccgttcctcaacttggccaggtgctcgtcgatgatccggtcgatgaaaacgtccagcgcgtgcctcgccgccgccatcctcttaccgatgccgttgagatcgagccacccgaggcaagggatgtagtctcccatgttgaacgccatgaagatctccgagagctcgaggatgatgtcgacgaacaccttctcgtcctcccggctctgtgcaccgaacgccgcccggaaggtcacgttggtggcgaacttgaataccagatcaccgacactgcccgcgactcggcgcagctcggcaacggacctgacgagggcgtccacctcgccgcgcacgacgcgccacgagacgtcgcgccgggggctgaagagcttgagcacgcagagcttgcgcatctggcgccagaacgggccgtagtgcgcgaacgccatgtcggccaggtcgtaggagacgtacaccatggcggccgtgaccggacagtgcgagaagacgctgtcgttctcgtgtatgatctccctcaccgtctccggcgatgacaccacgaacacgttcggctggccaacgcggaggtggaagaagccgccgtggatcttggagagcttggcgaggccgcggtgggtgaactgatgcacggacagcaggttgccgaggacgggcaagccgggaggcccgggcgggaggaggatggctgttcgacggagtcggctggcgtaccagaggaagaaggcgatgctgatcaatgaagcggtgacgaagtaggcatcttgactgtagtactccatagagtgatcacttcactaaggattactacacactaacaagttcaatagcgtgtttatataatgttcgcgagttccatatattatatatagctgctcaattatgttgtttctattgtaaaactacaaaaataatatactaagacatcacgtgtatgaggtaggtgacatatccaatggagcatgcacgattatatatttctatatggttggaaactttcctcgaagctttcatcacaactttaggagaaataaaaactatcaaattctcgcgttaatcagaaggggattacttgtgactgaatttgtcaccttcaacttctacgccagttttcatgaaaaaaggcatcccttcatcatccccatttatggtgaaactcgaactctagcagagaacctgtggtttagggggtaggtccctagctcctgtttggaactcctgtactcagcacaacacaagtgtaaattatctgcccgtatcattttttcatgttgggcttacttcgtgcttgaatggcccgtaggccgtaactctaaatttccatccatttttgaccctatggcctatccatcgtaaagtaattgtgacttcaccaggccatagtaattttccaagaaatatcgggctcggcccgctcggcgtccccatacccatcgctgactttcctcatgcccgccggaatttcagaacaaccccgccgggcacaatagtattcttcattcattttagatttggtcaacatttgtttggattttaaatattttaattccaaaatttccgaaattcctgaaattttggtgccccagtaaaaatgtccaaaatgaaattgcagacatcctgcagcatcaatcgatttctttggtcttctccagtagttttgcttgttattgctgtctttttatggcgtgtttttctgttttgaatttattgtggatattcatcttgaagatcaatttgatcctgactccattgttggcttatcttgtttcaattcgaacctggtgcccgtaccttaatttggatccataaatgcaatatttgctaattcagtgaagtgatatgacaattgtttattctatgccaatactaatagttactattctatgctggttcatgtaaaggaaccgatactaatacatcgtgctggttgatttgaagaaccggtacagacgaaggtcatcattattaatttttgtactccaagaacccgcacaagttaggagggttccatatcaataccagtttttagctataatagtagtgtgtgtactaggcacaccaatggttcgtaatgttgaatagttacaaattactttggacctcctctagaaatatagtcgtatttgggatattttaatccagataaacaagatactgaacatgtgttgtgaataacggagatatctggtttgggatattttaatccagataaacaagatactcaacatgtgttgtgaataacggagatatctatgaacatgctaataatagtaatatagcatcatccagtaacatgtttaccactaaggtgattagagtaatatacccatagaagcgccagaagatgaggcattgttgttgtcgttgcctccattgtaattgtcgttctccgctccttcagtgtcgcctttctctccgtttgttgccattgacgtagaggaagccgaacatgatgaagaggatgcagtgccgagagcactcatgcgtacaacgcactctgaaaaacttgatcacctgacaacccatgcaggttctccagtggacagagttctgaaggcttgctcatcctactaccaacaaccgggactaaatgttttttttattattttttgctgcttgcataatgatttccccaaatcgagtaggtcccgacatccccaaataaaattgagatccccaaatccctacatcaaatcgatgtcacagatcgaatgaacataccatgtttacatcacagatatccccaaatcctcacatcaaattgatgtcacagatggaatgaacacactatgtatatacgttataaattcagagatcaaaatataataagaaaaggacacaaaaacaacaaagacacaaacacattcaaaagtggatcgatcgatggagatgacggcaatggaggctgcagccgcctacacccaccgcctccgcgccgacatcgccgagggcaccggtcgcatggccctcgccatcgacgaccacgacggaggccgccgcctccgcgggagccgccacccgctcgccggcttgcgcgctcgtgcagcccgcccaccacccgctcgccggcttgctagctctgccacccgccgccaactcacgccacccgcctgctcggcttgttcgctgctcactcacggctgctgcgtgtgtgcacccacgggtagggaagagagatagaggagagagaggaggaaaggaaggggagggaagagagagatggagagatagaggaaaggtcatgaggagatctcgtttgtgaggaggagatgataagtgcgagggattatgtacgacgcttcgatctttaatcccggttggtatgactaacctggactaaagatagtgggggacctaacgctttttaaactgggactaaaaatgatctttagtcccagttggtaacactagccgagactgcagatcaaaaagttttgtagggctttttaatcgggactaaaaatgatctttagtcccgtttcccattcgaactgggactaatgtgatttttgccatccgggcaaagatcacttctccggtagtgatcctataagcgaatcgaagaaacaagcaagatcaagataaaagcaaactgaattgcaaattgaattgcaaataacaatttaatacaaacgataaggtggggttatgaagacgagtaattaagcggtctagctgacacgtgtaggtacaaggtaaaatagaaatagctaaaacattaatcttacataacccgagaaaccctgaaggggtacatagctatttctggaggtgggaggatgaccaaggggtccctagggtcgtgctccactatgttgtggagcaccccacaagttccccactttggtcggggtcccagataaagttacaagctcataggcccattatagatgacaacaccttgtttccttgattgcgtccgattgatatagaatttcgagacgaggcaagatccgttcgaaagaggaataaaaatgctatttagtcacggctcctattcgaaccgggactaatgtgaattttgccatctaggcaaagattaattctccagtagtgatgctataagtaaatcgaagaaacaagcaagaagaagataaaagcattttgaattgcaaataaaaattgaatacacacgataagacggggttcaaaagacgagtaactaagcggtctagccgaacgcataggtacaaggtaaaatagcaatggctacaacttatctaacataacccgagaaaccctgaaggggtacatagctatttatggtggtgggaggacgactaaggtctctctagggtcgtgctccactgtgtttcggagcaccccaaatgtgccccgctttggtcggggtccaagataaagttataagtctatgggtccattataggtgatgcaacaccttgtttccttgattgcggccgattgatatagaatttagagataaggcttcatccgttagaaagaggacttgaagagctttccatcaagtactcactagcagaaaacagacattgtatgcacatttgtatgctcgttgatgtggcatggtctcgatgtcctccagttgacttaagatgtgaataatggttatacctatggtagtcatggtcacattagcgtgtaccgaggaaacagtagagtcagggagagatgaacagagtggagggagctccctgtctatctcgaggtggaagatagtgagcgcgagagagacatttagggagtaattcaaccaattgattgctccatccgttactagagtaacgaatctccgtcagttatacctgccacgcctcagctgcggccatggcccgactctgcacatgcgcatgttcgtgtggcaatcccaccatcatcttaactgctcaagagctgctctcaattagcaacatgtttaagttgaggtccctcctcattgtttttggaggtaatattagagcctgtttggatccatgtcacatcggatgttcggacactaattagaagtattaaatgtagactaatgacaaaacctattctataaccttggactaatataattcatgagacgattcaattgagcctaattaatccattgattagcctatgtgatgctacagtaaacatgtgcaattatggattaattaggcttaacaaatttgtctcgcgaattagctctcattaatgcaattagtttagtaagtagtctatgtttaatactccaaattagtatccaaacatcagatgcgacagggactaaagtttaatccttggatccaaacgccaccttaatcctttaattttaattgttgacccatggaatttactagaaataaattggccgtagcccatttaattctaacacctccaagtggctaaccaaatgtctgtctaagaatttacgattttttgtgaactgtttgagatcacctcttatatagcagtgtcttcattaatcactgttgtcctgacatgaacaccacatgagcgcgtgagtcacgcacgttcatactgcataggatattgcagtgtatctgtcactaatcaagcaataactatagaactacagatatcgccctcgtgcatatctgtggatcaggagatgccaaaacagcagatgacgtagacaatatgacgggccacatagaccaatgattccttgctgtgtctgcatctctagcaagctattgcaaatttgcaattgcaatgctgaaggagatggccaaaccagctatacaagatatattgtcccctgacagaaagatttattttctaatggagggagtactatatagtattatcaattttgatattctctccttggttagacctgcatgtgtatagaatatgactatgtaatcatactatatacaatatagtttatctttcgccttcgataaggacaattcgaacagacgaaatggcaggtgccaggtggtgtgttagcatgcaggaagcatttgcgtacgttctatgatgaagcaaccgtgagtcttaaggttaaggatttaaaatttcaaatcgaaaggccataaatttttgacgacttatgtcggtaacaacaggatgaatttatcaaatgatagcagtattggttacaaactttgaaatttattaaaccatgcaagatctatagttaagacaccaaccaaaatacaacttttcaaaacaaagcacaaattcaatatctatttatttttactggaactcaatatttataaatatgactttcaaaattattactccatctgttacatctacttggcaacattgactttgaccatttcaaccttgaacattatcactcttttaatgagtaaactgtgtttagggccacctttcattaccaaagtttactttggaccaccctgtaacccaacctttcactttggactaggttatttttcttttgtttcacattggaccaccctaaaaacttttctaaagcacattaatgactttatgcacatcagcacccataaaccatcaatcttcccgacttacatgtaggctattctcctaagtgggtccaaggacgagtttggactaaaataaaagaataaattgcacccatggtgcatcaacttggcaggtgggtgcaatttagtacaataactggagaaatgagcattttagtataacaagttagcagctaggtgcaatttagtataagaacttaataagtgatcatataaatgcaacagcttgtaagataagtacaattttgatacagtaaattaagaagttatgcgacaacttaattatttgaagcattttttttataaattcagtttttaagtacttattctgacaatataatagtgtggatttgcataagcatatttatatttttattctaataactaataacagaaagtcaattaaactggatgtagaaattattatatttcggttgatatttgagaaggtgaagaaaaaaattcataaagttaattggatgtaaattgtatgtgttgtataattcttaaagattaaatttaatattataaggtaatatccataggattactatgtaatggcatattgacatcgtgaaaaaaactcacccagtatttgcttagctaagttgatgcaccaaaataataaattgtcaaattcttaaactagaacacacccaattatcaatttgttgcactccgacattcaattctcaagttcttccactatatcgtacgtatctgccaagttgttgtacgatggtgcaatttactcaaaataaaaacttgaaggaactgcttgttattgcattgagtttggtgaaattttagtgacccttgttagattcttttcatactttcatgatcaatatcacacacacccaccatatttgctcatcttctacactggaggatagcaaacacatactttccatttaccatatatgctatacttctacgtagaaagtcagaataatttatacatctaccacaaaagctaaacttctacactagaagtccgcatcaactaaccatccatcaaataaagacttcacatatttatgatttctcctctaactatacatggaaaatgagacatgagctagaaaaaaataaatgttgagaaaaaagctcacaagagactattctcgtgcatgagaaaaagaaaaaaaatgatgagagagaaaaaaaaatagccatgttctccaaataagtgcaaggaggaggatccaaaaaaaggaatcatcattacactttccccctttttcacatatatccgttgtccacactcatgcacatcttgatcatgatggtatgactagttattttcttggatctgggttttgactatgcaatatatgtgatgcaagtatgccgttcttctttcatacatgggctccacataatccttattagaagtagaaataagaaagagcaaaatcactgtcttggtgaggaatcatacacattgagcgatctgagagaatcaattgaggagtaaagtaaagttatgttttatgagcaaaacaaaaaaaaaacccaaggtactcatcaggaggagtggatgtaacttgaatcaaggccgttccattcttaaatcacccaagatggtgtatgctttagaataacatgcatgctggaattatttcaagggaatcatatctctgttgtcatccataatctttacttagggatgagaaaagactaagtgtaggggtcctgttgccgatccttaagtaccgaatccaaccatcaattcttgcattaaaagcaaatggaatgccaaacttagaggtagtggttattactaaccatttccacaagtcttggtcaatatgcgtatgcagatgaactatggaccaaaaccacacgccatgtgacaaaatacacctccggacaattggatgcgattacacaaatggaggtcccatatgtcaatcaaaaccacctaccattgagtccaacaaaggtacaacatgtagggacccaccagatctcctcccaaccgaagcaatgactgggagcctgggagatgggatagaaggtcagttaaaccacaatgtcgcccgaacctccatcgattcccctcgccatctgctttcacatgtagcctcctgataatctctcaaaggctgttatgcttgattcctggtggttaccgaccttccaaccgtcataggaagactataaaaggaggagaagctcttactctcaaattgcacaacaagtggagtacaactcacctacacatttaggaagctctctagtagagttaaaatataggaagagagtgaggggaagctccgaaaggagagccctaaatgtatgatttctctctgggatgttccggagatgttggcctatcttcaggagtgtccccgatggatgccttattttacaagtaagtgtcggcgcactctctcatcttgtacctcgatggatgccttattttacaagtaagtgttcatgattcctggtatttaattaccttgcttaagtgagatatattctcatagttgcgagttcgttgcttattttttgtaataagtgccctataagtaggactcttgatgaagaaggaaattcctgcgccaggcttgaatagtaatcaatgacttaggcatagtgttgaggttagtggttaccttcgtttgttatgtgctacacggaaagtgatattcatagcaggtggtgatagccctgtctgccctttacatccctccatgtttggatacatcatagagctacaggcctgtaagttatgtctagttaattattccattgctgtcctttctagccaaagcgtaccattagttattgtccttggataaaatctctttccttgatatacacaccccttagctatgattcgatacactcagaatactctaaagctgaagtgctacatcggtatctgtgcgcttgcgggttgatctgtgaccgtaacaaatataaatacctacccatcaacgaaggtgtttagtggtacgtggtttgagcagtgaagttgaacttgccacaaggggattaagaaaccagcgagttcccaaaattcagatgaaaaattgcttcacttgtgtcttatttacttattgcattttgttggtatttcttacattcacaaataaatccgcaagcacacgaatactactgtagcatttcacccatgagtattccgaagggaaggtggtggcataaaggtatggttttatatatcattaatcaatctataattaattcaccatagtgtaaaaaagggttaggataataattaattcaccatagtataaacaaggtagtggacacaggagattcatctatattataatgtctagtacaaaataacaatacgaaactatagtacaattgtacttctatactaatcatgtttagtatacacttaacaagtacatgctaacaacataggacttagttctaggcacctaggtacagcagagagaccactcccggctggtctgccagcatggttaaagcatttacggactattacgtcatacctgaacgtagacgaatacaaagggtggacatgactgtcaccacctgccgcctaattcactttccgtggggaacacctgcatccaacgatatttatctaacctaagcattgtgcttatgccagcaaataatagcactaacctaagttggagctagagcaacctataaaggtcatttgactattaccatagcatagatcgactagcctaggttgaagtagatatacaatgtatatactactcatagaacataagctcaataaagaaatatgtaaactattctattaattcaactatagtcttacaagaagagtaaagtactaaagacatacccaaaactccgaacaaactataggaccgaagctcctctagacatatttctactagaactatagagaatacaatatggaagagagaattgctccttcggtgtttcttgtgaagtgaagagcacccctctattatagccttgtaatgatggttttatggtggttatgggccgctaatcgtgcacatctatcattgggagtggttgagtcgacacatggaagaggagtgccaagcgcgccaagtatggttcggccgaacccattccaccgccatcgcccaccgactttggtaggagtatgttaggtgggccccttggtcggttcccgtttgtttgacccccacattaggttagtttgagctgacttgtgggcccctcaatccgtgtgcttgcatgtgattcgccggaggtgtgtttccttgcttgccggcctcattttccctttaatttgactatatccatgttaattctctaatcctaatacgactatattatttctgattgatatacttttaggaaatgctaattttcccttgattcattgtcacacctgcagtttccccttttccgtagtttctaattcaccaataaattatctatagaaattactttggctaacctcgagaaaacccaagttaacaatgtatttaataatctaatttgtcagggagaattattttttgaattctcttttctctaaaatcattaacaggatattcacagcaccagaaccaatgttgttaatttaacttgtcaagatttgaagtaataataatctttatcttacgcttttggtcatgagtcatgcccgattcactcccctcttcgtccgcggtttcattttgcatgatgagttgggtcctatttcgttcgcgggttccgtttccgttcctttcctaaaactccttatcctattttccctattcctatttttcctccccctctcctcctcccactcggccgccgctccccctctcccatgccgcgtgccgcccttcccatcggagtctgagtcggcctcctcctctccccactctgctgactcccctctggccccatctcctttagtttttcccctctcctatttaagttagaacccacctcccccgctattttcctatttgttttattttagccttagacctagctagccgctgccgccgactagccctagcgccgtgtcgccaccgaccgctgctctgccaccgctggccgctgccgccgcctcccgccgttgccgtcgtcgccctagcgtcgccggtaatatgtttttcctctccgtgtcatagctattgccataatctttccggttctaatttgtttccgtcctaggttttgatctaacgtcgctgccgtctccgtgtgttgccgtcggactgtcgtcgctgtctcctcctcgccgatagtctcggttttgtgaggaacctatccgtaatctcccgtttagggtgttaattctttttagtggcggcgttgaaaccctagtagtttagccgtcaaaaccctagcctagtgccgccgccgccgctctgtgtcctagccggccgagccttagccgctgccgtcttgcctagctgccgccgctgccgcctgtgccggccgagtcgtgccctagccggcgccgctctgtgccgccgccgtcggcaccgagccaccgccgctctcccgcgtggtcatcatggtttgccactgtgctgtagctcggtagccgagttgcaatcgaaatcggtacataacaactgtcaacacatttacttttgtgtaattcacattcatagacactatttgagcactcatcaccttaggattgcaaaacttaatataatttcttagtttgtcttatccttcaccaagcctagcaacttgggttagttttgattagatgttatttatttttaatatcgcctattaacccccctagtcgacatctcgatcatatacccatgtggcaatgaaagaggggaagtggattggattggtccgccattttctgagggatggtactaacctggatctagagggaatattatttttcatggatcatctgtaacaaccctctctctaggaccatgtagcccagcccaactgacgggcgggccacttacacataccactccacatacacttttgtccttgctttgtgtaaaagggtcaacccggaattgatatcatcggagagaacagaccttatcagttgattccacccttgctaaactagcaaggtactaaacatgcgcaaacagctctcatggactacatagtccccatcctaattgggtcaggatgtcacatcatcccatatcacccgtccccaaactaaataccttgaaaaatgggtttgcccccaacctgacacatcccatcctcccaaccaaacacatgctaaatagtgaataacactcatggcaaaccagaaagaaaacgacctgcacagatccagtcttctatatcctgccgtcttcttcctcgcacacacatgcatggcaaaaacacgagcactggtaggtcagcaaacactagatggaactcagcaagtccaaaaccaactgacaaaagtttctaaaaactacaaaatagaattttggcagcgaggtgattctgttttcaaatgtcccgacggcaacaaagacactatggcgatagcgacagtggtggtactaaacgtgacaagaactcaaaaccctaaacgactacacgctaagactaacaacatgacacaatgatgcaacacaaaactaaacaaagcaaaaactgaaaagaacaattcttttgttttcttgtatagccattttctggttataggtaaagctcttgataccacttgataaaccctgagctccactcgagacactcacggcttcgattggcccgatctttcggtgagttgatgataactacgatttgggagaaacgttaacgacccaactacaaccatatgagacgttgttcttgatgcatctctccgtgggttgttgaacatgcaatacagatcaaccttattcctacaagcaaattgaagaaacaagtaagaacaagataaaaacaatatgaaatgtaaatagcagttgaataaaaatgataagttggaattccgtaactgaaaaatgacgatctgttaaactttagtttaaacaaaacccgagaaaccctgaaggggtacctagctatttaagggcatgggagttgtttgtatttcttatgataatagataaatctgcaagcgcacggaataccgttgtagcacttcaccttcgagtgaccccaaaagaatattgaactcagggaacatgtgtaatttccctaaggctaagactatccaagggcaacaacttaaggtaggcaggctagagaggactttctatgtgtcttaattatctaagctaagcaaaggtcatttcatatctattacttcgggcaccaatccctgctggtctgccagcgtggttccggctatagctctatgatgtatccgaacgtggaggattactaggccgggattcagggctgtcaccacctgccgcctacctatgacaaatccgtgggatacacaacaaataaaggtaacctttaacctagacaccacgtctaagttattaataattactctaatacttgtacaggaacttccttctttatccatagtcctagtactagagcacttagtataaatactagacaatgaacccgcaaagatgaaaatctatcttacttaaacaaagtaattaaataacataagaaaggaacatgaatgcttactttatagaagatgttctccgaacccggagcagagtatacaaacagctccggtactcctccagaattcctcctaggaagctacactcgtcgagatagaagtcggatgagggccaaacttccgggcactcctccagagcttcccctcactctctacctaattctaatgtacaaaagatacaatagagcctcttataattcagctcaaagttgtgttttggaaatgagagtgaaatcctccttatataggctccaaatgacggttaggggcttgggaaatgaccaaaagaccctgcaaccgccttaggggagaaatccgagccgtccacgtgaagccagatggcgggaggcgccatgattggttcggccgaattggcggttcgaccgaaccaaaaaactgtcctcctgacctctcctttggccggtaggttgcttaatgggcccccaacatcttgcacattgttttggcccaattctaagtggttttggtttatatatgggccctccaattcatgtaaacgcatcctgaattcgcggaggtgcattttatcgcatgacggatgtgttttctcctcaaattacctacatacacatatttcaccaacactagtagaaatgattagtaataaaccctaccactatgttggattccatattttatttcattatatgcaagtattgatggtcaaatattatgatttaaggaccgtcaacaggaggacgactaaggattctcttgggtcgtgctccactaggttgggactgttgacagctattaagtatcaaattctcgccgtcaatacctgcacaaaactgaatgtgtaaaacgtcttacataagtggttgggtatatttctaacaatttccacaagtgttgctgtatatttggatgcaggtgacaaactaccaaagttgtgaagaaatatacataaagaaggaggagaatcaaacctatattcaaacctatagtgttttggacccaaaaacctaatgaaacacctccaaatgagcccaaccactatgccaatggactgagggcccaccagagaatgtccaggagaatgggatgggcagtggcgtagttgtgggggtgccggagggggccaacaccctcctatccgaacaccaccaccacatccccctgtttttactctatattgaggttaactaagataggtatttatctagtttatttgtgcagcttagaattattattagtttagttagttagcaagcctaaaaaacattagaatgaaacatgatctacaaaattagtctgtgatttctcatttttttcaaagtaaaatagaagatacttatttgtgagattatttattagtttacattaaaaggatatagcaataaagactagttccaaactttcaatgatattattaaagagctaaaattcagttttttaaaggactagtttacgcattgattgttattagcagtgactaattgaccacccttgtcatctgttgacggtcgttacagtcaaatttcgactgtcaatatgactaaaatagtggagaattagctatgcttacaatgcatatttgttttcaaataatatagtttcacttgtacttggagaataacatgttgcaagaatttatcaaataaaataaagagaaagtggagaaaacctcactcctaagcaagcaaatggataaggaggcctccgccatgagggcccacctatcagccaccctgtcgaagcttgaggcctgctgggccggcccaggttcggcggcgcccagtctggttagctctccacgtggacatccaggattgcttctcaatgacggttgtgagggtaaaatggacatttcacatgccattaaccgccataccacccctataaaaggaggagctcattcactctcgcaacacattcaagcaagctcaaattcctcttcatactttagtattagtatcttagtgctaagtggagtagaatagaattttggtatggctctagcagctcttgtgttctcttctgtaatactttctatattaatgaaatactcttctttatatatcttcggtactttgtttagtctgagtattgttcttactttatatttgtgtcgtaccaattctatgggtagtgtaccagagaggtgcaatcatgcgggtttaatgtttaatatatcagttgctctatgtcatgttcacgggtgtagagtagtattttgtaatgtaagcacggcgcttagattattaaatatcattaattgggcatatatgctgcgggagagtagaggtgggccgctgatggtgacagctcattacggatattcctccatgtcagtatatattcctaagacaaattcctggggtgtgtactcctccgtatttagccccggttggacggctatgacaggttgtcgtaaggaactcggcaacccggggtggtctctcgatgtacaaggagggcactgttagggggtattggccacatgattgtatactagcagatgtaaactaggatttgagtgtatattagaagtataggaattgagtgctttctaattcttcttccacttagttagaattactccattacgaggatttgattagctttgcttcatgtcactctaccctacattaaacttaacccctgcttagactttgactattacaagtaatgtatgtataaggtgcactagcaaaggtcactcttattatcttccgttgggattaaaaatacggtcttggaatacttccgggtgaaatactccaatggtaaattcgtgcgcttgcagatttcttctgtaaccataaatatatatatatatatatatatatatatatatatatatagtggatctagaaaagttttggtccttgtttagatataatgatctggatttataaaatataaattgtatctttataattagatttaatccaaatcatgatctcataccggtcagcaaaccgaactgttttgttcctgccaacacacatgggatatagtttgggtctggaaacatggacacaaaataaatgaaagatcatttcagcaactatttaattggaaaaaggaatcaaaatcatccctttcaaatcaaaatatggaaaagtccaaattccttccttatgtctcttctctgtttctggcatctttcctttctccgttaaagtcaagtttgcgtcctcttttcatcgggtctaggaaaatagtcctagcagaagtcaatttatctccctgtcgttacactacatctttcttttctccgttaaagtcaagtttgcgtcctcttttcatcgggtctaggaaaatagtcccagccgaagtcaatttatctccctgtcgttacagtagcttcgtcaagctctagcagagacagtggcctacacccgacgccaccccaatcctgtgcccgattcaaccaaacccgtggagataatctcaaattagttgagcgcttttgatctatatctcctaccctatcttttccctcaagaaattgaaggaaataccatggaagtcgctcccgtatcgaggtcgaagtcgagtttacctctctagcgaaccctagttttatctctctggcaaacttgagtcggattcaaccaaattagcacctcgacggacaaaaatgccaacaaaagagaggtgatgaacggaaagttaccaattttttaattagttaacacaatattggtgcttcatatataataggaaaatgttcagagtggggtggtggaaaattcaccgtacaccaccaccacttattttatagtaaagcatggatgtttttccaatgcatccatccccgcgatcatgacaccacactcttaattagatcagcatacgggagtttactattttggtatctgcctatcgcaatggcacaaccaaacttcccaaaacattaacattgaaattcacaaaacctagataaatttcgaaaaaaaaaccttcattttgtctaaaaatgtatcagaaaaaacaaagtagtaagaaaataaagtcagaaaaaatcgagaacaaataaaatccaaggcaatttagtaaatccctgaatgattctcaagaaaacataaaagctaagaaaatcccttatctcactacaagaatataggtgtttcgtgaaggtgcttaaaaaatatagaccagcttgcaaccaatcccgtctcagtaaattcctattgaaagtatatccgcaactgggtgaggatttcaatgaattcgtgcttttgctggtggtcaataatttttatttagaagtcttcgaaattgctaaaaaataaagagggaaaaattcaacccaacattgcagaccatgtgttgcccatgtgaacatttgtgtttatccaaaactaaaatgcattagcacattagttatcttacaatcatcatgcataagtagtatttacaatgttaaaccctgaaactagctacccatcgacagctgccagaattattgaaattcaaattaatttacaggtcaaagcaagcatgcgttcagtatatatacatagttggcggtactttcaatcttacttgtagtagcaaactaacgacgtatccaagcagcgcagagtcttacttaacaatagtatcccgtcccatagtatccgtacgcagttccagccaagttggcggcaccgagtgccggcggcggccgagcagcggcgactgctgcggccgcctcggcttccatacgcgctatgtccgactgcgtcctctccttgaacttcctgatgaacgtgtcggcgcgttcgtccaccttgccgtcctccccatcgtcaggcgccacgagcaccttcctgcgggtgaccgcaggctcgacggagcgtgcggacaccgccgtaggccatgcccgggccgtcacagcggctggcggcggctgtggtggtctggccggcgccggagctgcagactgcatggacgacggtgcggcacgcggagtgatcttggataggaggtaggaggaggaggccatgatcaagttggccgtgatgatggtcgatgactccaagagtgaggagttattccggcgacgtgacggtggcatgcttaattagctagacgcgccttgtagagggtggaactggtgttggaatacgattcttcacggtagtacaggcgacaatggtgctatttatatgcgagaattaatggagaattgccatctgtttggagtgtttgtcactctacgttgtaatatttaggttgctatagtaaatatcttcgacatgtggtggtccttccacgaagacatgttcccttggacccatgcctataatatgttgtccttatcttaactgagttgtagcagtgagctttttaggcgatcgatctcatcttgattttcactacgctaaactctaggtgcgttatatatcctcaggtgatccatggtttaccaaaccagtccatatattctgcaacatgagggggtcactgctatagaaaacagcatcatagccgtttagaaaacatcatgccttgaaccgtcagcaatactgagcattattgccaattcattttcgatttggcaggagcttgtttgaattggcagtaatattccatcactatctgttcacgttaaactgacagtgataagtcagcagtgatacatgtctatgtagtactggttgctgatcgtggcagaaaaagaccatctccatcgagtcaatagtcaagtacatttattatttaatttggaaagactaacttgtacatgcaaattcatttttgtcgaaaacatatcacatgacctctctctatattggtttttctctatagaatgctcattttcagtttaactctaaattaatcaacgaaatttcgctcgcttagctcgttactgacagcatattgatttggttataccttgggtatttaattaattatacttttgattgtaatatgcatggatgcatccaacttctattattaataggaaaaccatgttcttcttttcggatgtaattagccatacgtaacctttgaaacaaatcattgtcccgaagaaacggcaccaaaactttctcttcaaaaatctggtttacaagtggcatggtgggagaataggatcagatacgaccaaaggaacaacgttacgattgcttttcagataagatggccaaaggggtgatctgtccagctatttgttggagtgtcgcacatgtattcctgacaggacacactcgtcatgcttttcagataagagcatacgcagtgttgcacttagaggaggcattagaagagagagaaaaggatagaccacacactgtgatatgttttttagccggtctcaagcaagagctgggtactagtcataggtcccgattctactggaaagagcacatgacatggcccacgcgtcagacaaattgtgtctttggcctgtatgtaggagagagattatgacttttctttatcttattttaatttatgtgaggcccacaataagtacctttgccaactttatacactgcatcagttctcacgaggtgctatatctgacatgggtcccacctttagtatcgatgcatgcatgacacactacacatgctctaacgtcgtcttattgagtacagtcttctgcgcgttactccaatgctgcacttatcttaattgcctctctaattcaaaatataaggtgtttttttttgtttcgttcggataatctttgaaaaaaatgcttcaataatatatcatttttatgacaaaaaagtatatcataagaaaatacttttggattaaaatccattaaattcagctttcactgctgtgaagcatcttattagtaccggcaagtccgtaccagttactccctctattccataatataaggcatagtcaaacttgatacggtcttcaaaactaatcttagtcttataattcttatatattacaaggtttatagtaacaaaattataaccatatgaaagtaaattcaaatgttaatccaatgatataatttttaacaagtaaaaattcaattcatattattcatattatactaaatgttggtcaaaatattttgaaggttaaatcttgaaatttgtgagcgccttacgttatgggatggagggagtagtagaaaaactagcactaatatgggatttcccaccctccgagcccctacgcatctcagaagtagaaaaatgacattgttcgggatcattactgacattgtttaataaacagcattgatgtatttagtacttcctccatctgaaaatataatattttttttcctacagaatttgtcccaaatataacttcttctccaccaatattctcttatcaatcaatcgcaaccctataccattcaaaattcccaccaacctccacttctcaaccaatcataatcttctaccgtttaattttacctacttttttataaccgtgttcaattctaaaactccttatatcctggaactgaggtagtatcaattccctacatgaccgacatagaaaggtaactattagtgtcagtttttgggcaaaccgacacaaaagagctggtcgaaggaggtgagtcaagcatattggcagagcgaaataaagatttaagtgccctcccatccgcatcgactcccctcctcttccaggctcacactctaggattgcctcgcccttctcgccccactgtgcgtgcctcccccttctctcctcttacttctggttttgccccctcatcagctagtgaggaggctgggatgctagatctagcgactctagcctccccaccggtggatccgtctagccaaactgagggcgcaagccgatcaccactcggatgccttcgacgctcatcactaggctacctccctatc

SEQ ID NO: 29419 - DNA, 13844 bp, Oryza sativa
aactgcttttgatttggaggagatgttgcaccatgctgaacctgaagttgtggctggctctgctcgtggtttggataatttcaatgcattacaaaaggcatcaaaggaacttttctacgatgacgcaaagggttgtggaaaggatttcacattgttgcgtacggtgcttgaacttctgagattgaagtctagaaacaatttgtccgatagtagtttcaacgatttgttggttctactaaaagaattgttgccgaagcccaactcaatgccaaccagcacctatgaagcgaagaagcttatatgcctgttgtcattgggtgtgcaaaagatacacgcgtgtgttaaccactgtatcctgttccgtaaagagtacgaggatttggacagctgcccaacatgcaagagtagtcgatacaaaacaagccgtagccagtccgagggtcaggatgttgtccttgacaatcttgaagagtccgatccatgcaaagacagcaacaaaaagaagattccccagctggtcatgtagtaccttccggtgaaagatcatttgaagcgtttgttctcgaacccgaggaatgccgaattgatgcgctggcatcatgaaaagcgaaaaaaggatgggatgattcgtcatcctgcagatgcaagacagtggaaggaatttgacacaaagtaccataagtttgcagaggacccaagaaacgtaaggtttgcattgagtatcgatggaatgaatccattcggtgacttgagcagctcacacagtacgtggccagtactcctaaccatgtacaacctctcaacgtggctgtgtcagaaaaggaagtatattttgttgaccatccttgtacaaggaccacgacaacctggcaatgacatggatgtgtttttggagcctttgctggaggatatgcgcgatttgtggaaacacgggatctgagtttgggacgaattccttcgggagtacttcacgctacatgcaattatctttgtcaccgtgaaagactttcccgcactgttttacctattggggcagatcaaggggaagacaggttgtgttatttgtgtggatggtactgtgtacaggtatcttaagggatcgaagaagctagtgtacatgcggcaccggcgtttcttaagaaagaaacacccgtaccgctccaaagcagaatatttcgacggtactgttgaggaaggtgatgcaccagaaccatggaagggtgataaagtgttcagaatgaccaaaaacctgaaggttgtttttgggaaggtaaaaaagaaggaaatgaataagcggaagagaaatgatgccgaagtgccagtaagctctagcatgccattcaagaagcattccattttctttaagtacctttcgtactggaaagatttagacatacgccattccattgatgtcatgcacctagagaaaaatgtcttcgatagcaccattgggactatactggacataccaactaagagcaaggataggctgaaatcacgtaaggacctcgtggatatgcagataacgataaagcttcatcctgtggatgaaggtaataatggaaaagtgtaccttccgcctgcttgctacaccttgacaagagcgaagaaaatggattgtgcaaatccctacatggggtgagagtgcctactggcttctcctcaaacattaagcgaccagtgtcgatgaaggatctgtcgctttcgagctacaattcccatgactgtcatgtaatgctcacagtattccttgccattgcaattagagcagtcgaaccagttcacgtaaagctggtcatcacaaagctgtgctatttcttcaattccatatctcagaaagtaattgatcctgaagagttaggtcctctccgggctttcgctatacagacagtgtgcgaccttgagatgtgtttccctccatcatttttcgatatgatgcaacacctcatagttcatatcgtgcctcagataattgcacttgggcccctttacctgcatcagatgtggccttttgaacgatacatgtccattctaaaaagctacgtatggaaccgcgcccacccagagggatccatgatagagggatacacaaccgaggaggtcgttgagtgttgcattgattacctaaaatatgggaaagcaattggtttaccggtacctcgacatgaaggtagattatctaggaaaggaacaaaagggaagaaaagaatccacgacaatgactacaaaaaagtgaaagatgctcatttcactgtactgcagcaactcgcattagtggagccgtacataagcaacacctgcaggaattacaagcaacaaatgtgggtcgatctaatagatggatcatgaagaaacacaagcatcactttactgaatggttcaaggacctcgatctaccagatggccataccatggaagaaagaataattaaaatgctagttgacgggccatcaagtgtgtacacctcatggcaagcatatcatctgaatggatacacgttttacacaaaagcgaaagacaaaaggagtgcatgccaaaatagtggcgttcaagtagaagcaatcgacacaactgggcaaaagagcacatactatggattcatagaagaaatctgcgaactaaactacgggccaaatatgtagattccactgtttcggtgccaatgggtgaaacacccagccggcatgtctgtggacaactttgggctgacaattttcgacttcgacaacgtaggccacaaggaagacccatgggtgcttgccgatcgggtcgctcaagttttctatgtgacagacccatctaatttgaagaaagacatagttatttcgggaaaacaaagtattttgggagttgatgatgtcgaagatatcgaggcatacaatcaatatgagaacatgatactatttacagattttcgaaacaagatactacgcgtcgaagaatcaattggcgaatcgccgaagccatacatgagaaatgaaggtgtagggagatatgtgaaaggctaattcatgtgaactgatggatgatgaatatttatgtatgaagtgtgacatgcatgatgatggataatgatgaatattatttaagtattaatatgtgacatgatgaatatttaagtattaatatgtgacatgatgaatatttaagtattaattttatattttttattcaaacaatttaataaattattaattcttttcctatcattatgattcaaacaatttattaaatatttttatggatgttgaattatttatgttgtgtaaattttatttacatatatctgcattaaaaaaagaaaagaattaaaatcattaaacaattttcgctggcaggccaataagaacacttctagcagaaatcattttcgctggcggtgagattaggtggccggccagtgaaaaaccatcgcctataagtacgcaaacgaccccaaaattttctaagtacggcgaaggcgcgaaaaccctagcgccgctaggctgcccaaattttgtgcgccagcgaaaaaccctagcgcctcctccgccaaccgccgctgcctcctccaccgcctactccgccgaccgcctcctccgccaacctcgtcctccaccgaccgccgccacctcctccagcgcctactccgccgaccgcctcctccgtcgaccgcgtcctccgccgaccgccgccgcctcctccgccgcctactccgctgaccgccgcctactctgccgaccgccgccgcctcctccgccgaccaccgcctactccgctgaccgccgcctcctccacaccgcctactccgccgaccgcctcctccgccgaccgtgtcctccgccaaccgccgccgcctcctccgtcgcctactcagccgaccgcctactccgctgaccgccgcgtcctccgacgactgccgcagcctcctcatccgtcgacctctgccgcatcgtcgctggtgagcatatgatgaatgcctgggatatttgatatgcatggtttgatgaatggttgatgaaatgcctgggatgatatttgatgaatgtttgatgaaatgcctgggatatttgggttaattctgaatttttcagtacaaacagtacatatccccatttagcaaattctgaatttgtgataaacagtacatatcccttttttcctcttcaataacagacaaacactttgatcgttaatttgcagggcagctcaaaacacactaacacatattcttcttttttcagtgaacactgctcttcttattataaaaactgaaagttctgaatttaatctgaaactcaagtgcaaatgtgatttaaatgctgaaatatgctgtagagaaaactgaaaactgaaatctgagatatcttcattaattgagtttaggttctctgatctgaattagtaatactgaatatagttctaaatctgagttagtaatactgaatatagttatacaccttttttaaagctatggaaaaacacaatgaagcacaacccgcgggtgacaagtccaatgaaactgaacttatcggcttgcaagtaatcgcggaagaattgtcgtcatcaagctccggtgaagcagggagtgactcttatcactcaccgagtgaccctcatccttctcctccaagaaagaataagggcggtggtgaggacgacgaggttgactcggattacattccccctgagccggtggtacgtaacatattttgtttatccaaatctaattgtgagtgcggattttaaccgatgacacgtcagatacaattacagaagaatgctccacgccgctcaaaaaggaaagcgcaagccgcacctatagaaagggaaccaactgtggaagccgcatctgccgtgcgcccaacagcttctcgtaaacccaaaaaaagaagaggcgagcgaggcaaaaacgtgctgtcaaaagaagtccacgcccttacgcggatcggtgagaaaggggaacccctatcgcctgaagatgtatgttccaagtatagcaaccaatgtggggcaatagtaagggataacgtggagatcacatttaaagattggaagaaagttaacccagctaaaaagaacacgtgttggacggagctgaaaagtaagttttcttttccagaagggacagacgaagaagcagcgaaggatttcgcgctaaagactatgggcaagttatggcgaaactggaaaacggatctgaacacgaaatatgttcaaaaggatcgccaaccttttaatgactatggaaagataacaaaggcctagtgggaagaattcgtggccttgaagacatcagcggaagaaaaagagaagagccagaaaatgttagaactggcaagaaaaaacatctatcctcatcatttgggatcggccggttaccgtcctaaagccaagaaatggagaaaagaagaagaagaattaaaaaaggcaggcaaaccaattcctatggaatatcataacgaacgagccaggaactgggtgcatgcaagaaccccatcttttaactcgaagggcgatgtagtcttcaaagatccaaagctccagcaggtagccaacaagatgaaggagatcgtcacacaacagaaggatgggatattcgtgccagacagagaagtggaccaactgtcagttgctttgggaacctcggagcacggaggccgcgttcgaggagtctcctcaaaggctagttggaaggatggcttcaaagaagatgctgctagctacaagaaacgtgatcgatataaggaggagttagtggctagctgtagggcagcaacattgcaagaatgcataagattttttaaccgaaacccggaacttcagcaacgcgttgataggatgcaagatgcgtttcctatgcccgatgtccctagctatccagtcgatgatataaaggaagatactccttgcagactgcttattccggttagaaggacaggaaagacaattcaggttgcaactggaagggcaatgccagggcgcagatttcattgccaagatataccagatgactatgccaaggtagaggtgcggacggtaaatgaggatcacaggatgtacgagatagactttccaacacccgaggatatcgtgtaccttggagatgcagttgaccagataatactatggcacaaaaaggatattcaattaggatcaacggattctccgccaaggatactgcggtcactatgtcatgccttgcgtaacatggacgaagaaccgggggatcctccagaagatgcatcacctcggcatcaacctgaaaagcaagccgatcagcctgaaaaacaagcagatgaaccagagcttgcaaagcaatccaatcagcctgaaaagcacgcagattaaccagagcttgcacatccaatgcctgagcaactagagcctgagcagccaatgcttgataaagcagagcttgaaagggaagaagaggttgtacaagaaagggaaaaggaggttgtacaagagagggaagaagaggctgtagaagagcacaaagaaaaaagtgcgcccaagaaaaagtttgtggtaaaggcattcccaggaaggaagagagatatcaaggggaaagcaaaggatgtttatgataaaaggaaagcaaaaggcctgaaaataagcttggataaaactttgagttttattcctactgttgatgtgccagaactatttgagaatggcaaagcattcctccccacatgggaattagaagaaggaccttggcaattaaaaaggtggcatgaatggtacatgaaagcaagtagaataaaaggcctttcatcatttacagttgccgtttcagaggaggttttcatgagcggaccatgtctactacatgttagttttaaggatatgcatgttctctaccgtaggcaaagactcgatgccaatttggtcgccatttggtgtctgtaagtgcacgagtactagctaaattgatgatagtacctatgcattatagtactaactaattcgatcatccatttttttgaaggatgaattacgtcatagcagaacagatgcgtgagactgtcggcttcctagacccttgccttataagtaagccgaaccacaccttcacgctagatgagaagagggtaccggcacatgttgcggccatgactcccgaagagagagatgcatacctgacagaaaggcatcaagctaaaattcgcgatgtggctacttacgtagctatagcacttgaatcaatgcagggcaaagaatgcatctacgccccatacgcctttgagtaagttttcgtatctaatatctactacgagtatatacttaatcgcggctcgactaaggatttttttttttttgcagcgaccactggattacttttcttctatatccaaagtataacgaagttatagtcttggattctcttgataaagacatacaatcatatcaggaaatcctcagaatcttcgatctgtaagttatatatatatggatgattgttttattctcatgacaacatgttgttagctttgatgaatctaaattaattgttttcttcaagcagtgcatataaaaggtattaccaggtaggcggacaacggcgaaacgacagagatcaaatatacatccgcaataagtggccggtaattaattttggacgacatacaactacttaattttttataaatgcacgtgtatatccatttataattaactaatataccttatattgatgtcaaaagtgtccaagcaaccgaagggaagcgtactatgtggatattatacttgcgagttccttaggatcaatggtcaatattgcaaaaattatggagatgcaagtagatgccatcaatacgtttgttaaattaattgctaactttgaattgctaacaagttctgttgccattatctcgatgcagcttctaaaattccccaagagtgatagggagctggatgataaatccattcagaatatacaacgagacttgtgctatttcattcacaatgaatgttgtcaccagcttgggaggttttttgataaagaagggcttttgggcttgccagaaaacgatattctttctaactggagcaagcatgcaatttaaattcaacgtcaatatcattagtcgacttttaagactagcagtagtgggatatagtagtagttagcacatagctgattttgctgtttatatatgtgaaaatgtccaggtctgcaggtgatggagaagaaggtggtgaagtctgaaatctgaaatctgaaatctgaatttacttttgaatctgaaatctggatggtggtacctcctgctatttttgttgctgctgctattctgatctgaaaatagatattgaaatgcagcacatgtatgtttcagacaatatattaaaattgagatgaactatgctgctgcttctgctgattgcgattgaactgattcaggtgaatgctagctttatatatatagggacattttattttgtaactgaaactgatctgcaagatgaaaaatgatgtgatgatgtcccagctgtatatatgtgatgtatggctaaatatatgtgaagagctgtaggactgaatatgaatacgagctatgaatctaagtctgaatctgaatttagtgcagttgcagtactgaaccattgcagatgggattttccaggagatgagctgtttgctggattttcaggaattggtacattcaggattctgtgctgcaatttttgaatttactctctgaaatggatatgttctgttcagaaatatatgcacataagttaataaatgggtagatgcagaaatatatatacttgtcctgaaatttatatgttatgttctgaaaattgtatacatatgctgatctgaaactgatcaagtgcaaatgtaatttaaattatatatattctgaaatctgtcctagtatatgttttggagagctgtgggtgaattctgaaatcagacctagtatactacctgtgggtgaattctgaatttgagcacaaaaagatgtactgtattctgctatttttctgaaatctgaaattatatagccaaatagtgtaagttttcactggcgggccacgtgtcaataaatggctggcgagaagtttaccctggcggcccacgtgtcaacacacagatggcgggcagttttctctggcggcccatgtgtcagcaaacgactgactgaacgcatctttgctggcggctgtccttagtcagacgctagtgaagcaagttttctctggcggttagtactagcgagccgctagcgaagaaagttttcgcttgcggctagctttagcgaaccgccagagaagagattttcgctgacggctccattgagaaagccgctagcgaaaatagatcttctctagcggctggactccgccagagaaaactatacatcttcactggcctctactctctggcggctcctagtaccgccagcgaaaacctgttttagccgccacaaaaaacgtatttcgtagtagtgtgtgcgcgtgtggcctcctcttcgccccactccgattgtggatgacgacagccatgctagaggaggtggatcaggtgacacgagattgatttgcgaaccagtgagttccgagcccaagatgagttgttgatatgtgaactagtgatttcttttactgatgagtatttgatccgtgtgttaatattgcggatcaatatatgttccattacggttgatgcagggttatttaggggttagtatttggggtttttctttgctgtatttcaagcagctgatcacttgattgaattaaaacgtctcgacgcgttttttagggcttgtgaacctcttcatttccggaccaaatatctgccacttatgaggacgacggatcatcaacaccggaaatccagtgccgattggagacctaagagcacccgcaatggtaaagtaaggtgctatctataaaacatgtacatctcagcaatatactagattaatagtaaaccacttcaatggtatgtctacatgggtatctatagctctataatccattgcctcgtttttctctatagactatctctaggttagtagatagctttgctctctctctctcttcatttaatctcttccaagtagaaaaatatgctgacatgaatctcttgtagagagcctatagataatcattgcgggtggcctaataacaccgatatcctgccatgctggccagagtagaggatctgaagtggtagtgtttacatgataaaaacttgttttttaatatacgacgttactttttagatacgtttgaccattcatcttgttaaagagaattatgtacttatcatttcttttgttttgactaaatttatcgtcagcattacttaaaatttctaatatctgcaaaaaaaaagatgaatggtaaaaaaataaatggcatcatgtatttagaaaacgatgatagtattacagtacaccaattattggtcatgttcagaacggagtgattgttcaaatacaaaatcatcactggcacgtgcaggccattggttatttaattaagttcacaagttctgttcccacctccgttataaatacaaacaaaagttgtgtagaattaattgcgtgaaaagcacatatgtatgttcggtaaagttccattaagttactcgctaaaattcaaacataataaattaacacgataagaaagcaacaacgagattaattagttgtacacgtagccgcgcaagtgtgttcttcaagctagtagacaaggttcgcttttctatctggtaagatgacaaaccaaacaagcacatcatgcataccgtcgctataactactaaaattaagctttagacatatctatcgcgtcgtgtccccttcttccactagagtctacgatggtattctaagccttcttacattttgctttcttgcttcatacggcctagcttctattgttccattgatcataggtggtatcatatatagaataatggacgattggccgtatcttgctttctaatgtggtacaggttggtgggtatattttataggattgaaacacaagaaaagtctgccaaagaaaatgtttggcagtaacatcaaaaactattttttttagaataaaaggaaaccctcaaacctcgatgactctcaaaccctcacatctgcccgttggtctgagcaccacctcctcatcgttctgatcgctcttattgctttctatagcctgacaacgctggtttgaccgtgccaaaaccaccggtccaaccgtagctcctccgttggtccgatcaacaaaaccgagaaaaacacgaatcaaaaaacttaaaagtagatcaattatattctttctatgtgtgtttataaattacaacaatagtacactaaactcgaaatctagactaaaagcttattttcgtcgagactgtcctctcaccaaagcctcaaatccaacatgtataagtagtcctaattccataggaaacgtacccaaacaagtatcaaatgtatcgttattacaattgaaactctatctttccaaatttggactacttccaaatttaactatgtatcccatatgtacacaatcccacttgtatactatatgaaatctttaccaccatgtgcattgttctttagaatatacataacacgtgatcttctttttgtccggacatcaacttctcccaagtcgactcccgatccatcacagacaacactctctcaaggcctcaagcaacaccacatttggataaacaagaaaccatatcagagcacaagttctttccccaacatgacttaatattaatacacaatagtattacatacgcatagtaatcatgcatgtcgaattcataaacatgaagtaatcacgagaatccaaaagattagctcaaatcagaaccgcccggtcagaccgtcaagtcagtcggtctaaccggtgcccggtctgaccggcattgaccgactcgtctgatcacatatctctataagcaaaacaccattcacagtaaaatcaaaaactttgttcatcgtcaaacctcggtccgaccagaccaatccagagcataaaaccctagcacaacctatgtctggtccaaccggcattacatggccggtctgaccggatatatccaaaggcaaaactgcacttcaccaatattccaccaaatcaaatatgatcaacatttccaattaattacaaaataataatcaaacctttcttttatacatttctacgcctagtactaattagatcaataacatttttagttctttgaacagttttacgcataattattatcgtgttaatgcttttgttaactacattggatcttagcatggatatgtgcgaacttcaagcatatatatatatatatatgtcatgtggttacccgcgtgttgcaacggaaaaatttagaaatacctacaaagaacatgatgaacataatttgtaatatccataaagacaaatttttaagcttgatagtatgtgatataagattatgattttttagacgattatctccacctatatatatatatatagtgcgtgtgccttggtatagactaaaaaacataatctaagatcgatgctttatttcattcccacagtttacgctaaaccgttggcttcgccagggcatccagctgatgagctgaataaaccccatgtcttgcttggcattcactacaccattggtccccatctcaacctttccgagcttcgcattttcatccttctaggcagaaatctgccaggaataccccaagcaccaaaacaccatcagggcgatcggtccatgacattccttatcgtcgggaaaacaaagccaggtactgttggaattgtatacaggatattcgtcgttggtgatttgtactactaccaccatttcaaaatgtaaaacgctgttaatttttcgcacaacgtttgactattcatcttactaaaaaatgtagtataaatatataaaaataatactccctccgggctgataatattagttgttttgaacaagggtacagtcaaactttataatctttgattataaataatttctaaaatatttgtcttaaaaatatgaaaaccagatgtgtagattattcttaaaaagtacttcaacaaaatcatatatttgttgatatttctatatatattataatataaaatagttgtcaaagctactttttggagatcgtgcccttgtcgaaaacgacaagtattatcaactcggagggagtataagttaaggttatactttacttgttgataaagcaagtcacaacaagataaatgatatttatataaaatttttgaataagatcagtagtcaaaaattgtgtaaaaagtcaacgacgtcatacatttcgaaatagagagagtatatcactcgaacagaacacctcatttgtaaagggtggcaacccacatttgtgatgcataaacgtctcgcgagtgattagtagtcactagtgagaaaacctacatgttagaagttaccatccgtcatggaggagtcatcggctacggatcataattacaaacctttatgaatgagaatttacaatttacgaattttaaatgcaaacaaaagaccctaatttattttaacgttaccacggtattccaacattccaaccatggtctcacattactggccacaaattcatgattttcaagtaaaatgtacaggcacaacatagatgtttataggccaagacctctcaatacacacaaaccatctattccatctcacctatagtccacgtgttgataggtttcagatgtcattcttttgactattgcttttcaaacgtgaggcgctaatttgacatactagatgactctaaatgagaattttttctactacaaagttgaatatatcatcgagttctacaacttccata

SEQ ID NO: 29420 - DNA, 8805 bp, Oryza sativa
ggagttccggaatgtctgcattgctgagattccaaaccaccatggaaagggccaattgccaagtatgccgtggttggtttaccggtggaaagggcccggtgggaaagaaagaccagggggaagaagcggggtagaggaattggtcaactcattaggctcaaagcacagactggcatcaaggagtccaaagcatcggttgcttccacttgtttgttgcctctacttctacttggacagctcagcagccctatattcccttgttccagcaagcaaacaaatagaatagttggaacgaatagacaagtaggacagtgttactagctagttaactcagttcattcttgactttcggcttgtagctttgctacgcaacctcgcattcgaaattagtacttgcttggacagcaggtaaagcagggacagtagtatatggtagtcctttcttagggtagggcgacgaatacttcaaattccggaaaggggtcgcgaagctaaagcgaaagttatagaaagcccctcaataatagactcgcacctgggagaaggagtgtttttaatttttaagttctagaccttgttgagatctacaactttcatatagagcatgtctctatccgagttatttgtgaaattcaaaaatttaaaatttctcccatctgtgacaggtactaccacccatcgtagataacgttatttgtgaagggtaatagttatggcccgtcaccgatgagtgctttcattttttatgggccttctcattacaaccgtcacagatgatttgttatatgtgacggggcatgtttatgacccgttataggtcatatgtgacgtgttacaactatgatccatcacagatgaccttatattagtgatggatcatccccagtagcaatatcttaaataggatacattttgaccaatttgagatgacttctaatttttctcattagtccatcgcacatggctcatcacggatgcccggctctacagtagcatatggcatctatgtctgacctaacaaagaggaatcctcaccatttaagcacaactatcggtctcagttagaaaatctattctatacaacactcttccctcccaagaatgaaactcctcccaccaacatccaaaggcacaaacccacttcacactacagttaaaagctggtcaaaatgctcccacgtcggttagaccttggtcaatccgatatacggacagcccacactatcacctctttacagtcttcatttcacataatgtatagagtgacgatatggctatcgccaaaatgaactcatgatggatctactattcttaagcattgcttttctaacatcatggtgcgaatgtgcttgtagcatgatgggacataccatccagtggggagctacccacgaaggatcaaatcctggtcttgccaaaaaaaaaactcacatgctttgaaaatagtacggatcaagaattggcctacgtatattgagccctcttgtaaaaaaaaactcacatgctttgaaaatagtacggatcaagaattggcctacgtatattgagccctcttgtatgtggtatgggagtgagccctcgtgtaggggtacaagcctaaaagcacagattaagtatcaattcatatccgtgtagggggaccgtttcgggtgccttttcttaattgtgaagatgtgatgcgtttaatatgtgtaagtatttgtgaagatgattgaatgttatatgttgaaatatttgtgaagatgcttgcatgtgtaataaattatagatgatattgcttgcataattttaagatgtatattgagttttaggatgtagtgggttataactatataggaggtgtacataccttgggaatggtcttttttctatgggcagaatttattccttccaaatgtttttttaatggcgtctcagaatttagaatgctgtctatatgttggcttcgttttcctctttatcagttctgtttataggttacaaatggatctttattatatgtatcaatataattaaatatcctagagcaatgtgcttggtatcatggtatgataagaaaaccgaataaacttatgaattgtagccttggatgaaaagaccagactcatcccgttggacaacaactacataaaaatagatataacttgtgtggcgattaattagctatatatcctttttcctgaacatggtaattgattctctaccattttgcctgaacacatggcaattaattcgcgctttttttacatctgtggaaatattaccagcacgtacttatcctagaattttagaaataaagattccaaactaactctcctgcttagattcctgtgagtaaagcaagagctctcgaccaaaacaagaggtttacaagcatggcaaaatgcaataagtaaaccttttgggcttgtctccattattggtgcgtggattcggatatccatgaatcaattcgcagaactccatagaaatattgacaccttttgtgacccccgagatttgtatacaagaggcagagatatggaccacacaatcatacaagagtctgtccaaggattgattcttgctatatgttctgcccttttgtgcctaacttgcttgagctaccatccgcagttaatttacatcaccagaataatctcacaataaactgatcatacaacctcttcctagcgcgtgacattagcatgggatataagcgcatgcggcaccttgaatttcttagcaaatacaaatactgatagtcaaacaaacagttaaatgcaacgtaaacagctactgagttacaatttctttttaagaacgtaacacagggtttcaattgttgcaactatatagtttaggcccacgaagttgaataataattcccgaaaaaaatctcgaaggccgacaaatcactactatagaaaacctctaataagtactgactcataggtgctggttcatttaaaattggcatctaatgatcgtgtcccacctttgtggaatgcaaaaatatagaaccagcagatttgagtaactgtagatgccggttctagagaaaaactggcactaatagtactaattttttaaaggataggaacctatagatatttcaaaggtgtcagttaattaaaaaactgacacctataatataacacccataaaaccgagccaagccgagccggtggggtgggattctttttatccccactcctgcaattcaaccgcccttatcctccgacctgcgagataacctttgctactctctccatctcattttctccactaccgtctccacatcccgtctccctccttgctccctctcaactaagtatgccgatcggttgccatgcgcatgacgagcttgaggtgcgcctagcgaacgtggatcccaaggtacgcatggtcagggggcgggtcttcgtcatgatcacaggcggtggggtcgtcgtgccagtgacgggtagcgccgtggacagtagaggtgggatcgggggagccatagcagctggattcatcccattcacggtcgcacgggggctcgcatcgtcggcagcccaacagggttatgaggcatggcagtggcggtaggtgtcccatcgccagccgaggaggcaagatatgggcttaggtcaaaactcctccatttctaacagtggaggagtcgaggcttggcggatggggggtgagtagcagattttggaatactagttgaatgtccacgattttctacggataaaagaaaatacattgtaatatgtccatgctcttctatttcttttttctacaggaaatattcgccttaatttgattttatatgttgatgttcatctagaagcataattgttgacattagcaaccaacttggaaaattgttcttaccttgctttctggaatcacggttcatgaaccaacaccttttacatcaagtgagaaaaacatacataatcttgtgaagaaaatgtccttagttagccccaagcaatccttgaaaagccaaaaattctaaatgtgcaatgctcaaattgaaactataacattggcttcaaacatctctaaacctttggatttaatcagggactgattcatctgaccattgtctaaacgatgtaaaatctgaaagcttcatcttttggattccagaaaagaagtaattatgaaactattttactagattggcccaactcctgatataactagatgataccccgcgcgttgctgcgggatattaagtattgacataggtttaaagggtccgtgcacagattctaaatggaaggatttaacataaaagctgcacagatgtacaccattttcaaagaaatgagttagggtccttgtataataggagcttattaaggatgatgaaccaataagtttaaagaaatgagataaagagaagtctttctcatgtagcgacaacaattgaatggtcacatatacatactttggctggagctactgtaggctatctattgtctaactgaacacagtttatatagaccaaacgcttgtttccaaatgagaagagcaaagctgaaaaataccttatacagctaatatcgatgatatgaagcttattgcccagtcaccaatccctgttttatagatgagtaacctaatatacatacaaattcggggggaagttctgcagattgatcgactgaactgacgttagcaattggctaatcgctctgtaaaaaaaggttattggttcttgcctcctcaaatacataagaatgaaagataaggaaaatcaagaaattttttgagataataatattataatttaaattatgaaatcaattaacatttgtaaagaaaatcccaggagggagggacctgcagagactatacctttcacttacatcattgatcaccatgctgcatatgatggaattatctccaatcacatcatgtgcaaaatcaccgtctgcctggaggatgacattttttttttataatttgtcacctcaaagaataatctatagtcgcataacttgcatatcaaatactgtagttgcttcactggacataatactataaccagtataaaatataaaattcatggacagttgcaaggtaacttaaatgattgaaaaattgagcatagcagaaaatgtatattttggaatcaaatctagtagtatgtaccaaaaaaaaattgtgccaatatacttattattcaacgttgtagggtacttgaatccagaaataaacctacagtcaaatctgagaagaaagtgaagcagggagtgagtaatatgcaaccacaaatactgttgtacggaagaaaagaggtcaggttgggatactaaaatatatgtcgggaactaatagctgaattgccgagaaacaatctgcatcaatcaatatcgattagaaagagatatttacctggaatgctgtattagggatgaaccgggaacaatagggatcagcatgaaggggaacaattaatctcatcgcctagaagatggatccatgaacctgtgtgatcgtatggtgcagcaatacaacaaacaacataatgtgtgtaatatatacaaagaagacaggaagagggaggcgagacaacaaccaaataacgcaggtgacatttattaggagaggaagatggatagacaactgggagccggctaggcctgcgcatgtttcccttgaactggcgcggccgcgcgggtggtatggctcgttccgtcgcttgccctactgccgacgatcccctttatgcgatgcgctgatgctgttggtgggagagagggaggcgatgcggtgcgagcttaggtcacgcggcatgggagagggaccacctgcgggctgcagcactggaaggtcgcgcggcgcaggaggcggaggacgtgctcgttgggattcgatgcggcggaagagcgagcgttgcagtggccgcggccggtgggggaggcggagcgtgatgcgggaggagaggataagatccaggtggacggcacgtgatgcggtgtaggtggaaccgtggaagcgcgatctgggcggacggatcgctcgatttagatccaacggtttggagaaaaaggatgacgtggaggcaccaggaagcagagaattcctagtagtggggatgatttgtataggtatataggattagctagtaaagaagaaaaccaaatgaacatcgatctagaaagtgatatggaaagaacctaactctcatagcctcttaagatgatgtctcaccacattgtgtcaggaatcgactaacatgctcaactattaaaatattctcttgtcttgaaaactttgagaaattgggtgcctgtatcggtttggtaatggaaccctgtcaaaccaatcaaaatatggttaccgatacatgtatgtatgtttttcttaggcttaagtccaaactgttcccgtataatttcagctattttgtctgcccactcctcatttctatacccacatattgatgttgtgttggctgctgctcatgttgattcttctacggttgatattgtctttcaccatgttgatattcacattgaccctctagccgatactgatgtggttctggtggtcattcttgccaatattgatgagacgatccccgctgataacgattgttttgattagattgctcatgatattgttgttgctgaggttgttgctgttggtgttgcccccccatactaggcaactttatgatacccaatagacacctttggaatatggatcttgctaggtgtccatgggccttcatccttagctatatcataagtaggttcctgaaactctgttttcatagccttataataaggagggtatttacagacgtcataggtttctctcgaacagtagatccattaacaacccttatgatcaaattttgtaatatattcactaaactccagattaattgattaaagctcgatttacagcatcatgtactgtatctaccctataattcaccaactcactcttacacctacattactcattcatcaaatccaatgttccaaatcatctatatacaaacgaacgacctagatcatcccacgccgaaccctctcccgatatcgcgcgtggatcgctgtttcctcccccaaaatcgcgcgccctcctctcaaaaaaaatcgcgcgcccccatctttttcctctcgcaaacgtcaccgcgcttatgccgccattcatcgccgattccttcgcctccacatgaaggggtagccgattcctctgccccaaatccaggtcgccgaacccctgtccccagctcgtcgtcactgattccccctctcacatcaccgggaccaccaccgcgtttggtcggcgccgatccccatctcgagccgccactaatcgccgcccatctcgaagaccacatcaccgcctgatcctgcttcctcgccgtcgacctccgctcgtcgttcacggccacaccactgcccacgatcatctccgagtcaccacgcggcgcgcaaccgtcacgttccatcgctgccgcccccgtcatcaattatgcctccgccaacgcctccatccgcggctccacgctcaagtcgatgccgtcaaccccaccgatgaggtattgacgtcatctactcaaccgctgcttcacatatgtaagttgcaaacaggtctctgaaaatcctcatgatctgttaattgcatgtacatatgcattaggcaataggtttggttatggatatataaagcttcagtgaacagtcaaggtggagattttgcgtcttcagtgaacatgattttggatgctctataattttcttgtattttttttgtcaactgaactgtacagatctatataattccagcaaattttctcaaacatgattcacatgcttcttattcctgcaaattttgttcttctacttcttttcctcttgcatatgtcaacataatggagtgactaacttttgggtattcttgccttttgatttgcagacacttcacataaatcaactgtgcatagacatatcccagaagaatggagtgactaaataaaattttggttgctccaagcatctctgaaagaacttgttaccctgtatagaattaagtgaacaatttaattaagtccgatttgtcattcgagggtgcttttgaagtaatacgtggtatatattaaattgcatgacttgcctttgatgaagctatatccttatggtcaaatgtcatctgtaacatttcaaattcaggatggtatgcatgggggcgatgagcctcagatttcaagtttcctttttttttatcccgtgtttgacctttgaattgcatctcaggcttagtatcatggttaatctgccaacttattcaatatcatggaataaaatacaaagaaagaatttcactccatatgcttttgaatctatcgcaggggtcagattgttgaggttcatctcaacaattcaacaaggatgacataacagctgttgaaatttcttgtttcctgcgtcctgtctctgatattcagttgcttattctgtcatttttttttgcaggaattgtcatgtcaccttggttgctttgcagctgcaaatggtagatgtccaaaagcatctgaggtaaatagctcccttctaatagcctgagttgtgccacaaattatctattatctattctcagtgatgattcaatagtggtttggcggcatatgatcttagaaggaccacttctttagacgtatatcgcattgtgtcaaaaatcattgtggattatcacacataataggtagggtaagtataacaatgttgaacattgttcttcaatcattggagcgaccccccaccccaccccctaggaggttgagaaattgaccagggctgcagg

SEQ ID NO: 29421 - DNA, 2348 bp, Oryza sativa
cggttatattacatttatgtttggtttacattccaaatatcatcgtagcgttagcacgtgcatattactagtcttgaaaggtttgaaaaagatgagtcggaatctttggaggagttacacttccctctccctcaatcatcggctcaaggaatcgagttttctatatgggtcctttccgagtcatgctaaaatattccaagcacaggttttgaaaatcttgcgtcgcttgatctactttgttttctgtttatctgtcaacctgtctactgtcactcaaataatatcatcgttattaacttctttagacaggttgacagagtaaattcgtcccactgtgtgtgccaaaagtgtgttgatgcaaaattcgtcgcacacatgaaggcatgaaagatttgctttacactaatgcatgtcctatcaaatcgggttcagggcgtgctagttagtttgatcctgtaactaataatatacgaatgaaaaatttaaatcgtagtgcgaatcagtcacaaggccgatgtagtatagtatgcccatccgatgtcgatggaatttcagttcgatcggctataaccgatggatataaatataaccttgcgagtacatacttatacccataggctaaactaaatcaatacaaggatttctgactcattacacttccgactcaaatacgactgaaagtgtaatgagtagtttcctatttgtaaggagtatcattacacttctgacttatatacgactccaatcaactcataaatagaaaactatctgagaaaaattctaacatgattccattggctcaagccactatctacagaaacataaactaagatacaccttccttattatggaagcttgatttaaacccggataaacttgctaactgaatcttctacaagtatgacgtgaattccatctgattggatcttgactaatggaaattgccaatttttttgttaacacaaacatgatatcccataggtatcatgctgatgttagcatggtaccgtacatatctctggtactagacatgatacctgtaagtaccagattcggtacctatggtaccatgcaattgatccgtacccacggtatcatgctgaggtaccagattgatgtaacgtcctgtatgaaccagatctggtacataaatatcatgttgaaatcatcatgatgtcagctattccgttggaacgttggaccgttatgtactattttttgaaaaaaagataacacgaccgcgcagggaaggcaggcggctagattactcatggaataagttcatctgaggtcccttaacttgtcaatgaatccaatttttgtccttcaaccgaaaatccagatatgatgggtccctcaactgttaaaaccagtgcaaaaataagtcccaaggcagtttggacggcggtttaagctgacatggcgcctacgtggctaatttgactcagtcttcatctgacatggtgcctacgtggcaatttgatttggaaaatcataaaaacggtagccccacgtgtcaattgcaccaaaaggattaattaaaaatggaggggcccacgtgtcattcttacccctcttcttctctccccatccaggattcatggactccccagactcgctgtcgccgtcatcactggcgccggacctagaggtgtctccgtttcttagcctaccgccagcagccgcctccctaatatccccttcttctccacctccaccccaatccggcaacccggcctactcgccgccgccggaggtcctctcggacaaccatcctcttgctataactgctctaccgcagcggcctccactcaccgggatcgcggccatgttcacactctgacctactccacctccccttccttcgatgccgcagcaccgccacctcaccagagactcaccgtgctggtgactatccccagaaaacccaccatggagcgcctcctgcacttctggcccaccaaaccgacctctgccaatgccgttgcaacggctcctgcacttctctccttcctccctttacccttctctctcgggcctcctctcccctcggcccaactccgtccccctcccttccttctctcaggccgcccctctcccctcccctcggcctagctccctcctctcctcctctcgcctgggtctgccccggcccaagccgagctgcagccctcccgcgcacgcgcgccgcacgcgcgttgaccgcgcgcctcccgcgtgggtcccgcccgtcaggcgtccccgacctccagccgccggcctacttcctctctctcctgtgaaccctagcgccgttcctccctccaatccgctcaattcaaatggctcattccaaaattgattagggg

SEQ ID NO: 29422 - DNA, 17758 bp, Oryza sativa
gtggccggctccctccccgcgcctatgaaatggaaccccctccttccgttctctcgttttagcctcctcccgcgtctccccgtggccgcaccacccctccccgccgttgtccgctctctcccatgccgccggccgcctccagccgtctccagccgcctctccctcctcgcccgtgcgtcggtaggccgtgctgtcgccatcctcggcgtcgcagccacatcctctcccccggcctgccctccgtttcgcgcggtgaccatcgcaggcgcgttcccgccttcgtctagtggcgttgccgccactgtaccgccccagccgcctgtgccgcctcgctggtgctttggctgtcgtcgtcgcctccttcctcggcaccacggggccatcctcttccccggccaggccacggcgtcacccgaatttcgccggaacgctgtcgcccgcgccgcctctccctcggtctcatcggcacccactccggcagcctcttccgccgtgccagtgcgccggccgacgtcgccatctccacctccggcatcgcagcgacaaggtcgccctcagcctcgcctcccctccacccgaacccctccgctgttcatcgtcgttgtcgtcctctcgccggcccggtcatcgtcgtggcgttcgtccctccgtcaagccgttctcgttcgtcgtcctcgctttgtcaagtgagccgctgcagccccgtcgttgtcttcgtcctcggctccgcgtcgtcaagcctcgtgctggccgtgtctcgccttcgtccaaggatcgccgccgaagtcgttcgcctccgttgtccccgagccgtctccgccacgcccgttcatgtgtgcgtgtggtgacctattagtgtgcccgctcggtagccgcgtggtttccacgtgtgcagcccgcgtggtgtctagtggagtctgtttgtcggccacttgcctcggttgacacaccggatccgcttccgtcgacccgtggaccgtctctgtgtactcggtctaccgtggtcccttaggttgacatgtggggtccgcatgtcaacaagcgcagccctcctgtcttttccaggctagcgcttacacatgttttatagttgtaaaacctaattacaataatccgtaaatctccatataacagcattaaacttcggatgatcatatcttaatcatacgaaccccgaatcgacccgttcaagtctcctaatgtttgttataacctaaagaaccttgtgctttcttgttatgtattgttattgcttctttttaggcttgtagctttgcttgtgtgcttcgcgtagcttctgttgttccggcggtttccgaagcgtgcttcgcggtcgtcgccgaaggttcggaaggccgttctctctgagcaaggcaagtcgcatcacccttgagcatattgaatcccaatttataaaattattttgatttaaattattgcattaccgctttacttaaattcccgggttatcactgttttatttagccatgcctatttacctttgttatgaccttattattattgctattgttattattaccttgttcaccctaggataaacaaaacaccaactagtgggtactctattaacggttccactagtatgaatttaggtagatgcttcgctgattaattaggcaacactaggtggttttataactttagactttgggagttctcatatcatttggacactgtggaatggttggcttgtgatggaattgaacacacacctcccccctctattcaaaactcccaaaatggttttaggctgggctcgaggtgcatggttctgctagtagcacctcggccactataaggaccggtcttcgggcttctgttgcaacgcactaccgtactaaccacatgtctaataggtaaggcttaactcggtgctcagtctagtcctggcaagagtacacggatggagatggacgaagtcggggctcgatggacatctctagggcaaatgaaggttacacgggctgcggctcgatagtcgagatgccatggcatagggccggtgtcctgctgttaggggctcaatcttacctacctgtctcgggattcctgccgtaggcgaggttgggtcggttcttttgtcacggctaggatgggtaaaggggttatgtcacatcctttacgatgggttccacggccgtggaatgcagagtaaagatgtgtcttgtgggtaaagatgtacacctctgatcagagtaaatctattcgaatagccgcgccctcggttataggcaagcctagcaatgtacccaagttagtggtttacttcttaaaacctacttaacaactaaaatgtggaatggttggcctggattggcttgggacgagctgggacccaggtcgggttgccagttcggtctgaatcatcgtagaccttgggttaaggcaggttcgtgcgggttcacggccttgattaataatactgtgtagctctaggatcgtgtttacaaaatagctttgggcaactaagtgactttcaaatgctgttttctgcaaagcttaacccctatactatttccccttgtacccccttgcattattcatgcatctttcggtgtgacttgctgagtactgtggttgtactcattcatgctctatctctcccccttcagtaagagaagctttggagaagaagtcctaggtggagtcctgacttataccccagttgagcgcctgtgaagatggagccgtaggctcgctagtccgctgctgtttatttttgattgtcaggcctgaagcgcctgtgtaataatgtaagttttatcgatataataaagatgtgccttttgtatcatgtttgtgtggtgtaccccggcttttcctaggacggagattaatacactagcgttcgggaaaatgcaaattttctcggtcgcgacaagctggtatcagagccatctcgactgtaggataagccaagtggattaaacctaaggacatattttataaacaaaactattggcgaaaagttccttttttcctcctttccctaatgctatttgcaaaaggtttactcccttcttcctccttcgaatttcaactagtactagatggtctgctttgcgaagaagaagatgtcgtcagttgtctgccgaagctccggaagactgttggatccgctagcgaagcgaaggaagcagtgaagccagctgtgaagccggagtgaagatcttggagaacccatcgcaaaacctaagccatcctctagggtagagtcgttagtcgtgtgtttccttacttgtgtgtgtagcgcgtggtttggatctgtagggtgtgatgtaaccatgctaggttgtttgcttaatcaacttgcagaataagcctaacatacatcacaacagaaaaagattagatctgttaaggtcctatccttagttctgatctctttctttcctccaattttccctctctccctcttcaaaccttgtatcagatggctaacaatgaaaaaggcaataaggtcagaagtcaggacaagggtacctcaagctcccgattgaatgaagcaccagacaccagttgtgtggcagtggtccaacacctgattaaccagaatcgattgcttaaagagctactacagcagcatcagacaccaattctgaacccgagtcagatgcaacctcaagtgcagttggaggcagtccaagcactcacacctcaagtcagtgcaccaccagcatcccaaccggcccatcgcgccatgcaacatctggactcaaaagaagctagaatcatttgttttatatgtgatgaacaagcgcactatgcaaggaactgtccttagcagaaaagaaaagcatcaatgcgaaccgaagatgaagtccgtaagatgaccattaccggcatagaatggcctccaccaggaatgacaaaacgtcagataggaaatttctttcgaggtgcacaacagttgacagaacatcttttagctaatggaggtagagtgtctgatagtgaagattcagatcaagtctcctcagatgatgaagatgagaagtatctccaatgtttcaagcagaataaaatggaacataaggcatgctctcgttgtggagaaattggtcatgttgctagctcgtgtgccactacctgcgttcattatgaggaagaccatccatccgacgggtgtccaacgagcaggatcacttgtttctggtgtgaaggaactgatcatgtaccaaaagaatgtcaatttagttttctgctaacgaagaagatggcaaaccaacccgccagttccgacggagagaagcatcaaggcaacacaaatcctcgacaagacttgtgccactacctgcgttcattatgaggaagaccatccacccgacgggtgtccaacgagcaggatcacttgtttctggtgtgaaggaactgatcatgtaccaaaagaatgtcaatttagttttctgctgacaaagaagatggcaaaccaacccgccagaggacagaggaatcaaaataggaaaagaaaatgccgagtccggaaagatatctgttgcttcaattgtcatgaattgggtcacttcaccgacaagtgcccgaaaccgagaaacatagctgccaacacgtcaatccacgcaaatccctggaatcagaagcttgctccccagcgaattgtcatccatgcatcccgaagcagtcctatagcccgcgttgcaacagcttgaactccaatgagtgcactaccacaaggtgtcaatgctcaatttcagccccagcaaccagttgacaagacagaggccagtatctgcgttgtacctttagatgttccagcacagcagccaagaaatcaggtacaagatgaagaacctgagtgtaagaaagttattgtttgttacaactgcagtgaagaaggacattactccagaaattgtccacaaccaaagcgtaacccacgccatcattccggacattatgcacgaagaagacatgaccacaatattagggtcactggagcaaatgcagaacctgtcaagcctagtgctagtcagaagcaatcataatactcttgtatcggtgttgaagtacttttgttttatagttgttccctgtcaaccatgtaataagagagaaacatgagataatgaatgagtttgacaagtttatgaaggatcgatgttaagattgcaagtgctgtgagttgtgtatgttttattgatgattaaggagacctagagtctcatttccgtgagctcctactctattatgaatcaaataacctagttgtagatagaaaagaaaatcaagtgatcaaccaaagagacatttgtttggactaagagtttcagatgtgtcttcttcggatcaaaggcaacaatcatcagtctagcttttgacgaattacttcaaggttcctctgaaaggcagcaggccccagggaccacattgccaccagaagcatccacaactctcagagtgaagagtacttggttgagagaggtcaaaaggtgattgatcgaagaggtcggaaaagatgtttggttactgggaaaagatgtttggtcgaaaggtgattgataaacgataatgagaaacatgatttgtgtcactcgaggaagactcccaataacaatcgaccctacaacagtcaccctgtcattaaggcagaagaattcgcgagtaagcaagatgaccacaggtagaagtacttccatgaggacaaggatggaaacctttgtgacatgaccaagaagtcaagaagttaacctgaacagttggaatctaaagctcggttcaaccttcggctctgtattagatgctacctagaataaaagcacttgcactagtatcgttcaacacaatttcctagcaatcgatccatcgggaaagaacacatcaaggttgaaggtgcgaaagaatacgttgaatgctaaatgatgacagcatgaagagaatagtggaaagtaaaccgaatgtaaagaaagtgaatccaagttgcttgttcgtgagaaccattcccagttatgaaccaagtgatatgttcgaagataatctatagagtccagatcaaaatcacatccaacaatcagatttggtagcataaagattatacagttacaagtccagcagcaaagtcatctgggaagacgtcaaagcatgtcaagtgggataagttggttctcttgggaagcataattcaaagttagagtggtctacccttggatcgaatagtagaaatgtctagcacccggagactaggaaggctaatatgaggcaattagtggcaagttgtcaatcatatggtatccttggtaagcgggatatcttagtctgaagcatttggtggtaagctggaaggaaacgccaagcgtggtattctcatgatgaaaagcatggtatcctagtaatgacaagctggaatcgacgcataacgtgaagtgggtaacttgtatgaggctgacgccaaagatatgaactatgagaagttctagaactaaagccccatcttcaagtgccgcaacccagtcgaagtcagctagaggtgcaaccagggacaagtcaggtgaagagaagattccatctgcaacagaagatcaagccaagcagttcagactggggaagttttgctgggcaagtttgttaaagaagacgcaacggaagaagtcagaccagaagagaagactgcccacctatcttcttgctagccttctcgaatcttgggtgcaagattcctgtaagggggtggatttgtcacgtcctgataaattcatcccgaattaaaaatcattctttaaaaggaataatagaattaattaaaattcaaaaagaaatttgcaaacattaaaatgcgtacaagaaaaattcgaatgtgacccggagaatttttgttaaattctccttggtctaaaaggagccctcaaattttacttgaattttcagagcaccggaaatatttattaagcaacaacaacaattaacaaagtttattaaaaagaaaaactaaaaataatcccctttcctcctttgggccgagtttagcccaaagtctttctctcctccctcccttttcccttctctctcgggcctcctctcccctcggcccagctccgtccccctcccttccttctctcgggccacccctctcccctcccctcggcccagctccctcctctcctcctcccgcctgggcctgccccggcccaagccgagccgcagccctcccgcgcacgcgcgccgcacgcgcgttgaccgcgcacctcccacgtgggtcccgcccgtcaggcgtccccgacctccagccgccggcctccttcctctctctcctgtgaaccctagcgccgttcctccctccaatccgctcaattcaaatggctaattccaaaattgattagggggaattaaaccccattgattcctctctctttccccctaatttcccccttgaatagcaccattaatcgcccggaacagccgcgccatccccggccaccttccatggccgccggccgccattcccgcctccgttccgccctctcccgtggccagctccctccccgcgcctataaaatggaaccccctccttccgttctctcgttttagcctcctcccgcgtctccccgtggccacaccacccctccccgccgtcgtccgctctctctcgtgccgccggccgcctccagccgcctctccctcctctgtcgtgcgtcggtaggccgtgccgtcgccatcctcggcgtcgcagccacctcctctcctccggcctgccctccgtttcgcgcggtgaccatcggaggcgcgttcccgccgtcgtccagtggcgttgccgccactgtactgctccagccgcctgtgcagcctcgccggtgctatggctgtcgtcgtcgcctccttcctcggcaccgcggggccatcactccggcctccaaggcccgtaggactcttattcggatccctatccgaattaagctcatattggatctccatccaatccccttattctggcccattaagcgtgcgaccctgtaggttcatgtatactcggctgttacccgaaaactccttttcggtccacgcatcaacagtggcccctagcagaacgtattgacccacagggcatacataaagataatatcggctgaacctctggtgtatacttgtatgaacccttttgcctcacgatatcgattaagctcaaggctagatatgtgccatcctctaatatctcaatcattcatccgaacctgttgatagattatataacttgtgattgactcctcaatcacctttggcatggccatgcactttcataatctacaacatcgaggggcccagagatatctctccataggaggggcaaatcccatcttaattattcatatctcactacatgtttcatagtatacccgaaaactacttttataactacccaattacggagtagcgtttatagcagtccgtaagtaagctactacacatgttgggaaccatgataatctcagatctaaggatttaacaccaacactaaataagatcactgatgacacaacacatatggctcttgcagtgtcttatgttggatctatccaacaacatgttcactaacatgtgtccatattattaatttgatatctctatatcatgatctatgagacatgatcatcaattagtatatgtgctgatcatctaatcatatttgttccacatatgatatttaatcagggatcctatagaaatattaacaaacaagataaagagtctcatgaaagaatcacatattcattaactaataatgagttatctatttcaagaaacaatgtcggataaatatgtaaacatagtatgtgatacaatcatatctatgattgcctctagggcatatcactaacaatatatatactacacataacacacggatataatcatataaagctctgcaagcagctagggcggttaggcaaaaatggcgatcagtagtgttgcccgtgctgcaatagtaatcttgtgtctcgtcgccctcacaaaccttgcgcaagcccagaactcgccgcacgacttcctgcaaccccacaacgccgcgcgcgcggaggtcggtgtcggcaagctctcctgggacggcaccctcgccgcgtacgcgcggaggtacggcgagaagaggtcccacgactgcacgctcaagcactcccgtgggccgtatggggagaacatctaccggggcagcgccgggcggcggcggacggccgcggacgcggtggcgcggtgggtccgcgagagcgcctactacgactgcgggagcaacacctgcgtgccggggcggcgttgcgggcactacacgcaggtcacgtgggcacggaccacgaggctcgggtgcgccgccgtgacgtgcgatagcggcgccacgttcgtggtgtgtagctacgatccaccgggcaacaccaacgggagaggtccgtaccctggatgtggggattatgatgtcgtgtccgaatagctctacttaattactacctttctctagagaaatagctgtacgtatagcaaaacaccacctagtagaatttcacgtgattgttgaattttaaccccttgtgtataactccctcttatgtttacataaccaaataccattgtagtctaaatttagattttccatgataaagcattatacttgtacgttctttctttttgctcgtaatacaacaatgggaatttcagggcgatatgaacgtgatagttcattttaacccacttgttgctgtataataaaagatttatacgacatacataaatagtacagagggatgaagccatggaaaattcattattttcttatggtagggaaaaatcatcattgccaataatacgaataccagaataagctaggcccggtacttttctcgataaagatttacatcggtttacgttagcacgcttttcaaactacaaaacggcgtgttttgtgtgaaaattttctatatgaaagttgctttcaaatatcaaatatatccatttttcaagtttttaataattaaaactcaattaatcacactttaatagctttcttattttacgtgcccgcttttaatcttatgaagattcaaatgccacctaaatatattcaaagtacacctccagtaaaattagatgataccccatacactacaatacaaagacatcctttggtgtcggctccaaaagcccctttggtgccggatttggagcggacatgaaattggtggcacctatgagtcttcctcattggtgccggtccaacagccggcaactatggtgtgcatgatttcaaaaagaaaaaaagatatattgctcggctcaatcgaaccatcacagaattatctacgtcataatgaatcatatccaaccataaacaatgaacagtaacaatgaatcttgcacgtcccagaatatttcagtcagcaatttccaaatgctagctctagtcatgaaagaacactgaacacagagatcatatccaaccatgcatagcatcttgcaagaacagtgcagaacacttatccaagaacatgtaacaacaaaataacaacacgaacaaatcacataacaaatcgcttagtcgttgtccgtcgactcgccactcatcgtcgagccatctcgcgaaccccaccacccagagcaatgccccccctccctagatctacatgccactagtgggaggccgatggagagggagaggaagagggagaccggatcagcgccccgtcacctctggggagcccaccagttgcctcccttggccactgccgccaccaccaacataatcgggttcataaacctgtcatacaacacaaaagaatagcagcagaagtctcttaaattcaaataaacaaaagaacccgtggagtgtcaaccatcctacacgggcgaccagctggggcaagagccaagttgaacagctactcaccaccctcaccgcccgtgtagggcaggaagaacacacatcaatactttcatcctcacctgaaagataacaagatgaatatgaatggtactcgcaagacatacccaatataattagtacaaaggagaatgcaagcttctatttcaaaggaaggataaatgggttaagatttgccataaagctagttttatggatcaaatactatgctgagagtataagcatttgtaaatcatcgcaatctgaagtttttgacagaaagcatatatatctaaaattgaaccacaaataagcacaactggtgctctcaccatcatctatgggccaccgttgcccaaataaccattcgcaaaatatctaccaagatattcatgactagtacccaccatttaacccatgtttcatgctaatatggagtgactaacacatcaagcgtcgcccgtaaacgtggacacgactattcgcatagttttactccgatcagaggtgtaaaactttacccacacaaaatgaacaaggaacaagtgtttgatcgtcgccatccactccaaggtgagcttcgcctcaacccatcatctggtttcatctttccatgcaaaacacatccatactcatatttctccactttgcacaggttgagttcacggtgccacggtggccatcgccgtcggctctagtgcatagtcgcgcgtcacttcgccgttcccgttgacccggtgcatttccggccaagcagctgcacccctgacgtaaccaaggtcttaggagccagacgcgccaagggattccatagagatgccaccgacgtggggatcgagctcatattctctacctccagccgccagccatcaccgtagtttcctccttcctcggtgagctagagttcgattccttatgcaggaattcctcttagggtttcagtagcctcatgagcaccttcatttagcagcccacagactagagcgagccaccgccgtgaagccgacgccatctacagccgacgggtcgatcctcgtttcgccaccaccatccaagacactaggcccatccataaatttggttagctccctaatgccctctacatacacatttctgcatgtttttcatttgaatcaaaccatagctctaactggtcatgcaccccgaaccataccgccacttgcaccactactgtcattgattcagggatcaccattggccatgattagaccacctacggatgcgcaagagacccattgtggacaccccgagtattataccatccagtgtccaacgcgaccaccacatactgttggaggagtgggatccaaacacgcataaaaaagccactcatcctcaatgtgtccatgatcacggttgacaccttctgctataataaccggaatgccgagtagtgatcgtaagagataaaccataagataacttgccaggctactccgtcatatgcccgtcaaccacacgaaggcggcgactagaaaacaaggcataccccagtgcctcgatccaaagcgctatccccaattatctcaagcaatcaaaacccgttactcgtgctcagctagtccccaggaatgcgactagcctcacacattcatcgcaagcaattggaacatcatcacaagtgcataaaaaggggttaagtacagcaagtatctggtacagaatagggtccgatgtcccatctaacagcacacaagtagcagtggaagattcaaacaaaagctagaagcacaaaacaaaaccggtggtgccacaaccccacaaggtcaccgggcaagagccaagctgaaggcagcagaagatcattccctgccctcgccgcccccagaggacagtgaccacacaggaagcacaattctacgccggagtcctcatctgaaaaacagcggagccgggttaagtacaagattgtactcatgagtcttacccataaaaatatatataaggggagagagaagtatacaggtttaccttaacctagagcaatctaagttcaacatttgcataaagccaattttattgagcagatataagtgaaagcgataacacaataaactgattagcaacattataaaattctggacagcaagcgaattaatctgaaatgtacaagtaaatgagcccaaacggcgctcacaacatccaccatggaactaccaaattccatgtcatcatggcacagcctgccaacatcaccatcaaacataaacacaccagaataacccaagtttgatgctaacataactgaggcacacatcaagcattgtccataaccatggacacggctatttgaatagattatactctgatcagaagtgtacaactgtacccacaagagatgaacaaggatcaaatgccgcccaccacacaggtgcaacctacaagtgattcaagctcatcacatgtcctttcctagccccaccccaaccatttaaaccacaccggggcccccgacgactcagtcacgtgcgtgtgatgtgactaaggcgggctcaccacgcgggagataccccctgccgtaccccggccaaccgggcactccgcggatcccaaatcctcacgtttctccgatgggcgtaaatgatcacagtaggtttagtaatcaaacaggccggtcctaggatacggtgtgtggtaagtatgtagggtgcttgaatggacgtcaaaatgttcggtccttaacgacccagacagagctactgcatcaggggaaacatacctcccatcatcgccctaccacccgtccaagtcaatcatatttcatcaaccattatttaatgtaagtgctccagtttttagcccattaaccaagttgtccatatcccagaattaacaaaactgtccagccatatagttgtatccccactaagcaaaactaagcataatgaataaaacatcccaactatttccaaccaggagagtaataggtatatggcagctatatataactaaggtaaatacaccaattaattgtctaccatgtcacccaaaactattaactaaacaaatgcaaatatatatatagattcgcaaccaagggagtttaagttcattggcgctagatgcttaggtgctcgccatcccgctgagggtagtcacactcaggctctggttccgcttcagcactctccagaatcttcgaatctatcgaaaagaagcaatatgcgaataagattcaaataagcatgcatatgcaacatgctcagtaaaaacatggcctaattacagtaggtagagagtatgatgaacatattttagaaacaagaatcatctcatttacatttatggtttgagagatataaaaataacaagccatatacactgaaaatggcactatgctaaaactgaatataaactatagatcatttggtgatccccacataatctagcaaattttcatgagtgcaacttgtaccgtactaaagagtataacttactggttatatgagaagtatttggattatttaatttggagtttgaataagttagtaggtatttaagaaatctagagagtgaggaaaagaaaactactgcttgcagcactacataagatttgtttccaaagtttacttcctaaatacttcgtgattgaggaatatgaggaaggcaagatttaactcagctattggtttgtgaacacaacttatacgaggtgttggatagttcagcgagggattaagtcacaacatgaagtttctagctagcctaagaactaagaagctcaaagacaacaacttgctttcccaatggcaactcctaaaggtcgtccaacggttgctgcttcaatgcatgcatgcatgcatacactttataatgcaggtgatgtggcactgaggttgcgaaggttggagcacaaactaaccatagaacaagtacaaatcgatgacgaaaaaacatggtgatagcaacctaagtaaaccgagagagagaggggttgtaatcgccggaatggagagatacgagttgtagctgttccttgctgtaaaactttgcatcaacgacctgtggagagagttatggaggctcaacataatggcacaccaagagggacaccatgtataggaaggaaactcaccaagtggaggaaaaacagggttgttttgctgctaaaatcagtagcaagctccacctatatattttcttcccgatctccctcatgaaccctatcatatggaagatatttggatggatgggaggcttggatacttgatattgctgtggtgtgacatgcatggatggatctcaagtgtttggaggagttttgatgggaagaagtgagctgggagctcagcttgcaagaaagaaaagaacagacaagggagaaagaaaggggaagaagataaaagggtttcctgcttgtcttatgtacctgaggtgggctgcacgaccaggagggtgggtgggggcttggtggagagcctaagtcagtgacaagtgagaccaagttgagctgggcccaagggacagatagaggaaggtcggacacattgaaaacagtgaattttcaggaattttctttctctcgttcttgggtaactagtttgtcctagctaaaagagagtaaaaaatgtgtgttctagggtggagatagattgagttacctagattccatttttcaaagtttcactcaaaaattcaaaatattttaattctggcaaaaagatgaaaaggggtatgctgagacctaaattggattttaatgaggtcaaaattaattgtaaaaattctagaaaaattatattaactcatgataaataatctagtttgtattcatcataggcttgaactgaaagaggtaaatagaattgatcatccactgccctctgtaaatgttgttggacagaatcattcttgtgcctgacaaaagagaagagagtaggatacacctgagcaaagacctttccattacacaggtcatgccagaagctaactgaagatccactgttaattgttggccttgcaaaacctctgaatagaacttcaaactgaacaatgtccttccaccaaaaggaaccacaaacgctggcattttgaggcaatgtcctagagtaataggaattccaaatcagtttaacccaaggtatctgcatatgctggttaaagaactttcctaactgcttgaggagaagggccctattttgcactctcagatctattacacccaaaccacctttcttcttgggcctacaaaccttcccccaggcagccaatgattctttggtggaagttaaatcctttcccctccacagaaaatgccttcttgctctatctatattctctatcactgccaccggaagctgaagggagcacatatagtaagtgggcattgctgacagaactgaatttacaagagttagcctatctccataggagaggaaggaagaagtggccacaagtcttctttcaatccgattagtgagaggagaaaaatccactaccttgggcttagaacaactgagagggagccctagataggtgaaaggcagagaaccctgagcacaaccaaaagtctttgccagacaatcagccttctcttcatccaaatttaggggtatcagacatgactttgcataattcactttcaatcctgtggaaagagtcactgtattgaacaaagcttttagagctagaagttgtttcccagaggcttgcatgaatagcaatgtatcgtctgcatattgcacaattggaaaattttgatccccaatgacaggtataggaagcttgaacacccctctttgatgtcctttgttaacaatggtttgcaagatatctacaccaatagcaaaaagcagaggagatagaggatctccctgcctaacaccccttttgcaagggaagaactttcctgggaccccattaagaagaactgaagttgaagctgaactgaataagagctgaacccactcaatctatttgggtgggaatcccattgaagtcataatctgaaggactgcagggtgctctatcatgtcaaaagccttttcaaaatctagctttaagagtacaatttctctcttagacttctcttaggatgtccaagaagtgaatgactttatgacaattatcaataagcaaagatagtttggacagcttcttactccaacattttaagtttcttctgagctgtttgaacttggctgaaatagcaagggcatttgaactcgcgttttgaatggaaagccaagcattttcaacctgttgtaggaaaccatcatgctgaacccaaaaattctcaaatctgaacaaattagctttagggatggacgtcttcacctggatcataaggagcacatgatctgaaatgtgcttcgaaagagctagaaccatagtgttcggataggagatagaccaatttggggtaatgaaaacccaatcaagctgctccaataatggattatcctgcatgttactccaggtgaaagacctgcctttcaatgggacttcaatcaaacccagattactaattagttcattaaacaggtaaatgtcactcatgtcagcacaaggcctatttctgttgttgatagatctgtaaaaattgaaatcacccataaagatccagctttcattcaaatctatgtctagcccattcgtccagtgaacaaaaccatctctttgggggccagaagatggcccataaacattaaccagattaaaggtatcagggctaactctggtagaaaactgcacgataatagcatgatctgtttgatccacaacttgaccattgaaatgagcactattccatcccacaaacagaccaccagaggctcccctagaagggacaaaaacaaacttatcaatacgtctgggacaaaatttcttgacataagccaaatcaaaaacctctctcttaatttcctg

SEQ ID NO: 29423 - DNA, 3720 bp, Oryza sativa
ccacaaagctgagtgcctatattctgcagcaactgaatagagcattcagtaggaggattttcagaatcactattatcatcagcctcaaaaaacttagggggtaaaggatgaaaagaagaaataataccactctgttcagccagaagcttgagccttttagcacttttccccctaggttttccaatccctagattggggtcaggtgacatgtactcctctgtgagcttgtttattctagagctcctcctacgatcagtgtccacaattaccacagttttaccttttttctttttgcttttcttcaaggaaggccgacaagaggacaaattctgctgaaaagggtccaggggcatatctgagacatgttgcacaggggggacacagctaatgggctcaattatttcagcattttcaaattgttgggcctccaaatcttcctatcccaacatggtctgttgagtctcactgtcttcaatcccaaccaccagcagaactgctgctagaagagcaaactgaacaatatgaataacaggcaaagagaagggcacaatctgaaggtcttgaggggggcccaaatccagagaccactgaggtgagagctgcagcaatctgaagggactctgattctgaactgacaaagtgccttcccaagtagagagagttgtgttaaaagcagacagaatcctccaaaagaacagattaataagaaaccgaggctggacaagatgttcaaaagagataattccctggttctacagcaccatgttatgagaaccagccaccactgacagagcactattctgagaaatatgctgattagcatgggcatcctcttgcatattgtccccaaagacttccacatggtgtgccagctgcgggacaggatcagggataggaatatgattcacaggaggaagatcttcatccccaggcatgatatcaggcatctccccatgacacagaaagaccgaaacagtccaagatcttccaacacccccaaaagcagcagcccttttaatcacaattcttttagggacctcaagggcagaagagtacaaagctttaaccaacaaacttcctcttatattatcatctaactggactttgactacttttccaaaaagagagactgctttgtcaataacggtcggggttttgaaatccaacgggaagtccaaaaacataacccacccttccacagtaaaaggagagtttcggcaactagaagtgagatcatggggaacaaaacatagcataaactgattatccacctcatagggaccccccgcgattagcgtatctcttagcagagcagacgcaacccgaacataaagaaactccataggatgatggttgacctctaacacatgataccccaacacattctgaacatagtttaccgccaactgttgaaaaccctcaaactggtcaggggttgggggaggctcaatgcaagccacagccataccttcattgcgccttggaggatcctcttgaagacagagatcaacgcactcaagctgatgatcccagggttcatgcagttgtatggttggagggaggaaaagagcagggtcagggttgacaaccgccatggaagcactatgtcacgaccggaaataacccaacgggcgttccttacgtgcgtgcattaatccttgtcccaggaggcaaggtacaccaaaagttgatacaattcagagtttaacaagcggaagcgtaaatagttaatttattacatgggcagcggaggcccaacacacacaaagacaaacgagaaacagcggaagactagggcgacgaccacaggcacttgacggcaggcacgagctagacaccaaagccttcatcctccaggaacccctcttctgggtttgggaaaaattgagcaagactgagtacaaccaccgtactcaacaagacacacccacaagtgcagaataaaagcaagggagtacaaaggagttatactataaagggttagggttgcagtaaacagcatttaaagacattagttgctcaaagctattttgtaaacacgattctagaactatacaattattaatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacagacgaaagacgtgacatagtttccaacccatcctagccatagacaagagtaccgacccaatcccacctacggccggaacccctgggacaggcaggcaggactgagcccctagcagcaggacaccggccctgtgccatgacatctcgactaccgggccgcagctcgtgtagccttcatttgtcctagagatgtccatcgacccccgacttcttccatctccatccgtgtacttttgtttataactagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagaaggagcggtgtgaagccaatttcacaataaccaaaccattccatagtgtccaggtgatacgaacattcccaaagtctagagttgtaaaaccgcctaatgttacctaattaaaagcgaagcatctacctaaaatcatactagtgataccatgagtagagtgtccactagttggggttttgtttattctagggtgaacaaggaaataataacaataacaataataataaggtcgtaacaaaggtaaataggcatggctaaataaaacagtgataatgcgggaatttaaataaagcgataatgcaataatttaaatcaacataattttataaactgggattcaatatgttcaaagatgatgtgacttgccttgctcgctttcccaaacgccggcttcaacttccacgaagagcggatcttccgaagctgcagcgtctacacgaccaacggaaaagaaaaggcttttactctaataaactccatataacaagcagaaacaaagcacaaaaatgggttcttgacttcttaaggaaaaattagagacttgaacggtccaattccgagttcaaatggccaagttatggccatttgaagtttatatgctctttaaatggatatttgcgaatttcttcatttaaattttaatttaaaatcggatttattgcgtcagccgaggggaggagcgcgcggaccgggtccacgggagtggggcccacgcggcagcctctcggtccacggtggaccgggtgcacgcggctcacaccggccggcgccgtgggtcccacgcgtcagccgcacccgagggctcgggcggctgacggccgggccccacatggcagccgcggcgcgcgcccgaaggcggcctcgccggcacagccgacgggaggcggcgcgcccgcgcccctatggtcgccggcggcggccataggcacggcggagcggcggccgagag

SEQ ID NO: 29424 - DNA, 11174 bp, Oryza sativa
  unsure (1)..(11174): unsure at all n locations
cggcgagtggcggaaacggtggagggaggcacggggagcgtttatatagggtcgggagggggagagagaggccggatgagggggaatcggccgcggaagatccggccgccattgatgcgccggcgaagttagggggaaactttctgaacaaatccgagggagagagagagggaaaagtggggggaaagggagagggaatcacggggagtgatttccccctctttattgcgcgcggggacggcgggaggcggcgggattcgcggcggcggcggcgctagggcacgggcgaggcggcgggagcggcgggaggtaggggataacgggtgggccccacctgtcagcgagggtggcgggcgggcccgcccgtcagcggcacgcgcgcggggaggaggccgattgggccgcgggggagaggagagagagggagggaggtgggccgagccggcccaagaggggaagggggggggggaaaaagggactttttagggtttttctttttataaaacctttttaactttgtttatttcttaataattattatttgtgctctgaaaattccactaaaatttatttacgcattttaggcttttaggaaatatacaaaaatcctccaagccttatttgacttttaactttgcacattttaattgttggaggctttcacatggattttacttattctatgcataattttgaggatgtattttagagtcgttttgggacacgacacactaggcaaagcactaggcaaagaagctgggagcaaaaggggaacactctgccgctgatgcgaggaagaggaagggtttccttgattcgtgaaacaaacaatttccttccctaaaccatccccaccaacatcaggcttagacacagtcttgggccgccagacatgggccttctttttattccaacagaccacggcccgatggtctaatttgcgacaggaagcgcatttgaccatattaacacattcaaattcccggtgaccatgcgacagacaacgatcacaaaaaggaggggttttaggccgatctaaaattgaattcttcttatcagccgataatggcggatcacaattccgctgagcacggaccagagtcttaccgacggtgatctccggaaaacgaagacgggcaaaaatagacttgacaggaataacattcttagtctgaaatttagaatccgcaccctttgaagagtgaaccaaagagagatctaaagactttgttatgttaggctttagaaaaccagagaccctgggaggattaaccagcttaggagaggaatcagtcttaacaggcttggaacgcgcagcagactgctttttagattttctagaaacaagtgtccattcagaattctgctcagcagaccatagcctccattctctctgccaatttggacctccatccctccaaagatggaatcgagcatgatagtctttacagatgaaagaacgaagattatagatccaaatacccacggctttagaacaaaccaaaaaggaattgctccgatccttttgatgagcgacaaacagatcacccggagatcccccaatacaagccctcagcgctagaccaaccgaagaagtgcacaaccgaaaagaagaacgggggaaatcgaccacaagacaaaaaggacgacgagagaaaaaatgagaaaagtgcaccgggaaagagaacctggattagacttcatcacggatacggtcaccaggggaaaaatcccaaccccctgggggcgctggtgtcaccatggatgcactcagaggactccatggaccgcctccccaatcgtccaagaaacccggaacaaggatatcgcctccattcgctcccgatgaattagctcagttctatcttatttcggggtattttggtttagggtagtgctaaaacttttggtagttttttggcgctatacaatagttactaatatacatgtactaaaccattaatatatggtctcacctctcatacacatatgatgttttggagttatttatacaatagttactaatatacatgtactaaaccattaatatatggtctcacatctcatacacatatgatgttttggagtctgtgttgtagctggctacaaatctgtcgtccactttccttctctctcctctcttatattttccacatgtgcttatagttgatttgtagcctgcccttatacttgctttgacaatgggtcaaggatttataaataaatactaaagaaaacagatacactttacaaatttaggtctaaccatgtggggtggtgcgggttctatttccagaacctcatggacttttctgaaaaataaccagcaactgacatgtggacctctatgtttaaaatctggaaattataatgaaagtagtttaaataatttctgtagcactgaaaatggtgcaaacatgtaaactccatagaaaaatcattttagctccaaatgagttgaatcaaaatttgttagaataaaaaaatgaactatttttttatgtcaagtaaagtctgtaagaactatatgaaaaatacatccaaatttggtcatatgtaaatagccacatatagtgtattcaaacatgtaaaattcataggaaattagttacaactccaaatgaaatgattctagatttgtgaaaaatggtcatttatggtaatttttgtgcataagatgacatgtattacaacttgttgccatggagggtagcaagggtatacttatgctatcttgttgatgaacaacatgatttacttgatatacatgtttcaaatgcattattaaatactgttgtaaaatacttgtaaaataaaatttgctttatgctaaaaattaaagactacaaatagcctttcctttgatttagagcttgcatgtatttaggtttgatttttgccttgccagtacattaatgtactgattcttgcttgttgtatattttgttttccttagtccctgttgcaggttataagattgttttaggttgagtgttgcgggaactactcttccaggatagttataactgggggcttacccatagtcggttgcttgtggagttcttttgggtagacatgcttccactgtacctatatatttggccggtcggcgtatctaataacttagatgtaaatgtacaataggtttaaatatttgtatgccctatgttggatgtcgttgcttgatataaaaatgtgggactagtcctcctccgagaaactagtctagcatgagtaagtgtttagaataactgagttgttacagaactccagcgatttgagtcaagtctccaagaatgtgtaatacatatggtcgccgccttcgtgtggtttgaccggcacgtctcaggctaaagttgattggcatgccgagtcgcaacaatatatctcttgttctctactgggtgctttgggatctatatgttgtacgttattttgcatgccaaagctccaatgagtttggatggttatttttggtatttcttactgacattactagaaatattcattcccagcaatggcgctaaaaatagtcctggtatatttatggttacaaaagtagtccacaagcgcatggatataccattgtagcatttcacccggaagtatttcaaggtatcgtatttttaaacccaagggaagataataagagtgaacttttccaatacactttatacatatgttacttgtaattgttaaagcctaagcaggggttaattttaatttaggggtaaagtgacacgaagcaaagctgatcaaatcctcataatgaagtaattctaagtggaagaagaattagaaagcactcaattcatatacttctagtatacactcaaatcctagtttacatctgttagtatataatcgtgtggccaatatcccctaacagttacttacgacaacctatcatggccgtccaactggggctaaatacggagcagtaccctccccaggaatttgtcttaggaatatatactaacgtggaggaatacctgtactgaactgtcaccatcagcggcccacctgtactgtcccgcagcatatatgcccaattaatgatatttaataatctaagcaccgcgcttacattactaaatactactctacaccaaattaatgacatagagcaactgataaatcatacattaaacccgcaccattgcacctctctggtaagctacccacacaatcagtacgacacagatataaagtaagaacagtactcagactaaacaatgtacgaaagatatataaagaagaatatttcattaatatcgaaagtattacagaagagaatacaagagctgctagagctataccgaaactcttccgaagactttgaggactcctaatactattctactctactccacttagcagtaagatactaatactaaagtatgaagaggaattttagcttgcttgagtgtgttgagagagtgaatgagctcctcgtcttatagggcaggtatgacggttgtagtcatgtgaattgtccattttactctcacaaccgtcattgaggagtgatctggaccgtccacgtggagggccagccggagctgacgccaccagggttcggctgaacctgggtcggccaacagacctccagcatcgggtagggcactgacaggtgggtcctcttgtcggttgtgacagttaaggcggtttctggacggttacacctgacatatggcccctccttatcctctagcttgcttaggagtgaggttttctccactttctctttattttatttgataaattcctacaacatgttattctccaagtacaagtgaatctacattgtttgaaaacaaatatgcattgtaagcattgctaattcttcattattttagttatattgacggtcaaaatttgtctgtaacgaccgtcaacagttaccatattattcggtttttgtttgagaccccatatgtcgaggagtgatcctctctagtgggagatcgtgagatcccccttttatgagttcggccgggggaaaaggctcgcttggggagatcgcgagtctgccctgaatgctactaaatcgtgtgcgagcgccaagattatacaggttcgggccgctatggagcgtaataccctactcctgtgcgtgagattatggttgagtgttacaagggttcctaacctccggagagtgctcccgctcttctcctcctagagttcaggttttactgagtgtcgtcccctctctcggtgggcaaggtcctccttttatagttcaaggggttaccacatgcgctgcttctacctactctttcataggagggggacccactttaccttgaccgggccacgatccttgccttcgcccggaagctaagcagcagtccgtccttgagcgggacccagcaccgccccccgcctgacacgggggacagccttgtcattccctcataaatggatgaagactcgtggtggtcctcctctcatggagggaactctgaatgacgcttcgatgggatgggacatacctacctccactccgccagatacagaggcgacgtgggggcacaggcgcccgtccaatcggacgtgaccggcaacaggccggtcacagactggtcacgtccgattgacgtgggttagtcaggcggcaccgcatgtatgcccttaccgcataaacgcggtgaggaacagttggggcgctgtgaattgatggctgttcagcctgggtcccctccctgctcgctccccccaccacatggcagttgggcgagggcctcggggcgaggcagcacgagggcccgaggggcacgacgtggcaccccgaggccccccggccgtttctgcgactcgtgaggtgcgggagtagggccaggctgtggagccacgcggctggatgggaaggtaacttcccctcactttgcatacccccgggcccatatctctgacaaatataatagattttgtttgcttatccattcaagtaatagcaccagcatgatgtttaattatatgaatgtgctagtcatcttaattaatatgcatgttttgaaggctgaacgcctgaacacacatcaacaaagaaaatgtggtaagcaaaagaactggaaaatcagaaaatttacttcaaaatgaactgaattactctgtcaaatactaagttcttgtgttgaactgaattatttttcagctgctagccgcttccatattcttttgcccccatcatcatttaaattgcttgcaaatattgcacaagcgtacgtgttgtttcaaactcttcagggccttgagcccttgagccgccgctggaagacggtctagttgatgtgaataatcatgggatggataaccaagggtcaggggggttctttacaaaaagtaatgtatgtggcgggcgtttttttttttttgtaaaattgctacatccggttggcagcccttggattgagatcgagaggaccccattgcacgagtgcatgtgtgcatgcgatggctcgtgtgcacctgatacgctgccgtgctaagtagctgcttggcgcaatatatatgtaacaatttgagtggtttaggccaactcaatttctggaaccatacttaccttgcaagctttcatatcagcatttcttaaaagtttaaactcggtgaatagtcattgggattcgagcataaggtcatattagtttggatggacacttttctaacttacaatcaatttaagccttcccagagcttcacagatttgattgcagccgtatagcaagtgtttgccagggcatcgatacatccaacctccattggggtgcttggtttagtcggtgtatgtcaccattccgcttgcattggtaagatcttgtaagagcttggttaaaagcttgagtgtgtgtgatatttaagcctccacttcctagtagttaataggaacgtgcatatttttgtgtatgttttttgttttcaacatgcatagaaaatttgggataactgtgctcaacatgaacatcttggtcaagtgatattagaatgatcaacatgaccaatatgaggtaagtgatgttcttccaggtaagatcaaatctactctatcttattttgaagaaaattatgatcctcgtgctaacattgattgggagctagtggttgatagagaatttaaggagcatgacttgtctgagaaacatatggttatgcgtgcctctagtgttctaattaaaaatgtttttttctaattggaaagtaggcataacaaaacaccacaatcttggaaagacatgatacgatatttgagagatgtttatgttcccatgtattatgctgacattctgttcaacaaactgcaaagtttaaaacaagataatagaagtgttacttcatactattataatatacatgcttgtttattacgttgtggtttagatgaatgcgaagaagctacataattgaggtttttacatgggcttaacaaagaaatttaggacacgcttgcttgtcaatgatatagatctctttctaattttttacaacttgcttgcaatgctgaaagtaaaatagaggaggacatgaaaaggaaacatgctatgttttttcctcctattactaatcatttgcaggaagtgcataatcatgaaaatgaggagagtgacatgaaagagctgccgttcccattattcacactcaaatttgatggatctccatcatcagaagagagaatcacatgtaatctacatggtgctgcaattaatcaaggttagtttgccgttaataaattgaaatcatccacttttattgctatcatagagcaaccattagttgagattcctttgtcacaagttgatttaattactgatcattttgataaagaagtgttgtgtgataatgcttcaattatatccatgccaaactagtgaatgaacatgctattcctattggtaattcttactgcgctgattttaagcatgttattcacattgctaatgaggtagaggaacgtgaattgatatcttctttaaatactttgggctacgttccgtttgatgatttttgtgagttcaatagtttgaaggagaaattatttgctaaatctgatttgccatgtccaactaatgctatttttcatatctttggcgaatataatgatagagaaatataattggtgtatagaatttatatatgttcagaattagaacctcctgtagatgtggataaaacatgcaagctagagagacctattattgctaatcatgttatcttgagtttgtcttgtttcaattggaagaaacaggtttctctaaatggactacgcgacaagcaccatatggaaaaaccgagtacggttttccgtgaagaaggggaggatgatgtgaccatggctactatagatacaaccgcagttcacatcatgaattaacaagaagacatcaagatcaagtcctcccaagtgctggaatttgattcggccgcctactacattgctgacttcaaacggccgccaaatatgcatatgagctttgttttgggtccacgagtacatgatagaaagctctcggagtcctcattccaacggatccagcctcattgctattttccattcaattcagatgcaattgaagaaataagttgccgcgtcacgtgtcttgggcctctgggcttgtatctttgtttgggagcttgtatccttgtttgggaccccggcacaagtggggcccatgtggggtgcgccccaacaagttggagcacaaccctagggacccctagatcttcctcccacctttataaatagctaggtagcccttcagagtttcttgggttttgttagattaatgtttagccattgctacttgcttgcagcacgcatgtcggctagaccgtccgtctgcttgttcttcggaaccccaacttatcatttgttttttcaattcctatttgcaattcagattgctttaatcttgtacttgcttgtttcttctatttgcttgcaggaataaggttggtctgcacttgcaagatcaacaacctacatagaggtgtatcgatcgctaagactcaacacaacaacgtcttgtacggttgtactcggatcatcaacgtttcttccaaatcatagttatcatcaactcaccgaaagatcgggccttgagtgtctcgagtgaactcagtgtttatcacttgggccccacctctatcgatcgccttcctccagagactgtcatgtgggcacctaaggcggtgcatggttgtctggccccatattaagtcggtttgagctaacatatgggcccttcaatctgtgtgctgtcacatgattcatcgaaggtgcgctttttgcacgccgttacatttctccttcactttattgtataaaccctacattcatactatttatccaagacaagtggatctataatatttataacaaatgttagttctcttttatttattgaggtaattgacagtcgaaatcggtaattaacggccatcagtaccaaactgcatttataaatgccttagattcaactcaatgtgcgttgagggctttgtttatatattgtttcacgtgtgtaatacatgttaatttcctagggcttgtctaagtatcttcctcttggtcaattacaaattgtgtgaagtcatattgctcgttattcctagacctttttactaaaccttcttagcttttcacccatgttgcttaatgcttatcgtctagactgtgctttgtttttgctagaaaatgaaacaaaagaatgaagcctattaataatgttggaggtacaccactaggacctttcggccggacctaccaaaaccaagggcttaggcgagaagtcaggacagagcggacgggtttcaccaaggacgggttccctcagagaattgtgtgggtgaagatcgcaaggtgggaacccctgccgagaaggacacacgcttcgccaaagattgggccgagccatttggctcgttaagagcccaaatatgtaaaggacactgtgtgcccccaataatgtctctttcacaagggtaaccatgtaaattctcctgtacaacttaaaccctaaaggggagatctgtaataggattataaatagccccctagggccatgtaacaaggggatccaaaaatttttactaaggaatataattgttcttactttccaaccactgttgagagaaccacgtctttcgacgtgacacggttgtctattcgacaacaaataatatagttttgtgagataacaagagcatgtttccaaattatagcaatgtatgtctcagatagttttattttggattgcactaaatgcgcagcaaacaccttatttgtttgcttcatatataattctttttccattcctatggtctaaatatgaaatattatcttcttagtcaactgcaggcactcatacacattcaaggctttgtatgaagtcaacttcgaaaaaaatgaatgtttaggaatttatctcatcaatggataaagcggcaaatattttataagatcttagaaattatattttttgtagaaatttgttatagattggtgtaaataacatttacaggttttttgcaataccgtgcttgtgccttttgtacaatgattccatgctatttgagacatgacgcttataaaagattttatagaaacaattttgtacatttctgaatattaatatcgatgattttatagtggtatattgcttgtaatattgatgtgttgctgcgattcaaaaggatgttactagtaggtgtacctgtactcacatatatgttagtggctttgcaataatatgagttattgggcttgtgagtttggaactccacctccccgcatggaaaacatgataatttattaatatataattaattaagtattagctaaaagaaatttaaacacatataataggttgggattgaggaaaacactaaattaatcaaggtcagcctaccccctgaggaagaaacattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 29425 - DNA, 186 bp, Oryza sativa
gccgacgtggccgtgaccctggccgactaccagggcttcaagggcgaagccatggccatgggcgagcgcacgccgctggccgccatcaacgccccggcctcgggccgcatggccgtggccgaagccatcaccaacatgctggccgcgcccattgcgctgcccaaggtcaagatgtcggccaactgg

SEQ ID NO: 29426 - DNA, 316 bp, Oryza sativa
tgcactccatggtgcaggccaactgcctcatcgtgctggcgcacgaccaaggcagcgtgaccgccggtgacagcgtgccggtgtggctgctcgatggcttgctgtagagggtagagggcggcacacccgcgaggagatcgtgagcacgttcttaagccaacacctgctccacgcccaggttggccaaggcatcggcccgctcattgcctgggtcgcccgcatggcccttgacccaatgcaggtaatgcggtggcccgagttttgcaccaaggcatccaaagcctgccataaatcggcatttttcacgggttgcttg

SEQ ID NO: 29427 - DNA, 627 bp, Oryza sativa
ttaccgatgggcctggcgcgaactatagccaagtgctgctacatgtagggagctcccagtgaacagtgttgcctatcagggaaatgggctctaccgcttacagtgctgatctaccgcaattattgctctgcttacaaagtgcccttctcccgtatatctcccttcatggcgagactcatgtaccccgatggggcgatggccttcaagcaattctacacagaatttgatgacctcatctgttccataacccttggcgatactcgcctttggacgagccctgatacgaacatactgcttcggaacccccctgtacctctcgtacggaaacatgtggcgtaggtatacatgcccgagaataccgatctctttacaaggcgacaaagccgatgcttccttatatgcgaaaaatgaaggtgcaaatttcaactcaccactgacgagacattgcgccacttcattctgaagggcttgtaatctatgcggatcgatgaccttctgcaaaatcgcgttcatgagtgcacatacctttgacatgggaccggacgaacgtcaccacgttgctccatatgcttcatatcattacgcgcttccagtgtatctgtcaactttccggatacacctaggaag

SEQ ID NO: 29428 - DNA, 3054 bp, Oryza sativa
gtgacactatagaatactcaagcttgggctgctcccatgtcgctctcgctgcatgtgaatgatttcctctcatccgctcgcgatttccaccggatttcccattaaccaaaagccatcgtcctcgcggcgagctcggtgcaaccactgcttccacctaccacttctactactcatacacgcagtgccattggtgtccacctcgatcgatctctcccctcacaatcctctctcacgtacgcaagctagctagctatctagccatgtcgatcagtccacgcttcttggccgtcgccgccgtcctcgccggcgcgatgtactccgccgcgacggtggccgcggacacgccgggcggcagctgcccgtacccgtgcctcccgccgccgatcgccggtggcgcggtgaacagctaccctccgccgccgcccgcggggagtagtagcagcagcagctcaggtggaggcgatggcggcgccggcgggttgtttggcgggacctacccgccgccgccgcccggggtgatgcctggggccttcgctccgccgttcggcggcgggttcccgtacgggccagcgccgccgccgcccaacccgatcctgccgtggttcccgtggtactaccagcacaacaaccccatcaccgggtcgacgacgtcggcggcggcggtgggccggacgccggcgagcatggtcacgacggtggtgttgctcccgctgttcttggttgctcttcttcgtgtgctgtagagtgcttaataaattctaatttgtcgctaggagtgttttgctaggtaattagtaagatgttttatgtacaacctggtttttgttaactgagatgatctatggagttacttttacgaaattattattatgatgatcatgatgatgtgagtatcgagaaatgcttgtcctttttttttttttgttcattataggtttcacaagttcatgaaatatggggtgaattatggataaacttcaccttggtgatttaaagttttttttgttaaaaaaaagtacctttcaaagattaattgtaaaagaaagttccaacttttttggagttcgaacaaacaaaaaaaaaggataatattgacagaacacagtcacacaatttgatcacctagccagtatgcctcctttctgaatcaaccgtgttctactttttgttcttatcgtcaaagtttcgaggtgaaaaggcgtttttcccactcacctttcaggcattcagctgtcaatcatagagaggctactgaagcttctagctagcattgtattgatgccatctctgtttgttcagatgtcaaagtctagcaattaaatcagtaggaaagcatcagcttgtaaattcatatctaggcccacatttgcccgtttttccgtgcctgtaccacacctttcttgactggattttctggaacatatatataacttgccacagaaccttctaatttaaacagtgccaaacatgaattaatacatttgcgattgtgctcacaaccttaatttgaactaaacatttcctcgataatccgttttatattctagaactggtcattgcccagaagactagaaccggaagatgacaagaacgaagaacacgttgccccctttacctggaaatctggacgtttctttctcgcgtcacaaattgccagttggtagtgagagtccagctaatggcgacgacggtttctgggagatatggtgacgtgagggctatcctgtttcccttttcggttttgatatagaggtactacaagaatgaaactgttggcttattgaaaggaaaaagggaatggaattatgcaagtgcccaagaagttatcatcggccaattcgtcccatacatgcatatataattgcatacacggatacaccaaccgaaaaaaaaggttcttttttctctttggggcctagctagcctgctaaagtcaggtactgcagagtacgtactctaccaaactctcgaggagctgattcattttatcatcagaaaatggatggccaaccagaacaaacaagtccttagcccagaaattgaaatttcggattttcttttttttaagtcagttaaaattattaaatgttaataattttgtactccatgcatattatgctcccatttattataataattactaataacataaaaaaccacatgagaaggacgtattaatattaattcagatctattcaatagtttattctctatacaattgagtggacaaggatcattaaattatatatagatccaagtatttaaagaagagtaaaatgcaccaacggtccttaaatttgtcaggaggtttcacttaggtccacaaacttgcaaagcgcacatcgaggtccctaaacttggtttattgtatcatcctggtccaaaaccgcgtttgaccgtggtcttggctacgtggcatgccacgtggatgatgacatggaatttttttatattttttgcttccttctttttttttctcccttcttcctttttttctctcctgtgcctccgccggtcgacacgggagcgggggcgaagagggggggcggcggcaggtacaagggcaggcgtcggcgagctcggcgcgcgcggggggaggtgttgccgaccggggttggcgagctcggcgtgagcggggcagacacgagctcgacggcggcagggtgagctcgacttgagcagcgacgactgggagaggaggacggcggcgctgtgtgcgtgcggggggtggtgttgccggccgcggcccgaggggaggtgtcgccgaccgcagctgcgcgtgaggggggaggcatcggcgagcaaggcgcgagctcaacggcgacagcggggcggcagggcgagcttgagctctctccccccccctccatcggcgagcttgaggtctctcccctcccctctcggaccgcgacggcgacgaggacagcgcgtcgatgcgagcgagcgaggggggcggagatggtggatacgaggaggagcgcggcggccaagcgcccggtggcggaggaggaccagggaggaggagaaggcggcggcgccggctgctgttgtggc

SEQ ID NO: 29429 - DNA, 6647 bp, Oryza sativa
cctcttcccccagtcaccgccgcgcgctcgcctccgacagtgacggcgccatggcgtgcagtggcgccaccccttctccccccatcgccaccgctgtcctcccccatcaacgccgtcatcttccttccccgtcgcaacatgccccagcacgctcgccaccgtcgcgcgctcgcctccagcagtggcggcacccatggcgtgcggtggcggcggcgcgttcgcgtgcgccacgcgtgcccatagaggagaggagagggcagcggctcggttgtgaaggagggagaaaaaaaagaaagaagggagaaaaaaattccatgtcatcatccacatggcgtgctacgtaggcaagaccacggtcaaacgcagttttggaccgggatgatacctcgatgtgcgctttgtaagttcgtggacctaagtgaaaccttctgacaactttaaggaccgctggtgtattttactctttaaagaatatagcaatctaagctctccattgttgctatcaatgtgaataacatgtttaaacttaacacaaatggtattatagtggaattaacatgttcattcactagttgtggtatgaatataagtgaaatatcgctaaactcttcattatcacttgaaacaacaaacaaattattttgtgacaaaggtatttcatcaattgtttccattatgggttgctttaatatagcataagaacaagacatatttagcacatcataactatgcacgccttgagtaaatgtagtaccattatcattatcaatgttctcatcttcagaaattgtaggtgctagctcaattaaactttcttgaagcatgcatagaacaacgggtaggtcgtcctgttgtatgtctttcttcacttccttattaccttggttgttatcagatacctgccaaatgttagaaacagatcggccaatccaaaactcatgctccaagtggcggttgacgcgctgtagtagtggcggaggatggtcgtgtgctcgctggcggtggcgtagtatgaaaagttgtggatggcttagcttgtgcaatcatggtcgatgttcttcgcatgagggagttgctaatcttgcttttgttcttttgctagtgtacctgcaactctttctctgcaatcataggaagctagaacaaagattgacaatagtatattctttataataaacaatatcttgaatttcatgcctccacccacgataaaaatgacaaattttatcctttatttcctctactaccccgcaacatttaataccctaattgagctcttcatagtattcatgaacaatcaaattaccatgttctagtcattgaaatctcttacgcaaatcacacaggtaggaaggaggaacaaatgtaccaggttgtaagtgggaactacctgttaatggcatcactagctcggatatgaccttggcccttatgtattcatcaaacaaaggtgcatgctttctatgtgagatttacgtattatatatttgaataaacattattacatcatgagttttgtgtgttctcgtttgcaaaggtacatgcttgggtaaaaggagagagaccaagcgcaaggcataataaatggctgatcgaataagttgattggggaccaaaccaagatctttcccaagtcttatcctacagtacaacgtcactttctgtcaatggaagtcaagatataaagttcggcatgttttggattcagattcggacttcgtgatagcgccaacttctaatggacctagccgctaatctagaaggaatctcggggcccatgagtacttgttggaaagcatatggaatctactttcagatggtttggtcccacatcaaaactcctatcaagctgtcaagaatctgcaaaacaagccacgaagctcatcaagtccgattctaatttgggccttgattcttgtaatggtgccctgagctaagcccaaggggtgtacgcccgagggctaaccctaggatgtccttaatcatatttatttagtagctgtcatattatagtctgatttttcttagattatttttgccattgtagtttcaccgctagtttggtttgtggaagcccaactttgagatcttaatcattcatctgcaaattgagttgcaatctaccttgttcttacttgtgttcttcgattctcatgcaatgattagtcttctcggtgaggcaaactgagcggcgcacggttgatgaccagaggagcgtggtattgcaattgcactgaacggatcgtgctgatcgaaagctgtaccatatgtgtcaagtttccaccaaatcgagagttattaatacctatcagaaggttgggaccctagttcactacctagatcattccaccaaattatcgcaaagtccttcaacacaccagtagcttgactaaccctatgtacctatggaactaggtgtgaattaaacttctgttgtactgtcatccccgaatcaaaatatgcctcaacatcataagcaatagaaaataatggaatactaaacttgacattagcaaaattattacctcccatacattgatgattgcagcgaaggcattgacatagtcattcatcttatgttgcttgctggtgaacctctccatgttcatgggtaccatctcgaaggagtagacggcccttcaactcgtcaagtatgtcgttaagactagctaaccgtcattccaaaagctcaatgaaattggttatgtctaaattggccatagcatcatccaaccttttcatcatttggtctattgttccctacctctgagtgcgaaaacctttggactattttctcctgttgacattgttagcgaaaacatataatagaaaacaaaaactcaaaaggattatccctatcagctactagacaaggatcgcagtggaggctagcaaatgaaagcatcttaccaagctcttacaagtgttttaccaattatgctaagtatggtataaccgatggctggttcgtgatactggagggcatgatctggcgattgaaaagggtcgaagctgtactgagcgagaagcatgtatgtggagcttaggaggccaaatttattgaagcaaaggaaagcaattgtgccaatcagaaaaatgtataataatagttcaaagtactagtaaatgtgttggtctagcctagactcaaactctagctcaagcaagcaccaaacaacactaagggtgtgtttgaggaggagattgggaagatacgcaaaacgaggtgagccattagcgaatgattaattgagtattaactattttaaatttcaaaaatggattaatatgatttttaaagcaactttcctatagttgcaaaaaacgcaccgtttagtagtttgggaagcgtgcgtgcggaaacgaggtgctttgtcaccctatctcacacaaacgaacgcagcctaaggactagatataaatcaatgcacaactctacactctaaacacaaaatcaaaggagtcactgaaattttctttttcacttttttcttttcgttcttttctttctttcttatttggtgcaccttttttttctttttttttcaactttctatctttttctatttgctttttttccctaattttttaacaggaactaaccaaatatctaaatcaggaaccaaaagttactgtgaggaaaacaatggtctcggccgcctttctggagtagactggcttgcaaaaaaaaaagaaaaatcgaatattaattctatctatgtactgaagctggtgtagatctatctgttttcctagtccttctcatcctaactcccaacacatataagcacggactatgttacatggaaatcgtaacacttgatgccacttcacaaccgaccgaaagaaactcttgcaaactgcaaaaaggggaacccgatgatgatagggttcaattttctagttgcagatgaatgattacgaattcgatgttggggttcttcaaattgactaacagcgaaatagcatgacgacatattaatctaagcaaaatttgactatggctgctactaaatatatatgattagagacgtcctagagttaggcgtttaccccttgggcttagtccacaacacaattataagacccacagacaaatcagacttggactggataagatacgtggcctgttttgcagattcctgacaactcaggaggaattttaatgtgggaacttgaccatctgaaagtagatttaataagctttccaacaagtattcatgggtcccgaaagtccttctggatcaacggctaggtgtgtttgaagttgatattttcgaaggcttgaatcctaatctagaatatgcagaacttaacctcttcccataaatggaccaaaagtgatgtggtggtgaaggagtagacttgaggaaagttttggttttatccccaatcaacttttttgatcatccatgcataccttgctctcggtctgttttccatcacccaagatagtacatctacaacgagaacacaaaaaactcatggtgcagtaaagtttgttcaaatatataacacataaatcttccgtagaaagcatgctccttggattgatgaatacatagggcctcctggaaacatttcaaagcgtaaaccaaacgtccattggttatgcattttgttgtagaagcgtgaagaggataataaatagtaataaatactacaatactccctccgtactcgtaaaggaagtctttttggacaatgtttaagtcaaaccttgggaatataaatcttgaataactctcaagttgttgagtttggaaatgtaaaaattatatgaatatatttttcttgaaaaataatttcataaaagtatacatatatcacttttctataaatatttttatagaaacaagaagtcaaagttgtgttttggagaccatgtcgctgtccaaaacaacttccattacgagtacggagagagcatagctttttgccagccatggatgaagatttggcagcatagtttgcttttgaaaatttcttgtcattcaatcgaatcgtgttggtgttactatgttttatggatgctgatggttgtgatgtaaactttgtaataatttagctttacttttttagattagttggatctatgccattacagatttactggttttgaaaaatactatcaaaattcgttaaaccagctatgtgtcaccgagattttctaaaattcaaacaggccattgaccgccattattgttaagtttcctgtcaccttctcccctaatctcattccatctggatgtgagaccgagtgtgtgtgcatgggggggaggggtggggggggatcgccggtgacgatcagtgtcccatcgttgtcagcgagcttcgaccaactggttctctaattttccaatcatggtttgggcactcaaaatctgaagaacattctttcttttttacttttccgccgttggcttgtgaaaaacattatcttcctttgtatggccttcaattattttatatcataatagaggatgtctcagaaaagtaaactcaaataattgaccattatagttccataatatttcttcaatgtagtagctctcttttctgtactccttgaggtaatggtggtggcagtgaatctattttggcaaaactaattttaaaactattttggcaactgtgaatataatttaagaacaacaaacagcagaaattaaatatccatttaagttcctaaccttttaatacaagtaaaggaactatagcattaaacatatacattaaaagtagaaattaaacttactatcttcacctgactttgaataaaataaaataaaaagctgaatccttgatagattaaccaagtatcaaaagctcgactaatgggaaaaaaggaatcgaatatcactccaaatgaccaatgggagattaattttaccctctaaaatgccatgaaactacctaaatgaaattcccaaagtttgtaaagtatttatctcccaataaatctggaactctcaaataaatgaagcattagaaatgaataagtctttctttggaggaaatatgaaaatatgtatccaaatttgaaggagttaatatcttcaaatccaagttacctgtgtcttctagcatctccatattttttatttagacctttttaataaataatttagaaattaaccattgcaaaacttatttcaatgatctgaacattttggccaacccagcccacctcgccatcccaccagctgctgtggctaaaaaatgttggcatgcaagctaggtaatcgtggcaaccatcgccacacaggaggtcgttccccgctcggagtcaaccacattctgacatggcattgtgcttgaaatgccagcgcaagtggtgtcgcacttcttgttgtcaacggtatttacgttggtaatgttgtggtcataatgtcatatatgtgagggaatgcatttgtagttatatcttttttttctaatttggacgtgtagatcgtgcgtacaatgtctatgtctccttgtgtgtagaagtcgttggtttgcttggatcgattgacaagttatacttattttgcatgtcaatattattttgttgtagatggatcgtgtactgcacgtagggaaaatatgtggtggaaaccatatatgcaatagaaacttgtaaactaccgttggatcgaaaaatg

SEQ ID NO: 29430 - DNA, 29783 bp, Oryza sativa
actcatgatgacatggacgaatctcggacgtccatttttcgatccaacggtagttttcaaattttcaccacatatttgcatgtgcatgtacattagggtggaacaatttgttgtgatggacaatttacaaatatgaaagttgatgtggtagtatttgaggccacacttacatagttaggattattctatcggatttgttctaaatttccttctttagaacccattggtgcgttaagcatggaagggatgtacgatgcaggcatgtgatcaagggagcacttttttttatcatacccatatcacgtgagttggagttgtcgacatatgttgcatgtgttcaagatttgcatgtacgctaagtacatgttgttgcatcaatgtttgggatacttcgtgcaacggtagatccgatttcagtcgattatacaaatattttggaaagacctcaagaatatagatacttcaacacaggtggacccatagtcgaggtagatgaacatgccaatgagggtattgttcaattaagtgagcataataataccccaatttatatggatattaaaaccgttggtcagggtaataggcatgtcaatggaaccaatgttgtactaatcccatgtggcactatgcaccatcggctaggcttgaatcagacctagcccacagtgcactccttctccctcttggcccagctattgtctctgccccactcaccatctttcctagcagtacaacgtacgaccccagcaggagaagaaaggcaggccatccctgcgaccattgcaacctggccgtcaccttctcgcccgctacgccaccagctgcctgccactgccgatgcacgccaagccaggctgcgtgcaggtcaagggatcgatccctcctcccaattcatggaatttgatttttctagaaaatagcatagggcagccggactgctttgaggttttatgtaaaacagggtggtttaaactctttttaccagctcatatgcatccctggtttcttaattggatcagactaaacttaggcctggttctggtttttagctaggttaaaccagtggtccactccggctttaataactactccctccgttccttaatacagggcgtggctgttgtagttgcaaagaccaataaaaccatttaaatagcagttacgatgattaattctctccgttcgaatagcaacgtttcagtagttgcgcgatagatacgctagcattaattaaccaccatgcatgcagcgtgcgctcgacctgcactttccgcgcgaatagccagcatgtatgcagatgcatttaaaagacaaaccaagtcatcagttaattctgcaggcaccagtagtacaggagccgaggaatactaattaattcatgcatgcaccgaggagctaccaccttgtattatgaaatccagttgaaaagaagttacgccctgtatttaggaacggagggagtatgttattacccacttccaggccagtcgagcataaccacaccatgctagaagcaacagttaggctagcgtgttagacttatgggcttccgatttgtttctctgggtgtcatataatccttaatgtcatccttgcatgcataagttggacagcgcatagctgatatatgagtatattctactcttactgaaaagaacgcatatttttttctttcatattttatagtgtctcgatttttttaaccaatttatatttctatgcaaaagcaatcagtattgcaaactcaaataatccggttacaagacgaatctccggcatggctattggttggtgcttgtagacaagctatctgctattatttaaatactttaaaattattgaaaatatcttctattataatatgtgttttatccgggctaatcaaattatgaaactctagtacatatgaattatctcttttggaagttgaatagcttaagtgagaatccgaaaaggatggcaaaaagaattgcaaatgacacaacggccatagcagccacccataacaagtcaagattgtaaccaaagtagctctcaacaaagtcagatacacgcacaccgttatcaaacttgtcatctacatccccaaactgtgaagtaaccaacccattgattgtccatgcaacagggcaaatccaatagtaccatctccaccatattggaattctctgcagataaaaggagccatatttaggaaaactaggagtgaagtttggtagtacttcttaattttttttctagtcttggctttgagataatttggctaggaaccttgtatacattgatatttgagaaaagctagtatacttaactgtttttggtattagaaatccagagaaaaggtgccatatggcatagaaagttgtggaaacaatagaggacatggtgtagtttggagttagacctgccgccatcatgccataaaatgtgaagtatgatagagtgaagtacatgaagaacatgtaccaaaaaaacttggtgcatgtccactcgtatcccatcatagaatacactatcacaccatatatcaaggtttggaggaagatgtaaggaagttcaactacaacctgcaatagaactagatgttaacaaagcttattcatttatcatttctgtccacttaccaagggttttagttttgtagaaattgaacacaatcttgaaacattatatctagcctcatgtgtaaacactatgatgccaaagaaccatacctgccccaaggcatatggcaaaggcgagtacatgtgagatgctctttccctgtaaaagaccgtgcgttcaatattgacaactggttgaactgaagaagagttctgcactcctagagtgaaacatgtggaatacatggaacccatggcactgagcaaggcttgttgactttgcctatgagaaaggaatatttagggtaagcatggtccaatggcaacctttaaaatctgtaaagaaaatcacaaatataaaatatttccttgtgtttattgttatatatatttacctttttctaccaacgccccagaacattgttccaaacaatagtgcaattacaacggtgaagaagaaattcacagcaatatatggaggattcctccaatatgacaaacgttgcttccagaggcaagccaaacattgtataacaaaggtctgtgaatatttagttggaaacaataagtcgcttgaaccgtcatggggtgtgcttaactcctttatcaaatttttgttcctcctgtagggaaaacaaagcactaatatcatcaaacaataacattacctattaaatttttcatatatttgaaacattcattataaaagtgtaaattgcagatcttttgaagcatctgtagtttagcattatgatatcatcacaatatatgattcatgtagggatattttttgcttttgccactaccttgtattgttatttcatttctttactaatattgaaaaaaacttatattattgttttttcagaatatcatatttgtaattttagttgtttccccagcttgttgaaaattgtttagacatgcataaaaggacaccattgtcttctcttttttcaacctatacttaagtaactaatgatagaacaaagtattttctacataccacaaacatggacacatttatcacatataccattatggaaccagacatcttgcacatcacacaaagtttgattttcatctaggttttctgttgctggagcaacgattaaaggtatatagtcagactattaactaaaggatgaccccatccctacctatatagttcagaattcttgtatacttgagtaaagttaaccccagttatctgttcctgcaatgtacaagtcacttccagcatccatgttgaaggattgtagccatgttttatcttcctgacaccttcaatagactttaaaaatgaaagcagttcaatagcatgtttctgagtgcaaaaattcaagcatgtattacattatgcgatttttttctaacctcaaaatatttgatcaattcacatgaatgttgtcctaatggacctacataaattgcttcacctcctcttttcattaggaagagctgtaaatatgaacaataccagaaggaattgagtgggatgcaaataatgttaatccaccagtgatttacttttttcttgtatacccattaaatctgtgtgagaaaatgcactatattgctataattttgttcacctcatcaaatgattcaaatatatcaatactaggttggtggattgtgcaaacaacagttcttcccatgtccacaatattccttactgtcctcatgacaatggctgctgctcgtgcatcaagtccagatgttggttcatccatgaatatgatagatgggtttgcaactagttccactgctattgttagccgtttcctttgttcagttgataatccactcaagccaagcaatccaaccaatgcatcttttaagggaaagagctccacaagctccatgaactcatcaataaatctctacaaaccaagcacacgaaaaaagactagcatgtcatgtcatgatacgtacttatatactacttgacgttcaaaaaagtgtttctttcatgtctaacctttcttgccatagaatcaatttcggctggtaatctaagccatgctgagaacataagggattcatagacagttagatttggtgaatggatatcattttgttcacaatatcctgaaactcgagaaaatgtttcttgcttcttcggatagccagatacagtaatattaccatgtatgtgtccactggtcttcctcccagctaacacatccaacaatgttgtcttgcctgcaccactgatacccataagtgctgtaagcactcctggcctaaatgaaccactaagatccttcagtagttccaaccgactccctgccataccctgtactttcagtgcctacatgttttgttggataaagacaattatatatggagtttgctcataaatgttatgtttataggcgatttatagatagaacatgcatgtcaagaccagacaaaggaatatttgtgtacctttggcatgtctatactgtatcttatatcttcaaatgtcatgtaaacgggtacaaaaggcaggatacttcctttcctggctggactagaattatgatttgcattgcttgaagttgcttcatcattgttgccaccctcagtgtctagtagacataacacagaagaaagttatataatttattaaattaaatctcattgtgatatatagtattttatattggtgaatataaaattacatcttttatcattggtaactcggcctccagatgatggctcttgatcataaccggttaaattttctagttttatctgcaatgtttcctgagacatttctcgcacatttcttttaagtactgcagagaacatggtgcataaatttagaatgtatagcccctttttaaaacaacaatagcttttactaatataagaaattcatttttttctctaactcacatgtgagaattgagaggcagatggtgtagaggatattgaacagaagcacatatccaagcaaggcaccaagaccaatccaataccatttggcctccgggaaaaccccacgagattccagaactaaccttccaagtggttctctaaaaccaggtagtgcctgataacaaaatgtttttaatggacatattatgatatatggatttcgattgattccataagtttttttttacctcattccagctgggacttaggaattcatttactgctaaggcatttagtgcatacatcaggggtgatgtccagtactcccatatcagccattttttaacttcatctgttaaatcaaacaaacatatcatacaatatgtatacaagtaccaacacatgtggaaataatatcagaagtaatgccaatatcatgtcgtgttttgtcagatagtttgtgtacctcttgataggatgaatccgcttgaaaccataactattagtatacagaattcactcacggtgcttgcaacaactggatgccttgtaagagcagcaatgaaacggaaaagtccacatattgcctcggacattacaaaaagcacaaggaattgtctaaaacatctacaagattgcattgttttcattaatctttgcaatatattcattacaagaatttgtccgatgtattgaattttgtttttcttacctctctatatttggatcaaatccaataacatagtatgttatggagacccaaattattgtattaaggaaggagattggagtcttaatgatccatgatggcaaggaatatgtccatgctggatagaagagtagatccctttgcttgaaaaaaactgggagatttgcaagagctgctcccatttctgccaaccctttaaacattattgccaacgtaccaaagaactgcactcccatgtacatcctcccgttttctatcgagtcatgatgcatatttgtatggataaagacactcattgcaattatcgccactagtgttaactgaacaagtcaaagaaataatgtaagagaggccaattagcttcaattgttccaaagaaattgtgggttgttttgctataatataatataaaatgtctcagattgtcagaatcacctgaagtgcattgaatatatatagaaatgattttcttttcaacagcaatatctctctgtcaatgttagctttaagtatttttttcaagttgacaccatgctttgatgttttcagcgctgcaatatggctcttgctgttatcaaatgggattgccaactcacttcttattgcctggccgacatggaaacactgaaatgcctcggcaatcactgtaacaggaatatatcgatatgtgtcatcgccatgtatccagtattgtttctgatctttccttgatgtaacctatcacatttcactcatatttagtaacaattatacactgcaaccaaatttaatcatctgatactaccatgattgaacatagtgagaaaactcacttcttgcaagaagtcagctacacctattctttctaggcatttgaatcccaacgatttaaagaactcaagcacatgatcacgagggccactatagacaacttgaccatctgagaggagaattatatcatcaaataattcatatgtctcgggtgcaggctgtagcaaagcaatgacagctgttccaccaagaacatgaatggtttgttggatggtgttcactatctggaatgttgttgagctatcaagtccatttgatatctcgtccatgaaaagagctcgtcctagtgtgacaagcatctcagctgcagaatcaacattaggggctgtatgagcatccaaacatcttaagtaaatccaattctaaattacctgtagttagtcaccttttttgccctccagatatgcctctcaacatattatcacctacaattgtgtcggcgcatatatccaaccgcaaaatcttcaaatgataaaaaaataaagtaaaagaattattatcgcgtatacatgtgaacttacacatgaatgagaagaaattttcaacagataattttttttaccaggcctataagtagggttctagcagtatccagggacaaagggtggtaatttatttacctcagggaggtagtaagtttttagtggaccaaatggtaggatgaggaagcggaatagaaaaataagaaaagggagggtgctgctctctgagacacgctacatattatgttgttctctgaggggcgttctatagcattgtatataagtagatagtgctcatatacctttagtatgtgatttgtaactatctcagctttctcctctcctgttgtagctgcctgcatatgcaaaatgagacattgatgttcatcaaaccttatactggaacattaatagatggtaaaaacatgaagagattgctcaacatactggataaggtgagttgtgatttaagaactccattgtaccttcaaatatatatcagtttcaggatctggtgtaatgttttcttcctcttctcttctcaatagttctagaaacagatctgaaaattttccataaaatgttagtttttcatatgatatgacactatgataagtttaaactccccatttcctgtcttaccatagtgatggccaactccttgacactttgcagagaaattgattgtctcacgaactgtcagttcagccatatgcagatcatgttggctaacataagctgcggatctttggggtataaatttgtccattgtatgcccattgtaagttatcatccccgataccttttgtaattgcattgtagtatttccttatattagtacggcaagcatactagattatatatactgaagacaaccagtaggccaaccaagtagcatggtaaaaaaattgaaaaacataaatgaaagtacttttacggttgatgggagtgttccagccaaggccaacaacagtgatgtttttccagagccaggagaacctaatagcaaggtcattctgaaaacagcaggataaaagttatatatagcatcgagataatttagacattgtcaattgctgagatgttatgacctgtgaggcttgatgatcccactagcattgtgaaggacagatattttttgcttacttcttgttgtcatgtgaagagtattcgccaggccctgtttagaggtgattgtcaatttttcaccatgtcactacacatggaatatagtaaaataagggagccatatgcagtaaatatttaggctgctgcaaaagtaatgtcatcttctaactaaaaacaatcgactatgcacagattccttgagttagagctacttgaattcggaagtaatggctatgaaccagtatttggtgtggggcgcaattttattcaaattggtatacgctggttctccaacatacagataggtattatttttattagaccttatttaccatctttatacctcttgcttcatttttttttcttttacattcattgcaactgtattatctcttccaccattaaaaaaaattgcacttctctcctttatcattcttcctccagtgcatagttttgcttctccatcacaaaaattctaacatatccaaaaataaatatacgtgtcacatgaattatggcttagctttgccataatccctaggggtggccgatatttatactcgtaggtcctttgagttcctcagcgaccttgctaaataattgaggctaatcagcttgtgcgaaggctcttgtctgactaggagtaagtactcttccttaatcagactctgttaccttgtctgttgcacatggccgtgtcgctaatgtttaggaactgttacaagatatgatacggtatatgtatttttggtatggtatatgtacgccaatacagtataccatatggagtagacgatcaccaccaccaccaccatcatcatcataattaaattcaccatgaaaatgatttggttcttaaatgtttcatgagataatatttaccgtggaattatgtgcatggatattattaaatatttgtggaaaatggtaaccatggtatatttatttttggatatggtagaatattttccttttataaacatctaattttgaaggtacagaggaaacctttcaatctaactgagaattttcctactgttgtatgtgatgtaaatttatagtgaagctatgactataacttctgttctattgtgatacggtattttcgaggttgtattcatgtagttcaacttttgatattttctagtacttcagtggtagcgatgtttttttttaattgtagctctagcatttcaactccatgtcctgaaaaaaaaacatggttgcggaaatggtttgagtatcttttccaatcatgttttatccctacctcctggtacctgcacctactcaaggatggtaaaaagactccttttattaataagatagtaagtttaacaaagtatgtaaataccttcaatatgttggcataggtattgagaatggtgggaaggcccctgctgccaacatatgactctgcttctacattcaggttcttgtacctcacctcaattgtcggcagtttaataccaaccctgtacaaacggaacatctttaaaattgagaaatggaaataagtttctaaatgaaactagcataattgaaaacattgcttttcccttatatttaagcatgcttgataaaataattatacgtgggcacgatatcaaatgaacacaactcaaaccatgcacacatgcacaaactccagtctaaccatccgatccatgatgggcgctcccacctcgcactaacatgaaatattgcaaaaagaaaaaaaccgcagagggaatacattttgcaaacaacctctatccttaggttcatatatcgacattgtcatccacacgaaatatgagcacgtgtggtatatatgatttaaaccttagacctctcactgatccatatatatccttcatgccatctcacctgtgaagcactttgtgactaggatcgatgctatttttgttgacttcacctctcttctaaactagtaacacacatttggcactttaaatgacattaaatgaaaatgtcgccaactacaacattgtaaaccttgttgagctctacaactatgacataaagcatgtctccataaaagttcatttgaaaaactgaaaaacattttttaaatagacctaagatattataataaatatttgtgccgtaaatgatctcaaattaaaaaaaatcaactacaaattttcatataaaatttatcatcatgtgacttcatatgaaaagttacaattttttcatgaaataattattctcccacttttaagggcgattttattaacacatccatctttgaaaatcaactttcacaggcttttccttatgagaaccacctatattgttcttagaagtggttccttaataagtccacatgtgaaaagatatttccttatttgtttgaaattgaccgattgaggtgtacaaatttcattatgatctttaagatattctctttattaaagccaggtccatatttcttcaaaacatttcttttaatattaatgaatgaccctactaaagaaaatatgaaccagctagttatattaaaagtgtcgacgggtttggtttgtttggaggatgtaggcatcggttggtatgaggatgccaaccaagttgtaaagtgagtaaggagatagtgatttttatacaggtttgggtccccctactgacgggtaatagcactactcctattgaccggagccgatgttgcctttatatatcaatctctcgtgaatacaacacgaagaaaaacctaatataatctaccaatatatgtgtgtgaagctcgttcatgtggtcgatggctagctattatcggttttcttgggaagtaactttttgagattggaggtggcttgtattgatttgtacctctcacgggttgtcttggctttgaaggcttgtgctggcctcgtttcatgtccccctcatgagaccttgtatttataccctcaggtgtcctcttgtctaagtaaaactaaagaggcaagtttagatacgatccatgttacttcgagggcccaaataggactcaattcttttttttcttttttgagattcctttcttattaactcaggacttttgccatacgtacgagccttgattccataggaagacttggtatcatgacttggtatataggtgtcgccaatcttggtacacaagtatatggtatctcatatttcgaatactaacagaaatgtaaaattataatgttctcacaaaactttggttcacctcaatcaaatttcaaataaatcatcaatgtttggacatcgtaaaaaactcactagtaaaagtagatattagagcttgtaacgaatatttagacacttaaacaatctcatatgtacaaagttgtaaataccgttgtcctctacaatgttgttatagattgcatatctccattcaaggttgtttggaaaactcaaaaaatgaagcttttaataaatatctggggcctaaatgatctcaaaagaaaaaccagttgaaagttgtagatagcattgatagccaatataaaatattatgtaatccaacttgatatgaaaaagttacaagatcttttttaaaaatagtattgctctcatttttcaccaagtttaattttgacttctacaagattctgcattgccggtaaaaatcaccccacttccaattaaaaaaaaagacctgtatatacagttttcttaaagacttgaaaattgcttcttatcgagcgcccaatccggcgctgagagattgggcggccatatactcagcgcccatatgcaacactacaagaagccctccactgcgtggagttgtgctcctcctcttatctactctatttttaacatttgaaacgatctttcttctaaactgctcatgcgatctagttccaattgcaccatcgtatttcttacaattaaatctttaaaacaaaatatcacatgattatattctaataaaaaattatatatgtttcatccattgaaatttaatgtttcacgcgtgatagttggatgttttagctggaacccgactctgttgcacatttcttagttctcaatgttgcaacgtgtatttttctaatgttacacttggtgttgttacaatgtttgagtaaatattgtttgatatttcattagttctttgcaaacgtaacgtcctatttattagatgtttcagcaaaactgaattttgtttcaccgcttatagaaaattgttttagttcagcgtataaaatgtttcaaagaaatgcaacattaataaaatattggctgcaacacaagcaaccacttatatgaagtattgagtcccaaggagtgaaacattaaaaaaatataaaagatccatatttgcaaaagcttgacattgttgaaacatttttatgtcatgtgtgaaatgtatttgttcaaacattataaaatactgatggaaacattaaaaaaacatcatgtgcaatatttgaggtcattgagacatttaaataaaaacaagtgcaacattttaaaaatccattaaaaaagctaaatagtttttaacgaaatataatcaggtgcggtcttattctaaagatttaattgcaactaatttaatggtgcaatcaaatcataaattggatgattattttatgagaaaaaatattttgaagtttgaaatattttgctaatatatctcttgggcagtgtgcagatctaccaccctagtacactataagagatatgaccttctgtgactaactccttgtgacattggagctattcgccataatttcattttgatttatgacgttcagctatgggtagcgtgactttgtgacaaaaatgaggttttcgtcatcgagaccaaggacaaatcgttataaactagccaaacagtgtatcgtgacgaatgttgttttgtcataagaggctaaccagcaaacgtcataagttaatgacaatgtttgtttgtcataaacatatttttattaattttttaaaagcaaggatatttgaggcgccacttatttggcccaaccattatattatgaagtgaatgccaataatatgaagttttttttcccggatactattgtctgaaagtggacattcaactcatgtcacacactaaaatttatttaatttaatatttcattaataattattacatttgattttagaatcaggaataataattattgacaagggcaataatttaacaagtgaagttgatatgggaaataaaattttacctagtaaactatgacttggaagttttaataatttatccataattaattatgctctcttaaattttcttgaaatgttcggagctaaagaattatttttaataatactaacatcatttccgtcattatttaaattgaaaaaaaacatttaaagccatcttcctatatttgggccaaaagcagcccagttcctacccatcactgcgcaggcttatagcccagccagggaaagtctatctcgtatccctcctttctcccctaaacgtaagccgatgagtctattttacatcattcaaccaaagttcagttttagtcacttcgccagagtaggaagcagcagcccacactgccagccgcagccctgctaagtctaatcagcctctctcccctctacttctaaatttgtaatgcttatttggttctctaaatgatcttaaatgaaaaaaaatgatcaagtaaaaagttgtagatctagccgatctctattacttttatatagatcacatcttcatctaaggtcggttgaaacatagatctgatattttgtaataagtctaagatgttataataaatatttgggcctctaaacattctcaaatgaaaacaatgtcaactataaacttttagatctcgtcaaaaacctacaattttgatataaagttcatattcatccgactttatatgaaaaagttactccctccatttcaggctataagacattttgactttggtcaaaatcaaactacttcaaatttgactaagtttatagacaaatatagtgatatttataatactaaattagtttcattaaatcaataatcaaatatattttcataataaatttgtcttgggttgaaaatattttttttctacaaacatagttaaacttgaagcagtttgactttgatcaaagtcaaaacatcttataacctgaaacggagtgagtaggtgcatatatatttttttttcaaaattttattgtgatgagacaaattgggatgaaaatgcaaatgaatataatataattgggctgaaaataatttgtaaattgctatgccttaaatgggcttggtctaaatctaactaggtttataattgggcttggctcataaataggttgcttactataaggccttcgatagtctatgatgtattttatgacgttttctaggtttgataatgacgaaaatgaacgtcataaacttaatgacgaaagaaggatcaacactagatcaatgacgaaaaaagtaagttttcatcatagaacatgattagagacgcatgataggtgacgaacgaattttcgacgtgattgtcacaaatttttaaacgtgaaaaattttgcagtttgtatgacgtaaatgaaacgtcacctatcataagatctcttatagtggtagccaccctagtagctactccctccgtcccataaaaaccaacctagtactataaatctggagatacctctatccgaatttactgtactataatgtgtcacatccagtactagattcaatttttttttggagagagggagtacaccctagcagcctagctgcatgtagaaaagtcgctagaaaacatgcaaagtgccttcgattgtgcatacagagtcgatcggacggcatagacggcgcctaatttatctctccaattgggcccctgacgggaagttgcttcataaaggcttgccttaaaaaagataattacccttggtggttcccttggaaaaccgtttgtgcaaatatatagatttccagaggtggttttctaagtacaaataagttttcacatatggtctatgaacttaaaagcgacctccgccatctttctagctggtttttcttttaggccacatgtgaaaagaaaaagtctcgtgcgttgcgaaaatcattttttaagtagtgcaggtcctccactacgagtctactccttgctgcatatagtttgtgaaggcgatggggatcagagctttgctgctttaagatttccacatgacagatgcggtgcaaattaaccaagtaaacaaacagtccactataagatcggctaattttattgtggtattcataattaattgaaggcgaattaatttcatttcaacaagttgggattgcatgtgccctacgtaccgatcgaaacgttccttgaacttgtagaggaagcggaggtagtcgtcgtcgccgacgacgtcaccgcctactggtcgccgcagctcggtgccctccggcatggccggcgccggcagcgccgccatccggcgggctgatcggccgtaggtgagcaggtcatcatcgtcgtcgtcgaccctcccagtggacggcgaccgcgagaacgcagccgccgacgccgatccctcctctcgctgccggtcgaccgcgtagatctcgccggcgtcgacgtcgtcgtccatcccgccgatcgacgtaggccctgcctcgctctccaataaggctcgatctagctagttcatgaccacgggaggaaaggaatgggctctttatatagcgcgcatatctcgaagcaaaaagcgctacgtgtagggaaaaaaaaaattctactcccttcgttttaggttataagacgtctattttaagttttaactaagtttatagacaaatatagtaatatttataatactaaattagtttcattaaataaataattaaatatattttcataataaatttatcttggattaaaaatgttactatttttttattaacttggtcaaatttaaagcagtttgactttaaccaaagtcaaatacgttttgtaatctgaaatttatttagcatgtgcagatatattcctatcaatcactacttagcacgcacgtcggagtgaaagctgttgtagtgaaaaaaaaattgaagagcacgttggtagcaaattaaatacatatatattatatataaaaaaaagatagtcgcgattgtacttaaggaaatcataattaagcattaattattttattgaaaactataaccgtgtttgtttatgattttctttgatataaaaaaagaacacatggttatcgatttgttttatttatcaaagagtgcagatactacaattatatgcttattacaaatagaagatcagaacaggatagcaagtagcagttaacgctatacgttggagttgtcgtacgtaataataataaatagcgggaattgaactagttaggaaatcaccataattctttaataggaaatctcatcgtggatattattttttttcgactgtcacgctggtaaaaaaacctattttttattataagaaatgtatgggcgccggttaagttaatcatcactcatttcttgcgcttataccccaataattaaataattaaatacagttgtatatgcctttgtttgatgtgtgtacaacaccaaagtatactatatgtagatacactagaagtgccaaaacaatgaaatttctacaactactcctttaaacagaaaaacatcgtggaagcatcaatatataaattaaggttataatacaacaattgactgacacgtatgaaatatgcctaagaaaggtagataatcaattgtcagcacatatagtatttaattaacacactatgacatgataaactaaggttatcaccatataacaacatttattaacccagtgagatgctgacgtgcaagctactcccatccattcacgcaaacatggcttaacaagtaactgaaaagactataaggggccggtaagaatgaatctcatcaatgaaagtagattcgtgttctcttaggttataaagagatggacatcctcgttagtgcaaactttgatcgtataacttccatagcaatatgcaatatgtgcatatgcaatggcaatcaggggcggatctacccattaagcagggtgggtcgatcgtcccagctacgacccgtgtcaccccacacccccaagaccctccctacctccttataatagttataggccatcaaaattaggtatatcaaggtgtgaacatccaatagattagtctgtctcttcacaacgcatgcacaccacaaacaatgatcgagacaattatacgattgaattataaatatgatatgtgttgtgttcgattgcttatcgagtaaacatcttcattctccgccccatctatattttaaaactgcgtccaccacagatggcaatgcaatgatatgtattcacaaaatacatcatattaggccaaaatacgaagttgtaccattatggtcacaaggttcacgatttaactccaaatataattcaaaagtgatgcaatataggatgaattccagcgtaataatattataaccacatacctatataagccaagtataaagttactcttgccaagggcataaaccatagtgtaataacaataaaacaatgattaaggtaagtaacatctcaatttatcacacaatattatcgtgattactgatatagaatttcaaagtgatggtgggaaaaaataacaagttaaaattgtagcaaacaacgccatgtttacttgccttcactatcgatgagacaaactctagttgcgtcctgaagttgaaccacccgaataaacatcggttcagcctcacatgatacacaaataatatttaggtgtcatgcattcacttgcaaagaacacaaaagaaataatcaacaatctgcctatagaagcaatgtagcttaacaattttatttctccaattataaaccacgtaacatatcaaaatatagcatttatgacatttacataacaaaaagtttcaggtacacatggattgatcaagcataactgacaataatcagttccaaaattaaatttattgccgtcctaatattgaaaatctagccatgtagggttttcctacttatttttcttggctactttggacctctttggatctgcattctgctttcgaattatagctctgcccactcttgttgctgtgttcagtggaggatgcacttcttcactcctattggtggcaatgaaagatgactcaagcaatgttccaggaaatgtcgtagcttgctgttgactgatgccctattgcagataaattgataaagagtttgtgcaatttaggttcggtaagaattgtttacaacacaagtgataatgatttacctctctaataaatgcatcaattacaggagagctcctttgagtgcttgtgccaaggaagcatataggatcagtcaaaagctgtcgtatcatttgcacaagttaattgttcagttgcatagttagtgtaaaatgataatctcttgtacctgagtgatgacaggttcatcaacctcttcaacttctgttgtggattagtaataatctatccccaaaaattgatttttgggttttctaaattgaaaataagaagtgaaaaactcctccctccaagagatagcctaatttcaatcccaaaaactaaatgtgggcccttccattaaactaccaacaaaaatttccgttctttttccttccacgcgtgcatcgacctaccaacagaaatttccccgctcatgcgggaaggagaggggaagcgggagagcagaaacgcacgaattagagaatgggagtcgctctctcgccgttaaatccacagaacgaaatatatggggatgagaactccaaaactagtagagggattttgaggatatgttggatctgattttttcactaaaaaaccctcaaaatcagttttgggaaggaaataggatgactattggtgatgctcttataaacctaacatttacctacggtacatctaagaaaaatcctacagtcagaaaagtttaggtgatccactgtattatactccatccattttacactataacacattttaactcatcagatcaaactttcttcggtgttaactattttattaaaaaaatagcaatatctataatatcaaattagtttcattacatctaaaattgcatatagtttgatactatatatattgtgttacagtttgatataaacttggtgaaagtttaaaaaatatatattaataaaagtcaaagcattttattttatacaatataaaatgaagagagtatatttcaccaatggtataagcgtccgattggctaatgtaagctgtaactgatgcggtgcaggaaactaatggttttagagggaagctagtgcatggaatcccatggtattatggaagtcacgggataattaaaacacccaaaaggtttaatctgtcccccacgctgtccacgcgatttcccctcctcccctgccgcttccgaacacgaaacctgagcagtacgccatcaacagcaaaacaaacggcacaccgccgtacgcaatacctcgccggcggcgctcacagccgcatcaactactcagagcaggagtgcgccatcgacagcaaggaactggcgcgcctccacatgcgataccttgccagtggtgcggaacgccaccgcatcaactactatgagcaagattcgccgtcgacagcaaggaaccagctcggtatcgcgcaccgccgcaacaactacaccaagcaggagtgtgctgtcagcagcagcagggggtcgagccaaggaaaggaagaagaggagacaaaatgttggtacttgatacttgatacttcgtaagtatcgaccctggtacctaaggtatcaggtctcatacctaagcttgatacctatcgtaccagccatgatatccgcaggtaccaggtctaatacctaggtatcagccatgataccaaaggtactaaacatggtacctacaggtattgattgcggctgatgcattgcatgacatacctgcacacactccaacgaggagcatgatagctcaccaagacatcgtagctctgtgtgacctgcctgggagaagggtgcggtcgccgcgtccacctcctgcttgggcttcaaggcagtggtgatggcggcgccatagtacgaggcgctctacgccagtgcaccgctggcgaacaactcggcggcgtcggcccggccaccaaaggagaggatggtcggcgggggagacctgctctgtgatgcacgagtcccagctggtgttgacctccgccaccttccacggccggtgctcccctgctgccgtgtgctggcgtgctgctgcagcagcaccatagttgccgctacgtccacctcgctggcctgcccaaacacgaaggcgatgacgaaggcttggatagagaaaagaaagggaagggataagatcgaacgttatccactcattttaatttatcttgtactgacggaataccgttccacagtttttctgatggttttaatatagaaagaatctattctatgtcatagtttgctttagttcagtaatttatcgtcgacttagtcatataccactgattttatcaattgattgatcgacatattaaaggttttgaaaaaatataaaattctttgtgtagccgcccagctgaacaaggaagtttgtgtatatatttcaagatttttcaatttgcatttatttttattattaaaatattatttatcttttatatgctaatagattacttttctgttgatattcttttatgtaaatcatttttcatatgctacaaaaaagtatatttttagcattttagatatttttaaaaagtatacaagcccaatgacatgttgttcaaacaattgataatgtcaatagatatgagggggggggggggaattaatgtcaaaattttaaacttgagtaaatccagagacatagaatagattatatctttaatatatcacttggtaataagttgcataaatggctaattgctatatctttttctttctaagaagatgtagagcaagttgaaaatcacaattggaagttattttacaatcaacataaagtggctactttgttgaaactcacgatagggttatttatcacctttttaaaaaaaagaatatgcgggtgtacatttgttctatttaattagaagagagtgctgacatactccaattacatatatgcttctaacaaaatgaagatcacaagtagagatagcaaacatcactggtaggatggagttgccgtaacaaaaaaaaaaaaacaatagcaggaattgtaccataaggcaatcatcataaagtttttttttatttttttaatgactcgtaccagacagtgtaaaattcatattgatagagcaggaaaaaaattacaagattacaactttgggaggtcataaccacgaaaaagaaaaaatggccaccacccacacactgatagcaccatcacacagaccgagaaggctagcaccaaaccgatcaccgctagaccaacaaatacgctacaactgggatcgcccaaagaccaccctagcaaccaatacaaaactacactctatccacatcttttttttaattgaaatctcaatggtgattatttctgattttttaaaaaatatagctgtagactatgtgttactattcatttccgattatgtttacccgaatcattattaaatacagttgttttcttaaactctgtacgtgcccttgttacatactccctccgtactcgtaaaggaagtcgtttaggacaatgtttaagtgaaaccttggaaaaataaatcattaataactcttaagttgttaagtttgaaaatataaaaattatattaatagatttgtcttgaaaaatactttcataaaagtatacatatatcacttttcaataaatatttttatagaaacaaaaggtcaaagttgtgttttgaagactgtgtcgttgtcaaaaacgacttcgtttacgagtacgagggagtatgcctaaaaagtgaggaaaatccttctgatctcagttaccaagaagaaatatctttctgttacaaattatttagagtctatcatgatgtgaaatcctcttgatccccaaataattaataattatctaaggcaccttttgcagcccaagaattttactggatatctttaggatttagtttaattgaacaacatgctcaaagtccaacggcctagttggtcagtctagttggtacatgctttttttttatttggaaattaactcatggtccacgtgcatgttgctacgtcttcccttcattaaatgcacattatagttttgttgcaaattcaaactgcaaacgatgtagtagaactttgtatttattaactgtaaagttcaaaatattattatattaaatttagatggcttaaacctaattgggcattgccaagaaaagatctgcccgttgattggttggaatatgttacaagaatgtatattgaaaataaaacatatcatcgtaaatatgctgtgctttttagtttttatttggtatcccactgagctaaaaatgccattggaattacatggaatatttagttttatttttttcttataatttcataattctagcaatacccattttatatatagatggctgagatgcagctaggtttactgtagttgcacttaacctgccattttcatgtaccgaattttggtcagttttttggatgacataacggtggttgacgtggctacgcgcgtgttctcattgtgcaacaaggtacacactatgacaattgtgtgaagcatagcgtatgtcgtctctcccggcacggcagggtgacgaaaaccctgcagggtatagttaccaaagtctcgtcacgtcgctgtatcaagagaaactctgatcagaattagagcatcagcctacaaactgatctcctcactggtctgaatttttcctttctactactttcaagacgtcctgtgcgcagagatcggtgtgcggaggtcaagtaaccacagtaggatacagtattttttttttctcaatccacccacctatctaattcctactccctccggttccatattaattaacgttttagagaaagttgaggtcaaacttttataactttgactatcaataactttaaaaatatttagtttaaaggaactagaacaacatatatagatttgtcttttaaagcgctataataaaagtaaacatgcatttatttattatatatattatagtagaaaaataaggtcaaagatatatcttgtagaccgtgttattatctaaaacgtcaattaaaatgaaatcggaggaagtaattatatggggtttagctcagtcaatccctaattaaatgggcacaacctgtttttcatactcaatccacctaccagccaatcaccagttacatgggcctgacctattgtaaagcacaggcatattactatatctttcataagggtcatccttctcctgccacacttatagttcccattcccttataaaaaaaaaccgtatgaaaattcacccaactcatgttttcgtttgaaaatcaatccgaaagacctcatacaaaaactaagccctataatttagttcctttgtaacgcatggatatggtactagtattcagaaataaccagtgtcctagttctcaatccatgcatccacctaactaattcccaattatatgggtttgtgctactaaacggaaaaaacgcccatatgccctagttctcctagcttatataacttatcttataaaaattttctttttatataagctacctggctattttttttgaaaatgggtaaaatgcacctagattctcgacccgcgatatctaattacctaaagttgacggttatgccaccagctgattggtcaatctaatgctcctcagctttgtgtgttccatatataactacctagcattctccgatttatttcgaattttctagttttttgtaatttttttgcggtctctgcagttgaagtgtggcttgatgtttgttctttatactatcgacactggtttcgtctttgtttgatgataggtaatggatgttccgatcagcactctcggtcccagcgagtttgctgattgaaggttcgattagttgggaccagaagtttcgattgaagtttaatttctttactaatgtttttcatgaacacctattctctctctttggctagacagcatcaagatcctttcaaactatattacagaagtacgtcacatataattaattgcaaagtacacaatatcattaactattcagtaatatttctgttacgcgcgttaatattgcttcataatggtcatatccctacgacttttaaaggaaatcgcattggtgcaaggaaaataagttccgcaaaccgatatatgttcacagctctcctcctcctctctcctcatccttctctttcttttctgttcatggatttttgaggaatttaaatgaattttggtggggagaaaggggtttaagggtggggtggataaaccgccctccccgctggtggcaactgctccttctacgggtgcactttttttttaatgtcttcaatatggctccatgggagaatgcactaaatataagacaacgtgactttatggttttagctcctgtacatatcaaaagtcaatatttaagaaaaaaatactcttaaaatacgaatattttccgctagacacacacccattagaatattcatttcttacttaaatatgagaaagaaacagtatgaaaagtcataaataatcgtggtcccatatgtcgattctcccatctatttttttcgctttctccatgcaagttgcggcagcatagggacagagcaagggaggagttatactgctatccgaaactctgcctccttgagctctgccacaccaaactccagactgctaactccaacttctaactccaaactcctacttcagtgggagctaattcctaatggagttggagactcgttgagaagtgtttggctagttttcagctctagatctgaaaaaaaattgaaaaaacaattaaattgaaaaaaaaattgaaagaaaaaaagaaacctagtcgccggcagcccaatcacatggcgccgcccgccgccgccaatgcgttgtggccgcgcgcgccgcccactgcctgccggccttcgcccgctagctcactgcccgccgctcgcgcgtcgtcccgccgacctgctgtggtcgtgtgcctgccgccgccgcctgctagctcgcctcccgccgccgcgcgtcgtcttgccactgccaacaccgcgggacagccccgaccagagcgccgccgccgcgccctccaccgcgacaaccgacgccatcgccccgatccctctcactcctccgctgtcgtggccgaagctacctgccgccgctgctgccgcccaccgccgcagctattggactcgggaggaagatgggggaggagagagaacgggaggagaggatgtgggtagggatagttcagtggcatttttacataattacactaaaaaattaaagggtaatgggtcttttggggtggagtggagcagcaaaaacctagctccacccccgtagtacaattttgtggagcagttctgctaactctgctccaaaaaacggaggatctagactgtttggcacaactccggctccaggtaagttgggaactggagctgtaccaaacggggcattatatgccgatctccggatccacatctaaagtctccccatgcgattcaatgtacacttcctctgccactgcatctcgtgctcactggcccgtttgcgccagccctctcatcaacaccgtgcgagtcgctcatcaatcacgtcattcgcccacacacccaagccagcagtggctcctggtagcatcaagcatgcatgcctcctcgaggtcttcttccaacaccacgttgtcaagtgagcctggctcatcggttaccctttctcaccgactgtactacacagttctcaattcgctgctatacgtgcttgagataatatgtgatagatatatggggccaagggcatttctgacccttttgctatttaattggtagtgaatattatagtagttatggtgtcaaatagcatatattcacattttgggaatatcttccctatagatcaaattttgctatatccagaagctaaatcttgtattaacggtgttgtacggaaaattcgcccaaaagaagaactcctggaggacgggagtgtatattctgtaaactttcaaaagaaatatttttataaataaaaacatatgcgtatacataaataaaaaaaaaactcatcataagaaaatgagaatgggctatgggctccagtttctagtgggcttgctggttgcccaaatggcccaagaactggcctgtgttggtccaggccgtcgtgcacagcctctctccaccggcgagaggcggcggcggcggcggcggcgtgcacagcctctccctcgagccgctccggggcttcatggcgccatggcctcctgcccacgagtaagccacactcccccccctccccccaccctgttgattgactgccgcatctgcttcccctacaagcttttgcttgattattcgcggtcattattgcgcttcgcaaccaaatcgaatgcgccattggagaggaatcagtggccgctgcctaccccaaagttcagtaggttcgtatgggtagtttcatgggctcccgattcgtttctcaaagggatgtgagttttagggattcgactaagagtctaggaggatgtggagcgcgatatatatattttcagtttctcaaggggggcagccagtgcaaaaaactcaatgaaacaacttgttaatctgagtaccatgaattccaggatacacaatgtgctttaagatgtacaattatggtgatacaaatgtgctttcaagctgtacaattacgatgtgctagtattcacatgctatacacaactcgggtatgccttcctcaatttatctcttctggaagttgaatatcttgattgagagcccgaaaaggaaggcgaagaggacggcaaatgagaccaccatcacggcaaccacccacaagaagtcacgatggtaaccaaagtagctctcgacaaagtcagatatacggacaccattatcaaacgtgtcagttacatccccgaactgtgaagttaccaacccgtagagtgtccacgcaacagggcagacccaatagtaccatctccaccatattggaattcgctgccaataaaaaaataggctgtattagaaaaggcagatgctccataagtgaaattactataagacatttgtgaaatattagtatacttacagttcttggtattataaatcctgagaaaaggttccatatggcatagaatgcagtggaaacaacagaggccacgttatagcttggagtcagacccaccgacatcatgccataaaatgtgtagtatgataaagtgaaatacatgaaaaacaggtaccaaaagaacttggcagctgtccactcaaatccaatcattgcatacactagaacaccatatattaaggactgaacaaggatgtatggaagttcaattgcaacctgcggacagaattgtatgttagcagcacatagtgtttcttttaccattttcttccaattacttcgggagttgttcaaccattgtgttatatcctggttaaaatattttatataacccttttagaagcctcatatgtacaagcttccatttgattttgatgctttacatgttaattgagctgctcttttttccccttcaaataataatcttctctttcctatcatacaaatatcaatgctattgtataataaagttaatgtaaaataactttacctgtcccaaggcgtatggcaaaggtgaatacatgtgagctgctcgttccctgtagaacacagtgcgttcaacagacacaactggctgaacggaagaagaattctgcactcccataaataaaactgacgcatacatggagcccatggcattgaacaagtcctgttgattgctcctgcaagagtggagtatcctcagtgaattgtgacagatataatctcaaggtagcctctctaaatcagtggaaaatgttgcatatacatttttacttgtttttattgaccgtatacctttttctgccaacaccccagaacattgttccaaacaacagtgcaattacaatggtgtagaagtatttgacagcagtatatggagggtttctccagtaggacagactttgcttccataggcaagccaaacattgtgtgatgaaagtttgagagtattctgttggaaaggataggtcacttgaaccatcaggaggtgagcttagctcctttatcatacttttattcctcctgtaatgcaaaagagactataatattattgaactgttaacattgactcgtttagatgcttttgaacataaattgctacagtaataatcatgttacacatatagtggcagtttgaagcatttgtgatgggccattcatgatttgagcttcatttatagtccatatttttttcacaaacaggctcatcttttccatttagtgacttaccctcttgaaaatagttaagacacactgaacatgatactgatcgttgctgccttaattttccaatataaaattgcggagcttaaaatttgcatggtctatagtcaaaattatcaaccatatggcaaccaggtacttacctgtacagttcagaattcttgtatatttcactgaagttaaccccagttatctgttcctgtacagtactagtcacttccagcatccatgttgatggattgtagccatgttttattttgctgacaccttcaatagactttagaaaatgaaagcagctcaattacatgtttttagagcaaaaagtcaaattgatggtaacatatataatttttttacctcaaaatatctgatcaattcacacgagtgctgacctactggacctacataaatctcctcacctcctcgtttcatcaggaatagctgcaaagatagtataagtatgtattgaaagagtgcatcttaaatccatgtgacaaaagaagtgggtatgatttctatcacctcatcaaaagattcaaatatgtcaatgcttggttggtgaattgtgcaaacaactgttcttcctgtgtccacagtatttcttattgccctcatgacaatggctgctgc

SEQ ID NO: 29431 - DNA, 23327 bp, Oryza sativa
  unsure (1)..(23327): unsure at all n locations
gatgtcattctgctcacagtatcctgatacacgagcaaaagtttcttgcttctttggatagccagagatggtaatgttaccctctatgtatccactggtcttcctcccaccaacacatccatcaatgttgtttttccagcaccactgacacccataagagctgtaagtactcctggcctaaatgaaccactgatgcccttcaatagctccaaccggctctctgtcacaccttgtgctttaattacctacaagtttcattggatattaaagccagttagagttgctcttaagtattatagatataggagaatcttcatactgagcatgcacatttcagatatatttatatttcagtaattctctaccaaatacctctggcatgtcaacactgtatcttatatcttcaaacgtgatggagagaggtacaaaagggagaaccattcctttcttgcctggactagaattcactgttgcatggttggaaattgcttcatcattactatcatccgcagtgtctggtaggcatatcacatatccgaggttgttgttagatggaaactcattatgttaaatcatatttagacagctaaatacaaaagcgaacagtacttgtgttggtggtaattcgtcctctcgaggatgcttctataacatcaccggtcagattagcttgttttatcttcaacgtctcctcagatattgttggctgattgctgtcaaatgctgcagtgaaagaatgcataaaaatgagaaattataaaaatgagaatttataagctctggcattccaaatataatttatttctgactcacgattgaggaatgtgaggcagattgtgtagaggatattgaatagcaggacgtatccgagcaatgcaccaacaccaatccaataccatttggcctcagggaaaactccacgggattcaagaactagttttccaagtggctccctgaaaccaggtattgtctgcagtacagcaagaacagaacactttagccagacattcatataatggctgttaatcgatttccatgagtattttttttaccttgttccagctgtgacctagaaattcgtttactgatatggcattttgtgcatacatcaggggtgatatccagtatccccatatccaccatttcttcacgttctctgttcaatcaaatcagcgtccattcattatttttttgatgtggaaattatagaggaacataagcaatctgattgaagaatatagataatttctgccttacctcttgacaggataaatcctcccaaaagcataaaaatgagtatacagaatgaacccatagtgcttgcaacaacctgatgccttgcaaacccagcaatgaagcgaaacagtccagatgatgtctcattcattactaaaagcagcaggaactgtctaaaaagcctgaagcattgaattatttcattagtttctgcaatacattcataccnnnncncaatgcaatgtggaattttgttttctttacctctctacattgggatcaaatccaatgacataatatgttatgaagacccatattgttacattgagcaaggagagtggagtcttaatgatccatgatggtaaggagtatgtccatgctggatagaagaggagatccctttgcttgaagaaaacagggagttttgcaatagttagaccaacttctgccaatccgttgaacatgatcatcaggatcccaaagaagagtgcgcccatgtatattcccccatttgttattgagtcatgatgcatattggtgcggataaagacagtcatcgcaatgaatgtcatgagtgttaactgaataagagagaaacaacacaaattaaatttgttatcggcttccatgttttttcttaatagaaacctgtattgaaaagtttcggtttcaagaataacctgagttgccttgaatatatacacaaaggagttccttttcatgagcaatatctctctgtcaatgttcgctttaagcagttctttcatgctagcaccatattttgatgttttcagggcagcagggtggctcctgctcttgtcaaatgggattgccaactcacttcttattgcctgaccaacatggaaagactgaaatgcctctgcaaactccttaacaggaacatatcggtatgtctcatcaccatgcatccagtattgccgctgatctttccttgaagtaacctataacatatcatttatattaattcaaactcaaaagttgcactaaattatgattgtagcatttaaaaattctctagaaagttttctacattgtcctcttcttttaatttctattttttcttaagcgagaaagcccagtgtaagaaatattttcaagtccagtataagaaatattttcaagtaatgctacttctatatccatttcatttgaaacaatattatatttgcatagtttactttgtcatatatgtccagtcttgttctgtaacaagatactgcattttttccatgagatgtgtcactagaaaaaagcttgataaaacatgttgagagaactcaattactcacttcctgcaagaagtctgctacgccttttctctcaggacatttgaagccaactgattcaaagaattctagcacatgttcacgaggaccattgtagacgacctgaccgtctgagaggaggattatatcatcaaacaattcatatgtctctggtgcaggttgtaacaaagcaatgactgctgttccaccaacaatgtggatggtctgccggatggagtccacaatattgtatgttgtggagctgtcaagtccagttgatatctcatccatgaaaagggctcgtcctggggtgacaatcatctcagctgcaacaccaatttcagggtccgggtaagcagtgaaccttgtatgtctgcaatatgtaagcatctagtactttatttgtaccaaagatacattacctgtggttactctctttttctgcccccctgatatgcctctcaacatattgttgcctacgattgtgtcagcgcaaatatccaatcccaagaccttcaatagttgaataaaaacaagaattgaagaattagtatcataaacacctttcattttgtataccccctgagaacatgggagaaacatttgttgccattgaagtttgaatggtgatagctaacgtaaattatattagaactgtatataagtagttattgttcatgcacctttagtatgtgatttgtgacacctcggctttctgctctcctgttgcagcagcctacacaagccaaataggaagttcatatgaatgaagctattctctgaaacaattgtagatgacaaaaactaaaaatcaacaaaatggaacaacttgtgaattaaatgaattgtgatataagaactgcattgaaccttcaagtatatatctacttctggatctggtttaatattttcttccttttctctccttgatagttccattagcagatctgagcattttttcagaaaattgttagctattccatgtgacatgccattgtccagattttttttttcatttttctgtttcttaccgtaacggtggccaattccttgacattttgcagagaaattgactgtctcacgaaccgtcaattcacccatatgtagatcatgttgactaacataagctgctgatctccggggctcgaattcatccatggtatggccattgtatgttatttgtccagataccttgtgcggttgcaatgttacatttatactagtacttccaagggtatgataaactgacaaagcaatgtactcaagtaaataaaaagaataattgagtacctttagacctgaagggacatttccagccaaggccaaaagaagtgtggtttttccagcgccaggaggacccaaaagcaaggtcattctgaaaacagaggtataagttaacatactgaacaaaatgaatattatctggaaactggcaatatgctgggaagttacctgtgaggcttgattatcccactgacattgtgaaggatcgatattttctgcttcctatttggtgttatgtgaagagtgtttgccagaccctgtttgtatggaggtgattaacaccttgtcagtgcacatgcgtggacagtacaagaagggagtctgatgtcatctggtagatgaatgcaaacaaaaagtgtactgtacattcatgttttacattcacagttccttctgttaaactaaaaataaatttaatttaacttgatatccttgtttatgtgttatttacatccttgctgtagatattgtttaggaggtctactgatgatgaattctgtatttgcagagccctatgtttggagtaccaatcaggcaagtctgctgtttatcaagatgtccaagagaagtcgtgttaccaactccaaccagagaacctaatctcgttgctcttcaggatcaccggtttgactgtcttaacagtggcccagaattttgctgcactacaggaagctctctagctaacacgggcgattgtcgtaatcaaaattaatgacaagcactgaatttgtttttgccaactaagtttcacaaaaccacagatatattgactaaattaacacaaaactacagattgatacatcactttaattctgtagttttatgatatatcaccttaaatctgtagttttgtgataatttgaacaaagtatttgtagttttgtgaaatttactaattttctcctatcggtggatgtaccagtttgagttacgtttctattattgcaatagaaagaaaactctgactagaagtaccctctctgaaaatagtcaacgagaccaatttattttgacgtctcgtagcatattttattgagtattgactgtgacactttggcattactatgcaaagctcaagcacgtaaacacatcagggtaggtaccctgtacaccaatgaaaagcgggcaaagtgttcagtttattcagaaaactgcctactgctgaactgtgagtactctaaaaccccaaaactaatctgaaaaactgaacaatctctgtaccaactctcatcatcagccagattagttggcgaaactactcaattgtttgtgattagttaccacaacacatgatgattattattatagactgatgatatagtacctccagcacattggcgtaggtgttgaggatggtgggcaaacctctgctaccaacgtacgcctccgcttccacattcaggttctcgtaccgcacctcgatcgtcggcagctcgatcccaaccctgcatgcgcgcatccatcaatccaaaaccatcaaaatcactctacacttatcatgatgtgacactaatttggaatcacgcgagagaactttttcgaatttttggaaatagttttttcttcgtctgaactctaaactgaactgaggagggcggaatttgaaaaagaagaaaagaaaaattcgaatctggtacctgtcgacgcggtccttgaacttggagaggaagcgggcgtggtcgtcgccgacccaggcgaggcgctgcagcagcgcgtgccgctcctgggggccgaggcgctgcacgttcacctcccggagctcgccctccggcatggccagcaccgccgtccgcgccctgtcgtaggtggggagcttctccagcgccgcccaccgcagcgcctcctcgtcgtcctcatccctcgacgacgaccgcgagaagaacacggcggcgtcgcccgaccgcgccgacgacgcctcccgccgcaggctgcccccgagcgcgtgtatctcgccggcgtcgtccatcgatcccgccgccgcccgccgccggtgagagtgtgagtgctcaccggcgcgacgcgtcgaagaagatgagatgagacggcgcgagaaaggagatggcggatttatactgatgatggtgatgatggtgatgagagggagagagagagttaaaaggttaaaacggtatgatgatgacgtgggccgtgacgtacgacacagcgtgttcatagtttttcaggacaaattttgatttgatttccggtttttggagataaacctctgcagcgacgacaaccttagccttctagaaacaaaacattatatatacgtactccaaaacctataaatagatccccgtttgtttcttctatcagcagaggatataattttggatactcatgatacgcttttcaaactgctaaacggtgtgttttgtgtgaaaattttctatatgaaagttgctctaaaatatcatattaatctattttctaagtttgtaataattaaaactcaattaatcatacgttattaccacctcgtttttttgaaacacttaatctttattttatcttcatctttagaagattcaaacaccaccatatattctcccgctgcaaactctatattattttccttgcaaaggattgaaaatgaggatacaattatcccaaatatcacatacaattggtttttttattacaggaaagaagcaaacgtacacatatcaccgtacataaaatacctctaaacacatactcaaaataacgaattaacagcggcaacttagccttaataaaatcttattaaaagctcacgcatatgtttagcattggtagccaccagattttaaattttgatgggtctagtttatatactagtgacttaccgtaacatatgaacgtctccggtacatatcaattgcaactatagcactataagtaaaattgaactattatcacaggcaaggtttaagcgctactagcttgtagtagtagctcctgccttatttataccttttctataaaaaaaacgaattcctttttagtacctaaaaaaatattgtagtaccttaaagtgtttgatttttcttgcattacttaaagaggttctaattatgatgaaaaaaaataaaaaggttcgaataagctgtgtagtttgtctaacaacttccccttgaaaactaggataaggtcgtaactcaaagctggccatgtttccgtgtttatttgaaccacacgtatttgtaggaaaggatatgaatcatgtcactgcaccttaaacctcagcggctttaatttgcacttactatatgaattgcatacatagtaggaaaaacatataaagccatataaaccctgatcgaacaactttatttagttctaaatatcattttaatgatgcctcttttttgtactgaacaaaatgttcaataaagattcctttacacctaaaacaaaaatcaacaccgacacttatatatatataagtcgttttatcttctcaacaggcccccaccactactatactcatccaactaaaatgtagttgaaaaacacatgtacagtaaaaatgagttgtgcaacatatataatagttcaacaaaactgaggtccattccaattatagtccacaaaaatgcttttctctttcatgcattatagatgaaaatttgtatatatccctgcatctttttaatctttttaagtgggggcagattctgtttgtctcaaaatgaaagaaaaaaaaacaaagaagaaacttttgttccttaattattggagtcactgggtgtctctgatcttgatccccacttcccatgttaattgcttcccttgcttgtagggaagtgtgttgtccaattagaaagggaaagcatcagcaccttcattgatggataaggccaaattgtgcagatttttaatggctgctccactgctccttagcagccggccactgtccaacgagatcaggacacgtggcttaaaatcacaatcgacgcacgaccttcagtcacgtaatatcacacttcgcatttgttactttctattataagattttttgattttttttctaagttaaactttttataattcgattaagtacataacagacatagcaacatttttaaaaaattctattaaaatatatctagtgttagatttaatgattattattatagacgttgctagatttttctataaatttgatgaaacttataaaaggtttgaaataaaaagttaaaatgtcttataatataaatgtaaacggagggagtaggtagcctttcgcataaaaaaaacagtattatatataatggcactggataaccggttttctggtggagtttgtgcacccgtcgttttcgtgccgttagctgcaatcacatcatcactgatgcaactgccactgaatttctttttcataggcttccattcgaatctgcaggccaagagtttgcaatttcgttgagatttcggatagagggtttgaaacatgcaaatcacagggatctgtgtcacgaactgaaaacgcgcgtacgtgaacgctcgcgcaagctgaggtcgcgtgaatgctcacatgtgtaaagctatggctacttaagaatcgacagttgtatggcttcatacggtttcttaagctcgatatgagcatgcacataaggtcccacgtgtagaataaatttttgtgcttgctcaaattattttatatcaaagtaaaatcgcccgtacagtgagtatagtgagccgatacggccgactaattatttattttatcaaaataaaatcggcagtataatttgctcaaattatttatttgtgcttgctcaaattatcatctaatctaaataaaatcataatgagaattgtataatcggccgtatagtgagtatagtgagccgatacggccgactttttctacatgtacatttctacgtggtggaactgcggagttaggaaaagatagctaagttgttgttcacgtttcacttactcaatgcatgtgggatacccaatccatctaatatgtacactagtccaaaaggattttgtaagtatggataaaagtgcagacacaagatatggaccagagtattcttattacacaaaatcactcatatgctctctttatccagccaattcttatacgtacatggaaagtagggtgagattcaattattgtattgggctgatcttcatgggccaaaacccaagtttctcaacatgaacaacacgaatcgtatcatcatatattcatacattctcccgaagctagattttttttcccaaggcaaacaaacagacaaaaggcccatctgtttccttatatcttgttctttccctctcaaatcattttttatcatgtagggaaaaatataattaactgcaatattccccggctgctaagaacttattatatcatattttggaggatgatctggtgttgagtgcacggttgacactgacagtttgttgtaaccttcttcctgttttcaatagataatcttattgacgttttgacacaagttttgattattcatcttattcaaaaatttagtacaaataaaaatatataagttgtgcttaaagtatttttaatgataaatcaagtaaaaataataattacatactttttaaacaaaataaatggttaaaaagtgtgaaaaagtcaatgacgttatcattgaaaaccaagtaacatgtaagatcatctgcatggctagctctgatccagcagtgtactcaataaagcatcttaatatctgtccatatcagtgacgtctctttctgctcaagttcaataccaaagtattgcaatcttcacgtgtctccggacaactataggcgcaattttttttcgttttctttttgaagggaaaccatatatagatgcaaagcatgacgatgagagatcgatttggttgcttgacttcttgcaatattgatgtagtggatttggatttttcgatttaccccacaaattaatcatggtgaatgcatgcgtggaacaaaacttgagatcggcctttcagcgcgcaaatctttggttgatatatgtccatcgaaattgtccagagaggaaaatataaatataaattcttagctaaaataccaatgcgtgagacaacttgcagtttgtgtagctatctaatattttgtcaaaatattacatcatatatttaatttttcaacaatcaaataatttgttcaaattgtacaaatagtcttccttcttgccaaaaaacattctaaaaacaacgcaacacaaatattccccattcatatcgctatcagtccttgtagtagtattttaggtatgttctataccactgcaccgcatcgtacttcacctcccaacaaaacactttttcccctattttaccacccccaaataattactagctaggttacttagttcactatcaaatgatatttcttgcagtggtagtataatttgaaatctaaaatccagtgaaatgaaaaataaaattacatgccccttagtttagtagaacatctgtgacctagttatcgaatataaggaagaatctgttcttaatgaacactgtttatgaaaatttaggcaaacaaatataaataactactaaaaatttgataaattgacccttaacccgtaccaaaacaaatggcaaaaatgaaccgtcggctgatggtgctgagttataacatctcagcgtcaccgtttttggcactgagatccttgctgacctgttcggaactccacgtggaggggggggggtcatataattagagtattgcgcaataatttgtaaacaatgtactggtgttgcaatgttacgttcttttgctggtgtacggtgtaccctagaaccagggttcgaatccccatcaagtcaggcatttttgttcttttttttcttcaaatgttcaatctacgcgcatacaaataaatgattaataatggtctctgcttttgaaaaaaaatatatatacgatactgttcaatctacacgcgtatatattcaaatgttcaatctacgcgcatacatataaatgattaacgatggtctgcttttgaaaaagaaaatgtatacgatactaatcactctgttagccaccaaactgaaagaaaacataggccaatgaacaaaattaatggaaaaatattgttgctatgtcgagggctcgaacccataagtgctgcacacacgattgggcatcacaccaccaagctacgttcgcataatgaatttgatgttccttgcatcacaccaccaggctacgtttgtatcatgaatttgatgttcattttgtattaattagcttgtaaaggggtcagtgccaaatgcattggcgctgacacctagtccacgtggaattccggttagctcagcaaggatctcgacgccaaagatgatggcgctgagatgttatagctcagcgacgtcatcggggttggtattgtgccaacggttcatttttgtcattagattttggtatgggttattttcaaataatttcactaaagcggttaatttgtcaaaatttcggaaaaaaactacgtgtgagatcacccaaggtcaaatattatgtaaactacttgaaatgataggttaatttgtcaaaatttcagaaaaaaactacatgtgagatcatccagggtcaaatattatgtaaattacttgaattgatagcacgaaatatttagttggatagggtctcaataaaacaataaccattcaacctctcgttgccatatcaagtagcaaacatattatgaaaaccgaagcatcgagtagagagcataggagatattgataggactccgcgtgctagtcaatttcagcctgagacatgcccatcaagccacacaaaggtggtgaccagatggttacacatttcaagagacttgacaaattgttggaggtctataacatctcaaatgctctaaacttatactcatgtgaataaactagttcgtagaataagcactagtttcacattttcatttaagcaatgataaacagaaataaggcatgaatagaaattagaacccagattattacaagatgtaatttcctaagccgatcggccaaatatatataatgattcatggaagcttgtatacccattcccacaagcagctgactagaggtagacccataatgaatcaaatcctagaagaagcagtcgaatcccgaatcactcaattcaatttaaacctaatacctgcaatatatattatatacgagtgacaagagtcagtacatcaatcaaattaatatactggtaagcacaaatcaaacctaacattctatatgcaaagccataattcaatggaaggttgtctttagctcaattacagcacaaaggcaaattttggttcacaaacatttgtaaagagagttgacaattcaattcacaaaacatgaacataaatataacataatagtcatcataatatcatcatataatcattattgatgcctaaaccgacatcaagtctcacattcatcatcaatataccataaaccatataattcaacacaagttaccattttcaaacccatgtttcacaaacacaatttgaaaatataaatctataatattgacatttcactaagccgctcatgaccgcgagcatgactaaacgattagttttgagaactctgcatagtttgtacaactttacccacatgacatgaatcgttctagtttgaccggtttccgtcggtaccaccacactctacaccttgattgtggtctagaggtcataacatagccattacatcataggatttcatttgtacaatcggggaaaaagtaaatcaaagatccatctgctccaagcttcagaatatgcccttgcactagataagcctcatcaatacgcgaacgagcggctgagttaaaagcaatttggttgctaaccacccctagcccttttgctatccgagtaatcagagaagtgcactcctgtagcgcccgttccgtcgtggcgcctagcgggaaaattatctcttaaaaaccctaattgcgaaatttgtttccttgcttgttgtctagtgtccgtgccatctcaagatctcaatccccgatctatcgtcgagttcaattccgaatccaatccttccaaatcaaatccctccgcaaaagtctattttgcctcccccgaggtcgatgggccgaatcccgctcggcccatctctcccccggccccctctctcccgggcgccctcgctctctctctctctctctctctctctctctcgccctctcccctccccggcgcgctccgcttctccccccgctcagctccgctccgcctcgcccgcgtgccgcgcgcgcgagcgcgtgagccgcgccgcccgcgccgagccaagccctcctttccgctccctcgctgccgctccccgcgcgttgatcgcgcgcacgcccgcgtggtcctcgcccgcgtcgcgtctgcgccgcccggccccgctgccctgccgcgcctgcagccgctcggccccgcagccagcgcgcgtgccgagccgcgccgctccatccgccgcgcctcccgttgcaagccgcacgcgcgtgccgtggtggccgaccgcctggtcgccgccgtcgtcagcgtctgccgcgtctgtcgcccgtgtcgtcgcgccgctccaaaccgcctgccgtcatcgccgtcgtcaccgcccggcccccgccactccgcgcgcaagccgccaagggacggaggcaacgcccctcctctctctgccacgtcgcccccgctcccctcctcctttttcccaaatcggcaaaggggcaagccccctttctccccctccttttccccttttcctcctcgccggcgtcatcctccctgtcgccgctttggccgcgaccgccgagcgccagctcgcgcccttgaccgcgcaagtcggttcccaaaccgacattgccgcccatttaaaccccagcctccccttttgtcacaccccgaagttttcctcccaagccaaaattgtaatttataaatgatcccaagaaaatgcaggtgaaatcaggagaaaaccctaaggaagtaatgcaaataataatcggatttgacatgtggaatttttcttgagttctacatgtcgaaattcattaacaggatttttagtgaaattttcagagctctagaaataattttaaccaattaaaatggagcaggcaatattgttaattccagggaaaatcctttttcctttttctttttcttttccctcccttttcctccctttttttcgaatgggccgccggcccattcccctccttccttccctcctccttgctgggccggccgcaggacgaagcccacccaggccgccccgctgcctcctctctcggggtcgccgacaggtggggcccacctgtcgggcccgtctccctcctcccgccgatcccggcgcgccgccgcgcccgcaaccgtcgccgcgcccacgtctccgccttccccgggccacgtcgaccacgcccgcgcgtgcgccgcgtctcccgcgccctttcccctctctctcccgctcgcgcccgcgcccgagatggccgggattcgaaaatcgaatcccgcctctctctcctccccactccccacgtcggccggcgattcccgcctctcccggccacgtccggttctctctccccctatttaagcatcgccgtcgtcctctctcactttttccccatttcgccgacccctcccgagctcccattgctcccgcgccgtgcaaccacccgccgccgccgcttccgctactccggtcgccgctagccgccgctaggctcgccgccgcaccgcgccgtcgccgccgtcgggttcgcgtggccgagatccatcccgtccacccctctttcgtcgaggtccatcgccggagagccgttcccgtcgtgcgacggtgagggtcgccatgtccgccgccttcggccggcatccccgcctcctatggcccctctcttcctctctagtccctttcgtttcgttctttaggtcgtcccggtcgccgtccgccgcgtgtcgactgccctccgtcgctcctcgtcgccggacgccgtcgtccccttcggtgaggactccttccccttttctctacttcctcgattctccgtgcgtcgccgccgccgcgcttgccgtcgcctttggtcgttgccgccgtccactgccgccgctttcgcgtcgcttttgcgccgtcgcctccgcagccggatgccgtcgccggcaacgcgacgtgcgcgtgccgccgccgtcagccccgggtcggccggtcggctttgatgccgagccgagcccggcggctgcctccaccgccgccgtccgatcggcccgagggcgatctgggccgtcggtcccgtggaccggcggtggaccacccgcgtggtcccggtccacggtgaaccgctcacccttgagtcgctgaccagtgggccccgcatgtcggcgccgcgcccccccgtgctgacgtcagccctggttaatattgcgcaataaattatttaaggatttttgttatagtaataaacacagtgaatcttctaaaattcataactaattcatccgagctccgtttaatcccattcaagtctcagtaaatcaagaaaaatgtgtagaatccattaaaaatggttttgttccctgtttcagtagtcttatagcctgtttgcaatgtttgccttgtatgtcgctagattccggttcctccgacgctccggtgtacttcgagatagtcgccgaggtccctccagtagcagagcaaggcaagtcatgcttgtcacttgatcatattgatcctatattgcaaatgtcctaatgttttctttcaaataccgcatttgttttgcaatgttaatatgggatggttacctattgttacagccatgctattttgataccatgctcctttgttagcttgggttataacatgattagagttaggactagggtttgcttagccatgcttagttcaactagttcacaatggggaaaatcatattaatgtttagactgttagttctaatggtaatgttggtttagtgacaccgctttggtgttggttaattaaaatgaatcacatggtgggctgtgggtgcatggttttgctggtcgcacccatggcagttaaggaccggttcgcgggatgccctggaaaaatttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgttgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacaattgtacacctctgatcagagtaaaactattcgaatagccgcgcccgcggttatgggcggtcaaccagattcaccgtgattagactcacattagtttagtctaatgaatttggatggtataggggttggttgggcctgttgcaacgtggtgtagcgttggacagtggatgcttaatactgcttaattattacaactgttttcgcattcaactcctgtttataaatgccagtatttatgcaaatgaacctgcttagctatcccttgttgaatccatgcatcatacccccattccggtatgacttgctgagtacagtgggtagtactcagtcttgctctatttttcccccgatccccagagttcgagtttgggtcagatgaaggtttctccgaggaataggcttcgtccgtgccgtcgaggatgcctgtggagtggtgttcccgctgcagtttagtcaaggcttagctccagttatcttttgttttccgctgcatttctgtaagacttttatgatgtttgtaagacgtggatctgaatgtcaacattgtcgtttgtgtaccccggctggtcctggacggggattttaatgcacactctgcttggaattctattcgggaatttctgggcgtgacaagttggtatcagagccaggttgaccgtaggacaagccaaatggaaacctaagagccctctgaatccttttcattgcatatgttctttgcaattggatttgttccgggaaaattgggatctgttcttgtggttcaagggaaaaatcttggtcgctcgtttaagtgagatttttcaaaacgagtcagtctagggttttagtaaaactattgggatttattcgtcagtcagttggggtttgatgggtgaaatgcattaggtcctagctcaggaacatgggttgcaaggtatttatgctttatttgttattattaatatgtatctaatttctcattattttatcgttatgtgagtctgtcttgtttattcgctctcatgcaaaatgatctatgcataaaaatttcgctcttattcctttcccttatttgagtcttttattgctttatttaaatttggatttgagcatgcattgatcctactcctttgtcttctctagatggccggtcacccacccaaccaccgcggagaaggcatgatcgactttgtggcagagctggcacgcatgacactggtggtgggctaccccaacgcgccagagtacacgacgattccgccgctcagtggcgagcttcctcaccgtgtccgcttggaggtccatggctacgtggggacttgcctcgctaacatggcggtcgaggcatgtggaggcacagcagatcatgcctgtcaggaggcagcctacttgatgatggccagactacgggagcgccacaactacatcttccacgacacggcgtaccgctaccacccccgtcgagccaacggtgatggcgtcagctccttccgtccgacagccggcgagaacgacaccacatttggtcacatgtgtgctgtgatgaggggattggacaggatgcactcggacctgcacaaggcgaccaaggccttgaacgatgggaagctcatgaggatcgtcgctctgaaggacgagatagcgcgcctgaagaaggagaacgctcagctaaagggtcttccagcgccaggaggagtccggatccgcactacgccccgcaagacgacgacggcacccgtgcgcatccagcttgcgcccaggaacccacctccaccagcagctcccgcagcacctccagttccgcccgcagctccggcagttcctgcagctccagctccagctccagctccagctcccgcgttcgctctctccttcgctccagcatcagccgccagaggtccagccagtggcaccggaggttggttgtctgctactcccagtggctcagagtcaggcagtggcgagacttatctgccaggttccaggagtcgctcagagggacctggtgacgagcaggaggacgccttcgactccaccgaccgcaggagccgttccgagcattaggctcgttttccattagtttatcgactgtctagcttttgcttgttagtttgtgtgtttaggttgcttgtttgggtcagtcgacggtcgatatcatgtgcctatgatatggctgtcttaataaggatttttgtttgctcttttaagtgttttaattcagatcagaacaattgcagtttaaattcctttgtaataaagcttagttcctgagcatctgtttttcttcttttcccccatctgcttttccctccagatggtctacaccaggactggtagccgcgcaacaggcgaggacagcaacggcgaagaacgcgctgatggtgtgcaccctagcagtgattccggcaatggtccgcccccgcttcccgagaatccgacgctagcccaagttatggcacatcagactcagatgatggcggccatgatgcagcagatgcagcagcagcaccagcagatgcaccagaggatgctgcagcacgccgaacagcagcaccagcagcttggtccccctccccctcagtccaagttgccagagtttctacgcgtcaggccacccaccttctccagcaccaccaaccctatggaggcaaatgactggctccatgcgatagagaagaagctgaatctcctgcagtgcaatgatcaggagaaggtcgctttcgccacgcaccagcttcagggtcctgcgtcagcttggtgggacaaccacatggccacccgcccaccgggtactgaagtcacatgggcagagttctgccgtagcttcaggaaggcacaggtgccagatggggtcgtggcgcaaaagaagagggaatttcgtgcactccatcagggcaaccggactgtgacagagtacctccacgagttcaatcgcctcgcgcgatatgcaccagaggatgtccgcaccgacgccgagaagcaggagaagttcatggcgggtctggatgatgagctgaccaaccaactgatatctggggactacgccgactttgagaggctagttgacaaggcaattcgtcaggaggaccaacgcaacaagatggacaggaagaggaaggccgctcagttcagggcacatcagggaagtcaccagaggccgcgcttcacttccggacagcagggtggacctaccaccatgatcgtccgccagcaccgcccgttcaaccctagcaacttcccccagggcgccagtggcagtcagaaccaccatggaggtcagcccaaccgcggtgcagctccacgcccaccaatggcaccggcacagtcaggccagcccgcgcaagccaagaaggagacgggagcaaaaccagggtcctgcttcaactgtggcgagcttggccatttcgctgacaaatgcccgaagcccaggcgtgccgggccaaggtttatccaggctcgtgtcaaccacgcatctgcggaggaggcacaagcagcaccagaggtcgtactgggtacgttccctgttaactcaatccctgcaacagtactttttgattctggtgcgacgcattctttcatttcaaagaaatttgtcgggatgcatgggttaattagagaggaacttagcacaccaatgcgggttcataccccaggaaatagctctacttcggttcaattcagcccttctataacaatagaaattcaaaggtcactatttctagccaacctcattcttctcgaatccaaagacctagatgtcattcttgggatggattggctgaccaagtttaagggggtcatcgattgtgcgaatcgcaccgtcaccttgaccaacgagaagagagaaaccgtggtgtacaaatctctagtctcgccaaagaaaggggtctcgttgaatcagattgagacggaaatcccagtggacaccgtagagaagaacttgagaaaattggaagatatacccataatctgcgagtatccagaagtgttccccgaagacctcactaccatgccacccaagagagagattgaattccggattgacttggcaccgggaactgctccaatctataagagaccgtacagaatggcggccaacgaattagcagaggttaagaagcaagttgatgagcagctgcagaaagggtacatacgaccaagcacttcaccttggggcgctccggtcatttttgtggagaaaaaggataagacgaagaggatgtgcgtcgattattgcgcacttaacgaggtcacaatcaagaataaatatcctttaccgcggatcgatgatttgtttgatcaactgaaaggagctagagtgttttctaagatagacctgcgatcaggctaccaccagttgagaattcgggaagaggatatcccgaagacggccttcaccactcggtacgggctatatgagtgcacggttatgtctttcggacttaccaacgcacccgcattcttcatgaatctgatgaacaaagtgttcatggaatttctggacaagtttgttgtggtgttcatcgacgacattcttatctattcaaagtccgaagaagaacatgaacaacatctccgtctagtactcgagaagttgaaggaacaccagctatatgccaagttcagcaagtgtgacttctggttgacggaagtcaaatttctgggccatgtcattacagctcagggtgtggcagttgatccatcgaacgtggagtcagttaccaaatggaccccacctaagaccgtgtcgcagattcggagttttcttggacttgcgggttattaccgccgattcattgaaaatttctccaggatcgcccgacccatgactcagttgcttaagaaggatgagaagtttaaatggacagctgagtgcgataagagcttcgaggagctcaagcagaaattagtatccgcaccagttttgattctgcccgacccgatgaaagacttccaagtctattgtgatgcatcccatcacggacttggatgtgtcctaatgcaagagggcagagtggttgcgtatgcctcgcggcagttgcgtccacacgaaggaaattatcccactcatgacttggaattggcagcagtggttcatgctttgaagatctggaggcactatctgattggaaaccgctgcgaagtatatacggaccataagagtctgaaatacatcttcacccaaccggacctaaaccttcgacaacgaagatggttggagctaatcaaagactatgacatgagtattcactaccacccgggtaaagccaatgtggtggcagacgctttaagccggaaaagttactgcactgccctatgcgtcgagggcatgtgtgaggaattgcggcaggagtttgaacatctcaacgtgggaattgttgaacacgggttcgtagccgctctggaggcacggcctacgctcgtggatcaagttagagccgctcaagtaaatgatccggaaatagcagagctgaaaaagaacatgagagtcggaaaggctcgggatttccttgaggatgagcatggcacaatctggattggagaaagattgtgtgtacctgacgacaaggaattgaaggatctgatactcaccgaggctcattagacccagtactccattcacccaggcagcactaaaatgtatcaagacctcaaagaaaagttttggtgggtcagcatgaggagagaaatagcggaattcgtcgcactctgtgacgtttgccaacgagtgaaggcagagcaccaaagacccgcaggtttactccaacctcttcaaatcccggaatggaaatgggaggagattggaatggactttataacgggactgccccggacatcatcgggacatgattcaatctgggtagtcgtggatcgactcaccaaggtggctcactttataccagtacataccacctatacgggaaagagattggcagaattgtacctcgcaaggatcatgtgtttgcatggggtacccaagaagatagtatccgaccgaggtagtcagttcacctcaaagttttggcagaaactgcaggaagaaatggggacccgtttaaatttcagcacggcctatcacccgcaaactgatggtcagaccgagcgagtcaatcaaatcttggaagatatgttgagagcttgcgctcttgattttgttggagcttgggacaaaagcttgccatatgcagaattctcgtacaacaacagctaccaggccagtctacagatggcaccgtttgaagctttatacggccggaagtgccgcacacctctcttctgggatcagacaggcgaacgtcaactgttcggaacagaagtattagcggaagcagaagagaaagtcagaatcatcagggaaaggttgaggattgctcagtctcgacagaagagctacgcggataaccgtcgaagggagctcacttttgaggcaggagattacgtgtatcttcgtgtcactccgctccggggagtacaccattttcagacgaaaggcaagttggcaccacgcttcgtaggaccatacaaaattttggaacgaaggggagaagttgcttatcagctagaacttccatccaacatgatcggcatccatgacgtgttccatgtgtcccaattaaagaagtgcttaagggtacctgaagaacaggctgattcggagcacattgatatccaagaggacctaacatatgtggagaagccggttcgtatacttgataccagcgaaaggagaaccagaaacaaggtcacccggttttgccgagttcagtggagtcatcattcagaagaggaagcaacctgggaaagggaagatgagttgaaagccgcccatccgcacctcttcaccagctcctccgaatctcggggccgagattccgtttaaggggggtaggtttgtcacaccccgaagttttcctcccaagccaaaattgtaatttataaatgatcccaagaaaatgcaggtgaaatcaggagaaaaccctaaggaagtaatgcaaataataatcggatttgacatgtggaatttttcttgagttctacatgtcgaaattcattaacaggatttttagtgaaattttcagagctctagaaataattttaaccaattaaaatggagcaggcaatattgttaattccag

SEQ ID NO: 29432 - DNA, 4626 bp, Oryza sativa
  unsure (1)..(4626): unsure at all n locations
gagtggtgttcccgctgcagtttagtcaaggcttagctccagttatcttttgttttccgctgcatttctgtaagactttcatgatgtttgtaagacgtggatctgaatgtcaacattgttgtttgtgtaccccggctggtcctggacggggattttaatgcacagtctgcttggaattctattcgggaatttctgggcgtgacacctttcccttcctcttcctttcgtctccgcgccattgccgccgcccccgtgctctgtctcgcctccgccgtccttcgccgagcgccgggagagccggtgcgttcgaggacgcggaaggggacttcggccgcgccctcttcttcctcttccccggcccgaggccggagagattactcccgcgccgtcggcctctcgtcacagcgccccgtcccgcacggtagtgcctccctccgttcttcctcctcgctccatcttccccccttagatttcggtagtagctcgagtagcctccccgtagttagccggcgccgccgcgaccgttgccgtcgctcgccgtgtgctcgccgccgtcgccgctcgagctccgtagcacctgcacgtcgccagcctcgctcggcgtagctccgtccaatccgacgctagcgtcgagttcccgaagccgcgtagatgctctcaccgccgggaatcgacccctcgtggcctcgtcgccgtttccctcttccctccccgccggttgtcgccgcgcgattcgccgccgtnnngnctgtccggtgaatccgagccgttggctcgtctcccctcatcacgaacaactgcccggtgtgctcgcttttgcccgtatcgccgtggttcactccgccgctcgccgccgccgcccgccgtccattcgcgaccgggtcgtcgtctacctcccgccagcccacgtggccgccacgtaggcgccacgtcggcgccagctcagcctagaccggtcgagctgaccccggtcagtccctccccgtgcgcgcgttccaccgcgagccgtgaggctgcgcgtgggcccgccgcatccgcgtccaccgcgagccgcgcgcgtgcaccgcgtccctcccccgcccgcgcgcatgagccgcgtactccctccgcacggtgagccgagccgctgacaagcgggtcccacccggggccgcgcgtggtgagcccggtccaccggactctctctctccttcctccgcgcgcgcgcgtcttgggccgctctgggccgccttcttgggccggccggcccgtttagatcggccggtccgctccaattcccttgggccgcgccttagccgcccgaggaaaagtctaatttccatccctcttttctttcttttcttttctttttcaaaaaggatttaattaaatccttttcctttagaccaaaaatccaataatcttagaaattcaatatcttcccaaccgtaaatccgtttgactccgttcaacttccaaaattcctcaaatctcgagatctatctaatggcacgcttagaggtctttaatagggctttattttcgccgtttgttgagttgtcccgtttcgcgtgtagtttcggagcccgaagatccacagcgcgaggatttcgaggatcaagctccagatctcgagcaaggcaagccacctttgaacatcttgagcctatatttgaaatttaattatattgcttgcaaaatattatgcattgataggatcgcacttaatctgtttgtcccgtctgcaaggcagattggcggacctacctaatttgtcgcatttgattcttcctttgttaattgctataccatgtccccttgtaaccacccagttacgcctcgatattcgtgcactctgtgcgagtatcgacggtcgccttcaaacttaaaaattcgtttaacaacttgggtaaaacttgggttttacaaaagacttggaaaacccgacacctgggtcggtgcttgtgaactaaatgaatttccaaaaccgcggaccggggaacgtaccgggtgtacggtttcccgctcttgcacctaaggaccgtttccttggaatttcatccaaacataagataagtacgaccacatgggtggaataggacacccctggctgagtaactagcttatcaggggagccatgatgccgagagacatgtggattcgccggggcggtgtcggagaggacccccctgggcttcctggcacagtatggtttgggacctaacctgttgttggtctgggaccccactcgtcggcatatggtaaacttgtgtcggctttggaaatgccttgtcatgaaagcttggaggtctcccgacgtggctgatccccacgggctgagtgatccgggttagtaatgtcgtgtgggtaaagtgtaccccctctacagaggttaacaaactgttcgaacagccgtgcccacggtcatgggcggatgtgaggtgattcctagcgtagttttgtttgactactgcttgtgaaattgctattgtgaaaagaggttcgatgtttgaaaaatctgcagctgatgggatcagctaggcccgggtggccgtttgaaaagttgttggcccgggtggccgtttgaaaagctgttggccgggtgccaaccttgtttcaattctaaagactgatacattgcacatactccgaccggacgagacgcactgtctcatccgtgtcgtttgagaaacactcacttagttgtttttagaaaagagttcaaataaaaccaattgcaaaaacaacagcctttccttgaagcctgcattaaacacttatttcccctggcttgctgagtactcccgtactcacccttgctctatataaataatcccccccccagttgctgaagaagatgaagcggatcctgctgatgaggagtttttccaggagcaagccggctatgatgagttttagggtttcggcctagttcccaagtcgcgcctgtgttgtttggtccaagtcctggcttccgtttcccttttgtaatgcagttgtgagctcgggatctgtccgcagcccaacatgactgtacctctactctataataaagagacctctgttgctgtgatattctgtctccctgtgataccagcactgtttcctgggactggtatcgattaacaggttaatttggagcgtcacgggctagttccggtcgggactagttcggggcgtgacaactccacaggagcagagaactttatactttctaaccattgccttatcatacatttcacaggagcaattttgatctttctaaccatggcaaacatgataatcaattcatctcccctaatgagtctcagatcatctctaggaaacaaagtcatagcaatctatttgtgcatgagcctaagtgtaggattatggatatcattcgttctaggtttcttgcatattggagcaccagaaatgtcttcccaaaatctatttttctcgaacccagaaattcctttctggagatcgattttacaggaatcttgaaaaccaagaagtgtacttaagcctttccatgtaagtgtgaactcctcacggaaaaagcgaaaggaaataccatcttctatttctttcaaagtgcacaaaaattgtaaagtaagcaaacgagaaccaggctcatctaccacatcaaatctctgccaaccaacagctttccaaatagaacgaaattcaacatccatacctatcttttttagtaggtctggtgagtattctcgcgtgtgagcatactcccggtcgctcagcatgtagtaggcttgtctctcccgatcactgacaaggtcgaggtcggtgtcgttcaggagtcatcgcggagcttcggcgtcttccatcgagacatcagctgatgaacgagtactagactcgtcatgatgacttgatgaagagccggaccccttgaatagacgagacaatcgcctcctcattctgcacaatggagcaagaacggactaactcggcgggggttaggaatgacaagaatttcactaggctgtccgttttgggtggctccacttcgacctcttgaatattctatgggttcggcccgtactttattctgaccatggagcattgttccgttctcggttgaaactcaaacttctcttccttgccgttgatgtggaaacggatactccccgttcccacgtcaatgttggctcctacggtgctaaggaacggacgctccaggatgagcggcgtctcttttcccgtgtccatgtccagcaccacgaagtctaccgggataaagaaatcctgtatcttgattggcacatcctccgctatccctgccgggtaacggactgacgagtcagccagatgaaggcgcatcagtgttggtgccaacaccgtgaagttgagcttgtcgaagacgtcttttggcatgacgctgacactggctcgaaggtcgcacaaggcctggtcgaactgttgtgccccgatcgagctggtgatcgtaggacaccctggatctttcttcttctccgggagcttgtggagtatcaggttgctgcatttttccgtcagcttgaccacatccgttgttgggagcggtttcttgttgttgagtatgtccttgagataacgggcgtatgttggcacttgcgtagcgtccaacaatggcacgttgatgtggatcttttggattac

SEQ ID NO: 29433 - DNA, 6305 bp, Oryza sativa
acagcaaccgtgtgtcgcagtactcctgcggcacgggcttttctagctgaacttccttgttagccgagtcattagatggcgcttcttttgatatcccattagttcctacagggttaggatatggcggatcacgagtggacttacctccccttgtcgtgatcgccttaacattttcaacggaggagttaggttgccccggaatcctcccagtatcatttgcagggactaaggatgccaactgagctaactgggtctctatcatttgattgaagctcagctggttttgaaaagcagaagtgaagccatctaacttgacattaatgttttctaggatcttatcattggcagcaagctttttgcttagcgcatattggagtcgttcctcgctccaacccatattggagactatcttctctattagttcaatggctccttgaaccgttttagacaagaaggctcttctagctaccgtgtccaagtgatcgtgggacaccggggtgagtccattgtaaaaattctgcaggattagccagtcgtccatcccatgatgaggacaggcggccacgtactcctgcagttgttcccatgctttcggaatagactcatcccttatctgctagaaacttgaaatccttccataaagggcattggttttgcccatcgggaagaattttgagaggaatgccatcaagcatttgtcccaggtattgacagcagcacggttggcataaaaccactactttgctttcccgagaagggagaacagaaacagtcgtggcctgatagcgtcgggactgacgcccttgatggtgtacgtgctacagatctccaggaactgttgcagatgagcattggcatcctcattaggcttgccacagaacgggctagccggcgtcatcgtaatgaggctggacttcaagttgaaatccatacccccaatgttgacctgcggcccaatggccacattgttagtagagggagcagcgaacttgcgaagagtcttgctcgccatagtcttgaaggtcggtggcgctggtatggctggtttctctgttggtagagttttctgcggagcaacgactcgtggtctgacgctccgaaagacagcttccggcaggttgaaaccagtcatgtactactctgttctcacaacaaaagtaaaaacaaccaaggttagcctgcaaaggaaaatgattacacagaggtaaatataaagttttagttcaagtaatctctattatgaatcttccccggcaacggcgccagaaatgcttgttggtatttcttaatgacattactagaaatataattcccagcaatggcacataaatacttctggtatattatggttacagagttcatccgcaagcgcacggatataccattatagcatttcacccaagagtattttaagggtatcgtatttattttatcccgtgggaagatcatgtagagaaaacttgactaataatttatatattacttgtgataatcatattctaagcatgggttaaggtaatccaagggtagagtgacacacaagcattaactaatcattctcataatatatcatctaagctaagtcgaaagaaaagagaaagaaaatctattcctatacttctaatatacatagtatacatacattctagttaactgatatactagctaataccctctatccgatgccctcctggtacttcgagaagccacccctgactgccgagttccttacgacagcccgtcatgaccatacaacaggggctaaatatggaggaataccctccccagggaattaatttaggattatataccggcgcggaggaataccgtactgagctgtcaccattagcggcccacttctcatccacaatatataaccccaaataatgatatcccataatctagacaccacgtctaaactaccagatactactctaatatcatcgtcatgacatagagtaattgcataagcaaacattatacccgcaccaaagcatctcccagataagctagtcgtatattcagtataacatgaacataatataaagtaggtactcatatactcggaaactatttcaataccataaatgtatatagaagagtattccaataaaagtacaaagcttacaaaagagaagagaaaagctactacagccatacccgaactcttccaaaggcttccggactcctgatttctactctattccaattccaccagctagatactactaaactaaacttgagagaaatgagagagctattgcttgaggtgtgtgttgaattgaagagagtgaagtccttatataggctgccaatgacggttgtggcagttggaatggtcggaattgccttccaaccgtcattggggagtgatccacgccgtccagccagaacctggatccaacggcgccaggggaggttcggccgaaccagggccggcccatcctggcccaaaatcggcaggtggcctcctgaacttctccactccgcagacttgtgaattttggcccaattcatcgtgtcaattctgagttcttggcctattcatacataagtctggttctcgacatcatccaattgatttatcgtctgagttgatgtcgattctcctccactttattgtcattctctgcaaaaggttagtacacctaatactagtggaatattattattctaacatatttatgcattgcaagcatcactagttctcctctattttggtaatattgatggttgaaactgatcaataatgaccgtcaacacctacatatccggggcactgattacgggcgctcgtccctgatccaacatattacagcgtatcagagttctaatgactcacggtcggttgccgccggtagcagctccctctcgctatggtaagtcgccatgcggttacaacaggtacgcctctctatacctagtagaactccaagtcctaaactgtaaccgactacgtacacatattcgacacaaactctaacagccaccgcacgtgaatatcgttctcccatttttacgtacgaacccttaagaggacagcacgcatgcgggcttcttaagagcatcgcacaggaaaataccctccctcctttttccctctcaacacttcaaaaattccatacttatcctccctccaactctctcacctcctcatccttattctcacctctcctctcactttctctcctctcctctcaagtgtcgcggcggcaggcgagtggctcggcagcgggcgacgggacgacgaggaggtggctccgcctcgccgcctccgccgacgatgaggtgcctgggagcggcgcctttggccccacgaatccgcgccacccccgccgacgaggaggaggaggtggctaggagcggaggcagacggcggcagcgcgtccgcccccccggccctcccgcgcagcggcgcccctccgtcgttcggatctagtggcagcgccccttccgccctccgcccatagtatccggctttggtgcccctccccacgcggatccgggggtggcgactgcaaggatgacgacaagctacagcgacggcaacgacggcgacgagctgtggcggtggcaactagggtttgcgatggcggcgacggcaacgactatttttttggtggatttttgttttcgcgtgtggtcggtacaaatggactgcatgagataatcgattatcccgtgcggtccacttaacacgaccgcacgggaagatgtatttttccgtgcagttgggccgcccgcacgcgaaaatatttattttcctaggcacctgggggtgcagacgggcaagacctctgcacggaaaaacactttttgaccgcacggaaaagtcattttcgtagtagtgacatcgtgtggtattttacatctatctttgtgcgagaaggctaagtcgcgactggtcgcgttgcgtgcggagaggagggcagctgacggcgcggtttctttttttctttttcgacgctttcttttttttccggcgctctcggtatcttttttgttttttctgttttttctttccgtattttttgcagcttacggtttcctttttttttgtttttttctgtttcgtctttccgtatctttttagtattttcgcttttttaatacgtatttataaaactttgtatatgtagacatataaactttgtataagtgtattttttagactttttatatgtacgaacacaaactctatgtacatatgtatatttttatacattgaagtgcgcatgtatattgtatatacaatatacatacgtataaatgttgtatttacgtatacaaaatttatacgtatgtatatagtatatacatacgtatgtacactagtatataagagaagctagagagactagggggcagctgatcgcgcgcatgcgcggccacacgactagccgcggatcagcagccccttatctttgtgtacagtatgtctgtttgcaaaatagctttcaatttcttgagaacacagtcagtttgcaagctaaattatacaacctgcatgactgacaacctacataccataaaactattgcaggtacctcctatagtaacatttctgctaaccaggctctgttaaaactctgaaactcaggtatgcctttgttagttatcgcttttggaaattgaatagcctgagtgagagtccaaaaaggaaggcaaaaagaacagcaaatgagacaactaccatagccgggacccacaataactcatgatggaaaccaaagtagttcttgacaaagtcagatacacgctctccatcatcaaacttgtctgatacatccccaaactgtgaggtaaccaacccattgagcgtccatgcaaccgggcatatccaatagtaccatctccaccatataggaattctctgtagataaaaagagccatattaggaaaatcaatggctttaagataatttggctagatatttttgaaaagctggttcacttacagttaacggtattagaaatcctgagaaaaggttccacatggtataaaatcctgtggaaacaacagtggacatgttgtaatttggagttagacccaccgccatcatgccgtaaaatgtgtagtatgacaaagtgaagtacatgaagaaaaggtaccaaaagaatttggcacctgaccactcatatcctatcattgcatacactagcatgccatatattatggtctgaaggaagatgtacggaagttcaattgcaacctgcaatggaactatatgttaatagggcttattgtctggccattagtttccccatactgaggggattgctgatgaaattgagtagtatcttacaacattataagagactcatatgtcgaagaatttaacctgtcccaaggcatatggcaaaggggagtacatgtgcgatgctctttctctataaaagactgtgcgctcaatagagacaattggttgaactgaagcagagttttgtactcccatggtcaaacatgtagaatacatggaacccatggcgctgaacaaggcctgtttattattcctgcaacagtggaatatatctagtaaatggcaatagatgaactagaggcagcctttgaatatgtaaaagattgtatacgcactattttcttgtggtttttatattactttgttaccttttttggccaataccccagaacattgttccaaacaacaatgcaactataatggtgaagaagtatttcacagcaatatatcgaggattacgccagtatgacagacgttgcttccagaggcaagccaaacattgtgtaagaaagggctgtgaatattgagttggaaatgataagtcgcttgaactttcatggggcgtgcttaactcctttatcaaatttttgttccttctgtaatgaaagcaaagtaccgacatggtcaaatgataacatttcctattgccttcttcataaaattgaaaaattgtggcacttggtgataacttgaagcatatccattcaatattatgatttcaggattatctgcatttcaattttttttcatttgctgttaccttgtctagttattacaaatggaaaataaaaaaattacattattgtccttttggaatgttgtatttgtgtttttcatatcttagtatagaacataatattttgcatatgccaccaacttggacacacttctcacttatagcgttatggagccagtcatttggtgcatggagtaaagttcgctttgatcttaggtgttatgttagtggggcaaccattatagttccatgatcaaactatattaactgaaggacaaccaggggcggatttgccatgggggcgggggg

SEQ ID NO: 29434 - DNA, 27624 bp, Oryza sativa
ccccactaccgccccagggtccatggagacccccctaagcccccactaaaatttttcacgagatgtggtggctggagcttcgtcaggttggctggagggaaggctggaggttgaagacgatgttatttcgcgatttgggcttgtttcgaagagcagcccacgaccacgagcgcagtcttcaagttttgtctagcccactccaagcaaaggcccacggtggcagattccagccagcccatttggctactccccctcccggcctcccgcctccccaattccccaatcccactggccacctcctcctctcctaaatccctaaccctaggcgaataggcgcgggcggcgggcggcggccgagcaggcggtggcgtccggcgaggggccagacgggaggcgtgccaggcggtgccccggtggtccagtgcatgcccggagcaggtggcgacctccggtgagctgcaagcctgcaagctggcgagcgccaagcggcaaggtgccgtggcggcgtccagtgagccggcgatgggccagacaggaggcaggccaggcggaggcggtggtccagcactccagtgcctgcgccgccacgccgccgggaaggtggcgagccgctcgctggcgaggtgccgcgagggcgcaaggcgccgaggcaggcaggcagcaggtcagcggcacagtggccggcaaggcagcaacgagtcaacgacgcagtcgcagcctactgtgactgtgattgaagatttgaagttagaaatcggtaaactagtaacctctaatactaatagatagtctaaaattgtgtcttaatgaggttgtgcacttgtgcttgaaacttataattattttctatacatttttagattgtcaacatgtcaaaaaaaacattgctcacgtattattttagtttaagcaacacaaatggcagtgatcctccatccagtaaagtgatcctccatccagtaatgagtgtttaagttagccaaagaaacccaagtcagggttttttcaatcggatgaaaaaatcatccaacaatttgaagatatgaaagcgcgtcagatgttattacctcaacagaaattagtggtatgctctatgcctccattcctccctaaatctctaaattatttgaatccaaaataagtatgtttcgattattcgttaatttgcctttttctttgtataaattactactcatgaagaataatagacgattgggtgtgacacgtcatctattcgatattggtttggtatggacaaaattctcgacatatcattaattcaatgtgtaccttgaactgacatttagccaatttacatgtgagacatgtttcgatttatgctggcgtaatttgttcagcccccactactattttttcctggatccgcccctgaggacaacccaatatatagttacctgtatagttcagaattcttgtaaacttgagtgaagtttacgccagttttttgttcttgcattgggctagtcacttccaacatccatgttgaaggattgtagccatgttttatcttgctgacaccttcaatagccttcagaaaataaaagcgattcaatagcatgtttctcaatgcaataaggcaagcatatattactttctattcttttttctaacctcaaaatatctaatcaattcacatgaatgttgtcctagtggaccgacataaatctcttcgcctcctcgtttcattaggaaaagctgcaaatattaacaacattataatgaattgagtggatcagcaaacgatgttataacccaccaacaatttacttttccttttgtctatgtctgcatgatagaaaaaaatggactatacaagtatgatttcattcacctcatcaaaggattcaaatatatcaatgcttggctggtgaattgtgcaaacaactgttcttcctgtgtccacagtattcctaattgccctcatgacaatggctgctgctcgtgcgtcaagtccagatgttggttcgtctaggaaaatgatagatgggtttgcaactagttccactgctattgttagcctttttctttgttcaattgataatccgcttacgccaggcaatccaaccaaagcatcttttaagggataaagctccacgagctccatgacctcctcaataatcatctgcatataagataaaaaaataacattatctaaaaaaagattaaaaaaacaatctggataacatgtaaaagaatacatgaatattcatgttaaatacactgccatgaaataaaaaaattcattgctatgaatattcatgtcaattttatttttcatttatagcattctatatcagttcagacaacattttcttttttatgcactactctgtatttgaataaagtgaaagtattttctttatctgacctttcttgttgcagaatcaattttagtaggtaatctgagccatgcagagaacataagggactcataaatagttacatttggtgaatggatgtcattctgttcacaatatcctgaaactctagcaaaggtttcttgcttctttgggtagccagagatggtaatattgccctctatgtatccactagtcttccttccagccaacacatctaatagtgttgtctttcctgcaccgctgacacccataagagctgtaagtactcctggcctaaaagagccactaatatccttcagtagttccaaccggctctctgtagcttgtgttttcagtgcctacaagttttgtttggtcaagactattttttttcaaagattgctcataaatggtacaaatagatgcaattttccatatggaacatgcatgtctggtagacttggcaatatttggggtacctctggcatgtctatactgtattttatatcttcaaacgtgatggaaagaggtacaaatggaaggaccattcctttaattcctgaactagaattccctatcatgtggtttgaagttgcctcatcgttgttaacgtccacagtacctggtacacataccacacgcacatcagcaataaactgacatctcatgtttaaactttagattagtggtccaaaaaaatatttacatcttgtattgtcagtagcctgctctccagacggtgcttccaaaacttgaccagtgatattagcttgctttttatggaaagtttcctgggacattattggctggttgttgttcaatactacagagtacatggtgcaataaaattagaatttgtagatcttttagaataatagcattatttactaacaataaaagattcaagattttctatgactcacatgtgagaaatatgagacagatggtgtagaggacatttaatagaatcacatatccgagcaaggcaccaacaccaatccaataccatttggcctcaggaaaaaacccacgagattccagaactagccttccaagtggttcgctaaaaccagatattgtctattgtgtgatgataagcaaatgttttagcgagacatattctgatgtatggcttttaattgatcgcataaatatgcttttaccttgttccagctgttacctaggaattcattaactgccaatgtgttcagtgcatacataaggggtgatatccagtaaccccatatccaccatttcttaatttcctctgttaaacataaaacaaattatattcataaaagtaccacatccaataaagaaattatgtaagaacttatccacatatcattgtggtgtttcatagatagtttgcgtacctcttgataggatgaatccacttgaaagcatagaaattaatatgcaggatgagcccatagtacttgccacaaccggatcccttgtaagggaagcaatgaagcggaaaagtccagatgttgcctcagacataacaaaaagcgctaggaattgtctaaaaaatctgcatcattttctttgtttttattaatcttttatttaacatgagtttattgaagctagttagaatttcgttttccttacctctctatatttgggtcaaatccaataacatagtatgttaggaagacccaaacaatcgtattgaggaaggagataggggtcttaaggatccatgatggcaaggaatacgtccaagctggatagaagaatagatcccgttgcttgaagaaaaccgggagctttgcaatagctaggcccatttctgccaacccattgaacatgatcatcaacatgccatagaactgtgctcccatgtatatcctcccattttctatggagtcacgatgcatattggtacgcataaagacagtcattgtatttattgccatgactgttaactgaacatttcagagaaaacataataagaggccaaattaacttttgatcatttaaattttataggttattgtgctggtaaacaatggaagatgtgctggtttcagagaatcaccctaattgcctggaatatatagaggaatgagtttcttttcatgagtaatatttccctgtcaatgttagcttgaagtagttctttcatgctaacaccatactttgatgttctcagcgcagcaggatggctcttgcccttgccaaatgggactaccaactcagttcttactgcttgaccgacatgaaaagactgaaatgcctcagcaatctctgcagcagaaatatatcggtatgtagaatcaccatgtgtccagtattgtttctgatctttccttgatgtaacctatcacatttcacatataataagtcagacttaagcattcagatcaaatttaatcctatgattctatcatgatggaaatcagtgaggaaactaacttcctgtaagaagtcagcgacaccttttcgctcagggcatttgaatccaattgattgaaagaactcaagcacatgatcacgagggccattgtagacaacttgaccatctgagaggataattatttcatcaaacaattcatatgtctcgggcgcaggctgtagcaatgcaataattgtcgttccaccaagaatgtgaacagtctgtcggatggagttcacaatctggaatgttgtcgagctatcaagtccagttaatatctcatccatgaaaagtgctcgtcctggtgttaccagcatctccgctgtagcgtcaatattaggaggtggattagcttttgtcaccatatgccaatttattaactccaataataaattacctgtagttagtcgctttttttgccctcctgatatacctctcaccatattatttcctacaattgtgtcagcacatatatccaatcctaagatcttcaatggttaaaaacaaagtaaagaattattatggcgcgtacatgtcaaattacatgggaatgacttgcaattttcaactatgaatttattgtaaattaaaaaacatttcaatacaagtacataatgctcattcacctttagtatgtgatttgtgaccacctcggctttctgctctcctgttgtagcagcttgcatatgcaaaatgagaaattaatgttcctcatgaaatcttatgtcagaacatcaatagatgcttaaaaacaactaagcataactcaactctggttgaggtgagttgcgatttatgaattgcatcgtaccttcaaatataaatcaatctctggatctggtttgatgttttcttccttttctcttctcaatagttccattagcatatctgaacattttgtaaaaaaatgttaatattttgatctgatatgacatttatgattaatgagtctcaaactcgccatttccatatcttaccatagtgatggccaactccttgacactttgcagagaaactgaccgtctcacgaaccgttagttcggccatatgtaaatcatgttggctaacataagctgctgatctttggggcacaaattcatccattgtatgaccattataagttatagtccctgataccttttgtagttgcagtgtttcatcatatcagtacttcaaacagccctatatataggtgagccacatactacataggaaagcatgaaagatgtacctttacagttgatgggagtgttcctgctaaggccatcagtagtgatgtctttcctgagccaggaggacctaaaagcaatgtcattctgaaaacaacagataaggttaacttatatcacataaattatttggaaacaatcaattactaggaatttacctgtgaggctttacgatcccactcacattgtgaaggatcgatattttttgcttcttttttcgtgttatgtgaagagcgttccccaggccctgtttggaggtgagtgttgtcactacacatggaaaatagaggatgctaatgcaatcatataaaatgaaatgaaaatcccagcctctgcatgcttagtctcgtaactacaggaaatctttctggattccttgaggaaattggcacaatttccaaaaaaaaaaaaaaaaaaacttaggcgcattcttggatttctcatatttttttggttttgttaaaatatcaagacttcgattgaatatagaccagttttctgttttttagattactttctgacatataaaaacatatttatatatagatcagttttttgttttctggaactatttgttcgaatatatgtgtacatattatttaaaaaaatattaaaccgtccgtttcccataaataataattttgaaacattttttttattttagcaattaatttggaacgtctacaaatggactaaatatacgtacattaaccatttttcaaacttgcgaaatattgattttaaatttgtatatgtgaaaatatatgatgtttatatgactagcaatcaattcatatagaacgtgaaagtcataattgtgaattcagaaaatctgtatttaaaaataatcatcgctaagatggattaatatttcataacaactaaattcgaaacttatttgctaatgaagtcttcgttttcatgcaaaccattataattcactccaacaaacagatgcatgcatttgctttctatatgctcgaaattattaattgttaattaggaattaaagactatcatgttgtattcggcgtggagcttgttttaatctaaataaattgttataatttggacctccgacatatagatggacaggtgttttaattattaacatagttattttctcaaagtagatgcagatacctcgaatatgttagcataggtattgaaaatggtgggaaaacctctgctgccaacatatgactctgcttccacatttaagttctcataccgcacttcaatagtcggaagcttgattccaaccctgcacaaaagaaaacatttctctgaaaaggagaattgataagaaacctttctcagttggagaatgaagctttaacgcaacctttctctgaaaaggagattaaggatgctattttccatatggagcataataaagcaccatgtccggatggtttcctggcggagttttaccaagttttttgaaatgttattaaaaatgacctgttggagctttctaattatttccataagggtgctctacctttgttttctcttaattttggcacaataattttgttacctaagtgtgttgatgccattaagattcagcagtatagacccatatgtttactaaatgttagttttaagatttttaccaacgttgcaacgaatagaataatgggggttgctcaaaaagttattagtcccactcaaacggcttttattctaggtaggaatattatggaaggaatggttattttacatgagactatgcatgaattacatcataaagataaaagcggtgtaatatttaagattgattttgaaaaagcttatgataaagtaaaatggtcctttgtacaacagatgttgaggatgttgaggatgaagggcttctcgcctaaatgttgtgagtggatagcttcttttatttaaggtggtcatgttggtataaaagtaaattatcaaattggtaacaattttcaaacatataaaggtcttaggcaagggtatcctttatcaccaatcctttttgacatagtagctgatatgcttgctctgttaattaagagagctaaagaggtgggtctcttaaaagggattattcctcacctagtggatgatggtttgtctatattgcaatatgcagatgataccattatctttttggaacataatttgcaacaggcaaagaatttgaaattgattttatctgtttttgaaaagctatctggcttaaaaataaattttcacaaaagtgaattattttattttggtcaggcaaaggagtattatgatcaatattccaatatctttggttgtaagttaggttcttttccttttaagtatttaggaattctaatgcattttaggaaactttctaataaagattggaaagtaattgaagaaagaattgagaaaaagattagtagttggaaagttaaacatttatctgtcgggggaaggttgatcttgattaattctgtactttcgagtttagctatgtttatgatatctttctttgagataccgaaaggggttatccaaaaaattgattattatagatcatgcttctttcggcaaggggatgatcataagaaaaagtacagactcactagatgggatattatttgccaacctaaggatcaaggaggccttggaattacaaaataaatgacttttgagtaagtggttgtataagcaaataaatgagggaggggtttggcaggacttattgaagaggaagtatctttataataagtctataatctaagttgacaagaaacaaggtgattcctatttttggtcatggcttatgaaagtcaaaagtatttttttagatatgggttcttgtatcgtgaatgatggggaacaaataagattttggtaagataaatggctaggtaacttagctttgaaggataaatatccatctttatatgctatagtccgaaggaaatcatcctctattgccactattatgggatctgttccgcttaatgtttcttttagaagagctttagttggtaagaatcttatatactggcatgaattgtgtgcttctattgtacatattcaattgaatttttcttctgactgttttagatgaaattatcatcagaatggtaggttctcagtaaggtcaatgtatctagctttaattaacaatggttatgttgagaagaataactatatttggaaacttaagatgacgcttaagattaagatctttatgtggtacttgcttaagagggttgtgttaaccaaggataatttggcaagacggaattggaatggtagcttaaggtgttgcttttgtatgaaaaatgagtctattcaacatctgtttatggattgtcattatgcaaagttcatatgaagagcagttcagttttttttttgttttaaccttccaactagtatatctcatattttttatgggtggcttttaggggttgacaagaaaaagagtaaactgatacttgttggagcttctgccatttgtttggttctatggttgagtagaaatgatatggtttttgacaaatcaccatctatttcctatatgcaagtaatttcagggcaacgcattggctccggttttgggcacagctacaaagatgtgaggatgatggggagttcctaaaagttgcgtgccgcaagttggagtcgatggttattcaactatttgccaatcataggtggaggttcacaagtagacttcaataaatgtgttctccttattttggcttgggttcctttgtttttgttttgtgtgttctttttatctgaactacactcttttctagggtgctacttcgtaataattggctgtagctctttttgaagaaaggccgggatgttatattccattatctaaaaaaacaaaaggaaacattttccaattgaggattggaaataaaagtttcaaaattaatttaacatggatcatcttggtcttaattatcgattttaaaaaaatataggaacacaaaaggatatgtttttataaagtaaatttcactttgggtcacctcttattaccgatgttttgctttagattgcctttcatcaatgttttcactttggaccggatattgttgcctttggttcacattggaccatcccgactctcttctcaagcatatgaacaatctccaatacgttggtttttacttgtcaataaacttccacaactgtatgtagactatttctttttttttttttggggaatgtagaccatttatttgacacacaataaatcgaatgtagatggataaaatagttgggactaatccaaagtaataacagatccaaagcaaaacaaacggtaatacaaggtggcataaagtggaatttactttaactttttttctatccaaaatatactgcacctgtggagatgaccaaataaatatagaagcatatgaactgactacatgaaaattaatcattgaattaccttacaagatacactcataagtttattttaaaaaaattccgtgctatggatcggatcatcacttttggtactgtttaattcctaaaagtacaagtacggtgcaacctgcaacacaatttcaaaaatataccaccaaatttaaattttcaaaactacatatagtccttgagcgcatataatttacggggaaacggtacgtgttggtgtgtgtggggtgtgttcaacgtcgtgtacgtaatcgcaaaaaatagcagagaaaccgcgcacgatagagctcggctacacgcgtgagcactcctctgactgatcacccgtataaaaatgattgctaccagagaagtgatctttatgggtaatgtaaaaatcacattaatttcgatttaaattgaagccaggacataaaaaatttatttatagtcccgattaaaaagtagaacatataaaaattcatttgtagtcccggttaaaaaaacgttcgtgactttataatctttatagtaccgcggttggtggtactaatcgattaatttggccttaccgatccaaacgttccttgaacatgcagaggaagcccgcgtggtcgtcagcgacgcccgcgacgcgctccagcagcgcgcgctgctcgtcggcggcgagccgccgcacgttcacctcccgcagctcgccgtccggcggcaaggccagcagcgccgtccgtgctcggtcgtaggtcggcagcttctccagcgccgcccaccgcaggtcctcctcgtcgtcctccctcgctgacgacgacgaccgcgagaacacgctgtccgccgccgccgccgcccacgcccagccgccctcccgccgtccgccgccgcacccgtaggtctcgccgccgccgccgtccatctcgccgatcaatgttgttgcctccggccagtgatccgatgtgccacgagaccaacgtgaactgaggagatgctggaggaaagaaatgggcgcaattatatatatatatatatatatatatatatatatatatatatatatatatatatatatatatatatatatatatatatatatatatagcacgcgcacttcgaagcaaaagctaatgtagtgaaaaaatatatatttgttcggctttttaataaaaaatggattaaaattcagactctacttacctcttaaattggatgtactatacacagccaaaaatatatatgttcgaattagcacagtatttctttttaaaggatatagagcacgtccgtttgacaaatatgacaggttggagttgtcctgtatataataaaagactatccgccctcaactgtactataaataaatcatcatcactaagtattaattcttttatttaatattgtaacttgtttatgattttttttaactaaaaacacatgggtacgacgatcaaagaggctagatagcaaaatagatcgcaaatagatagcaagtagccaagtaccaataccgccggttgaagttgtaatagaaaatcaacatattttttaattgaaaatgttagtatagctgtattttttaattatgacaaacgtatgggcgtcgattatgttaatcaccactcatttctgattgtgcttatcccattaattgaatgcagttgtacatgcccttgtttaatttgatgtgtgtacaccaccagatcagtatatatactatattcagacaatttagggatatattaggatgggattggaaatggatatttcctcttttttcatcttgtagaagttaaatttaagcttacatgtttattaattgatatattacatactaaactatattgtgattttttttcataactatttggatgacatgtaaataaaaataaaccagaggacatcccctcgagggattaaaaacagtttgccatatataattgacgtgtttagaccgcgcactactatagaaaaatcatttttcatagtgttacccttttccttttactggcgggtttgataaaaaagcgcttgtgaaaataattgagagggattccggttaccgaccgctagtgaaaatacaattttccctgcggttgtcaaggaccaccgactgcaaaaatacttttgctatattaaaataaccaccaactgcgacgaatccatctttatctcctcctccccccagactcaacgccttagcgataactcctctcctcctcctcccttctacctctcctcctcctactcctcctcggcgagcagtggcaactcctcctccttctcctcaccggcctcctcctcccttctccatctcctcctccttggcaagcagcggcgctccggggttggcgcggtgatgggtggccggcgagcggcgcgcagtcttctcctcttcacggcggcggggcacgacctcctcctcttcgccgcgccatatgctcggggccagatatgccgcccgaccagaggggaggctggaaccactgccgcgacgacgggggaggccgcatccaccgccacgagaatgggggaggccggatccgctactgcgacgacggaggtggccggatctgccaccctgatgacgggggagaccggatccaccgccgtgacgacggtggaggttggatccgccaccgcgacgacgtggaggccggatccgccgccgcgacgacggggaggcgggatccgctagctgccgtgatgacgggggagccaacagggagggcggcgatggtggcgggagggtgggcgcggatctgacggcgtcggtgcttgggcggccctccttggcggtgaaggaggtggatccggcggcggctggcacaacgacgacagctgctcccgtgatgacaatgacggttaccgtgatgatgatgacaacggctaccgcgactccaacccactcccctctactgcctggcgaccacggcgtggacttcggcaggcggcgcccatggtgaggtgtcgcgatggccgccggtggtgcttatggatgtggcggccagtggcaacattttgaattttttttatcccaaaattgttttcactggcggtgcactttattttgccgctagccaaattactatttttggtagcagttgtcttagcatagctgcttgcgtaactcaatttttccaagcggccagctggccactagtgaaaacacattattttcactagcctttaggtaggggtgaaaacttatcggataatatccgacccgatccgctccgaatcgctctgaaacgaggatatggtatgggcttttcgaaatccggtagatatgaatgtggatgcggatagtataatgtggatgcggatgcggatatggtatctctaaaatccggtgaatgcggattatctgatatttatgtcggattatctgataggccactttccggataatccgaaattatcaacatatgtgatatctctatctattgcatataacataaattggttccttcaatgatctaattcatcaattaacctagatttcttagtctgaggctttcaccgtttcttgtcagacttgcctagctgtatttttatattatggacctcatattcatgttgtttggcacttaagcatataattattacgatggatcgtttattgattattatattattgttcattgcattactaacttgatattatattggttgcatacacacgtaacatccgataaatttattccattcccgaactgattccgcaccatttccgacatccaaaataatccgttccgcatccgcgtccgtacactatccgcacccgcttcgaatccgcttaaaaatatggtttaagatatggtatgaccgtccgaatccgctctgttttcacccctacctttaggcattggaggcacctctgtccgccaagaaaaaaaaaaccttttttaagtagtggcggctatctatgcaccataaccaccctataaatagtggctagatttttagctatttgttgctcattgataaatagcactttatattaacttacacggtcacgtaggtaaataaaaaagagctgccagaaagctgtatttgtcaggagcaagccactagaaattatgggaaaatttgaaccatgccacgcaaattttgcaaaatttgtgatatgccaccctaacccacatgtcattgactcatatgggtcctacatgtcattgagatacgggtggcatatctcaaattttgcaaaattagggtggcatggttccaacaaacccaagaattattgggttcgaatgacatgataccaccacctaaaattaaatcttcggaaggattaatttgattcttctcaatatcttgtactattttgttcagcgaaaatggtaaatatcttgtccaaaaacttattttaaaaatttaatatggcattaaaatgtggtaaaactttgctataaaatttatgagtagctagttgtttcgatacagcaataccaatacttcctctggttctatattaattgacgttttggacaaggttgtcgttaaacttttataactttgaccatcaataactttaaaaatatttagtttaaaaaaactagaaaaacatatatagatttgtctttcaaaacactataataaaagtaaacatgcatttatttattgcatatattataatagaaaaataaggtcaaaggtatatctcgtagagcgtgtcattatccaaagcatcaattaaaatgaaaccggagggagtaccaattaatagagaatcaaaaaccaattaccgagggtcgtatatactaaaagtctatacagttaactaatataatactccttcctttttttaatagatgacaccgttgactttttctcgtatgtttgaccattcgtcttattcaaaaattttatgcaaatgtataagatataaatcacacttaaagtactatgaatgataaaacaactcataacaaaataaattataattacgtaaatttttttaaaaagatgaatggtcaaacatgtgagaaaaagtcaacgacgtcatctattaaaaaacggaggtagtagttaacatagcttcttaggccatgtacaaagctagagtcagacatgagctctacgttatttagagactagcatcctacaacagttggagacaatatgatctctaatcattagtgtatcaaaatattttttccttactcttctttcctttctttcaccaccatgcaacaaaaattactctaataaatgttaagagtcgactctgagccgttgtcatgcataacaaccatatttctcttttgtcctttctctttcttccatgtcatcaaatttacttgcatggcaatagagagactactaataaagacggctgtacatgcccttatatttcttgcaataaatggatgatgaccctaatgatagtatttatatgataagttggcttgtacaatgatattttttgaaagttgtctttatcgttgtattgtttaaagtagagcgttcatcaatggcatttgttgtattttctattgttataaggctaagtttgattgagctacacctaagctattttctcattatctatagacacgtttcccaaacaacttaacatgtttttcgtataaaaaactttatataagaaagttttttaaaagtatcaaataaatatgtctttcaagcttgtagtaatactaaaataatcatccatcaatattccatcttggggttcattcgtttcaaagaaattaattgtaaacaaaaagtacaaaaatatattatcttttgagatgcgtactgaactaccattcgtttcaaaggaacaaaaaaaaaaaacctcctttccctccacttttagagggaaaacaaacattaaaaaaaataatccactccaacccaatgttgtcaatcttttgaattgtttgctgcacaactatagaaaaagttctttatatttttcaatcctttaagtgtacatgtattttcatactatttctacgttttaaaattcctataaaccgaacgagctcttgattagttttgcatgaagcaatttgctccagccaaaagtcctgcgcgagcgatcccttaattagtttcgattaattacatcagcgagcatggtatccccaattctcccaccaatgcaagacaagacatcagcaacatggtacagtacgtacaacggtacaagtcccccccccctcccccttcaaactcgtggaacatgtgcatgttgctatgtcttcccgtcattaaatgcattaggcagttttataccagattcaatacaatctttagaaaatgttataaaaaaacagaactctgtttagggcatgtacaatcactgagatggctgctctctctctctgtttcaaaatataaatcgttttaattttggtcgaagtcaaactaatttaattttgaccaagttcgtagataaatatagtaatatttataacaccaaattaatttcataaaatctataattccatataaatttataatatattattttgggttgaaaatattacttttttttcgttaaaccttgtcgaacttgaagcagttttattttgaccaaagctagaatgacttataatctaaaacagatgaagtaatgtttaaaatagttaggcatgtgcaacaataactatgtactccctctataaaaaagacatgtatccggattcattcctagattttgaagttttttgacgcagagagtagatatccattctttctataaagacccaaagctgaaacctcagtgttccacgtcatcgctaattctcagtcgttcgatcagtggatgagatcgcatattaaccattggatgagaagatccctgcatgagatgtcgaggagtgaaaaacctccctctgtcgaagtatatgatggcagcagctagatcaacgatgatatgcagtgactgcgaggattaatagtactccctccgttctaagtcataagacgttttgactttagttaaagtcaaactatttaaagtttgactaattttatagacaaatatagtaatatttataatactaaattaatttcatcaaatcaataattgaatatattttcataataaatttgtctttagttaaaaatattactactatttttttataaactttatcaaatttaaagcagtaaagtcaaagcgttttaaaacctgaaacgaagggagtataatggaagtatgcatttggtcaaaggatgataaaatgaattaagcacgacattaaagccattaatcacggccgctcggctgccttttgatggcgatattccattgcccgagaactaatctatcggaagaggaaccatccatcgggccatgtgtgatctagaagtcgatgtgtgatgtactggtggctgttcatagtgaggcgaagaggatcaatggctcgagtaaccatgtttcagaaacaggtatttgccctcttgagacctgcttctttgctggtactttgtttccaatctacttacacaatttgtctgtatagctgtataattgatcattctttcgtacaccctgcatacttacgtacatatgttattcctccaaatatctgattgattgatacgtgatacaatgttcaggcaccatccattatatttgttcgttgattttgaaatgatttttacatcatatccaaatatatatccaatgtttctgcccttgattatcttctacatggacctatccaacccactagctgcatttacagtaattgtggtggttaatagcgatcgatttcgcttcaggaattgtagcttgcacaagtcatggcaagttgtctgatgatccctgtgtcctattgactgcaatttaattgatctctgcactaaaacattgactttgcagccttcagtctctaatagtttacatgtatcattcgttctcccattttttttagtgaaatcactggtggagaaaccatctttcgtcggtcggacaaaatccacaatagtgtcccggttccactaaaaaccgggactaaaaatgatttttagttccggtttataagagcaacaggaatatttgatattcagtagagttaccaacccaagttaccaaccgagagtcccggttcatatgctgtaagggcttgtcgcccccccccccccgatctttacacccgattagtaacaccaactgggactaaacatcctaactttagtccaaagatcaatccctttgtatttggttttttcctcctccagcccaagccaagcttcaaaattcttctacaagaggggaggtcatgccaaaatttcttgtgaatttattttggtgattatatacaaatcagaggtatgtaaaaggttagcaacttcttcctccattgtttttgttgtcatattacatttggagctatgttttgtacacattattatctctaaaactttgttggaagttgatgagagagaaaatttgtgtagggaagaagaatatattgaaattttgtttatttacaattttataaaaaaaattataaaatagctaagaagaaatatatattgaaaattaatctaaaataatagaaaacaaactaaattgaaaactaaaagaagtacaacacattaaatattagtttaaaacttcaaaaataatttaaaaagaataatttgtgagattattttataattattgtatgaataatgatatgtcattactgtatgactatttagtggatttcactttcattgaataattttatgatttttttgcatttcatatagatggatcggcaatggatgtacgcggaccggtggttgaaagagtttattgacggcgtgcattattttttgagagtggcagaggctagcaagcataagggttttatttgttgtccatgcattaagtgcaagaaccagaaggattgtacagtaaggactattcatttccacttgtttgagtaggggttcatgcctagctataattgttggacatcacacgaagagataggggttcaaatggaagaagatgaagtggaagacaagaacattccggactgggttcagtacgctggatttgaaggaaatagaacgggtgaggtggacggggatgttgacgataatgacgctgcggatgatcttggtcagatgttgtaggatgctaagcaggattgtgaaagtgaaaaagatgcccataaattggagcatatgttagaagaccacagaacgtcgttgtaactaggttgcgaacaggggcataaaaagttgggtaccactctagaattcttgcaatggatggcaaaaaatagtgttactgacaaggcatttggcgatttattgaaactcgtcaagaacattcttccggagggaaacaaattgcctgagacaatatacaaggctaagaagatagtctgccctctaggactggaagttagaagatacacgcatgtccgaacgattgtatcctctatcgcggtgaggagtacgagaacctagaagcatgccctttttgtaaagtactacgatacaagattagacttgatgatccaggtgaagttgacgggcagccaacgaagaagagaattcctgctaaggtggtgtggtatttccctataataccagggctatggcgtttgttcaggaacaatgggaagcccagaatggtttgttggcacgcagaagaacgtcaacaggacgggatattgagacactccgccgacggttcgcagtggcgaaacatcgacagaacatttaaagactttggagaggacgcacgaaacataaggttcggtttaagtatggatggcatgaatccttttggagagatgagcaacacccataacacttggcctattatgatatgtatctacaacatccctccttggctatgcatgaagaggaactacataataataccgattattattcaatgcccaaagcaacctggtaatgatattaatgtgtaccaaagaccactggtcgaatatctgaaattgctgtagaagaaagaaggtgtcccgtatgggatgaggacaaataggagaagttgaacctatgagcactgctgtttgtaaccatcaacgattggcatgcacttagcaacctattcgggcagtcaaacaaggggtacaaggcttgcactcatagtatggctgaaactgaaagtacgtatctgaagcattgcaggaaggttgtgtacatgggccatcgtcgatttcttgttgcaaaccaccctgtacgaaagaaaggtaagcactttgaacataaggcagaccaccgtattaagcctaaacatcgcagtggaaaagcaatgtttgctatggtgaaaaatctcaaagtagtgtttagaaaggggcccggcagccaacctatagagaacgaagatggtcacgcgacgatgtggaagaagaactatattttttgggagttaccatattgggaatttttggacgtccgccacgcaatcgacgtgatgcacctcactaagaacctttgcgtaaatctgatgggcttttaaggtgtatatgggaagtcgaaagatacactggaagcacgtaatgatatgaagcatatggaacaacgcggcgaccttcacctagaaccaaaggagaaaggaagccattacttgagtccagccagctacactcttagcaaggcagagaaggaaagtatgtttgaatgcttggagagcatcaaggtaccatctggatactcctcgaatataacgtgaataataagcatgaaggagaagaagatcacaaatctaaagtctcatgattgtcccgttatattcacgctatagtaagtctcatgattgctacctattatattcggggtatccttcccgacaatgtccgggcaacaataacaaagctatgtgcttttataaacgcaatttcgcagaagatcatcgatccggatatattagaaggccttcaaaatgatgtggtgcaatgtcttataactaggtataaattgaatacttataactaggtacatactcataattttaaaattatgaaaaatttgggcgaatttgtgtatttcataccatggtgccccatatgagtgtcctatatattatgcatatatatatatatatatgtatatatgtgtgtgtgtgtgtgtattgaaacatatatatgcataatatatataaaccatgcagcaacagaggcatgcaaataaaaaaaagataaaagatcttgagtcctggttggttacaccaatctggctgagccatctttagtcccggttggtggagactaaagatcgatctttactcctggctttttcacttgggactaaagatcgctgtctttagtacaggcgggtccaaaccaggagtaaagacagtttctccacaactgccagcttggaagcatgcacgcgtgctttgacatgatcactttttctacaggaaattaactcgtacgtacggttaattgttgttccatatcactttcaatcgcgtagcaaatttcttatagcatgataaatcagtaactacgtacttgtcccaagcgactaattaatctattttaccaccagcaccaagtggtatgcatgacctcgtcacccatccgttgtggcacaaatttaagagagaaaactagtacatatacatgtacaagtagtagagctaaggtcaataatgcagcccactgttggctaaaaaaaataaccatgtcatttataataaacgttgtaactaatgtctatacaataggacatactatagcacaaatattttatctttaatgggacccaccatcttcccaacatgtagcagtttctgctcggaaatcctaatgggcgggtgatcgctgccccatcggcccagcgatcacctcccttgcccctccccaatactcagatacactcttccctcctctccccctttatcctccccttcttctcttcctacggtacaccacacaaatttttttaaaaaataaaatttttaaaaaataaaagttagaaaaatttatgtatagaaatactatatataaaaaatttgaattcaaattcaaatttgaatcgggcatgtacaattttgacttataaactttgggtctataaactttaggtgtataaactttagatgtatggaaatactatatatagaaaatatttgaattcaaattcaaatttgaatcagatataattcaaattcaaatttgaatcgggtatataaactttaggtctataaactttacgtgtataaactttagatgtataaaaatactatatatgaaaaatatttgaattcaaattcaaatttgaatcggatatttgaattaaaattcaaatttgaatcgaatataattcaaattcaaatttgaatcggatatataaactttaggtctataaactttaggtgtataaactttagatgtatagaaatactatatataaaaaaatttaaattcaaattcaaatttaaatcggatatataaacttttgacttataaacttttagtctctaaactttatatgtgtaaacttgatgtgtataaactttaggggtataaatttactaaaataggaaagtaatgcggtgccaaaaaagaaagggaaaatttcatctataccacaaacttttgagcagtaccaaaaaatcccaccttcccaacaataccacaaaacgcaacagaagtggaacgggaagtggcgtttacattttgtaggaccaaaatacccttgtgcacagtggagaagatcgggagaccgtgcgacgggagagatcgcgtgcgagagtttctgttttccttttcttttactagtaattatgcacgtgcattgcacgtaatagccaaaataaattaaatcaaacatatcactatgtaaatttaccaacgttagtggctttcaacttaaacactacagtatattcatacaaagcagcacaaattggcaaactatatgcttcgtttaattttataaaaccacatccaataatataatcttgaaataatccaacaatagattttgatcataaattcaagtatagtacggattcttgaagaataactttattaatggacaaaaaaaaaagtaaagtgcacaccctgaaactaaattttcatttgtagtccatgcatggtattaatttgtttttccataatctccaatgagtgctcttggcagaaaattgaaataaataacaatgctaaaaataaattaaagggtccaataaccatgtatagtatgacaaaccgttttcacaacaaaatctgacaataactgtttgttcggtactatccaactatccaactatccaagatcaacttctcatcgaacttgtgcctcgcattgtcctgcttcaacctcacaatcccatatcagaatggctgcacactggatgtgcatggcccctttcaaagtgaacacactattattcaattccagcatagctaggaactgcccatcaattcacccaaggaccagggcactaccaattgaatgatctacttccaagtacaggtttcagcccccattcagagatcctcaaagatgattgtgtcaaaagcaatgttttaaatagcgtgctaagacatttagcgattagcttctcaaacagctgtagcggcagctatagcgagctaaacagagctatagcagctaaattatacatgagagcaaatagttagaacccttgtcaaacagctataacgggagatttaaaaccctggtcaaaagtatcaatgaacctaaacatgtaagccacattgccagaaaaaaacgtgagcaaactcaatgtataacctgagattataacctcacattggcagttgatgagtttgatctgtaaggtgctataactttacattatatcatacccaataatgaatactaaatcatatgtatagttagattgaaggggaaaatcatctaatttgagaataaaatacaatatgattctataattttattttgaaatttctggctgggtatataattcatagatctggctgatgcaaagtatggttctctgtcgtttgtacagaatatagacttttcaattaaatatacaagtcaaatttgttatctaccagttttttttcttaatggtgcacttatccatattaagattaaaactacagctttcttgtgaggatgtatattgtatctgtttggaaccggcctatgcaaccttgcttctgttcatcattggagaagtaaaaatcttgccctatagtcagtataaaactatatttagaataattagattgctctatagtataaaaagaaaacaatggtttcagactatcagtctcttgtcaatctgctaacatataattatctaacctataggtgttattggaatggaagaaaaattatatcaaaatatcaaacataaatcttaagttcttgcaatttgctacatgacaactgaatgttcctcatttccatcttacaaaatctactctgagttccaagcacactatatactttttttttctggaaaatgggagtttgatagtaataaggaaaagagggataaaaataatgtaatcatgcagaggttaataaacacaataacaataatcatgcagaggctgtcttgttgaaaccacatcaatcaattcaacaactacacaataacaatcagtaattttctctacaattaaaatgaacagaaaaggcagaatattttggtttccctagcaaaatattcaacagttggctataattcaaaaaattttgaatactggataaatatgagttgggacgtcctatggttgccctagggcgcacacccccttggactaagcccatgacacaattataaggcccaaaacccaaatacaagattgttgaaatggttactatcaaatattcaacagttggctataattccagaggtagaaatcatcatcttggtagggttactattgtttgctcagtagttttatgaacttgatctctcatagataggattttttatgatgaactgtttgtgtttgattctggttgcagtacctctcgaacaactttgtttgccaataatgtgaagttactacaactacagctccttcaactcccttcttatgtatctgaaaaccattcaagttatgttatcagcatttccgataaatataaagaagtcaaaatcacagtgaattttcggatacgtaaatccacatgcatatgtttgttaaacattatagacccataatgtaaaacaaagtgaatcaaagtatacttgactgcatgacatatcagccaactaacaaagaaaaaaaacagccattaggagtgaggacttcctaattatcaggaattaggagtatagaacttcaaggataacatcaggaccaagtaatagatccattatgttgaaaaaaaacaaaagtacgagaatatggttaggtaatcgaaacagatagctagaccaaaacatagtcattgattttacttcctagcattggattcattatattgaaaacctgaaacaaaatatagaaaaaaatacagtaaattggaactcattagaaactccaattaaggttaacagcttaggtcaagacaaatacttatccacatgcctgcaggtacacggcagcatgcactatggtaaacatccaaaaaaaagcttcaatgataatgttcagaaacttgcctttgcagtgagaagaatgtggagttgtggttgcagtcttgcagaggacagaggagattggcgcgtgaggaccagcagaatcagtagcacctcctcaccttctccaaaactttcattaggtgtaacgtttctatctattgtacaatttatcgccaaatcagaaacctgcaagagaacaagtcgaacaatgtggcacttgatttcataaaagcggcagtattatgaactatcagctatctgattgatagcaagaagatacattttgtagtttatcattatatatacatatcatccattccttataatgctagtccagattaaatcatgcatagtcatatatggaatatggatatttattcaactaaaaacatggcacataaaacattatacaactcaggtccacattcaacttgaattgctgtcacagaaaaagggaacataattggaagctgcacgttgagccaagaacacaataaaaaacacaccatttttacgcccacactgccggtacatattttatgcaaacaagcatataattatgctagtccaggactccaggtcaaatcagtacagggagatatgaacgcagaaaggcactcaccgttgtggaactcgtgaccacaccgctgcccgccatagacctcctgtctgaatatgtatgctaggtcctaattcaagtgactggccaaaaaaaaaaaaagaaagaaatcatgattcaatcatttgtggtcacaatcaaagttcaggcaatttatgaaatggagctatctctaaaattttcaggttaggataagaagctggcagtgtgggcggcaattagacgacttcacttaatgggagtttggcaagttattcatgaatggaaattagtacacctttgaaatatgtacaattaccggcagtgtgggcggcaatccgaggttttaagttagatatatacatattctgaaatatataccatgtcctgaatctgaaacaacaccacttgttttcttcaagtactcattaaaaaaattatgcagcaatcaagcaatatcactacaagtgggacaggataactcataaaaacagtaggaacgtttattttggtcaaattgaactgaaaagaatttgtggtcctggaaataataacaattaatatacacattgggagtaagaaaattcaaccaacgacatactgttgtgagaataatttagggtaatctacagacggagttcctcactgaaaattttgtgaagtgatctacaaatgagatgggagcaaaggggcttgtgcttcagattaattttgcatatgctagtcttcaacgcacaaaaaaattgtgaatgtcagatcggagctatacaaaattgaaagcaaggcaagcattaaaggcaatggttgaactaatatgcacggaagaatgtaatatgcagtttggccaacctggcttaggcaaatcaacgaacacattgcataaatcctagggattgataaatgctacgataaaaatgggatggtatcgaagcatcgtttagtgattaactaacctaattaaggatttagggatggatcgagcatatgattgagaggctgagagctggcgttggaaggcagacgcaccagaggcgtggtggtgcttcgcgcggcgaggaggtttggagagcgcaggggaaggagcagtgccgggggggggggggggg

SEQ ID NO: 29435 - DNA, 3409 bp, Oryza sativa
cggagtgggaagtgggagatcgctactaattgaaggggtgttccactttcgatataaaccattggatgaatagatctaagggtcagaaaagagatgtttgatgaactcgtgctttttttgttattctagatgttttccttttctgtggaaaaaaacgtgcaatagattagatcgatcgtttccttttctttttaaatctctttttcttccttggaaaaaaagtaattttctgtttgcgtgcgatagaattggatcgatcgtttcttcttttatttttaaatctctatttttccaaaaaaatgtaattttagttttttaaaaaaatctagttgttaaagaaccagcatgacatgcatggtgagcactttgtttttttttttaccattatttcttaattacgtgcacctactgtaaagaaaattttcgtcctttcatgaaaggaaatattatcaacaaagttttgcaaagtaaaaaggataatatttcttgcataaaaaatacatcatcttagtagtttctaggtgacaaaggaaaacaacattgacaaacaaaatgactaatccatcggtgcttctcaaactcccccttgatagcattgatagcatgttgcctcatagcaagtttaaattcttttccattggggaaattgacgtttttactaaaatttgggtcctccctattatgcacatagatagggagtgtattttcatctagtggtccatcatattcacacacaaaaagtggatcagactcatcgggaacatctgagttacaatcatagaaggtattgttgcctctttaatacacacggtatcatcaaccccatataagtgctcctcatcaacaccaattggctcatcttcctcattcaatctatctgggtcaccgttaaaagcatcagtccaaaacatagcctgccattgtgatatatcatgtattgtggtgccatgctccttcccaccagcaacatctgcatctacattagtggcctttgtattagcaacatctactcctatcccaggcttctctatcccgttagcaggctcctctatcctgttagccgcatctgcatcaactacaacccctacttgatttacgttggttcccctttcaggaatagccctggaaaatacaaagttgattctaccgttagttcatacctacgttatagtctaaatattctacttgggttaaaaatcacaatgaaaaagaacataaaacgtacccgtgaagaagcgcttcgtctgagggcggcaccatcactcgtatccacagaaccacgatgtcacgcccagaaattcacgaaccagaatttctaagttgaatgtgcattaaacccctgtccaggaccagccagggtacacaaacgacaattgttgacatacagatcgacgtcttacgaaaatataaaagattacaaatgcagcggaaaagataaaacgagctagactcggaagctcgacttctgcagcgggcaactccactccacaggcatctcttgacggcagcgacgaaaccaacctcaacaagacagctccaactaggaagatcttcagctctggtgtaggggaaaagagagcaagactgagtactacccactgtactcagcaagtcataccggaagaggaggtatgatgcagggtataaccaaaaaaggctaaaggttcatttgcataaagcaggcatttaaaaccagtagttgaaaacggtaaaacagctgtagtaattaatcaatattaaccaatcactgttccacgaaacaccacgttgcaacaggcccaaccaaccacctgaactacaccaattcattaagcgaaactaggggtgagactaatcacggtgaatctggttgatcgcccataaccgtgggcacggctattcgaatagttttactctggccagaggtgtacaactgtacccacaaaacacgattccacacatgtcaccatgccccgaagtatcaccatgatactgcaaagggggaaatcgtgacaaaaccttccgcataaccctcccctacccatccacaccacgctaaggtttcacccccacccccaacgggcagtgggcggtcccctcttccgccgcggtgaatccggcagctggacaaccggacaccccggctgacccaactccatcacgcccaccctcgccaccggtgcctaggaaagggtcgagctataccccaggtcaagcagttacccactcccgcttgtggtaagcacggtaagtctcccagggtttcccgtgaaccggtacttaactgccatgggtgcgaccagcaaaaccatgcacccacagcccaccattcagtgtattttaattaactaacactattgcggtggcaccaatccaaagctatgctcatagtcatagtctatgtaataatgtaatccccatttgtgtactagtggaactaagcatggctaagcatttcctaaaccaacatctaatcattttgatacccaagttatcaatggcatatggtaaataatatagggctgagtaataggacccataccccttacctctgtaaatgtatgagacactgtagtaaaattcaggagatttgtcaatagcgtacaatatgatctaatgtaatgcatgacttgccttgctctcgcattgatgagaccacagcaacgtcttcgaggaactcgcagatcgacgaaacgatcgaaacctatacgacaaacaaagcacacaagcaaaacatgctataagactactgaaacagagaacaaaactatttttaatggattctagggatttttatgaatttactgagacttgaatggacttaaacggagctcggatgaattagatatgaattttagaaaataatctgtgtttttactaataaagaaaagtccttaatcaatttattgcgcaataatacccagggctgacgtcacccaaggggagggggcggcgctgacaggcggaccccgcgtgtcagcagctcaagagagagggagggggcgccggcacgtgggccccatgggtcagtggcacaaggcggccggtccaccgtggaccgggaccacgcgggtggtccaccgccggtccacgggaccgacggtccagatcggccgggaggccgatcggacggcacggcggcggctaggcacggctaggctcggctcggccggccatggggagcggcggcggcgaacggtcgccggtgacacgggaggcggcgacgactgccgaaagcggcggcatgggaggcggcggctacggccgaaagcggcggcacgagggagaggagagaaaggggaaaagaggaggcgggaggcctcaccggggtttcgccggcgcgagaggaggcgacgactaacggcgacggcaagcggccggaggacgactgtgacaggcggacaaactccgggaccacctatgggacaaa

SEQ ID NO: 29436 - DNA, 3434 bp, Oryza sativa
gggaaaaaggaggaaaaagaaaaagaaatagaagaaaggatttttcctgggatttaaaattgcactttggctcatttttaattggttaaaattacttttaaggctctgaaaattgcactaaaaatcctgttaatgcattagggcatggggaactcaagaaaaattccaccacgctatttctgattgttgattttcatttattaattagggaattagctctaggttaattcaaaccattttcttcgaacgatttatttaacaattttttaaagaaagaagaagaggaaaacttccgggcgtgacaaacctaccccccttaaacggaatctcggccccgagattcggaagagctggcgaaaaggtgcggatgggtggccttcaactcatcttctcttttccaagtggcctctttctctgagtgatggctccactgaaccttgcagaatctgattactttgttcctggtccttctctcactgatttcgaggatacgagtcggcttctccacatacgtcagatcttcctgaatttcgatttgatccggacttgcctgttcctcaggaactctcaaacatttcttcaactgtgagacgtggaacacattatgaatgccaaacatgttggagggaagctcaagctggtaagcaacttcacctctacgttccaaaacccgatatggtcccacaaagcgtggtgccaactttcctttggtttggaagcggtgtactcctctgagcggagtgacacgaaggtacacatagtcccctgcttccaaagtgagctccctttgacgattgtctgcatagcttttctgtggagattgcgcgattctcaatctttccatgacagctctgactttctcttctgcctcatttaaaacttctgtaccaaacaactggcgttcccctgtctgattccagaagagcggagtgcgacacctccgtccatacaatgcttcaaacgttgccatttgcagactagcctggtaactgttgttgtaggagaactcagcatatggcaagcttttgtcccatgctccaccaaaatcaagcgcacaagctctcaacatatcctccaatatttggttaactcgctcggtctggccatcagtctgcggatggtaggctgtgctgaagttcagacgggttcccaattcttcttgcaatttctgccagaactttgaggtgaattggcttcttcaatcagacatgatcttcttaggtacaccatgtagacacatgattcttgccaaataaagctctgctaacttcttccctgagtaggtagtatgcaccggaatgaagtgagccactttagtgagtcgatcaacgactacccaaatggaatcatgtccagatgatgtcctgggcaagccggtgataaagtccattccaatttcttcccacttccattctggaatctgaaggggctgtagcagacctgctggcctttcgtgttctgcctttactcgctggcagacgtcacagagtgcgacaaattcagctatttcccttctcatgcttacccaccagaatttttccttgaggtcttggtacatcttagtactgccgggatgaattgaataccgagtttgatgagcttctgtcagtatcaagtcctttaactccttgtttttaggtacacacaatctttctcccatccagattgttccttgttcatcctcaacaaaacctcgggcttttccaactctcatgttctttttgagctcggctatctcaggatcacttgcttgagctatgcgaacctgctccaccagtgtgggctatgcctctagggcagccacgaatccgtgctcaactataccaaggttcagatgttccaaatcacgttgaacctcacaacacagtttctctacccatgcaacattgcagtagctcttcctgctcaaggcatctgctaccacattagccttgccgggatgatagtgtattcccatatcataatccttgatcagctccaaccatcttcgctgtctgagattcaaatcaggttgagtgaagatgtactttagacttttgtgatctgtatatacctcacaacggttaccgataagatagtgccgccaaatctttaaagcatgaacaactgcggccaattccagatcatgggtcgggtagttgccttcatgaggacgcaactgtcgtgaagcataagaaaccactttgccatcttgcatcaacacacatcctagcccctggcgagaagaatcacaatagaactggaaatctttcgtctaatcaggcagaattaaaactggagcagacaccaaccgtcgtttgagttcttcaaaactcctattccattcagcagaccagataaacttttcctccttcttcaagagctgtgtcattggcttggcaattttagagaagttctcaatgaaccggcggtaatagcccgcgagtcctaagaaactccgaatctgagtaactgtctttggtgaggtccatttggtaactgactccacatttgctggatccacagccactccttgagcattcacgatgtgaccgagaaactgaacttccttaagccagaagtcacacttgccgaacttggcatatagctggtgctcttttaacttttcgagttccaaccgaagatgctgctcatgttcttcctgggacttggagtagatcagtatgtcatcgatgaaaaccacgacaaacttgtcctgaaattccataaacaccttgttcatcaaattcatgaagaaggcaggtgcgttggtgagtccaaaagacataactgtgcattcgaacaacccataatgactgatgaatgctatctttggaatacctcttcgctgatcgtcaactagtgatagcctgatcgcaggtctatcttagagaacaccgtagctcctttcaactgatcaaacagatcatcaattcttggcaacggatacttgttcttaatagtgacctcattgagtgtgcggtagttgacacacatcctcttggttttgtctttcttttccacaaagataaccggagcactccaaggcgacgtgctcaggcggatgtatcccttctatagctgttcatcaacttgctacttgacttccgccaactcgttggctcccattatgtaaggcctcttgtggatcggtgcagttccaggtgccaagtcaatccggaactcgatatccctttttggtggcattgttgtcagatcatccagaaaaacctctggatactctctgactatgggaatatcctccaacttcttagtggttttctccactgctacctcttgtccttcaccaacagcctggttcaaactgatccctggcttctgcggcactgcagactggaaggttaccacttctcctttcgcattggtcaacttgatgatgcggctagcgcaatcaatcactcctttgtgccgtgtcacccaatccatcccaagta

SEQ ID NO: 29437 - DNA, 991 bp, Oryza sativa
ctcgataccatagcattgaaaaagtccatttttatacattcctcaatgatggattgagttccattcgtatctcttagtcgtaaaatcaattatagagcgtccccggccccaactatcaaatccagtgcaaattaagattctcagcggtttcattctacgtctcataacaatcagcatattgacatggttttccgttttcatagactcccggctggctcaaatgaggatgtcgatggggtcaacaaacgacgaggcacatcgagctgagatcgaagtactcctggttgacatcgatgatgatgacctcgccatcgtctgggatggcgagcatagagcaggcaatgaaacacatcagcctgccttctccatgcttgagctctactgcccgctggactaccactgctgacaatagagtggaaagggaagcaaagggtgagctggaggaagtgagaccccatatcagcctcatctctttgcttatacttatgcttatcattcaaaatttaaattttaaatcttaaatttaaagttgattttgggtttttcatcgaaatttattttttagcatttatttttagatcactaagaacatatatataaaagttttattcacaaattatttttcgtttggaaatatgttgtttcgcttattcctcgaatatgaaacgatgggggtcgtatgtatggtatttttttcttcatgtatctgacatgtggactacatagattttttttctaaagtgacactgacattggtcacattgagtttttttttatcgcaactagcatggtggcccgtgcagattgcgcggctagcatcattatattttctctcatataatagcatatatgttttctcattatattattaaaatatattacaatgacaacataattttaaattttgcaataacttttcaaaactactaatgtgtaataactactctagtcttctcttctaatattacttattttttaattatgaatttca

SEQ ID NO: 29438 - DNA, 15083 bp, Oryza sativa
  unsure (1)..(15083): unsure at all n locations
tgtgagaatttctaggtcatgagagcgaacatgnaggctcctttttttttgcgaattttagttagttttaaattcctatatgaactctatactctacttctaatatttcttatttttcaattccaaatttctactttttttcttaattgtatttctatatgaactctatactctacttctaatattccttatttttaattcagaatttctattatttcctaattgtatttctatatggactctgtactctacttctaatatttcttatttttaattccgaatttctattatttcctaattgtatttctatatggactctatactcctcttctaatattccttattttttaattccgaatttcaactatttctaaagtgtatttctatatagactctagtctcctcttctaatattccttattttttaattccgaatttcagctatttctaaattgtatttctatatggactctgttttttctttttgtctgattaatgtgagaatttctaagccatgagagcgaacgtggaggctcttttttctattcctttaattatataatagatagattgtgcatgggcatcacgttaaatgaagactaaatcaatataccaaaccaaatcattcgaaactaccctcaataccattaagcaaatcgatttatattggttttcaaagttatggaacgttctatacctatgcgaaccaaattccaccaatagttggaggtctcaaagtggacttttccaatggcatttctgtttcctgctccctagtcgtccctactgtacgctccatgtgatctgattgctgtgtacctaaaacctaccagctggtgtactcatcatagtactactgactattgactattatagcaaggaattcaatacttatattatatacacatgtttaagttggaaactttttttcaaactttcaacttttttatcacatcaaaactttcctaccacataaacttccaacttttccatcacatcgttccaatttcaaccaaacttctaattttagcgtaaactaaacacacccatagtttaggccccatttgattaaaaaaattcataaaattttagaggattttatttctataggaatttttcatatataaccctttgaattaaaggaatggatcttatataatcctatgaaactcctatggaatgtctaatgccatgtaagttttggaggaaacctaacctgaggtagaacctcgtggaaactttcttttgagtctttatctctcttctaattcatgtgtttttcctgtggtctaatcaaacggtcattcctgtgttttttttctgtgttttgcaattatctgttttacacttatattcctattaaaattttccgtttttcttattcctacgtcttctcaaattgttgcacaatgagaaaacgctactaatattttttatacgtttatgctgtaccaacccaatcatatgttcattattttagtatgataaccagcaatcgtcgaacctcagcgaaaaaaacctgttcatcatcagttcgagtgttcaacgacctttgccctccatcccaaaatctcaccgtcaccagcaaaggcagccatggatccagccaccaccgagctgcggttcgacaccccgctccttcgcatttacaacgacggccgcgtggagcgcctctttggcacggaaaccacaccggcgggcttcgacggcgccaccggggtcaccttcaaggacgtcgtcatcgacgacgcccccggcgtctctgcctgcctctacatccccgacctccaggcttccggccccggtcatcaccgcaaaaagctacccatcgtcgtctacttccacgtcggcggcatggtcctcgactcgaccgcctccccgacgtaccacaggtacctcaactccctcgtctccaaggccggcgccctcgccgtgtccgtcaactaccggcttgccccggagcacccgcttccggcggcgtacgacgacgcctgggccgcactcagctggaccgcgtcagctgccgacccatggctgtcggagcacggtgacgtcggccgtgtcttcttggccggtgacagcggcggcgccaacgtcgtccacaacgtagcaatcatggccggcgccggccaatctagcctacccccaggagcaacagtggaaggtgtgatcatactgcatcccatgttttccggcaaggagccgatcgacggcgagaacgcggagacgagggagctgacggagaagctctggcccctgatatgtgcagacgcagaggctgggctcgatgacccgaggctgaaccccatggcagaaggagctccgagcttgcagaagctgggatgccggaagctgctcgtctgctcggccgagagcgacattgtgctggcgagggcggcggcgtactaccaggcagtgatggcgagcgggtggcccggcatggctgagtggctggagtccaagggagaggagcacgtgttcttcctcaacaagccggattgcgaggagtctgtggcgctcatggacagggtagtcgccttcctcgcgggtaattgatgaaagggatcggatgaaatcaaaactgttcttgcttatcgcaagcacataaatttgatcgtgaataatgggagattggggggagaaagggatgggattttcctcttgttctctgcaaccactagttcaagaaagatgcgctaaatcggatcaagttcaggctttgttagctgtggttgttaagctctaagatgaaattcatgaggtgtttaatagaaggtgaaactgaaagcgtgtactgggtatgatgatttattgtgaggtaagttcggtgtgaaatatggaacatgatttaactgtattcgctattcttgaataaatcatgctcagtaaacaaactgtactgggagcacatgacaaaaccatttgtcaactgcagaagttgctcacctaacacgatttcaggtcgagattcgaggagatccttcattttggcctttattgcgtgaatcagagaccatttaccacacaaatgaaccactaggtgcaaacattcctagctacgattaggttttacaccctccttcagagtatgataactgataagatacccaatattacaaactcaatagcatcatctggactttagactgacattaaaaaaatggcattttttttggtgattagacaatgaagaactagaatgagtacactcattgatgttgcagttttctaaaatttactcaactagaaatgaacaaaagggatagggcaaaatttcatagctatgctgaaccttgacgcacttaggaaattcataatcaactaaaatattccttttcttttccacttcaatgatgcaaatcatcaatgagaatcaaaatcatagacagtatatattcctccctttattactagttacgagtagtagtagtataatcgctcaccggcgacacgagggataaccgaagcggctggcttcaacagcgccggacgaaatcggtcacgacggcgagctccttgacggcattgtcgcagtcgggcttgggcaagaagaagacatggccctcgccatcggtctcgtggagctccacctcgccgtcccacccgcactttttgatcccctccgcgtacgcgcgcgccctctccacgaaccagcagtgctccgccgtagtgaccaggacgcggccggccccgagctgcctccactcctccggcgacgccagcgggttgacgcacgggtggtcgaggccgagcttgccggcgctgacgaactcccacgtgccgtggaacgagccgcggtagccggcgtcggtggactcgccgcccacggggtccttcccccagaagtaggggtggaggagcaccacgccgctgaccttgtcgccgtagccctcgatcccttccttccgcagccggatcgccgcgttgtgcgccatgttggcgccggcgctgtcgcccgcgagcacgacgcgggacgcgtcgccgtgcgcggcgagccatggctcggcgccgtcggggcggcacgcagcgacgaccgccctgagggcggcgaacgcgtcgtcgtaggcggccgggacgggctgctccggggcgaggcggtagtccgccgagacgacgacggcagggaccgccgcggcgagggaggcggcgtacctgtggtagagcggggacgcggcggtgtggaccaagaacgcgccgccgtggaagaagagcacgacggggagcttcttccccggctccacaccaggcgggaggtagagacgagcggagatgccggcggacgggtcgaggacgacgtccttggagacgacgccgttggcggggtcgccggatggggacggcgggacggtctgcgtgccgtcgaagcgctcgacgcggccgtccttgtacatgcgcaggacgccgggcatatcgaactcgatctcggaagcggcggcgtccatgacggcggcggcgacggtgtccgtgctgcggggcttgaggctgattgggatcgggagctgcaagagcagagcagcaagcggagcggcgagcagagccacacgcagcaaccaacgcgacaattctggagcgggtgttgccatcttgatggcgagcaaacggcccgaccaaccagagatccgctgacctgaatccgaatcctacgccttccgagtagacacgccatctcaaagtctctccaaatcgtaccttccaccactcatcaaccactctctgatctgtagtgttatctctgcttctgtagaaatccgtatcacattgcttacagagcacttgtttagtttccagttttttcttcaaacttgtaacttttccatcacatcgaaactttcctatacacacaaactttcaactttttcatcacattattccaatttcaaccaaactttcaattttagcgtgaactaaacacacctagaagttgatgtcttgacttccttgcttcctgcacggctgcacggtcatgccataaacagaccatgaattttggaggaactttaggtatttgatgtggtaataggaggtacagtatcatatttcttagcataaaattgagattataagaaatagcacttgagaatctagaccccaatttctgaatgctaattggaactatttacacgacattcaaaagtatttaggtgtcaaaacactcgaaatttcactattagtgagtgcttgggttttatgaaagggaaaaattgattaaaatcagggtgatgcttatggctagtgtgtgtttgagtgttgtggcttatttggaatgattgggttttttcaagacatcttggttaattcttccttgcaggtaatttacaaagctttatccttttttcagaaatggtgtatcatgttaagaaaagaagatcaagctactatgctaggttggcatgacttgatgatggagggactgaattaagtgaaaccatgttgccttcctgcagcggtgtagttgatgcttagtgtacgttagtaggaagtttttttaagtctgttattgtagctgcaatagtgggtgtcgttctgcttgctctgagacctggccctgtttgtcggttttactttagtttgttttgcttgtctttccttcagtgtaagactctgtgatgcttttggccttttgggctttcttataaaactggatcaatgcaaatttgatctgttaaaaaaaacaatcgaatttttcagccactgattcaacattgacggtcatggctatggttcatgggccctcaacaaaatacaatacaataaggatggcccatttgcaaaattcgggggaaatttgggaccataatggtgtagtcacatgtctagttacagcgtaaactaacgtgtaaaagtgtcacttgaacaacgtaattggtgcagctcagtggaaaggaatcatccttgtgaagcggagggtgcctggttgattccctgtgtagtttttctccaaaaaaattgccgctaggtttttatccattcggtattaatttattatcaaagttcttttgctatcaagtcctaaaattagaataagaatctggtccttctggactacccggagattctgagagtagttgtagacttgtagtttagaagctcttttaaacggagccttattaccttctgatagttgaattatccagagattgtaaacttgacactatgaaatgtggccatatttgacaaagtttgtcctatggattggtggtgagcaaatgattgaatgagatatttgcttgaatccaaaatatctcaaagtagacacaccatctcaacgtaatctcaaaatctccctaacttaatccgtacctaccactcagcttgtccttgatctagtgatgcttctatagaaaccaacatcacattacttgcaggagtttgatgccctgacctcgcgaaaatcctaataagagatcaatcgccccgcgtgatcacctcattctccacatggttttcttttttggcaccgcattactttcctattttagtaaatttattcacataaaggttatacacctcaagtttacacatctaaagtttatacacctaaagattagaaacccaaagtttataagtcaaaagtttatatatccgattcaaatttgaatttgaattcaaatattttttatatataatatttatatacatctaaaatttatacacctaaagtttatagacccaaagtttataagttaaaagtttatataccagattcaaatttgaatctgaatttaaatatttttttatacatagtatttctatacataaatttttctaactttgttttttttattttttaaaaaaatttatggtgtagtaggaacagaagaagagaggaggaagcaggagaggagcgtattaggggggatgggggtgatcgcccacagcgatcacccgcccattagcgtcacccctagcctcgtgcacgacaatgtcataaacaaaccacgaattccagataaattttaggtatttgatgaggtattgggagtacgattttttcagtgcaaaatttaaaatatagagatttagacatgtatattagagctagaggttctaagttgttggtgagaatttggtccaccacttctagagatattagttcatctcgaaaactggactatttgaaggggttagagattctaggattagcatttagctaaagctaccaaaagctcttccaaatgaggacttaggatctgtttgatggtgtttctagcagctgcagcttctctcacaatcgaaaactcactcaaatagtctaacttttcatatagattttaacaagttatagttgtacaatccagaaaataaattagaagccagaaactagattttctaagttctatagattctcaggattctcataagctacttctcaaaatctggaattcctgtttagggagttttaaattctgataagcaactggttggcacttaggctattcatatcacgtgtctagaattccttcatttttcttatgtagtaatcaaaacaattttgttgtgtatcaaaatctcataggaatccaataaacatgacattttatttctatgttttctcaatctgacgtttaaaaagggctatcagtcaataagtagcttgaaaaactgtttttttaagaacaacaatgagtattacattcaaaacttgatctagctaagtaaccaaacgaagtttcacacgaagcaattcattcccaagcaaaggtttttctacaatccaaacttcaggctgtctgtgccactccgctccaaggcgacatgggcggcgacactaaaccccgctgctagctcccctccctcgcctcctctgcctcgccgccgcctgagcagttgccaacaaagccgggcggcggtgaggaacttcttcttgctcgcaccacaacccgacatatggagctttgatgaggaacgagcggaggggcagagacgtggtcttcggcaccgctggtggctggaggcgatggatccgaaactgacgaaggaggatctgccccgctagcagctagatcgggatggagcagcgccggccatgccgcgtcgaaggccggcaaaggaggttgagccgctggcagagaaggccgagacgtaggcgaagggcgtcatggtgccggcaaaggacgttgcagcgcaggcggaggagatcgcggcgccggtggacgaggtggtggcggggccaaggggtggtggcagccacgagtggtggtggaggtggcggcatcccgtctagatccatgccgttctgaccggatatgggaggtggccgctggcggtggggttgagtggtggcggcgtcagctggcgatggtagctgcagtggcggtgatgatcgacaccagtgatggcgactgctagcggcggtgtcacccaggccagcgtcatggcagaggcggcgggttggcgtgtcgtcgacggcgacagcacgaggtggaggcggggaaggaggagaccggtgaggtgtcgacagcgggatgcgggcgatggcaacttcggcaagaggtgcgggcggctgtggatgagatacaggcgactagccgggagggagggggaggcatgggcgacgacagcagctggccgacggaggagccgacgtgactggaggcgcggctagaggtccgcacgacgcgaggaggcgcaaccagcgggtggtagaggccggtgcgttgtggcggcatgcggaggctggtcgccagggggcgttagtgcagcggtgccacgtgccggcaaaggatttgatggcagaggagcatcaatatggcggatgtggatttgcaggcggtgggcggcaggtgaaaacctagcctagccttggctgggcctgcaacgacgacgttttcaagcgtcttcccctcttgagggcattgccatgccgtcccatctcctccagactccagtgggactgtcgggtgaaaacctagtctcggctatccttaagaccttgacggacgacaacggcgatgtctttgtcgttcctctctctagagatgtcatctaggtagcccttggccgaatccatccagacaacttgtgcaagctcgctctctagatgcatgtcctcttgtgtcggcgccctagcttatgtaagttggccccgtcgaaaagcctagagggagagtggttcaatccttctctttcaccctctctccctcaatcccatagaggtggctggagtggggtttagtgttggttgttagggatatgttttgggcaatctcggctatagtttctttgttgttatagcggcggccggttcgagtgccagccttttctaggatttgtgtttggtgctgtcggtacatgggtggtggttttttaaaaaaaaaaactggttaaaacctcccaagattgtatcaatatgaatttcacgctgtccgatgcgagttgcttaaaaaaaaagaaacttcaggctgtcaggagaagggacgggcagatacatgaaagaagcaattcattcatcccaatatttgtcaacgcagaaacgctagacaaatcagtacccagcacgagctggtgtctttcccgagtccccgtcgggatgccgtgatccaccacaacaccacggaccaccaaaccaaagcaaagcaagggtctccgtcatgctcacattcctaggtcctccttgtggcatctccccaccaaaaagcgtcgtcctcaacctcaaacctcgcaattttctatctgttctccctaccaggcgctatttattcagattgagctaatcagccaccaaactcgcagaattgtggctgttttcttcctctccagcttccaatctgatcgttgtcagtgtggttattggagcagttgccatcgatcatggtcgccaagatcaagcgacagatcggcggcctctcactcctcgctaagcttggtttgcttctgctcgcgctgctgctgcttcttgctgctatcttgctgttggtgttcttgctcccgcgtcaccatcggaggccgttgccgccggggtcgccgccggtgaacgcctccgaccccgacaacatcgtggcgtttgatttctcgccgttccttatactgtacaagagtgggcgcgtccaccggatggatgggacggaccgcgtccccgccggcgtcgacgaggccaccggggtgacgtccaaggacgtcgtcatcgaccggagcaccggcgtcggcgcccggatgtacctaccgccggcgaaaggtgcggggaagaaggaccttgccggcgcgctgcccgttcttgtgttcttccacggcggcgcgttcgtcatcgagtcggcgttcacggccaagtaccacgactacctgaacaaggtcacggcgaaggcgcgcgtcgtggcggtgtccgtggactaccgcctcgcgccggagcacccggtgccgacggcgtacgacgactcgtggcaggcgctgaactgggtggccaagaacggcaggtccgggccggagccgtggctgcgggaccgcgggaacatgtcccgcctgttcctcgccggcgacagcgccggcgccaacatcgcgcacaacatggcgatgcgcgccgggaaggacggggggcagcttgagggcggcgtggccatcaccggcatcctcctcctcgacccctacttctggggcaagaaccccgtgggcgcggagaccacggacccggcgaggcggcgccagtacgaggcgacgtggtcgttcatctgcgacggcaagtacggcatcgacgacaggctggtggacccgctgtgcatcccggcaccggagtgggtaatgcttgcgtgctcgagtgtgtccgtatcggtgtccgaccttagcgacttcaaggagagaggcaagtcgtacagtacggcgctccgcgccaacgggtggggcgcctaggtgaagaagtacgagaccgccgtcgaggtgtacgtatacttcctcgacaagccctcgagccgcaagtccgtcaaggaggtcaccttagtcgacggctacttgagccacgagtatcagcagcagcaaaacggcatgggtgtcagattggtcgcagacttgcagtacatgattgattgataattactcattagtggagtaccagctagcacagttgtctacatgtcttcttgtcttgtgcatctatagatttctccattgtttgatcgatcggtcatccggatccagttcatgatgagtacagtgaaattgctggggattttgggggaaagttggatgctttccgtgcctgcagtgttcagaagaatcggcaggggagtgtaagtttctccaaagtgagtgcagagtgcagtcagaggattggtcaatctcgttatcttgtggtgaccgggtgacgcatgccgagcacccagtgcaaatattttactgtttggatcatttgttttcttcagaaacctcgtacggttgttcagatgtctcctggtcttgccaaaattatgcatgaagctgctggttattttaaacggtgtcaagaaatcaaaaccggtcaattcagaattttgtgctgctgacatctcaactgaactccaggatgactgactgcttgatcaatgcagaactgcagatatgttttgcctgtcaatgtttgttggggtcctagtggtgaatgcacttatttaggactgtgaaaggcacttgattagtgctgacgattcgattagcgaaacgctagaatgagcaatagtactgtgcctgagacaagctagtgtcgtattggcgatttggcgtagagtgggaatgggctgggatggcgaccacaggagacagggaaagatgaagaaaaacagccacaatttcgagataatacaatgcattgcaatgctttggaacaaaaacttcagaaccataccttcgatcttcgatgcacagattgttgccgaacaattacaaatttgaactgttctttttctccttttttcgacttgcccatatgtaattgttatttttcacctatcccaataacaaagaaacctgacttaaacgatcctacgtaagcaaaattagctcctccattttgtactaattgtttatggttgtgcaaggtgcttcctttcgtggggaggcaaaccaagcacacattgccctgagaaagcagaaagctcatcggatgtcccttttgtccaaacacagaacggcaaaaactgatgaagataatgatgtttcacctaatacaccacagtgagaccggaagaaggattagtaggttaaacgacaaggttgatcatgcctgcaaggctgcaacaccaagccgttgtttcaaagcgaagatccgtagcatgaagcacgtccataaagtgctagagagatgatgtcaagcacggctctaggaacctgattattattgactatagttgtaactaggcaatgattggcgttggcgaaatggcgagccagaagacaaaagttcacatcagccatcgtgtcacttccttggccaagtgcaattttgtgcaagactttgtggagctcaacaacttgtgcaactgcatctctcctcttctcattcaattcatgcctgataccatgtgcttggtttggtgatcaggatacaaggcagaatgttggtgattgatgaagttcggttaaacgaatgcacacattagcaacaggaactacattagcaacagcaacaggaacatagtccatctttggcatacattgatctagttcaactgaaaaggaaaaggggactgcctatttaatgattcacgagaacaccattctaaatcctactatttttaactattggattgccgtaaggtttatgcagattcctctaaccctaacctctctctcttttccttcttcctcccttcctgccgccacggtgtgagcgcttgatgtcactggcgttaccctgcctcctgctctgccacctggttggaagggggtctaaagaagctagtgagccccatcctgacccacccaagcagcctcatccccgccttctcttccccaaggcaatgacaccaattgatgcctcatcatctttcttgtctccgacggttcttcactgctagatacatcattactagccaccgcctcgtaaccagtctcccctcgtgttcccgttggcccaccgcctgttgccaaccccgcggctccggcacgtccgttggtatccaccgtccaccgttagttctctgccgcccacgaccattcctctaaagccttggggaaccgcaaccccaaaccataatttttatgtctcttgccatagttggggatgatgttggagaaaatagggaactcgctggagttagataagaggaagcccatgcacgaatattggctggatccgacggtccaaaatttgtaagttttcatccccaaatttctgtcaaatgccatttagcaaattcacatttacgactaattattttttaagtagtaggcgacgtacctatcgatagcaaggtggtgacttcgtcagtctcaagatttgttagatccagtttttcggatgtacttatataagggtaggatatgtgtgttcatagagatacgtgtatacgcattgtgaacgcatatgcttgtattgtgtttctgacaaggaaaacccattttctacgttgtgcaagtaaaatagaaaggacagtttttaagttgaaatgtagtgtgtcaatagacatctgtgttttacatggattcatactaggcgaaatcagcataaatcaaataacaaatcatacagcaatagcaatagacagcagcatgcccaatgcaacagttacccaagaggccattggattctctaccgatttacgaactcagcaatggcgtcgtcctgcctgacggcctcgtcgccgttgaagtccatcaggtggaagcagtggccatggccggccacctcgacgacctccacctcccccgcccacccgctcgccttaagcccctcgcagtacgcgcggccgcggtcgcggatcacatccttctccgcgaggcacacgagcacgcggccgcaggccagcccttccaaccccggcgcgccgtcggcgagcgggttgatccacggatcgtcgacgccggtggtcgccgggcacacgacgctccacatcttcaccacgttctccgccatcgccgggtcccagtcctctgaggggaccttgccgcggccgaggaagtaggggtggactaggacgacgccgttgaccctgccgccgtgggggagcccctcggcgccggctcgcatggccatgttgtgcgcgatgttcgcgccggcgctctccccggcgaggtacacgcgggagaagtcggcgtggtcggtgagccaggtctcctcgccggcgccgggggcgtgggaggccgcccagaggacagcctgccacgagtcctcgtacgcggcggggagggggtgctcgggcgcgaggcggtactcgacggagacgacgatggctcgggtgcgcgcggcgaggaaggtaaggtaggcgtggaagacgaagttgaaggccgtgtggaggcagaagccgccgccatggaagtagatgaggagcgggagcttctttccctcaccttccccgctcacgccggcgacgggcgggaggtagaggcggacggagacgtcgggggagatggcgcggtctttggaggcgacgccggtggcggcatctgtggaggccgggacggagtcggaaccgaagtagcgctcgacgcggccgcccttgaagatgcgtatgcagtgttcgacctcgaagacgacctcgccgtcgatgtcgccggagccagccatggagtcgggatcaactacggtaggtgttgccctgttggtttgttgggctgtgtgccttttgctttgctttggtattgaaggggccaaccgccaacgtggcccacgtggatgtgccacatgatcgtttagacttttcagtctcacgtgagccgttcgattctacatttgacggtctcgattgaaacggctcaatgctgcgccgccgacgttgtctcgcggcggcggtggcggcttcttcggcggccacctcgattcttccagaatccagatccaagttttgaagtggagtactccactagttcgaatttgtccgagatctcccggcgccatgtccgacgctggggctggaggcgacagcgacgaggtcatccacgacgcccccaacttcatccgcgtg

SEQ ID NO: 29439 - DNA, 11292 bp, Oryza sativa
ggctggcgtcatcgtcgtttcggtggagtaccggctcgcgccggagcgcccggtccccgcgctctacgacgacgcgtgggcggcgctccagtgggtggcctcgcacgccgcgggtgaggggcaggagccctggctgaccgcccacgccgacttcgggcgcgtccacgtcggcggcgagagcgcgggcgccaacatcgcgcaccacgccgcaatgcgggccggtgccgaggagctgggccacggcgtgaaggtgaactcgctcgtcctgatccatccctacttcctgggcggcgacggcgatggctactccgagtcagacgagatgggcatggcgttgctgcgcgagctgatccggctgtggccggtggtctgcccagggacgagcgggtgcgacgacccgtggatcaacccgatggcggatggcgcacccagtctggccgtgctgggatgccgtcgtgctctgatttgcattggagggaaggatgcaatgagggatagaggaaggctgtattgtgagaaattgagggaatgtgggtggcgaggggaggtggagatctgggaggcagatgggcagggccatggcttccatctcttgtggccgacatgtactcaggcggaggcacaattacgggtcatcgccgagttcctgagccatggatgagatctctggactatgttgttccactactgcacacgatatgtccattgttcaaatagaattggatatcaaagtacattatcagttctgacttctgagttcttacaaatgtttgctttcaacattgtttttcaggacaatgttctactagcctatgaagttcatattcagactcagttagtgagctattcttatccattagaacgtttattatgtgttttacaaaaggtttaataaatctaagataccttagttcttcttacggacgtttgctttggttgtttttcagtacaatgttctactagcctatgaagtccaaattcagactgagttattgggctattcttatccattagaacgtttattatgtgttatacatatgtttaataaatgtaagacatgaatataaacttttcaagtcacgatagaaaggaaatactaaacagttttagcataaactagctcccctgtgtcaggtttatcttggagagtctgatgcacagatgtttactgctagaagtctccaattggatatacagcaaaacatcttttgtgtttctttttctggcatgacttcacaaaatattaagcactagtaagaatattcctttccatcttgttgcatgacttgttagctgatgtaatacgtcacgcatatgtgagaatgattacgtacaggtgagagaatgatcaacatacaatacaaggtgatcccagaaacaacctaattacttaagctatttgacagctgtgatgaaccagcaaatatacagaacatagttgtgagccactttgaagtactttccgtgctcgtacctcttggataatgtttttcagggaggccgtaaccatattgattatggagttccaatccccggctcgctgctttgtctatcctgcagggcatggtcgcatagatgatgtattggacaattcctttcatttgctgagtcaacagggttttgtacagttctgactttacctctttgtcttatcattgaccaaatgcagcttcctttcttatcttgggagataatgctgttgaataatctgtgagctatatgcaataaatgttattacagtaatcaaataacactggctatatgcaataaatgttattgtagtaatcaaatgacactttttttactagatgaacattgtattctcatttctgataaatggaaatgggaggagggatcacctcctcttgataaaagaaagtaatcttataatgctggcagtattatagatattacttcatcaattaattttcttttttgcagtgccagaaagattgacgtggaattgttatatggcagattgatagttcatgaggtaagcaaggttactattgtaagaactgcatgagtcatgagatgatgagaatttgagaagaggtctccaatggtaccagcaatcggacagcatcctgaactgaaatagagccatcgtcagcatacttggtaattacggcttcaatctgttgtgcgagtcatacattgcaactcacaatcttctattaaaacttattataagatgtttggttttctattagactttcttgtaagcaatcactcctctcattattaaaaaaagagagttaaaactgaccaattactgctaacgccgcaattaattttgatgaacaacattggtatgttacatatcatcattgcttacagttgtgcccataaaagtttatggtaccatttatcaattatttattgtgatgaaaatgtgttgtttgatgatgaactgaaatttgggattgggatttgttatattggaacttcaaagacagagagagtattgtagctgttgaataaaggatgctccaacattagatactttggatttgtgactagttttctgcaagttagtatttgttcttgtttcccttcctttagtaaatcattcgattattcttctgaccattctttgttcaaaaggtcttgaatccttaaatattttcaatatgtaatgtttggtattatcatgttggccttttcttggtgcagaagatcagattaggcttatatcttgatatgctgaaagtttacacttcacccctcatttatctgggcaaggaaaggacatcttttttctttactcaatttgatgtagagaatattgtttagctatagtgctatacaattgtgagtatgaaaaaagagagcatacctcaccactgatgtaacaaaaatccagctaaataaagatggcaccaatgcaatggagcttgtaaccgtttttctttcctgtggctgcatacatcccaaaatcaaatactacaatggcgcaccttcttctgagcttctatgtatgggctggtattatgatcttgttgctatttcttgatcaatttcggtcaatcaaatgaagtagttcacaaattggccatcttattcttttcgtagcgtgcaaaaatgcaagctagattggtttgaaacagagcatataagtgaaggtgaattttccaacatgaccaacattttgaacttggatgtaagaatttcctttttttttgttttgacagtacccccagcttcagggcactaaagcatcccttagtctaagggcaactgagaaagagatgtttatttgcatgaaggggcatatgcacagcatttcaaatcaaacttgcggatgcaagcctctcatccatcatggtgaagaatatctcactttccatttttataaattctcttagcaattatttttgtcacatcagtaggttcatttaacatccctaagcacagctggattaagtttcagcaacccagattcttttatgcataccatatttggttagttaatccaactaagcaataataattactgatagccaccactatcaataataatccaactaagcaataatagcccaagtaagtaatagtaatccttgaaatccagttgccaccagtttgtttattgaaaacaccttagctagccaccactattgacgatggttcaaacaataaagtgtgcactcttgcaacttcagttctatgttgcctctcatgagtaaaagtttgacatgtttccatttttatcacacgtttagattgtgcatcatgacttatcctgaacgttgttgaccttccctaccaccgatgccatgaaatttcttgtcgctgcatctatttatacttgcttcttatgttcatttcagctctcaaatcaccaccctcagaaatactattgtatcgtgtgtaacctatcctcaagagattagaaatatggagagtgaaaaacatatcatttgtagacatccaccaacttatggcaacctcataacagttctctcgattgatggtggagggattcgaggaatcattccagctgttgttcttacctttctagaatcagagttgcaggtaaatatttatgttatactatgagttccatttcgtggccaaggcaactctaacttgtcgagagataagttccaaggacaagggaaaactggtgctctagggttaggaaacggcatttgtttggtttgcttgttttaaatttaaaccatttagattcaaacttaattcagtaaccatatctttctataaattaagacatcctttcgtttcgaagtagatcttaattcttaaaaaccttttgcattagtgccagaatgagatttactgatcttttctgccatatgttctgtctttagccatttcttttatgcagatgtaattgttcaacagttgctcaggtttttcagcatttctttctgcatcgaatattccgaattcatttttgatacggctggaacagccataacaattattctgctaattgagaaaatctgattgttatgtcccatctatagatggtgaattgaatgttgtggtaccaccaaaaataaacttggcatgctaaattaaatttcccttttcatttcaatctctgtttgatctacatgctgactctctctctgtagtagcataaccgtgtgtgtgtgcacgaaatgaactgttcagattatacacagttcatgttcttgactgcttctcatgaaatcttttctgtttaatttctcaagaaacttgatggagaggaagcccgaatagccgactattttgatgtcattgctgggactagcacaggggggttagtgactgcgatgctggctgcaccaaacaagaaaagaagaccactttttgcagccaaggatattaaagcattttatatgaaccatgctccaaaaatttttccacagctaaggtgaatacatgtactgcagtttttttttctgatatgattcataacttggctggttgacattttgcttctctctttaggggtccattcggtaggatgatgaggatatttcgatcaatgtcaggaccttcctatgatggcaagcaccttcatgaagttgtaagagagaaattaggaagcaccaggctgcatcagactttaacaaatgtggtcataccaactttcgacatcaagtggttacaaccaaccattttctcttcctacgaggtatccctctttcccttcatccttctccctttaaagtctctcaagagtattttgtgtgttgttttggacacaagtgtctacaattcgtaataaaattcaatcaattcaattttaagggcacaagaacatgtattatacacaagtacttatttctctattttgctatgaaaataattcataggaattatttatgagccagtaataagaactcccatcaatacaacaatgatggagactacacaacatgaaccttatgctctcatatcataggttaagaagaagaacaacaacactatggatgctctgctatcagatatttgcatcagcacgagcgctgctccgacttacctgcctgcgcacttcttcaggactgaagattgtcatggaaacatcaaggaattcaatcttattgatggtggagtagctgccaataatccggtacgatgtctctgtagttgtgaacaactcattaccattgaagtgcactctgtgatgttgaaaatggtttggcaagtttacccagttcatatattgaagcgatgttttttccccaaaaggccctgaatatgtctatcttgtttaggctttagttgccattggagaagtaagcaagcagatattcaagaaaaatccagatttcttcccagtaaaaccaatggactacggccgttttttggtcatttcacttggcacgggctccccaaaaattgaagggaaatacaatgcacaaaaagctaaatcatggggagttctggattggttgcttgttggtgggtccactcccttggtagatattttcacacaagcaagtgctgatatggtggatatccacatcgctgctgttttcaaagttttacattctgagcagaactatctgaggattcaggtaagaaagagatagacagtttatttttttttatcaagtaatagccaacaaacatgattcctaatataaaaaaaatgccactttggaataacaggatgatactctcgaagggacactcgcatctgttgatgttgctactagggataatctggagaaacttgctaatgttggagaaatactgctaaacaaacctgtctcacgggcaaatttggagactggccagatgatgcctgcttgtgatgactcagaaattaccaacggggaagctctcaagaggtgaacatgtcaccacttatcagcctatttatgataatagtatctctcgttttataaatccatctatacttagtacccctgctatttgcagatttgcgaggttgctgtctgacgaaaagcgaattcgtgaagcaagatcaccgaaatgaagaaattcctctcttttttattcgtgccaaataggaatcttctctggatgacctccatatttgatagagcaaaatctggatcatttaatttagaacttagttgatttattcattgacttggaaatttcactgtaacatagtaaataaatgtataggtggcatactgattggccacacctgtagaatgtcaggccctgagtccctgatgtcctgctagttttgttcgtatgtaaaaaaaataatacaaatattcatttctaataaaattgagcattggactgccttttctgttgtgttgtcaacttcagccattttattttagccaaatgagtgctgaaggattgcaggtcggccatgcagcgagacaatcggaataaagacgtagcacgctgctgcatggaacaagtaccagatacgatttctctacactttgtacgtagaaatagataacctatctcttctttcaataacaagatgagcttccttttcagaacggatcgttttgcccctttggtacttccgatggccatgggcgggaagacgtccaattcccattggatttggagcgtgtacagactagacaaatgtatgcaaggggcttctctgcttcgctaactcaaagttgcccatatttattaatgacataactttctgaatgggctgcccaagaacctcatctgtgagtaccttctagcttttatcttgcacttgatgttccagttcactacctagttgccaacttagtaacttgctggtaaaaaaattgtttaacaccgaggtggaccaatttctgtgataatggtcttaactatatgccaagttgtatttgtttaactttccagcaaaccaatagcacaactcaggctcaatgagggggtgttggaagctattattttgatggatacaacagtgcgtaggcattctaaaactgacctaacctaaccatgtgctccccaaaacaagcaaacctggagcaccgaaagatctgaccagcgatcaatctcacacttgcgaggtaaggaatgcaaattgtgcatgaacacataaatataaatatacatgtagctagtaaagctgagacaattggcattttggaatcctagagcttccctttagctgggtggtagcaaaatttgtgtcaattaagtacaatgcttggacttcagccagccagacatgggggtcattgttagtgcaataatgctatatatttgatcgactatagttttggagaaagaaacacatttgacaagtatttcttgccatatagtatgccaaaatcctgaactttattgttcttgttagtggcctgcacctgttgtgtctcctacaccgttgatccagcacaactttacagagccgtcggcccgtcgcacacatgaaaagtatttctcctgtcaggtcataggccgtgcagttaataattaaaaggcaatttcctaggtcctgggagccgactaatgtgcttggccggtcaaaagactaaagagggctattcgatcgacggagcagaatgcaagttagacgccaatgcaacgagcgcctcctatgcatggtgccatggtccaagcaaagaagattcccagattgtgccatgcaaatgctgctgaccttttctgaatatcatgcaacatagcgtgtctgggcttctggcactccatgaatgtaagtgaattacatgagtttacatgcactacatctctgtaaaactttatgatagttaactttctaggttgaatttggtgaacataccattcagctttttgttagaatataccacacatgcagaggaatatatcgtttctgactacagcactggcatgcgaaaatttttgaatttgtgaaaatgacatccatggcttcgtgtaattcttcatgggtgtttgtgttagtttcttggcgcatctctctattttgacccctttttccctgttcctcgtactgacagctttgctgctttagcataccacagcatcgcaaattgcactttcttctccctataaattgtcgtagtggcatgcatccaaatcgaatctaagccaagaaactcaatagagaagagcagtcgcaatagcaagctaggagaagcaccaggagcttgtgtctttggccacctgaacagcacaagtcctccatacatttgtcaacctgcctagtacatggcaggtctcaagctctcatcatgcgttctggtcgcattgctcttcgtgtcgagccacgttgtgcgccacggcgaggcgaggcggctgaccgcgggggtggcggcgccggcgagcaagggcggcgaggaggaggcgccgcagtacgcatccgctcgaggcggccagccggcggctgctgccggtggcggcgtgacggcggcgtcgaagatggcgagcaccgacggccgcccaacctctcccggccacagcccggggatcggcaacaaggccaccggcaacgtccgttgagatcgatggacgatcacagtacagtactacacagtttcttcttggttggattgcttggcaattggcatgcacatataggcatctgccaatgtcagttcgtgcgtgctgctgcatgcatgcacactgtaatttgtttctccttttgttattggcatgcacatataggcgtccgtcagtttgtccgagctgtaatttatttctcagttcgttatgtaatgtacattggtgaacgcgtgttgtaatattttactttatctcaaataacaaagttgccgagattgcacacttttacatttttctgtcaatgttctgtagggaatcactaaacctgtaatgttaaatgcctaaactctcagcttgtacttgacacttagcttgtacttgcaggaattcaaacttaagtatgactcttactgcctcttttctaaaatatttgtcgttctacattctttagcatgtattaaggttaaaagaaaaaaattgtactatatcttattaaataatgtatagttagatgtgtgatggtggtggggggggggggtaaaaatgaggagaactttgaattagaagtggttgatgtgacaggtaatatttcaaagtggcaactattttttaaacaacttttaaatgctaaaaagacaagtattgtggaatgggaaaaatatatcatactggacattaacgtgtatttcaacgaattcactggagatcggttggaatctacaatagcacttacctctgttctaaaatataaatttatattttagctatgcacttggaaggatgaagggagtagtagctccgggtaaaagtatgtccctcaaaaatcattccctcatttttcatacatgtattggccgaattactctcactgaagcaaaacagagatgacatgcgaatcacgctatctgacgagtctccttttaaagacttggcgcagcaattattttctaaaaaatccttcctgtggttgagataaaatcagtaacttttaacttgtgctttgcgctaataaaacggtttaaattaagcagctgtgtgtttgctagtatactgccatagcctatgatgccctacagtgctatgagtagtaatatctggatatcttggctacggtatgttgaaaaggacgtgcatgtgagattatgtaccatcacgaagattcatgaacagttaaccagattatgcagtcaatatgtaatgttgaaaaggacgtgcatgtgagatcctgatatgtaccatcacgaagattcatgaacagttaaccagattatgcagtcaataagtactacgaacgagtggatatatatgtactggagtcttgacttttcctggccgtctctgaccttcctgagtgccatcacaactttcactggacacggttgtttgcctgctatttacctccattgaccggtcaaaccgtacaaaatgttaattaaccaacttgtttgctaatgctatctgagccgtttatatcgtccactgtggaaaactttgtgtgtataatattagcacgactggatgcagccagccattgtaatataccacagccaacaatgcgcatgcaggaagagatttctgaagttggaaaatatacggtgcaaaaagtgtctagggattttctacttgaagaaatctagtttgatagttgcacaaagagccagccattcgtgctttcagacagcctggctcgttttcattgttacattgttgggggtatgtctgttagcgctagtgtagactgtaaaggtaagtgtcttgtatatcccacctcttaattggtgacttaccgacatgccaacatgccgacatggataaaattatgagataacaattacttatatcgcttgttaaacttgctcttacctcttaccataaataaatatgagtactacagatttggacggggacacatgagggaaaacattccatgtagtagagggcttcagcagggggagccactatcaccatttcttttcatcctaacaatcgaccccttgcaaagaatgctacatctagcaaccgaggaagggcatccaattaccctaggtaatccaagtgcaagattcagaatatccttgtatgcagacgatgcaacagttttccttaatccttcgagagacgaagtggacaacttattgaaaattgtcggtgatatgggcccgagggtatcaggtttagagggaggagtctgccccccgatgccacgtgaccctcccctgaggggagtcaggcccgaggtggggtggtggccactcctgccccaaagactagtcggaggaggctgccccccgatgccacgtggccctcccccgaggggagtcaggcccgaggtagggcggcggccactcattcccagagactggatggaggaggctg

SEQ ID NO: 29440 - DNA, 2215 bp, Oryza sativa
ccctctctaggtcaccacgtacggtgggttaggtgtccgcctccaggtgcccacctacccgtatttatggcgacccgagcggtcgcaccacgccgcatttaatgcggtgtgcagtgcactcaaccggtctgtgaccggtcgaatgactgatgggacccaggatgtcaggcgcaccatcgcgtgtgtcaggcgatgtgcagcccgacatatcccatcaaataatgatggtgagaggttctcatcctcttatcccagccggagtcggtcctcccgctctggtcaaagcaaggcacccgtttcccggtgtaataggacccagaagtcttcacccattaaatggtgactgacaggggcaccccctgtgtcaggcagcaagatttgacaggccccatcatcaagacgacgtgcgcttggcctcccaagtcaagagacaagacatgcatttaatgcaaagattataatacttctccactggagctaggttagattgttgggcccatgtggtatccccttagagtataaaaggaggaccatgcctagcgaggaggggggatcggacttaggatccctgagccaaagcttgtccaaccctagcttgtatatcggggattcagggactttctaagcatagaagaatcatcatacacacaggagtagggtattacgcttcatagcggcccgaacctgtataagcctcttttgtctcatcgtcttggaggggcctaaccccctcaagatcacatagcttcgctcaccgagccctcgaatctcacccgctgcccccggccgaactcacaaaggggcgcctcatggttccctagtggaggagttcattctccgacatctggcgcgccaggtagggggcgcgttcgtgatttttgaggttctttcgagcgctggcgtgataagcgccgcgccgccgatgcggtgtaaggcacagcctcctcaggagtgtcgcgcgaccccaggcagggggctaggcccccgacatccccaccgggtaaggctagcggccagttctttgtggcgagtcttcggaatgtccgatggccctcaaagtttaggcctagcctcaccgagaagtacgacgacagcgtcaaaactccgagtccctccagatccacacgacgatcatagaggagacggggggtgacgaccgggtcatggcgaacttcttccccatggccctcaggggccaagcgcggggttggctcatgaacctgctgcccgcctcggtccactcctgggaggacccctgcagttgagctccggttgccgtcgaagcccaggatcccctgtgctggctcttccgtagcggctagctttggtcccgccggctggctacggtgcccggcccggctcaactaatcgtcctctcatgttttcagtattttcaaattttcaactcatcaacctagtacagcttgaaatcttatatttatttccccccattatattctcatggccctgcgacgcccgcgtgttgcgtatttgtttgctccctcggtggtaagagcccaacctctctcccatctacatgaacgattcttcgctaagtgtgggggctaagttttctagccttatcctagccttaagttgagccccgggtgccgtcgacgcccgggaccccctgtgctggctcttccgtagcggcttgctttggtcccgctggctggctacggtacccggcctggctcaactgtggacggggattgctggctctagagttttcggttctcacactcgtgcgaaagtaatcatccatgtagaaggaaaagagattggaaggaggccaccgaaaggaaagagcaaacataatgtgtagcgtgagggcgcaggctcgtgggaacctgatctcatttgctaagtggtcacaggcttcccaagatggtttggaacccatggtgggggggggggggctcttcgagctaaaggtttgaaaggtcgcgacatgcaagcaatgtttgtgtttgcttcattcatacaagcaattctttgctataagtgtgggggctacgattcctagctctatcctagccctgcgtcgagctctgggtaccgtcgacgcccggggccccctgtgctagctcttccgtaacggctggctttggccccgtcggctagttacgacgctcagcttcgcttgatcgcaggcgaagatctgacagccccatcatcaagacgacgtgcgcttggcttcctaagtcaagagaca

SEQ ID NO: 29441 - DNA, 1596 bp, Oryza sativa
cattctctgacaaaaatactctagaattttgtcaaagcaccagtattacatgttaacctgtccaaaagctcagtaacaccaatcaactcccaaaatattgatgtggttgttgttttagaaaatttcacatggcaacgagaaaccctcccatttatctacctactctagggtgcctcaggcgtgtacacttgcagccaatagaaaacaataccgaggctcacctgcccggctagaacaaaatgcttccacatgaaggtgtcatgtcctggtgaattcagtgcttagctccaccccaacatacgtactcattgtcttaaagcctcccaaacaattctacacggagatcgataaggtgaaaggatgattcctatatgccgctatgaagaactacacgagggcaaatgtacggtcgattggacaaaggtttgttacaaaaaccaacctcgatagctcatcggtaaccaaacatggaagaaacactataaaagatccaaatacgatgataacaccaaggcacgatatttgctaacgtggttcagccaaaccctacatcctggggcactgattacgtgcactccatctcgatccaacacaattaaagtgtatcagagttacaatgatcctcggcggatgctgccggcaaccattccctcttgcctatgctaagtcgccatgcgattacaacatgtgtgcctctctatttaagagagagcctaggatgtccaactccaagtccaaaactataactgactttgtacacatattcaacacaaaactctaacaaggttttgctccctactcaaatttggagggtaaggggttccaaacctagaaaattcgctagtatgcttcgtcaaaggtggctctggtatgaaaggaatgtgccaaacaaaccatggatttgaacacctatgccttgcgatgacaaggataggcattgttttcgacgtccactgtagtcatcttaggagatatcaaaaacacgagcttatagctagatcgaagggtagcaattaaggagcattgcactaaacccatataatcaatgccgacagaagcagagaacagtacaagagccattatgcaatcagcaatggctcaaagacatacgacacaacatgacattggctctgttcgaggaatacttttccatttggtgtatattggagtgagcaaacccatagctaatagaaggcatcaaagacacaataaggtggaagaggtcagcaaccagagaatacagtacaaagtcagcaaaggcgacgtcatgtatccaagtttggaaaacatgggcccccgccaaatgtaaggttttttccaggttgctgctgcaagactgactttggactgttgacagattgcagcaaagaggatggccgaattgctgtttctgttagctatgcatgaggaatttggaatgtgctcaccacttgattttggaatgctcgttcactcgtgcgtatggaatgaaaccttcaccaagttgcatcagcctcaacaaatgacaaacatgaccacaatagccttctttcatattggattggcagaatgcgcaaccatgaccgttccacgagggattaaaattctgccctagtc

SEQ ID NO: 29442 - DNA, 9380 bp, Oryza sativa
gcacaaaataataatcaatatctatatgttttgttctagcatgaaacactagattagtagataaataagttgctcaatattatcacaccaaacctgagctgccggtggagaagaaacttttagttcccgcaaaagagtttggatccaaattatttatgtgggtttggggggggggattttttttcgctagagatttgtacttagctttagtacttgatctagaaaccatagcttgcttgcgagcactccaagataccaagttgcatccaagaaaaactaccaaaccactagttgagtgccgatcatcaacatttcctgcccaatcagtgtcagaaaaagcacaaactaaagtagatgactctttcttgatctatagaccggcgccaagagtatattgcaaatatctaagaatctgtttcactgctgtccagtgatctgccattggcaactaaaggaattgacaaacattattcacaggaaaagatatgttagttctagtaagtgctactccctcagggctgataatattagtcgttctagcagaaacattgtgactgatcctttattatgaaaaatagtgaagtaatcagctttagaggaaataaaaccaagttgatgtaccttttgacttaacctttcaaaccacgctcttggcgcctgtttgagaccatagagagccttgtctagtttgagtacatgatctggccttgatttatcttcatatcctggtggttgcttcatataaacttcctcctcaagaatgccatgacgaaacgcattctgtatatcaagttgcctgaggcaccatcccctactaggtgcaccattccctactgactacaagactaaaggtatcctcataatcaattccatacctttgcttgaaacattaggctattagtccagctttatacctatcaagagagccatcagccttcctgttgatcttgaacacccacttgcaatcaattacatttcttccttcttttgctggtataggatgccaagttttgttgttgatcaatgcatgggactcactatccatggcttctttccatctttcatttgccaatgcttcatcaatattatgtggttctcctaaagcagccagaaaatcatacctaatatggccatcagtatagacttttggcttgaccactccactttgtgaccgagtgtgtggtcggacaacttctgaagcgacaaaagatctagcttggcctacctcagctgacgatctcggcgcctgattgggagcagacgcgtcctcattggttgagaaggcagccgcactctcgcttggtgagtgagcattgcgccaagggagacaggcgtggttccctaggtctgcattggcgatccaggggaagattttcctgaaaattcccctgttgcttcagggaaatcctcctcgtgtccagcgtcatcatgctctgttattcaagtgaattctcctcagaatttgctttagaaactaccaaaatttcaccagaattattagtaacatcaggacgtcgcgcgtcagggtggccatcagataatcaaggacctgttgatcctcagttacccaccgggtgaaatctgaattcaccttcttgattaccttgtctccttctttcactttgatctcctttacagggacctcagcggtgccatcaagatacccaaacatctgggctcctctaatggtgggaaggacttgcgccttccataggagatagttcccctttcccaacttctctatcaccggaacaacgaagggcaatgcaccaaccggagtggaagaggaagatgccatcggcttgttttagatgtatctctgaggagaaggctatgataccatgtggaaatagcgaagccatacctttgttgatatagccggcaaaacgcggcagagaattacatgcaagtttgttacaagagataagggatatgattatatctttggctaatctattcttatccttctatctttgtatcatatctaactatatatctaacaataagatgacaaatcatccatacgataagtatgcaactgtattttggacgagataaaattttgaaacatgagaggtgccaaagatttagcgagaatatcgaaatcatgaatacagctagcggcaagcatgtttgctgccacaggtgtaaatcttatttacattttcatatcaccacttggctactgtttttactccttttttttttacggatatttactcctaaaattaatagaacgccaagctggtctttcgagaaaaaaaattctctactactactgctgagggcaagttttatagtagatgtgactaccacatccaatttcatgcatgaaatacataattaaattaagaggtgatatgtataataggttacctctaccacacaatccccaatatctctaatattctcatatgtttattgaaatttgtgtaggggttgcctcttgcatgagaggtgactatttatctctcatccttcttctctcctccacctcactatttagtcctatatggcatcttggggctttgtgcttgatgcccatagtacttgccctccattgatatgcatgctacaaaagcactggatttttaatcatatccttcaactgttatggacttattgtgatgtttggacagttgggtttccaaaacctcctattggtgttgtccaaactccaaagaggaggcccattttgaaactgttgcccggcaaggaaaagggaaagaaagtgaatcgaaaggaggagagccatcgactgagaaagttcctccaccctaggaaccaaccatgcagaggagcagaatcttaatttctcgatagcaaatctaacaacggaaaccttttctttcgttcttttcgtattatatgaactgatgatgaagtagtacaggcacttcattgcaagttgcaattcttctcagttcacagattctgggcgctgaatgtgttcaacttggttctgacctttaattcagatttctaaacccattaaccagttcaacgctgaactggcagattataacagtatcaagctatatagtctttcctcagcactgagcttaaatttaaccaaaaaacaaactcgcatagtaggactgatcagcaagctagagaagcattcatcaaagctattaatacatgactttagtagtatattgctcttgcatagctgtcaaccaaatgagcttggttattattccttgactgtacgtgcatccaattaattacgataatcttcttgatcactcaagctaattatcaccccctgtttacataaggaatctcatgacagcttctctagttattattaggaaaatcagatcgattgaaaaggacacaacatgcatgcatgagatcctctcccaactagagatctaggaagcactccttttttgcccccggttaatatgatatggccaagattctgaaccacatttgactgaacaccggtctcagccatcgtgtgagtatattcccggcctgaattcatccgtgcacgctgaatccgtacgaaaaggaagagagctggttaatttcttgctctttcctttctctgtcactctctgaagcctgaacctgtcgacgtcgtggcgcaacttggtgtataaaacgaagagacgaagctagctagctatgcaggtttggtcagaggcagccatcgtgtggtaaagcctaatgctaacatgcgacgcacagcaagagatcctgccgatcttggcatcggcgaagcggtggcgcagacaagcctgcaggtatttttctcgtgtggatttcagaaggcgcgattttacctgacagatattcagtctggagccgctgattttgacaagaaaaggaacgaaagccataaaagcagcagaaagaaatttcttgggcttttatttttggcccataatctgcgggtagaattcttgattccatgaaattggcccataaggtttgtgctgagaaaatacctctctcttttaatttctcttttaaatcctgtcaagaaaaatgtaattgcaggatcgatgtaattgctgtggtgagttcgtcatggcgcaccaccggattaggatagcggattgaggtcatttttactagaactagctgggtggcccgcgcaattgcgcggctagcacccaaacaaaatcatatatttttttaagtatgattttacttaaaatttattaaatagctatctcattgtcttaggactttgaaagaccaaattttatcatcatcgtgtttctaattatatagtttttaaaagtcacaccagttgctaccccttatgtctcatctccttctttatttgcttgctcgatctaccactatttctattcattcttattggaacctttaaaaattggattttatagtttttagagtttattgtcacgttgggttttatttttataatttctagatgtcccgtcaaacgttgctattatactcctctacgacacgtccattgtcttatctctttattgtcattgagaatttaaaaattgaacataattatcgtttaagttcatttttactttttagaagtcccgccaaaccgttagcggctttgccattgtaatcctctacggctcgcccgctgcctcccttctttatttcattttgattttaaaatcgaacatgattatcattgatttttttacttttcagaagttctgaacctttaaaaattggacttgtagttttatttttaataatttttagaagtgccatcaaacgatgtcactatgtccctgatctacagcccatccgccacctactctttattatcattgtgattctaaaaattgtttttttttactttctagaaatcccggcaaccgccttactcgtttgcttcacggcctccctaacgtctctccttttaatcgtcattaggattctatttggtgttttattaacaatttttatatgtcatatcaaccgccaccactctacccctttataggcatgttacttaatatatctcgtcatgtgttttagatggtcttttattttaataatctttatttttatcaaaaattttagttatttttaaattgtattcctaattgaaatcttatttttctttttctaattttagaattttttttaaaaaaattatttaatactgtattgtgttattttaatgtttttattttttattttcaatttcagttgtttcaaaattttagtcctacttgaactctcttttattgttttctaactttggatattattttattttttattctaaattttaattaatctcgtattgggttcttatatggattcttttttcagtatgcttatttttaattcggaatttcagctatttttaaattgtatttctacttgaactccttattttctttttttaattttggattttattttatttttattttgaattttgattaatctcgtattgggttcttatatggaatcttctttcaatattccttatttttaattccgaatttcagctattttaaattgtatttctatttggactctcctttccttttctaattttggattttattttatttttatttcgaattttgattaatcacgtattgggttcctatatggactcctctttccatattgcatatttttaattccgaatttcagctatttttaattgtatttctactttgactcttcttttctttttctccgattaatgtgggaatttctagcccccacggtgaacgtggtgcctttgtttcgagctgtattaataatataatagatcgctggattgaagcattccgctgtcaggctgagctctgcgacatgccaacagtttgctgaactgaactgacgaagcaacgccatactgccattcctaatctgtggtggtcacctgtagattctacggatgaagggaaaacgggaagatacccacgccccaccccccaaaagaaggaaagagaaaactacccgtgcactgttttgtcattttttatctgattgatggaaaacatcagacaacatcatcgcatggcagctaacaaacaacagtagacagtagtagttcccatactatctaccttcacttccattttaccctcccatctttcaccaaagctcaggcttatagctcaactttctgagattcaccgtcccccacccttgtcagttgtcactgcccaatgcagacacacactcttaaatcattaggagctgaaagtgaggtgacagaccacaccccccaacttgcagcaatgcctgcttgccaccacatggcgccctccttgtttgtttgtttgtatggcagcaaatgaatcatccacacacacagacacacaaacttttccagggcccaggccatcggcatgggcgcatggccagctcaagctactggggctgcatctgcatgacagcatgagagagtctgcaggtgaacactacacacacgcacacacaactagagctagatgatgagagcccagccagccatatgtgctgggttcatcgatgtacccaggttgcaggggatggtggaatgccctggcatcgtgctattatctttgcccagcctgcctgcctgcctgcctgcgcgccattttccttttctttatgcgagtgatggtgttttgtctgtggcgatggggtgggggagagtggacaagtgctagagtctgaatctgtgggtgcaatttgcactttgccggttttttctatggtttctgagtctggggcaaaggccatgccgccaatgcgtatattatccatccggcaagagggtgcgtttactgttggagattaagaattctagggtctagtgaaaaccacatgacctcacaaattttcaggcttaacctataactgaactaaattactcaggatacagtagaatggcttgggcagcaaacctgatacatactccctcctattatggttaaaaacggtcgcggaaattcccaacaaattgacgctcgtttctgatttctacaaatcatatgggaaatggtaaacgctgaaaacagaaatgaaactggcaagaaaaatgataaatggaaacggttttgttgttctaccaaccgcttcttattttattgtatttattatgtggaaattaccatctttataatacattactcatcgtatttataaattctattctaggttagcttttttttgggacggaggaagtacatagtataaactagaatttatttggttatatgtgattttacagttcaatgctttcgacatttattagcggttttcgatccatactaacatgtttccatctgcataattaattttcagtaccatttttgttatcggctttaccgttctgattccgtttcggacaaaaatatggttgttgtagcaggaggcacataccatcccctattcgaccgaaacactctcactcactgatcaaagatcctaatagaccgaaacactctcacccattgatcaaagaggcttttacttatggcaagatctatacatatggcaaggttttttatttatggcaaggttttacttataacaaggtttttacttatgacaaggttttttttacttatgacaaggctcttatggcaagattttacttataacaaggcttttacttatgataaggtttttacctatgacaaggtttttacttatgacaaggcttttatctatggcaagacttttacttatggtaaatacttttggatctactgatacagtagaatggcaagacttttaccaaccaaagaggtttttgcttgtggcaaacacttctcgacttaatatgacaggtaaatactaaacgaccgatgtctagaaagaagcatttgaaggtaagtactagtcgatcagggcagatgaagcttgaaggttacgccatcgaactaggaatattcctcaagaagataccatggggactgctccaaccactcttgcaagctggcacctgaagctttagagaccacacaaatgtacaactatacccttagggtttctagcattataggggtattgcagtaacttcctgtgcaccctcaaaggtaagattgtaacttcacatgtacctctggaaccatataagtcggtcataatactgcaacaagacaagacataactaatagcaaaatatcatctcacacattttgcatttctattcgagttaattctcaagataggcggggaatttgtgttttaccgtaacccaaggtcacgacaatggttatgaaaattgttaagtttgctttccaaccattttcattcctaccttttgtcataaatatttgatgcttgagataagatttggtcattttttttaaataccaaccaccaataatttcttaaatttttagctgaaagtttagtatatataaattttcctcgaaaagcactatcttactaccataaacttatcagattctataaattaattttgatataaaattaatgatcagaatattaaagtttgatcaaaccttttctaagcatcaaatatttattgaacaagggagtacagattgtgtgcatgaagtgaatttgtcctaattttgtggctaggtataatcaacaatttatggtgtaacatatattatatttgattttacataatttttttatgattgatttaaatagaaagagagcccacttatccacatttaaggagacactcgtttgtctttgctaaataacctataattaattcatctcaagaaataagttattgcaagcctacatatggtttgaagaaggataacccttgtcattatattttaggatgcatgttgtaagtcaaatctttatgatattagatttggttaactcgttttatttagataagttctctcatttgaccactttattgatttctagataagctgcattaggcccaacaaatatgctgctttaagctttcctactaaatatagtactttcacccacaccacaaatttcgttctccaacgcgaccattagaatcaactcacacctcaaatttcctcctccaacacgaccattagaattaaccctatcttcaaagcttaaaactcctactttacagcaactttatctgatcctgctcctgtaaaataggtttttgagttaaagcatttactatccacttcatatttcttcctgtgagtcctgaggtaatacaatgtacactttgcaaaacaagacctaatttattaaaaaaatatcttttattagcttatacatatattaatttcttataatttttaccatcgtttatattttcaagagttttcatttgagttttatatattctccatgctattcattccgtttcttaatatatgtcaatttcaactttcctatttaagctttgacaattagttgctttgaattgttagaggaaagctaaaatatttaaagcatatcacactttaataatg

SEQ ID NO: 29443 - DNA, 12745 bp, Oryza sativa
cgccacgccttttacccaaaaaagtacagatcttggccacggccttgccatccccaacccaaacctacgaaaaaaatcgtttcttttcgtcacctgactcatctttcctcgtcttgatgtgacaagccagtggaacgaatgtgcacgtgcttatccatctctacattaactaaaaaaatgtcattttgatgtgctgctaagtttcctttccaaaatgtgatccatttcttgggttgcgcgaggtaggagagagagagagaggggggaggggggggggatcttacgaacaagctaggtgcggtgcagtgagagcagcagagatgggtaccaatgattgggtcgcagtgctgaagaagggaaatggcttagcagtttgtagcacccgctgggcaaacggaaggcatgatctgcaagctggccctgggacttgcagtgcagtggcctcgtttcgtttcatcagattggctgcgccgatatgcccgtccttccttcctgtactggcgatgggaaatgttcgtttgttcgtatgttcggcctgatgtgccaggttggtgggtagcgtcatccttggtgtgtacggtgtaccattgccgtccatctgttgcatctctcattggtcgactaattttaggcttgtgctgtgtttaggagatggacggtttgaaggtttcttgtttctttttctttcatataatgatatagggaatgttttctttacgtacgcggatactaaggagctgatggccacataaatagttccacaacttttggtgaaccggtgtttatataaggtacaggtgctaatgactgcttgtgttcacttactctacaaaagatgttggtggacacaaacaaaacgagaaaataatagtgataaatgatgtttccaaacaccagattgattctaattaggactttacagtttgtactgaagatgtgacctctcctttagttgttttttatggagtttctgtttgtagcggtacactagcttttcctgttcccttctatgctagtttttaggaggctgaacatacaaaaagttcgttcataaggtttcataatttgctacattcattgtattcaatgacaatatggagcatcatgctcctcttagtatattgaagaaattaaaagtcttatgcttttatagcattttttagcatgtcaatcagttggatgagtatacaggttagtgtgcctaattaaccggaaagtgtcatttgatgcaattctacgccttctgttcttattttgacattgcaagttcaagctcataggtttgaatatgtttcaggttgtagcaataaaggttattcgtaataagcaaactggacaatcggagggttatggatttgtagagttctacagtcatgctgctgctgagaaagtacttgaaggatttgctggtcatataatgccaaacactgaccaaccttttaggataaattgggcatcatttagcatgggggacagacgttcagatattgcttcagatcattccatatttgtaggcgaccttgcttctgatgtcaatgataccacattactagagactttctccaaaaggtactcctctgtcaaaggtgcgaaagttgttattgatgctaatactggtagatcaaagggctatggttttgtgagatttggagatgataacgagaagacacatgccatgactgagatgaatggtgtgtattgctctaccaggccaatgagaattggccctgcaactcccagaaaaacctcaggttcaatcacaagtatctaattcagttcttttttggggtcaacactagtacattcataccaagcattatttgtttaatagatccttaatttcaacgctagtacccctaaatttgcgagtctttctgtccattaatgtagtatagcagaagatagtatggactctctttttttttttgaagatatggactctataaatttgctgtcatgtactatggtttcctgtcactgttcactctctaattttgttagcattttccccttccttttaaatttctcttgtactctttttcaaaaagaaaaatgtatatttatttaattattttcattcagactttagttgtattatcttgaattgttcatcaatcttgcagcatcccatattttacttttgctcatatctccctaattttttttaggaatatagtatccttctccatgcttctgagtacatcatttgagttagtaattgatggtctttggtgtttgatgtcattattgtgtatatcatttttgcaatcttccggtttcatctataaggtcctacaatgcctttccaacaaaatgctactttccctgcattttcccttcagaagaacaatgaacaacacaattttagtcttttcacaccttggaaatatttttatattattttacctaattgtaattttggatgaacatcggacatgcttgatatctgttaattgtcgcagatattttcagatttaacctcgtgctcgattcatatattattctttttagaatacagggattggttttgaaaatctgagataatttaatataccaaacctgagaatgatagtgcattattgccttatagagtgaacagtggatgggataaaacttgctttgacaatcttatacaggtgttcctattaagacacttaattcctattttctaactatgtttctcggtataggtacttctggacctactggttcagctgctcgatcagatggagatttgacaaacacaactgtgagtacagatgtatttacccataaagtcttatgtgtatacgaatttttccttctataaccgtccagtaacttattgtaggtatttgtcggtgggcttgatccaaatgttagtgaagatgaccttaggcaaacattttcgcaatacggtgaaatttcatcggtaaagatcccagttgggaaacagtgcggctttgtgcagtttgttcagaggtaatttcaacccatatttgttttctaagggtaaatttcctctgttcctgtcccattgacaagatctgattaacattgtcaatgtgttcctttttccaggaagaatgcggaagatgcattgcaaggactgaacggaagcaccattgggaaacagaccgtgcgtctttcgtggggacgcaatccagcaaacaagcaggtacaatcttcccccttgctacatttccaccagaggaactgtaaaattgtgcagtaaacataggcaaaaggacctgagactccatttcttgaccatgtacagttgaggagtgacaatggcagtcagtggaacaacgggatgtactacgcagcctcgccgttttacagtggatacggctaccctgcaccgttccctgctgatccgggcatgtacgctgctgcttatggcgcctacccgttctacggaaaccaacaacaagtgagctaagaggtcacttgtgcttcacctcaaactggagctaggcacgcaagcattagcagtagctcttgctagaagaaaaaaagaacaaggtagacgacggtttcctaggtcagctagatgcagtcactggttatgtaaagtacattactacacgaactagctagcgccactaagccgccctattgactggccatggtctgctgaactcttcttccagaaaagaagttttgacctggagctgcaccttattgaagtagaacaataaactattcaaatacctactgtgcgctatctgatcttttttttttcccttgtcctcttttttttacattgagttagctcgctttgtaggtttgggggtttagaataccggtttgactgaaattactggataaaaattttaatccaaaatttaatttttttattagtaatcaaatcttactgtccaaaaataactctatatttaaatttttgtttcaattcatatttcttaagcagaaactgcaccaccagtccatggtccagttacaccggtttttgaaaccctaatatggtttcggttatccaaaaaagcatgttttttttaggataacatagtcaactttattaaccaagacagagttcagggcatagagcccatacatcacaaaaggatacagagtaaagtaagcaaccatctctaacagagaagagaccaagcagtctaaggaagcaaacttccagtagatactaaacagcagtggagaatcagatcgacagagttctacggcaaagccgtgacgactgaatccttgggcctccattgatatgctcaccgtttgacagaccggaaagctttaccacagaaatggcacaaattggaggtaagttgctgagccgtagattttggtgtaggcatcatcggactcaacacaatgattccacggagtctcccattagatctgaggagcaggaagtgctcaactcgaacggtagaccctgtatggatactgctattttgaaaccaaaggaagtaagatttcaaagaacaggtagccaacatcacaggaaaattcagatgggtgcaatagaacatctgtctttgcagaaggccaaggattgctgaagatttgtaaaagcagtgagagcccaaattcagacagaaactggagtatgacgcagcaaattgagaggagcaagctgtgaacaaagaagagattcagatcggaaaaagaagacaccatgggagattttcaccgtcaaatgaaggcagtagctggaggcaacaacaaaggtttcatgtccatctacgccaccacacagagcaacaccactgcacagagcacccaggctcctgctactacgggcgctgccgcacggtgcgatgccgctcaaagctccaaggttgtcgttaccttcacactgcttgtaaccagcagcagccccaaaagaagtctccatccattgattcattagcagaccttcaaatctctcagctccacctccagaaaccatcaccgccgccatccacgctctggcaacccaggcccttcgccgataagacattacactggacatgcctagaataacaggaaaaaaacctgacaaaactacaacctatctactctataccttttgcatgtcttatttaatgtcttattgcgaaactgaaaaacctgacattactcttattgcatgtcgatctgcaataagctggaacggttcacaatgtcaatgaactttgtaaattttgagcatctcgagctaacttgcaatgtgcatctcgaacggtttctattaagtagtcattaaatttcaagcgaaattcgttctgagatgaatgaaaaatcgacgtctcagtgagattgtgccttggggggagcaatatgcagataggtgacctgagaggtgatacttctgagcccgctcctgcaaacacttcgcctctgtcaacgacactctcctccaccaccacctctgtcagcaaacttcctacctcttcttctcttaccctagccccctccccctaattgtcaaatctgggggcttgagactagcacatgagattggcatgagcgggttgtggcggcgaaggtgacgtccagagcaacgacaatcaccgtcgatcactcaaaaacagctacatgcacttgcgaatgagatcgacggttttggggctagatctgtgccaaattatgtcggttgtagcttaagggtgcaatggatagttgtggtggtgtgtaagggagcttggtgattgataaagggcacacaactatgtgttggatatggttggcacaatgcccatttcagatgatttggctccctcgtgtgaaaggacgatgggtggggcttgtcctccacctctaggatgttttccaccccaaccaacaccatcctccccgtcgccaccatctttagtggctacctcttccatatgcctcctctcatatccgcttttagctcccaaatatatttgtctcccaggcgatgtctccatgtaccctcttatctgcccctacccctctcctctttgtttttctcttacgatcacagaaccatgcttgatgcacctctcgctgccattgaacccccagcaacacattccgtttcgctctttcctttcatccattttacatcgatgttgtgccgatgctagcatgcctccatcgttcttagccttgcttcaaccaccttggccccgtcctattgtctaggagtatgcctagttcgtgtagccgtgttccctcttttggattcactcaatttgatatgcttcttgttcaatagcttggttatccatgtcttatgaaaaaggataggcgaaagttataatatttctctttattcgaatattttatcatagattaattcagccgagcattgacccagtcacccaacgcttaaatccgcccccccttaggctaaacggtaactactaaactggcctggaatgaccagacacgtcccgagattagttgagttgtgccaggctggccgaaggcacgataagcccaccgtgctcctccttgtaataagtctattttgcctcaattatctctttgggccatgtcttatatggctggaaataagtttattttgcgtccctcatctctttggccgtgtcttatatggttaaaataagtctaccttgcgtctgtcatctattttgcctctatgaatgttggagcggcccatgccgagccaacacatcgtgcgaaggaagagacccagacacagtcgggctgagcctgcatggacccgacaacagccagggcatgccgtgtttgggctgggccaaatctccgtgccgtggaccgggtcgttgggtttggccatctatacaccggcccaggggccagggctagacgatgttcgccatagcaaggccatttccagatctccaccccaaccaactagcggcgacaaaggtacctaccatcaccactctcgttgccggcgtgccgcgcatggagcagggcggagattctataaaccccgtgaatcgcaggaagcccggaacactggcgaagtccagggatttcccaactttcatcaagactcaatagtcctgaaactgttttcaggcaagaagaatcaacattttggattcacgtatttcatacaggaatgctgcatacatcacacgacaaaaatttactgctgtttgacataaggcgggagtgctcccctcaggaaggagctgacaacgatgagtgctttctcaggctggaagtaaggacctgatggccagctccccttacgcagatgaacactagcccacccgtgtattgctgaacataccctccaacctgacgcgaaaaggacatatttttctttcagtcagaacagaacaggggagattataatttctgaatttgtgctcatgttcgtattacctctctgtttgctgtccatgggcgccatggttcagtgacggcgaggccgaggtcaccgacggagtacctcgtggctgtgagcgggcacacggagtcgaggtcgccgctggaaaaaaggttgagtacttgtcacaactcccaagcttgcattttggtatatatgagaaattttgtggtttttgagaaagtaccctgaggtaattagactttgcactaaaaattcggtatctggaggtatctagtatttagagttactaaattttataatagaaaatatagtatctcttgttatctttttaaggatggtaaaattaccttagaaatatagtactagttacagttcgatttgaatatttgccacaagcttgcattttggcagatatgtacttcctccgtttcatattataagactttctaacattgttcacattcatatatatgttaatgaatctaaatatatgtgtgtgtctagattcattaacatctatatgaatatgaacaatgctagaaagtcttataacctgaaatggagggagtattagttagtctggtttgagtatttgttagttgtcagttgtcacaagcttgcatttcggcagaaatgtagtggttacagtttgatctgagacatgaagcaatcttacctatacaaccacactggcaatccgtgttccatcaaccatttgagcgttggcaccatggacactggtgcatctttccagtgcaagtttctaagctcagttcaagaagaaattgttaaagtggatgcatactgttagctcattagtactctgctcagagatctcacttgcagcctaaccacgttgtcactctagcatggagagccttctgtaccacgggattgttaaggtaagcgtggatgtagtagttgctgcatggatcatagcctggcacctgcacaatttagaaacagaaacaattttcagaacacacacaaaagactcgagcaaatagtactccatggaggaggtgaccctttgtatctcttacaatgcggctggggaagaattttccgtcgggtgcgttgatgcaaaccggtccgtatatgtcgtagggatcggtgttaccagaatcaaatgcgtccatagcatcagagcatgctttaccgtctgacggactgaacctgcagttcttggtgatgttggccagcacctcatctgatatcaccccatgactccacaagtagtcaatttgccccttcaggttcttgaactcgtcaaggcaagggttgccaacctgaacaagtagaggcatacttagtgctaaactgctaaccatgacaaaatgtttgaaaaagttcagttttaacattgcaaaatgatcgaaatggaaaggaggacgacgcctgggttcaagatctggctttggaatcccactctcctattacagtacacctcgtcgaacaactagtcgccctatggaaagcggtccggaatattcacttagacactggagaaccggaccagattacctggaaattcacaagcagtggacgctacacggcctcctcggcctaccatgcgcaatgccaaggaacgccgagcacaagcttcaactccttaatctggaaagtctgggcaccggggaaatgtaaatttcatgcttggctcatcatccaaaatagagtctggacttcagatcgacttgcgaccaggggttggcaaaacaacggatgttgtcctctgtgccgctgtgaggctgagacggcgctgcacctcgttgccacttgtagatacactaaaaggatgtggggccttgttgctggatgggtgggatatcagcaaattgagccggctcaatgggaggaggcacagtcagtacaacagtggtgggagaacatcgcaaacacgccaaatgttccgaagaaaggactccgatcactcatccttctagttgtatgggaaatctggaaggagagaaatcggcgaatctttgaccacaaagaggtggcaacgagtttcctcctgtcaaaaatcaaagaagaggctagcctttgggctttagcaggggctaagcggctgcgcgagttaatcccgcactatgtatagtgtatagctacagtttctcgattttttcctgttgcccctaggggttgtattttctcccgctctattcaatgaaaaggcactctagtgctattttctgttaaaaaaaaacaatgcaaaatgtttcagtctctgaatttcacgcaccagtataccctgtaggtttatgatcattctcttgctctccatgttgtgagtcaggatggtggctgcaagctgtggagcgtagtgtccagcatagctctcgccagagatgtagaaggcacgtcctttgtactccgggaacctctcaagccaattgactaggaagatgtacgagtcattggctgttctttggtcgccgctcttgtcgtagtcagaagatgtgttggagtaagaaaatcccacaccagcaggcgattccaggaagagcacattagccactgaaaaaatttcggcaaagtgaaactagtactctgaaactaatttcctcatgcaacggcagtttaatcataatcatatatatgctgcttgcgcaaatttttgtgtgtgcacacattataagaggtctacaggcatggattctcttgaaaagaactgtaaagagcataagtgcaaaatgcttagaaaacacatactactaaaactgtgagtattttttcggtgatctttactattaatattctcctatttgtattatcattagtagaagcgatcttattatcatttgtataagcgatctaagtcattgatttatgacttctactactaagtaggtggtagtataaattgcaactgctattgctgtgtctaaccattgttccaggcgtactcatttctgctgagtgttttattgtcgctgtttatcctgaatggaccaagttctatcattgctccatagccaactgacgagcacccgggacctgaacatcaattaacacagtttcagacagaggacgagctgtatcaacagtaaagtttcaggcagtgcattgagaataatgtaactatgtatgccagtagagagacagtagactagcctccattgagccacaggaggagtggctttgccgcggcgtcagtcgtcgcctcgacgaagtagtagaagagagcacggccgttcatctcgtcgacggtcacgtacccgccgtactgattgaagccgacgcccttgggctggccaggcagcgccgtgatcttatcggcggccttcagattgctctggtcggagacagagtactcttctttgagtctactgctaactcttgctcctggctcatgtgcactgtagccattgctgccactgacagtaacagtgctgctccttctggatcgcacgaactctctgaatctggcctcttctggcgatccatttgcgtgcaatgctgccacgcaaatgatgagaacgaagctaaaggatagtgtgttgctcatcatttacgatgaaatggtttagttgctgtgtttctgccaatgtgagggagattagagtggtgctcgattgcttatattggtcagggcctcagttggtggaaggataatatgctcaaactattagtattggaaccttgaagaattcttcaggttagtgctcatttgaatactgaggtcgccggcagtatgttgtccagttcctttttgtacacaagctcgactcacctcacggtttcatattcttgtcttgtccttttgtttgccaaaacagttacccagaaagattccaattggcgtatagtgtagcatgcttaattaggattagtcataatattcagttgaaaaaaaaagataatccaataccataacaaaggaagaagatctgctacccgctctagattttactcctatactttttagaaaattattaaacattgcttacataaatcttttccaaaatatatccacatctgtgctataaacaaaatacaagttaaaataactcgtgttttctaagtttctatgtgtaacatatttcaacattctctctatgtttttattttttgccttttttctcactgcaactttcatctatactcctttaaggcctttcacagtgcatctatgtagcatttagcctcaaccatccagtagaagattttcctctgagttttactcccgtctgacagcctgaaccggccggtactagtaccgggaggtacaagattaaatctggccgtccatcttgaaaggatacgattgggaaacagaaaagagaagcggaacgattccggagtcacaccgccgcttttctccctcgctgtgctctttctttcctccctctccgcatcggttctttctcatctattcctccatccgagcgcagaaacggagcagttgcgccgcatccatgccccaccggacgattttttcccatccatctgccgtctacgatcgcggtactggaaaaaatggcacgctcgccccgcatccacgcctccgccggtgctgattttttccccatccatctgctgtccgcggcagcgaagccaacgacgcgctccgtcaccagcaacgccgccgcattcacgagcgaagatgtggtggtattctgtgtcccctatccctccctcaacggctcaagcaagtacctaacctcctccgctgccatcggcgcagcctaggcccccattacggctcaaacactactccaccatatggtctagttattttgtaacgaacaattcaatctaccatgtttttttaatgaatttgtgagaaaagcacaagcttttgctggaaactttaatctttgaattgaaaattttaagctcatctgtcgtctgtttttttatgctgtttacagggcatgatctatcgttgaatggagcttttgacttaatttttgtctgctgtgaacagagcatgatatatatgtcgtattgagagccattaatattttgtctgctgtttttgctcgatctcctgtaaaatacatgtcattctgtggagtgatcaacagcacaacaatggttacaaacaagtgttttcaatgaacagcaatccatctagagatgtaaaagttgaggaatcactggagtatagtgctagacacatgggcaataattactgagaaaaagtataatttacatgattctgaaagactaaaacaaacatactcgtactagtgagtaattcagagtttcagacagcgggagatagataaacagaattctgcaaattttcagccaaacagaacgaactataacttagcaagaatctaaaactaaaggataagttagacaacccatctgaagaagctgtaatttaaagtttcagacagtgggagatagataaacagaattcacatggattggttgctgagacatcaacatgctgagtgatctccatccattaattctagtaattgacatgtacaaaatcaacaatgacaagcatagtacatatta

SEQ ID NO: 29444 - DNA, 14482 bp, Oryza sativa
ggcgttttgctagtatttataaacttgatagctatataaccaacttcagcttgaacatcagaaggataaatctcaactcccaacaacttgcgcatcttgtatttcatctttgtcctattattcaagcaacacacttgccatcttttgcctgggctgccttctcatgaatatagtaacaatctcaagatttagcatttgagcttgcaaatattttaattatgaaaaggttgcctttagagtttaaatcaatctaagtaagaggtaaatatgcaccaattagttcaaagattcttatcctgcacaagccagaaaatgtaattctctttattcagtctcccactttgatggaaacagccccattacaccttttcaggacatatctgtaagcacaagacttaacgtgagtaggcaaccaaatttcaccaaatggaagtagaaagctgactgatcattcgatcagaaattcagagaacactgaaaatgcgaatactcaaattacttcgggatatcagcaggtgggagcatgcccttcaggaaagagtagaggagaacaagtgatctcttaggctggaaagatggaaccagatgtccagctcccctcactgatgctagcgtgaatcctccttcgtactgctgaacatagcctccaacctgcaaacacccccatttcataccaaaaatcacagatcatgtctcagttcagactaatcacactattaagcttaatttgcttctgcttgtccattacctcattatcaggtgtgtaccaaggacgccacttatgcgtgatagtcagattaaggtccttgacggagtaccttgtcgcagtaagtgagcatattgaatccatatcaccactgaaaaatatatagagggaaaccttattagcaaccattaagccaactattatgcaattctcaatgtgcttggaatagcatattgtacctataaatccatacacttaatccattttccaccagccttttgatggttcgcaccatggaatcaggggaatcgttccaggccaagtctagactgaaagaagaatagagcgtaagagaggattgtatggatctcagagaccttgaagggtaaaataaatggggtcatccaccattgaatcatgattaaagattagtgcaaatcattgtagcagagcttatggcacctctcagtatgagagtatcatgtggtgaattgggtgaaaatttcagaggatctgaacattaagtaggaatacttacttgcaacttagtcaaaaaaaaaatacttacttgcaacctgaccagttcgtgtcagctcgtgcgtgcaatgctttttgcacatcgggattgttgaggtaacgagggatgtagtagtcgatgcacggatcatagccaggtaactgaatcaaaaccaagatgcaattcagttttgatgaacacagcatggcagcattacattatttatctgttcaattctcatggggaaaagctgatcctgcaaaaaagttatgatcttacatagccgctggatcgaaaggttccatcttgctcgtggaggcagaccggagcgtagatgttgtagcgatctatgttcactctctggaacgagtgcgccgccacgaagcacggccagtcgtcggaggaggtgaaggtgcagttggcgaggatcttgccccagacctcgtcggagatcacgccgtggctccacaggaactccaggttaccctccccgttcttgtactcatcaagcagcggattgccaacctagaagaagagatccacatggccaagtccagggttatacttactatttcgtcaatttcagaaaatttaaatatttttttactgaattcaaataaattttgacaattcacaaagaaatgaaaagatccgaaaattcgtgccaatatagttacatgtagggagaggggtccaaaatttaggaaatttcagaccctggttaagtcgttgatttgttctaggcttaattggattcatgccattacaaattttcatgattaaaaatctaacgccactatttgtgattaaaaaaattgtgataccagttgagtgtcactaaaattttgtaaaattcaatccatgccattgttgtcgagttttttagcacctgaccaagccaccatcttccattgttgttgccatcatggaccacaactagacagccttctccacctcgtttggcgcccttgctggcttgctgccatccacagagtagaaagggaaaaaaaatagcgatgatgactcggtgagggtggggcttggctaggtggtggtgaggtcaggactgatatatccagcttcgatgacatgtggatgaacggatatggtgtccacgagatgtgcatgagcagccagacagctacccaccatcaatggcgacgatgagcgagatccggtgtcaacgatgaccggagcgagccgccggcttcgaaacatcgaggacatgtgggatgagttgccaccaccaccaccaccagacgagcattgaggacgcgtggtagcagcggatggagtgagcagaagcggtggggagacaagcgaggccgccgctcacacatcttgtcgattgccctatgcacgccgctgctcgcatgccttgtcggtcgcctcgtataagagaggaagagggagagaggaggtggaggaggcaagaaaaggagaaggtgatggagaactcaatggtaaaggcacaccgttcaaattttacaaaacttcaattgcactcaactagtatcgcgaatagtaattgtaaattttcaatcaagaaaatttgcaataacagagatccaaagtgtgcattggttcaatcgattgctagcataaggaggaataataactcacaaagatgccacggaggttgaagggggtattgccgtcaaagagatggttgataaacgtgacaatggtggcgatctgcgggacgtagtggccgccataactctcaccggcgatgtagaagtcacggcccttgtactccgggaaccgattaaaccagttgagcaggaaaacatatgtgtcctccgccgttatttggtcacctacgtcactgtagtcggaggagttcatcgagtaggagaacccaacacccgccggcgactcaaggaagatcacgttagccactgcatgatttcacacgccacgtcactcactgttggaactttttaaaactaagaagctatctagaatattattttctctgtttaacaatgtaagactttcaagtattgtccatatttatatagatattaacaaaatcttacaatattaaacggatggggtaccaaactaccaatagagagtaccataaaaatatttttagctttcgcttaccgttgttccaagcatgcttgttcctgcttagcgtcttgccatcggggttaacccggaaaggaccaagctccttcatcgcgccgaacccgagcgacgagcaaccaggccctataaactcgattaaaaccacttgatagtatcggtagagagcatcgtaaaaatactcattagcatatcaagcgtgtatacgtacctccgttgagccagaggatgagaggtttggtggaggcgtcgtagggggactcgacgaagtagtagaacagctcacggccgttcttcctgtccaccgtcacgtagccggcgaactgcgcgaagttgacgccgcaaggctggccgggcagcgcggcgatcctgtcgtcctccttggtgctctccggtgagctgacgctgcgcgtcgccaggtggctgaatctgccgggatcggcccattggtcgtcttctccaggcccgtttttgttgggcctgtttctgagcctcttcaaggccctggactccatgaacttgatgagctgatcctcctgggaatgggacgacgcgtctgtgactgatgcgcctagtgctaggaggatgatgattaggacggataatgtgatttggtgtctcatcttggttggattgtgaagaaattttggaaggtcctccgaggatttaacagttcatatgtgagtatatatgtgattagatggggagaagaacaaggaatcgaggcattcaacacggattctccaaaggagtttcctagtttgcatcactaccactgagagttcttgaaataatcaagttctataagctattggcttttgtgtgtttgatatggttttaacgtaagccatctgttagtattaattaagaagtttgaaatttgactgatcttgattagagaaaaaataacggttggttttgcagatccacgtgtgaggtagcattttcgttgcttcctccacataaactcgtcatcatcccgtacaccggacaacatcaactttctttgccgtcgatgccgaggttaacagccctcggctacaatccacacgatggcgccgagaccgaggtgacatctacgtgatcatattaacgatttggaaaagttttactggtgtggtagtgggtttgtgagtgcatactttttttagatgatgataacttttcctaatgtaaatgaatattacacgtatatacgtgtttttaatgagattttagtgagattagagatatgtaactggtttccgtctcttagcataattgttagggtacgcatttacaggagtgtgagcgtggtgttacgtatggtggtgtttgtgtgtgtgcgtccaccatgtaattggaaaagaaaaaaatgttgatttgctaatggaaataagtctactttgcctccttcaactcatgtgcctggttgaaaatatcgcacccctcaagtgcaaaacagggtatataacccatcccctaacttttcaaaccgttgcaaatcgattcccccgacggtttcgaaggcgttttcgtcctacgtgttacttacatggcgggtcgacttgtcttcatccaatgtggcatcgatgtggcacttacatggcactaaaataaaaacaaacctaaataaaaaaataaattttgaacccacgtgtcagttacctaactcctccctctttatcgtcgacgatgagtgagattgggagagtggcggggtggcattagcaccatgactgcgggagcggagaaacagtattggtgaggaagcctcgatgtcgcctcctctcctcccttgttcccaccgtctaccctcctgacccttacttcaaggcttataccatactaaacttctccggcctaatcaacatcttctcttcttcctacccaccaccaactcccttccacactcctccgccgtgctctgtctcgccgctgttgccttccacctgagagagagagaggggttaaagagggaggtgaaaattaaaggtagctgacacatggacctgaaatttatttttattgttttacttactgacatgtgggtcccatttaaggtctatttttattttagcgccacatggtataaagaccaagtcaacctgccatgtaagtgccacgcaggacgaaaccgcctggggagtcgatttgctacggttttaaaagttggggaatgggttatactcggttttacggttgaaggatgcgattcaaccacgggcataagtagaggaaagaaaataggcttattcctttgctaattgcctggggttcaccaaagaaaaggctgtggtatccgtgtatcacaaatcaatccagtccaacaaaattaatgggccaaaacgggaagatgtaagactcgagataagtttggcggcccaaagttagtggcgtcatgtactgtagatggtaagtttgagcgccatatgctctgtttggagcactgaatttctttggattcctgcaaaagtagaatgttcaaaaaagaagtcttatgtaatatttatggaactcatattttcaatttcatgatcctcattaattccaaacagggactaactaataaaaaaaaaaagtccatttggtctctcaagttgtaaacaatcattcacccagatattaccactagcttggtgttttattttgtctacttgagtaattttgagcaataaacagtgactaaagtgagaacttgagggccgagttggctgcttaaggggggaatatggtttcaggagattatactgtttgatacactctcttatttttaatatggtgtaaagatagaaaagactgccatactcatttcgataaatctgtcacatcaactattttttctgtctgaaataacttccaacactcttgttgcttctgagactcctccaatttaacgatctgggctgtattctcaatttgtcgtctcctggttggatcggctgatgattgttctatatatttggaagctgcatataaaagcacaaccaccaacttttgtttttggcaagaaccgtgatccctgtcatcttctgatcactggtcagtagactacgagagtaaaactcatgaagaacaacatgacaagaacagcacattctcacaagtcacaaccagtgcagctagcttgagcttaccccacagcattcttgaatttaaggaagaacactgctgctaccagttagcaataagaaatctaattaagcccatgacataaaatccgcaggaaaaaaataataagctgattgctttggtgataatttctacagtgctagtctgataaatgactgtttgagattaactcccttcagtaataatgctcatgcaaccatgcaaaactttatgcacagtagtggctcacactgtgacacatgacacacatcctccagatcgaccaccactaacgtgtaatcttattgtcgtgtcatggattccagttgctggtcactacatgatctgtgaaaaaaaaaaagggaatctagagctacatcttatcctatgtcaagcctgtctgccaagatgatcagcatattaaccacattcttcttctcctctgcttgactgcctcagctgaattacagatcacagagcatatgcccagcaataattcaagaagcatatgcagatatgctctctcacctcgtctctcaaaagcaaaggattttatttcatgaacggtagagcgccaagggcgctatcaatcagccacaattaaaggagcagaaggacatttgggccatcctttctgggtgatacccgagaaaccaaccaccacctttccggtgcagattctaacagcaagaacaacatatcagaagtaggagtaaaagaggatgcatataggaagctgctgctttcctctgatttgaaggccactttaatatgtctgttggtagatcaattatctttgcttccttacatatgggccggctaattggtttgcaagatctgctttagtaccacagatgacttggatataaaacgtgcataataatgccttaatctagtattaattatggagattataatgcctagatgattacactagtttcatttgattaggtagcttgtggcagaaagattgctagctacattaattctcgattcatattgcaggatattgtgatctggggcatcattcagatcttgatcttaaatcaagtaaaataaaatgctgtcagagattactgttcaacttataatcaacctttatatcacaaactaggaaggtagcccgcgcattcgcgcgggcatgcgtcatatgctaagtttaagatagttataaaagctaaatattaaccggagaacatctgccacgatttctccatacatttttttatcagcattaattgttttataattttttaacctattagctttatattatactagcatatttttatattcttcctcatcatttgaaaagaaggtagacttattttctttagaaaacatatcatcggaagtaaaagtaaggtgttttttaattgcatatatattatgatagtttattatgggataaattggggactaataggaagaaaatgagaagagcagggagacagagaagatagggacggtcaacaaaagaatatattggaaccgtgagggtatcattgcatgttttatttagtggagacacattttttattaagtactttgtatacttaaattatactaccaaattttagtagtatataaatatttttcgtcttttaaatttgatgagtgtagttggttatttgacacattgaaaaaatagactcaaaaaacacgtaatagacacattgaaaatacgtagagcatcgttatcattgttatcatggatctaatttagctacatatatatttctagattaatacagaatagcacatttgatatcgtatttattgaaaaaaaattcatcactgtcttgatgcatagcatatcatttctataattaaaatatagttaacataggtcttaacttattaatctaatcacacatattataaatattcaaaccagttggaaattagatgcacagttaagcagttatatttatttgaaaactagcatggtggcccgcgcagattacgcggttagcatcattatattttctcacgtataatagcatatatgttttctcattttattattaaaatatattacaatgacaacataattttaaattttgcaataactttacgaaactactaatgtgtaataactactctagtctcctcttctaatattccttattttttaattctgaatttcagctatttctaaattgtatttctatatggactctgctttttctttttcttatattaatgtgagaatttctaggccatgagagcgaacgtggaggctcttttttgttccgaattttagttagttttaaattccaatatggactctatactctacttctaatatttactattcattcattcccgaaatgctatttgttttcttaagggtgcggaggctcctttttgttccaaacttctagtggttctaaactgccctgtggactctatactctacttctaatatttcttatttttttatttccaaagctctatttgttacttaattggatggaggctcctttttgttccgaattttagttagttttaaattccaatatggactctatactctacttctaatatttcttatttttttatttccaaatttctatttttttttcttaattgtatttctatatggactctatactctacttctaatatttcttatttttaattccgaatttttgttatttcctaattgtatttctatatggactatatactcttcttctaatattccttatttttaatttcgaatttcagttatttcctaattgtatttctatatggactctagtctcctcttctaatattccttatttcttaattccgaatttcagctatttctaaattgtatttctatatggactttgctttttctttttctccgattaatatgagaatttctaggtcatgagagtgaacatggagactccttttttttccgaattttagttagttttaaattcctatatggactttatactctacttctaatattcctttttttaattccgaatttctgtttttttcttaattagtatctctatatggactatatactctaattctaatattccttatttttaattccgaatttctagttatttcctaattagtatttctatataagaatctagtactctacttctaatattccttatttttaattctgaatttcagttatttcctaattagtatttctatatgagactctatactctacttctaatattctttatttttaattccgaatttcagttatttctaaattgtatttctatatggactctagtctcttcttctaatattccttattttttaatttcgaatttcagctatttctaaattgtatttctatatggactctgcttttctttttctccgattaatgtgagaatttctaggctatgagagcatgcgcggctagcatcattatattttctctcatataatagcatatatgttttctcattatattattaaaatatattacaatgacaacataattttaaattttgcaataacttttcaaaactactaatgtgtaataactactctagtcttctcttctaatattacttattttttaattatgaatttcagctatttctaaattgtatttctatatgtactatgctttttctttttctctgattaatgtgagaatttctaggccatgagagcgaatgtggaggctccttttattccgaattttagttggttttaaattccaatatgaactctatactctacttctaatattccttattttttaattccaaattttagctatttctaaattgtatttctatatggactctagtctcctcttttaatattccttattttttaattccgaatttcagctatttctaaattgtatttctatatggactctgccttttctttttctccgattaatgtgagaatttctaggtcatgagagcgaacatggaggctcctttttttttccgaattttagttagttttaaattcctatatgaactctatactctacttctaatatttcttatttttcaattccaaatttctactttttttcttaattgtatttctatatggactctatactctacttctaatattccttatttttaattcagaatttttattatttcctaattgtatttctatatggactctatactctacttctaatattccttatttttaattccgaatttctattatttcctaattgtatttctatatggactctatactcctcttctaatattccttattttttaattccgaatttcaactatttataaagtgtatttctatatagactctagtctcctcttctaatatttccttattttttaattccgaatttcagctatttctaaattgtatttctatatggactattttttttctttttctccgattaatgtgagaatttctaggccatgagagcgaacgtggaggctcctttttctattcctttaattacataatagattatatttctatatggactctgccttttctttttctccaattaatgtgagaatttctaggtcatgagagcgaacgtggaggctccttttttcggaatttttgttagttttaaattcctatatggactctatactctacttctaatatttcttattttttaattccgaatttctatttttttcttaattgtatttctatatgaactctatactctacttctaatattccttatttttaattcagaatttctattatttcctaattgtatttctatatggactctgtactctacttctaatatttcttatttttaattccgaatttctattatttcctaattgtatttctatatggactctatactcctcttctaatattccttattttttaattccgaatttcaactatttctaaagtgtatttctatatagactctagtctcctcttctaatattccttattttttaattccgaatttcagctatttctaaattgtatttctatatggactctgttttttctttttgtctgattaatgtgagaatttctaaaccatgagagcgaacgtggaggctcttttttctattcctttaattatataatagattacttttaagtagttaaccacggtatactcttgtactatgtacgtacactatattttttaactaacttatatacgtacacttagagagagaaaaaaaagggttcgttatttctggatcgctccaaggccgaccataggcatgttattttacaaatctaatttaactatctgacatgcatagtggatccatcagctttagttgaaatcgacggacggatctttatctttttttttcttttctggtaacttgggagttataatctatctaattaatattttttgtttatatattaagtgttagctagaaaaatatgaaaggtcagttagaaaataggagaggagaagagatacggagggtggagggagtatggattatgtacatgcgcaaatacggtgcggggtgttgtacaccggatttttttaatacagatctaatggttaaaattgatgggtccacctatttaaaggaaaataatgattaaatgtatttcttttctatcataatttttaagattttctctactatattagagtgtcatgtgacagtttaggagcgtttgtagagcaccacgtggcggtttaggagcgtttgtagaggatttctctaatttatttaagatccacgtagcggtttaaaagcatttgtagaaagtttaatgtacttttaatatatagcagatagatttagaatatggtttaaagaacattgattgaatatttatatagatctttatttaactaaatatatttatatttgtgaagtaatatattttatctaaaatcatattttaaaaactgttatttttatggaattatgttttttctattttttttcatgtgtactttttttttggttccagcaagattaggaaagatcatgtacattaagtttattaagtttatacgtatggaaagatcagcagtagtatcgtacaaatacaaacgtaccgatcatgaggaggttattattttttaataatagatctaatctaatggtgtaaactaacgggaccaccaatttaagtgaaaatcaacggtgagattagataatgccatgtggcgacttgggagcgtttgtagagcaccacgtggcggtttaggagcgtttgtcgaagtttcatggactcttagtatataatagattttgatgcgatgtatgatcctaagatcatgatcctgttaattattaacatgaatacaattaacaatagagtctcgctccggtgccttctacttggagtagaaattaatccgagccgttgatcgtatttaatcatagggttgagatctagttcttatgcgtgctttccttagaagaaaacaataagcagacttctagtagaagtatacttcagcatgttcaatacatcggctgtgttagagtttctattgaatatatgtacaaaattgtttacaatttagttggaagtatcgttactgtcttcgaatggaagtcatgcatcagcactaacttatggctaagtggaacgagcggactttgagttgtactaagttttataatagagtaagagtcggactctattctctctttaatagaggggtagatctgttgtaaccgtataacgacttagtataggctagaggtagcggctgtcggcgatgtccagtcgaaggtcgttgtaactccgatatactgtaatatgttggatcatggagaagcacatgtaataagtactccggagatataggctttggttgaacttcgttaacaaatatcgtgtctcacatgtcatgtattattgtgtttggatctcctataacatttcttccgcatttggtttcggatagtgattttgggccggttttctaacaactggtattgaagcctatgtttggtacccggaacaatttctatagatcacaagtcttcggggtcacatgggttgatgtaaggagaagattgttggattcaatgcgtgacggaagagactattggatttagtcccatattggaggtgctcattcatgtaggatgtgtgttggatttagtcccacattagaggtgcccattgatgtcggatgtgtgtgcgcgtttaaagtagtgactgagacagagtacgcacgacaccaaccggacaacaacaactggccaagtgtatggtataaccatataggaagtggaggaagggatagagtttttaaaggagaggctatacatgtatttggtggagcaaggagattatttgatatccaatggctacaaatttaggtgattctttttccaacaaatctcacactatgagataactatgcactcgaaaattgtaaatcgcattggttgtaacttgtaagaacaacactatttcgtcgacgtgtcatgtttgttgtccgtacgtggccctaacttaaccttgcattattggcacgagatttgtaggagaggtacgtatgaattggaaaggtgaccctggtcacatgtgtgaacagctccggttgtacaacaaatgcacaacttgtcgcgttgcacttctcataacagagtaccactatttatgctcttgttggctcgattaaacagcagttaatatgcatgtttttctttgcgttgtttcgacagtacacgcacatttaatcttacgtgatcatactgtacatagaacagagaaatgatggtcggaacttggaagttggaagttagcagtaaattgaggcggcaatgcatagtgcactggacgccagtagtttcgagtggaagtacaagtgcggttcactcgctgacagagtgactgacataatcacagcatcatcattgtggcatgcaaaacaaagcacaaaaaacacttgtctcgcaaagcaaaagctgatcaagagaaacttctatcgacacaaagttaaggccgcctcgcatgcatgctggaaatctgatcatctctgccatggttcgttgatcactttgccaaagagctttgcgtggtaattaatctgaacggaatgccactttgttctccccccttccactttcgccatgtgacgagagatacacaca

SEQ ID NO: 29445 - DNA, 8033 bp, Oryza sativa
cccccccccccccccccccaaaaacgcgctcgcgcttccctgccgtccaaggacgccacacacggcgcggagctcgcggcgagacctttaatggcggcggtgtctcctcgcggtgcgtagggccgcccgcccgcccgccgcagccgccgagcattttaagtatcctgtctctgtctcctcgcttgctgtcttgctgattgatatgcatacggcgccggagatgaatggccgggctcggaggccggcggcggcggcgcacggcgccaaggcggcctccacgaagagcgacagagtatgcttctcaatctggcaaaaacctctctcgtttctccgtgtgctctgttctcccttcttttatggccaatgtgcggttattttcggttcccgcgatggattattgaggcgtcctcggtcgccggcgctcgcgggatcggaaggcggcgcctttgccgcctacttgaggccagctgttcgaactcggtgcttgatagttttttttttctttttaactctcgtttttggttcccaaggtgtgaaattctgtgcgcctattttgttgttttgcattggtggcgtaatgtggttgttagtgatttgttgcaccgtcgatgtgtttcctgtagtacgacggattattaaatgttgttgggaagaatacaaggacgaacagtgctgttttgatgttcttgcgagctacgttttggttggtggtgtagcgtgagaagatctcgccactgactcgcgggcgtcagttagctttcgagagctactccgatagggtatctcttgattgctcttgagcccgcatttcttccccttctttaaatcagccgctttatctctttatctttcggagaagaggaatctgttgctttgctttgcttcggttagcttctttcacagctaaacaacgccttctttttcctcttttgatgatgatactgttgttttacgtgttcagatgatggagaaggatcagaggaagggcgccatgccggtgaagaagggatcatcggccaacgcggtcaccaaaggcatcacgaacagaatccaagcgaggagagagcggaagctcgcactgcagcaagatgtactacctgaattctgtcccaaattctcgcaatttgagaagcgcattggttcgtccgagttgtgttttgtgacgcaattcgctgcctggattttacaggtggacaagctgaagaagaagctgaggcacgaggagaacgtccaccgagccctcgagagggcgttcacgaggccgctcggcgctctgcctcgcctgccgccgtatctgccatctcaagtcagtgccacatttgcattcgcatttgcatcaaacgaaacgcattgttcttgctctgcttgggacaattcggctctgaattctgaacatgttcctgctctgaattctgcgatgtgcgaagacactggcgcttctcgcggaggtggcggtgctggaagaagaggtcgtcaggctcgaggagcaggtggtcaatttccggcaaggactctaccaggaggccataatcttctcctcggccaagaacacgagcctccccggcggcgagggatgcgtgccggcgcagctcatgccgtcgagcccggtgccgaactcagaggtctctccggcaaattgtcattctcctcctactcgaccttcaatgaacggggtcgccggtgcaaagcaaacgccgagaaagccttctccttcggcggcggtggcgcaagacgaccgctccggcgccgggaaagagaaccagtcgtgcagtaacacaccggctagaaattgtcgccattcgccgctgctgcagaaggcatcaaaatccagactgccgacagcagcagcgcctgagaaacgcagggctactgctcaggtaaaaacagtagtaataagatccttattgctgctgaatggtatttatttacacatttttctaccatgaactaacttcttctgaaccgtactgctgctgcatttttttttatcacacagacgattagcacagtgccggaccgtaaaaggctcgcagacactgtcagcaataattcagaaaaagcttcccaagatgactcgagcgtgccgaacagattgtcggaggaactgttgagatgcctgctcgccatcttctcgcagatgggcggttcatcagcaagcggccaagacgaggagcaggcggcattgtctccttcggtttcaggttcttgcgagagctcagaggacgcataccctcaagatccttatggcatactggaattcggcacaagagacgttgggtcatacaagcgattccatgtaatcgacgccacctcgttcgatcagacggccatggagaacgacaccatgcttacccggaaactcaagtgcgttcttgctagtgcaattttccgttcagttattacaagctcggtttggttgtctgtcgagtaggtggccgcctgacataattagcatcgctgatagaggtggttcatgtctacctggcaaaatctgcagggctttgatccggaggctttcatcggttgacctgacggggctctcccatcagcagaagctggcattctggatcaacatctacaattcgtgcatgatgaatgtaagctgtcagcctgtcactcataattgagcccacccatcctgaatttcttcatcttgatcaattatatctttgttcattttctcgttagagggaaatttccatttcggtgatagttacctccttcgttatcaatgtttgcctccgatagaatgacagaagaactactgtatgctggaatatttcgggaggttaattacttactaccgcattgcatattactagtactatatggtacagccagtacaacattacagcatgggcgtggttctgacgagtacgttctttaaccatgaactctgaacatagtgctggcatgtctgtgtactgttctcttcagtcatttagttttgcttaaagaaatgcttcctgtccccatgaccataaacaaaggctttaactaacactgatcaccatcatcatcgctttggcattattatccttaggcctaactatctcatgccatctgcgatacggcctaggaaagggtagttaaggtaggtagatgtagtagtgtagtgtcatgcctagtgcctcatacttgtccctaacacttgtcttccttgtcgtactgcaggcatttctcgagcaagggatacctaccacccctcatatgctcgtggcaatgatgccgaaggtatagcactaagtaacttcttgcaagcagcacaaatcatgatgcgccggtgattaacgaagtaatcaagtctctgacgagagagtgatctccgtgtttcgctctctgttttcaggcgacaataaatgtgggtgggcgcacgcacagcgccatgtcgatcgagcatttcatcctgcggctgccctacagcgtgaagcatgtaaggcgttacagtatagttttgtcatggtggatacggccatcgtagtgatccgggtagattggtgttccggttgcacagcaccacacgctaaaactaacaacctatatatggctcgtgaatgaacaggtgaatcctggtggagtgaccaagggcgccgccgacgacgtgacgatgcgaggcgtgttcgggctggagtggcctgagcccctggtcaccttcgcgctctcctgcggcagctggtcctcccctgctgtaagatctccatgattccgtcagatttttgcagcattacagcatgtaaaaattccgtgtagtttgtgatgaggtgttgtgtgattgtgtcttgttcttggtcatgttttttttttcaggtgagggtgtacacggcgcggggagtggaggaggagctggaggcggcgaagagggactacctgcagtcggcggtggtggtgtcggcgccggcgaaggtggcgatcccgaagctgctgcactggtacctcctcgacttcgccaaggacgtggactccctcatggactgggtgtgcctccagctgccgagcgagctgcggcagaaggcgatgaggatcgtggaggacggcagaaggggtgtcgccgccgagtcgcgccgcgtgcaggtcctgccgtacgaattcagattcaggtacctgctggcctcatgaagagaggccagtgagtagcagcaatcagcgagtgaattcgagggtgttttactgcaccttgtacacaggcttccaataattgtgagttttgttcttcggtgatgtgaatgaatgaaaggaagtataaaaggtgtttccaccagaccacgactactccagtcgagatcgagtaccggtcgcttcttctttcccttccttttcgtgcttggaagagatggtactccagtactactactcagcttctgtacacaggcctgtcagacttgttgctaaaaaagcgaaaggcgccatggcatgctgtcctgtcagcagtcacagtgattaacctgaccctgcagcttttccctgctgcgtgtttcagccctgatgattgggaccaacggtagaatctacagtacgaccgagacaagctacaggatcaccgtggtcgttgaaaatactgtacgtgtcactagcttaccgccaccgacgggataatcacacggtttcaccgccattaaacgacagggagggaagctagctggcgttggagtaaactcaggccgtgtttagttcaccccaactaccccaaacttcaaactttccatcacatcatatcacatctaaaatttttctacacacataaacttccaacttgttttttaaaattcctaattttctccaaactttcaactttttccaagaataaacacaccctcaggtaagatccctggggaccctacacagcctcgtgtcgtatgagtagtagtacgacctgtgccgtaggtttatatactcctaaaaacggacagggtggctggcgtccttgaaggacaggcagggtgtgtcacgaagctgctgcatctcatggcctccgtgcccactcgctgctcacctcccaatttcccaaacgatccacccatcgttgaatccactgcacggcacgggacaaaacaccggtacgtgccgtgcgagtgtcgcgtcgcgtcatatatcgcagcttctgttggagtaaagcgcggtgccttgtactgtcgcgtcggagcagccacggttgtttggcgtacgtacccgcggtggtgtctcgtctgtacatatggccctccgagagtccgaggcgccgcgtggcgcggggattttgccacgcttgggattgctctcatggcgggtgcacctgctgttctgccactgtcatatcagtagtccccgagggccgggctagactgatcagcggcgtgcagcgccgctcttttctctttgggaggagggaaagggggccgcggggcgggtttatgggatcgtgtgaatcctgtagtgattgaatcatggaaggacggatcgatggggtctccttcgaagagctgaggagggagcaatgcaatcagatgagattgcgtggctttttgtagagggtaagtgctacttgctggagtaggtaaaaaaagaggatttgaagggacacacgaccccgagtgtgttggggattaagcgcctattaagatttagttaaaataaacattaccaagttttggtaatactaaaattttgacaagatttttttatgtattggccaaatttggtaacaaactaaacgttgatatttttttacaacatttaaaaaaaatggtatggttcaaaattgcatcaaagtgaacaggccctaaatatagaatcttgtgttgaactacacatcccttgttactgtcctatcgagtatatcttaagtgctactgttaggtgctagcacctcaatcaaaggaaaaaaaaagatcaaagatagccagatagtatcctaaaattttaacatgaaatgctgatggctgctatgtgttttttcatgtgaaggacgaacacgcacctccattatcgacagacgcctctaacatacatactcttagagtaataactttaataatatagccaactattagctccaaaaattaaaacatcaactataatcaacctaatagcctaatcacacattaattagttgtaaatacatattatataattaataccttgccaacggtggatacccgtagaccggatatagacactacaagagatcttatgataggtgacgctttatttatgtcacaaacattgaattttacgtcatgttatgtaatctgtgacgctcacgtgacgaaaattcattcgtcatctatcatgtgtctctaatggcgttctatgacgaaacctttttttttcattaatctagtgacgatccttctgtcgtcataaagttatgacgtccattttcgtcaccatcaagcccaaaaatcgtcataaaatttcatatggactgttaaggcccatgtagtgagcaacatgtttttgggctaggccttgttaaagcccatgtagtgagaaacctattaatgggctaggcctactgtaagtccaattagattttaataaattcagcccaattcatctatattgaattaaatattaaacgggccatacattttcaaaaggcccaataggcccaagcattgcacatagtatacatatggctcatgcacactggagaagcctttatatcaagcaaatttagcccagttaagattcaatataaaatccaattagcatttgatagcccaattaacatcatttagcccacaagcaccagttcacattttagcatgtcctaatatagtcacaatctcatacacaatctcatattcacggaactcgatgataccaatgagaccgtagtcgagctggttcgactagatcacccggcgacttggctcctgtaagctccaacttcgtaggctgtggtggttgtgttggcggtgagattcgatgccttgggtcctcccgggggatcccttttataccgcgggtcagtcgatctctaagtagaattcggagatattggaccccacatgatatggtaacgacccagttccgtccgagtaggactctttccatctgtgaactccgtttatgttacgtgatagatttccttaacatatacaagaaacacccgtatacgcgtgggtataccatatcagtatatatcttatatccaaggatagagggtatgccttatccgtaaccctgacatacctaatccactcatctatctcagatataacttattggagcccgtggtatagtcggctacaactctgtagcctgtagaaattgctatagagtccattgccaactccgtatacatactatgtctatgtgcccgtggtttagattatactaccagttgaaataatttgaaccgttcgttattaagggtaaatcaataatttactaataatacaatgattaagagtaactttgttatttatgttttttttctagctaaatgaaaaaagtttagtcattgaccctacctcacctacttttttcagacaataatgcccctttctatttctactactgttaactaaggtgttagtataaataaatctaaacccttcgattaaataagattaatgggttagattgctttcttctattaatataaagcaacgtagtggggctctatactagcaatggagtagagcacgtacagtacgatctattaattgtagtactacattccaaggctatccacgttaggacaggtttagatggagatcaggcaaaagagtagagggtcttaagggagtatcatgcactcgcacggtttgtacaggcctaggtagcaacagtgctacacttgaccttcgtgtgttagatttgagcctgtcgcaagcagacaggctcgctcacgccgtcacgcgggaccaagcgtggttgatagcaccggggtggcctgctcaccgtgctcgcttcggcccaaaacttgacgccttacgcggttaccttgattgctccagtttggaataagttcacttgaggtcccttaacttgtcaacgaatctgattttcgtccttcaaccggaaaaccagatacaatagatccctca

SEQ ID NO: 29446 - DNA, 2313 bp, Oryza sativa
atgagccagcaagggatctggtatggcgacgtgttcccgttgaccagaagcctcgcggccaagcccatcgtgccgtgggacgcggcgacgatgcagtcggcggagaacctcgtgttggggaagacggtcaagggcggcccggccgccgccatggagttcgcgacgagtcgtaacgaggagatgggcgtcatcggtcatgaccagtccacggacgccaccgctgagcatggcgtcaacatctccgataccctcgtccccggcggcggccgcatcgtcactgagttcgtcccggccaggtaatcacactgttgcatgaacacagttcgtcgttgccgtctctccgattgttcgagcaggatgatggcgccgccgcccttcgactcccgcaaccctagctccgcgtcgcagaccgccgaagaagtgcgcagtgggcggcggccagctgccgtctccgccccacttgccggccggcgcctttttccctctccgtgggcgctcaccggccggcgaggaacgatgccaggagggagagagaggaggcgctggtcgctccctctcccagtctctcgtcgtccaatcgttcgtggatagtgaggatggtgggacccactgacaggtgggtccactctttttccctttggtctaactatatgtgggccctatatttttgtttttgtttttaatttttatgttttccttccagtgacacgtcaccgccatgtaggacgcaaaccggccacgtagatgccacatcggccaaaaccaccgtcaaaaccgctgagggacctgctttgcaccggttttgatagttgagggatccgttgtatctggttttttggttgaaggacgaaaatcgaattcgttgacaagttaagggacctcaagtgaacttattccctccagtttcaacgttttatatgggccagaccaaacagatcggcctatgagtaatcaaacatcgccatctccctgcactaacccccggaggcccggacgtcccaaacatcagcgcttcgatttcgcaggggtaaccctggggtcaactctgctgtcatgctattgctacctcctgcatgttatgtcgaacaacctgatctttccattgtggagcgccacgacatgtactatcgagcaacaactgaaagatgttgacaccaacgtagtgaacagtacgcatcaccatctcatttcccgacacattttggcagacagatccctaatgcgatcatgcggaaaataaactaatcgtttcttggatcgctgctccgttgctttctcaatcccggatcatgcatgaagcatcaatttaattgacagatgctatatctagcagtaagtaaaaacagagggggggggggggggcacaggtatcatcggtactcaactgaagtaggagtacatgatttttatcggaaaaatttatgagcaattaataatgcatgctgctatttcattgatatactatcatgcaagaaatcgaaatggtcccggagacaagatcgcgcggccaagtgtccggtcgcccaacgaaatcacaggcgtgccgcgaccgcaagcgcgccctcgccgtcgccggccggccgggcatgtctccggcatgggggcgttagagcaagtttaacagtacagcccactactaattttaaatcatctatagccgatgtaatagtcaattcatacaatagttgcttactatattattaatacctggtctcatctatcatacatatattacgtcttgaagtccgtgctacagctagctacagatctgtaacccgttgctcttttttttcctttatctttttaaaatatatttgtagctggcttataagcctgctatatttatagctggcttagggcacccgcaatggttatttataggctctctataagagatccatgtcagcatattatcctatctggaagagattaaatgaagagagaacaaaactatctattaacttagagatagtctgtagagaaaaacaggcaatggattagagagctatacatacccatgtagacatactattaaggtgatttactattaatctagtctattgctgagatgtacatgttttatagagagcatcttactttaccattgcgggtactcttatagcctgctatttatagctggcttaaaatatatttatagatggcttaaacgagaccggaaagcatgcgtggggcagcgtgctaggagcgagccagcgaggcaggcatatgctcagcacagggccgtacgtccttcgaggaaggggcaagcttggtacagcgtcacatgcgtgcttgggcgtcggaccagcgtct

SEQ ID NO: 29447 - DNA, 766 bp, Oryza sativa
cgccgccggcgtccttgtggtgtccgtcgactaccgcttagccccggagaacccgctccctgcaggatatgatgattcttgggcggcgctccagtgggcggtgtccgcccatgcggacgactggatcaccgagcacggcgacacggcgcgcgtcttcgtcgccggcgacagcgccggcggcaacatcgtgcacgacgtgctcctgagggcatcctcgaacaaaggaccgaggatagagggcgcgatcatgctccacccgttcttcggcgggagcacggccatcgacggcgagtccgacgaggcggtctacatagcctcgaaggtgtggccgttcgcgtgcccgggcgcagtgaacggcgtggacgacccgaggatgaacccgacggcgcctggcgcgccggcgctgtataagctcgggtgcgagcggctgctcgtgtgcacggcgcaggaggactggctggtggcgaggggccgcgcgtactacggcgccgtggccgcgagcgcgtggctcgggagcgcggcgtggcacgagacggagggagaggggcacgtcttcttccttcgcgatccggggtgcgacaaggccaagcagctcatggaccgcgtcgtggcgttcatagccagcgcatgaacttctcttcttcatctgtatatgcttgcggacttgcagctgtatcttgcttgcctgagattaataaatcaataaaatgttatatattgtggcagtggaaaacatgatcattagtccattttacctgtattgcct

SEQ ID NO: 29448 - DNA, 107 bp, Oryza sativa
aaatattccttttcttttccacttcaatgatgcaaatcatcaatgagaatcaaaatcatagacagtatatattcctccctttattactagttacgagtagtagtagt

SEQ ID NO: 29449 - DNA, 1993 bp, Oryza sativa
gtgcaggacgtgctcttaagggcatcctcgaacaaaggcggagtatagaggggcgatcatgctccacccgttcttggtcgggagcacggcaatagacggcgagtccgacgagccggtctacatagcctcgaaggtgtgtccgttcgcgtgcccgggcgcagtgatcggtgtgtacgacccgagcatgaacccgacggcgcctggcgcgccggcgctgtaaaagctcgggtgcgagcggctgctcgtgtgctcggcgcaggagcactggctggtgccgagggaccgcgcgtactacggctccgtggccaccagcgcgtggcgcgggagctcggcgtggcacgatacggagggagaggggcacgtcttcttccttcgcgatccggggtgcgacaaggccaagcagctcatggaccgcgtcgtggcgttcatagccagcgcatgaacttctcttcttcatctgtatatgcttgcggacttgcagctgtatcttgcttgcctgagattaataaatcaataaaatgttatatattgtggcagtggaaaacatgatcattagtccattttacctgtattgcctgcgttctagagaagttatatatgtttttgatcacgcctttgagtatagccatgtggccgcgtggcgtatagtagcctacaggtactggttcttgttcacaatcgagggagtgattctaatccctcgaggggatatcccctcgtatacctttttcttctaaattcgatgcaaatggttgtgaaaaattctgaaaaaaaaattgacaatgtagagtataatgatacctactagtccaccaaaattcatgttcaaatttgatctacacatcgaaaaacaaaaaagacaaatttagatataaatagtacgctactattcatacgctgaatttgtcttttttatatctcgacgtgtgagttgactttggacttaagattttgtgaagttgtatatatgtgttgtatgaatgttgtcaaatttttccagaatttttaataaccgtttagatgattttttgagcaaacgagggaacttcccctcgagagattagaatagtttctccacaagggatatctttatgcacttatatatatgtgtcagttgtgaaaccggtacttatgaaacaccttatcagagctgcctgacagataccaattacaaattcaacatcaaagaccgggtttacaactgatatcaaagcggttttctgtgccggatatcaaatcatatctactccctttttttacgtcatgtgatagggacttaaaagttactatccaaacatccgatgtgataaggatttaaaagtttaatatttatagttagtgtccaaacatccgatgtaatagggacttaaaagttttagtcccatctaaatatggtcttactttggttagttttttttttctataaggggtttgtcccatattgcttgtctatatcgttaggaaaactttgtttatgtgtatcaaagattctgttcggctgcactcatttttattgtgttgcagccaacaggcacaatgtcttctgtgtgcagccactgcagcgcaactgctaaacataacagccgaacatgcccaaagaagcagagacagctgtccgaaggcacgggcggcctatcgtgccttctttaaaataagtctattttccccctctctcctttttgggttatgatatatatatatatatatatatatatatagttaaaataagtctattttacgttcctattctttgggccataccatataatatgtgtatttttcctccctatactttctgcggtgccttacacatggttgaaataagtctgtttcacatccctgaatttcgtgccggcccagcgtgttgaggtagcagcctagacacggtgcggttgttgggccgggccggcacgggcacaacccgagttgggctgtgtcgtgtctgggccaggtgaaatcgccgggccacatggccatctacaccccccccccc

SEQ ID NO: 29450 - DNA, 5034 bp, Oryza sativa
tgttttcttctctagcttggctagtctgataaacggacataatttcttctctctcttcagaagaaaaacggaagcgtttcagtatgattcggatctgaatcacacactctttgtcatgtgacagactgacaggttcgttgattaatactccaggggtaagcactaagcacgggtgcccagcctttgccttgcgttaccaccagcaattgacatttgacagcgatccacttagccacggccatggagtccaacgccgccgacgagctactgctcgagttggactccctacgcatctaccggagcggcaagatggaccgcctccaccatcccgtgcttgcgcctgccggcgtcgacgcggccaccggcgtcacgtccaaggacgtggtcgtcgacgctgacaccggcctgtccgtgcgcgtcttcctccccgcccgcccagatccgtccaagaagctacccgtcctcgtcttcttccacggcggtgccttcgtgatcgagtcggccttctccacgacgtaccatggctacgccgcgtccctcgccgccgcggccggcgtcgtcgccgtctccgtggagtaccgcctcgcgccggagcaccccgtccccgccgcctacgacgacgcctgggccgcgctccagtgggccgcgtcggggaaagacgagtggctcgccgagcacgcggacaacggccgcctcttcctcgccggagacagcgcaggcggcaacatggttcacaacgtcatgatcagggcggcgtcctcccatccagcgccgaggatcgagggcgccatactccttcacccttggttcggcgggaacgcggtcatcgaaggcgagtccgaggcgacggccagggacatggccaagatctgggagttcgcgtgcccgggcgcggtgggcggcgccgacgacccgaggatgaaccccacggcggggggcgcggcggggctggagaacctccggtgcgagagggtgctcgtctgcaccggcgagaaggactgggccggggcgcggggatgcgcgtaccacgcggcggtggccgcgagcgcgtggcgagggagcgccgcgtggctggagtcggaaggggaggggcacgtgttcttcctggagaagccggagtgcgccaaggccaaggagctcatggaccgcgtcgtggcgttcatctccgcctcctgagtccacctgggccgccgattaggtgggggtggattccggcgagggagggggaagtcgaagcggtcgatctgagcagtgtgtatgcaaattcttcgaataaagtggctacatgtcaaattgatatctcaatctgcgccgcctaggcgaacggtgcggtgaagcgggacagtgcagggcactgtggttctgttagggctttcacagcgcagtgacgtggcattcagccttgagcttacacatagaagattttcagccacatctgcatttctcgtgagcaaaccaaaaacgtgtgaccatattgagacacacgttcttcatcaaccttttgtcagcgttgtcaggcactcaggctagcccacactcgaggctgatgctagccatggccgtggatgaggtagatgagtcggcgtctgtgccgcttcggaggagaagcgccgctgacctcaccgtccgccgtccctcgctctcacgccgctgacatcgtcgttgattcaggggacgagaagaggggtggatctggccgctcttcaaccgctcatgtgccgccgacctcacagtccgctgctcttgcaccaccgaccttgttgtccaccgtggtgaatcaggggacgagaggaagggtgaatatggccgctcttcaaccgctctcactccatcgacctcgccgtcccccgcggctactccacccagcaccaatgccaacaccacttgggccaccccaccgctgctccgctacgagttcgtcgccgccggtgagttgaggtggggttggtggggtaagggagagggggagggagctgccgccgccggttggggcaggggcgcagctacggggggtgccggagggggccaacacccccctatctgccccctccctgctatactatttagcgcattagcatgttaattagtccattatcaataaacatgatatagaaaattaattaataagaaagagacggagagacaacacaaatcaactcctcgtctaaattgcttcggcttcacacatctctccgtcctcccattgcatctcgctgtcgagcatggtgactcaagtctcaaactgtcaaacatccaatgatacaactaaagagctaaattcaagctttttttaggcagaacacatgatgccctgttttgtcgttggcatagcttactctgacttatgacttgttcgccctgcccacacccccctaactatagatcctggcttcgcccctgggttggggaggagatgggtctggagaggaagagaagggggcgagggagtcgccgccggagatgagctcgcaaatctgcggcgtcagtgtggtggggagggggagaggagggggcacgtgggagccgagtgagaggaagagagaggcggaaggggaagaaaaggtggtggggccgacctgaaaagaaaaagtggtggacccacttaaagctacgagtgcacggtggagaggggagcttcgactgtttttcttcttatgtggacatttgggctcctcaataagataggacgcattgctattgcccttaaaggggtatttggataaataaggttagtaggcaatctataagaatatgaagaatccaagaagcagttggttgatatccgtttctaagaaactcagtttttatcttctcggttattttctatatcttataagtacaatttcacaaaatctagataaaaagctaaattatttggggagcttttaattcgagaaatttcaaaatataccatccaacttgtagcacgttcaggatcaaccatccaatccgtgtgtcttttagaatctgccatcacaagagctaatttcttcatttcgcgtcattccgtccatccgaagcaacgttgtccatccatccgttgccatgtcctccgtctctcgccattgctcgtcgccacttccagcaccgaggtcagggatggcggccgagcatgcggataggcggacgacacgaatggtgacagcggcggacgagctcgggtacggatctagcggcgacggtggccgagcttgcggatggcatgaatggggatggcggtggacgagctcgggtacggcgctagcggcaacgagatgcaaggtcggggacgacggccgagttagtggacggtgcaaatgccaaatagcgacggcggtggactagctcggtgctagatgcgacggcggcagtggtggccgagctcggagacggcttcgcgcggacgggcgtcggacggatggatggacagcgctagcggcaaccggacggagtggcgtgaaacgaaggaattcgctccccccaatggcacgttctaaagtacacatggattggatggcaaatcctgatagggctgcgaattgggtggcatgtactgaatgtagctgcataagctccccaaacagacatttataagtgtatagtgcagcttctaaatagtctacactatactgagccacatactgtatgtttgccacccgtcagaaaccgttccttgcgaatgcgcgtatgcacgaattagcatttctgatctcctattgcctttgggagaggaaatgctttggtatcgcatcattgccttccacaagtggtggttcagcttcatccttccaggagcagcagcagcagagccatggctggagctagggagccaatttcctcagccagatttattttgtttatacatgattggtcgatacagatttgattttttttcagtttttggcaatgctacggtatacttttacccagggttggaaattttggactgaaatttcggaaatttctgtcatttcagtcacctccgatacgatattatttcggctgaaatttttcaattttttaaatttttcatgaattggggtaatatttattcaaattcaactaaattttgcttaaaatttcggaaatttcggaccgaaatttctgaaatttcgggatgtcggtaacccccgatacaaaggcatgttccgatagagtgaaccctgcttttacctctctaaaactcaaattgtgcattggtttcatcaattttgtggtgctgatttggcttggcaagggtgtatagttgttgtttcagagttcagacactgatccaataagaaaaacaacccaagtttgtaaagctgattgctgaataacgatattgtgcattagcagaagattcagtatagtgcaggaccacaatctggtgtagtgcaaactacaaaaagcccgacccggcaaaaaaactacaacaagcctgtctcagttgaagggtcttggttagataattcagtgtaggtatactataattgattgaattataaaaacactgttcagaaacaagaagagtactcctacgcaacttccacggttacttaatggtattgaaatcatgaagtatcagtagaatgtagcttaactaaccagaggcatactgcgatttggccatgactaatatgcatgcgtaacatccttgattgctgccgctcttgtttatctttcttgcaccagtaatgaggaagtatttcagaagcaatctgcgctcaaagcacttcaagctcaccttgtgattaccttcggtgtgttctgacttggggctctgctctttcctactagtagctgcaaattgcgatgagaatcgatagctctcttgcaggcagcgtataatcaaaggttggaaccttctctcataaaggtggcttagaccgtagcagactagcagtgtgtgttttgtgtttgtagtgccaactgcattcccttcatatcatactacattactgccaagatcaagaacaaaaggttgtgctcgtttctctcattctctcactctcaccatcgccatgcctggatttgcccaagaatttcaggccaacatatgagtatattaggcct

SEQ ID NO: 29451 - DNA, 1522 bp, Oryza sativa
cattgtgaaacggaggaagtaactagcaccacggtggtgtgctagtcgacgggattcgaactcaggccgtgtttactttcatgcccaaaattattttcacgtatatggatacacatttgaagtattaaacgtagtctaataacaaaacaaattacataatcagcctgtaaactgcaagaagaaattattaagcctaattaatccatcattagcaaatgtttattatagcaccacattgtcaaatcatggcgtaattaggctcaaaatattcgtctcgcaatttacatgcaaactgtgcaattagtttttttttgtccacatttaatgatctatatatgtgttcaaacatttaatgggatgaaatttttggaagtttgaagggaactacaggcaacctcactcttcttaaaaaattctaatatgagagtcccttcttatgtatttattgttattgttttcttattacagcgagggaacgagggatctggcatccaatcaagggaacacaatggaaaggataggttccctctgttggtgtgggatggatgctccggacctctagccgatgggcaggaactaggggtgaaaacgagccgagccgaggctcgtgaaagcttggtgcaagggaagctcggcttggcttggctcgctacaaacacgaagggatggatcgatctaagtgcaacactgaggaaaggaaagtgtcacatttacatatgatgtctaatatttatgggattgtctatctaacattagtgtaaatataatataattagcatgtaattacaatataactctaatgtaagtggtatgtaagtcggtgcgagagaggggcaaccgcaatccacaagtcacgtgtcactagtggagaaatcgtttttagtcactagtggagaaatcatttttagtcccggtttgtaacccccaatagtcccggttttcaaaccgggactacgaatccgggactaaagatcgatctttagtcccggttggtgttaccaaccgggactaaagatgggagtgggcaatagttttttttcattcacgcgctatttaatctctaatttattttctcccaaattaggtgggatgcgtaccatcccaaatacataaatcaatcatatacactacagattatacatcccaaatcaaaccccaaatcaaagaaacatcccaaatatacaaatcatacacaaatcatgtacatctcatatccatacaatgagattccaaaaaaaaaattatacatctcaatccatacaatgaaccacagattcttcatctcaatctacacatggatcacaaattctttaaaaaaaagaaaaaaaatgaagcaaagccgccggccggctgagccggctgccgcctcccctcctccccagccgccgccgcactgccctccgccggccgggccacccaccccctcctgctgcgcacactggatcgagttgggaaggggagttgggaagggataagaagaaaaagagataatgaggaagggaagagataagattagagatgg

SEQ ID NO: 29452 - DNA, 8753 bp, Oryza sativa
attttgttagttgaaagaacataaactcgataagcccgagaatgagtagcatagccaaggaaaatgccatccaatgatcgagattcaaacttgtccaaatttccagatttaagaacaaagcatttgcaaccgaagaccctgagatgtgaaacttttggtcgacgaccaaatctgagctcatatggcgtcttgtgcaagatagttctcaaaaacacacgattggagataaaacaagcagcagaaatagcttcagtccagaactttcttggagtcgtaaactcatcaagcatagttcgtgccatctccacaagggtgcggttcttcctctcaaccaccccattctgttgtggaacatatggcgaagaaaactgttgttcgactccagaagaatcacagaaaaattcaaatgcagaatttttgaattcagagccattatcactgcgaatggctcgaagagcaccaggaaactccaaagccaaactacgagcaagagactggaagaagccaaatgtttcctcctttgattcaagaaaatagacccaagagtagcgagagaaatcatccacaacaaccaagacataccacttccccccaactgactggacccgagcaggaccaaccgtatccatgtgaagcagttgtcccggtccatctgtcataaccattgtaacaggcttgtgggaggaagatgtcattttcccatgacgacatggtgcacacacaagatctttcggagctttcaacttaggcaaaccccgaatcaaatccataccactaatgcgagacaagtggtcaaagccaatatgaccaagacgtcgatgccagaaaaacaaatccctattctctgaggcaatgagacaacgagaaggaccgggagcagaagagtcgaagttagcaaagaaaactcgaccaactcgagaaatgtcaaaaacaggagattcagaagcatcaagaactcgagacctgtcctttttgaaacgaacttccagattttcatcacagagttgtgaaacagagagcaaattgtacttaagcttacttactagtgccacatctttcagcatgaatttgtcattgaccttgattgttcctttagccatcacgcgtccactgctcgcatccccaaaagtgatggtctcatcaccggatgcacgagtgagagaagtaaaccacttggcttcaccggtcatgtggcgtgagcaaccggagtccacaagccaagaattacttctccccactccaaaatcctacaagaaagacacagcagatctcgatgattcagtactggggttagtgagaaatgacttaggaatccagtactgaaccatgcgaggagtacaagcatctttagtgttatgagcagaattatatgcaagatgaccatgtctgttttgccccaaccttgctaggtcacgtcgagggtgcacatctcggcgaggaaagcgagatacaccacttgaacgacaatgacacgcacactcgaacctctcagggactctagtagctcttctagtcctaagacgttcttgtcgctcttttctagcctttctaaagcagaaacctaccaaatgaccagctttcccacaataggtgcactcatacttggttttctctacaggcatggtttgtttctggttttgcttgtgctcaacttgttttggatttttgggtctaggtaactctacaggcttagacttgctagtcataggtaccatctttggttctgaggttttgggtgtactagaactaatgtttccaatgaaacctgcagacttgaaggttataggtttttgagctagttctatcatcccatctgtgacacctaaaatctcatgggtacctatcctcaaagactcagcaaaatcatagcctataccttgattgtttatggacactttggattggtctaggatcatgttcaactttttctttccttgagcaaacctctctaaagattgttgtaggtatgagttctctttcttagcagactcaagatcaactttcagagaaatgcatgatgaacaagaatcaatagatttgatagaatcaatgacagttttagcatcttttagttcagtttccaggatagcacaattagcacatgaagaatgaataggttccttagtagcaaaagattctaacaaatcattcttggtcctaagcatggcaacttgttgtcttaattcattattgtcactagtgagaatgggacaattttcacacctaccaatcctatcatgaacaaatttttcttttagttctttcaattccatctcaagcaaacccatatcaactttcatttcatagcaagtagagcaagcagcactagcactagaagaattcccagctcctaaagcacatgatttcaacttatccttgaggagattaattttagaaagatatgaagcacaagtagaacaggtatcctcctcaggaatcatggatctaagcctagcaatttctagcgccattccatcattttcagattttagtttctcaattttatacttagaagacctatacttgtcactaatttcaatcatcaagtgtgccattctttctttgcttagttcatcatcaacagagtcattatctgagcaaaaatcatcacaaagagaaccatccaaggaagggatatcatcaagacatacctcaggatgctccgatgagtcatccttatcctcaagtgccatgagacacaggttgatgaagtcctcgttgttggcgagacagcacatcccggagaagtccttgtcccccttttcttgatcatcgtcgtcggagtcgatgtcgctaagctgcacctcctcaagagccgccaagaccttgtgaatcgccttcttcatcaaatccttcttcccctttcgcccttgtccctcgggcttcttggtcgtcttgtcactcttcttctttaacttgggacaattcactcttatgtggttaggctctccacactcaaaacacacaaatggttcattggtttttcctctctttttatctctcacatttttgtaagctcttgagaattttctagcaaaaagagcaagatcatcttcagggatcttctctaattgctcctcagtgactgagtgtaaagcggcaagagagaagccaccacacacaaaagctgagtcattagaagaagtactaccagagggatcagctaccaaagccatggagtgtttgaggcctttccgatggaaaacatccatctcatgggtttttagctttgagtaaagcttgtccatggtaaggtcactcagaggagcactctctgtgatggaagtaactttcatttcccaaacaccataatcaagacaattcaaaagatgacgagcattatcattatcagaaaactcttttccaacagatcttaactttgaaacaatttctccaaaacgcttgaaataagaatcaatggactctcctgggtgcatctcaaatctttgatattctttatgaaattgattctgacgaaccaattgaatatcattgtttccctcatggaaattgcacaaagcagtccacatgtcatgagcagacttgtggtgttgaacacgattaaattcaccagaagaaattccaccaatgattgcatttcttgcacgataattaaaatcaacctgagccatatttgcaggcgtgatgtcagcatcatcgggcacagtgtaaggtgatttaaccttattccacacattatgcccttgcgactggaggtaggcctccattcgtgccttccaaatgacaaaattgtgtccatcgaaaacaaatggtttcgcagagtatttttcttccatagctgcgttcgttgccacggttaggttacaacgaacttaaccgggctctgataccaattgaaagaccaagaacagctatagaggggggtgaatatagcaattcaaatcttgcccccgaaaatactcatcaagccggatttctcaaaatccttactagaaccgcagctattagagaagccggatctagaaaagaagagagaaaaagaagagagaaggaattcccgaaactagaggaggaagagaaaatgaattcccgaaactagaagagaggtgaggaagagagagcaaaactcatcatcgcaaagttcaaattgcaagcggaatttaaattgcggaatttaaatggacaaggcaaaaatgaaatccttcaaatcatttcatttataggtgatgcaaaataaccgctcaactaggagcaaacatacaccttcagaggaacattaacacaaacttaaaatctctcggacaaacacactcaaactaatcctaatacaaaagcctctcgggcaaacacactccaaactcaaactgaaactctctcaccgagcatctcaaaaggattgccaaagaagcaacctccacccttgcatccatctctctatttataggctaagacccctaagacattgtctcaaatacccctagggcgaaaccctaactcagaatggatctggtccacccattcttccttagaaccgaaggaagcctcctggatgcttgccacgtcgttgatccaaactctccacgccgcactgatccgcgtgctccctctccaaaccagtgacgagccgccacgtcacgcctcagcacgcgagagcgcgcgctccaccgcgtggatcccacgctcacctgcgcgcatccagtccaaagcctccacgcgtcccgccgagctgctcccgcgcatgctcgcgaaatcgcgcgtgggtcccagtacaactcccgcctccgagccacttgaaacagcgtggaccccacgcccgcacgcgccgaattccttgccgccgcgtgtccactgcgcgcgcgtgcctcgcgcgatctcccgcgcttgcccgcgcatggtgccaatgccgtgggccgtcgtcttgtcttgggcctgctcggcctggcctccctgcctgctgatccatccatcatcttgagccacgaggaagggctggattggcttggcctccctgccaaccaatcacagctcacatgcaccaatgggctagcaagctcctcatgcacacatgcatgtcttgcccccgtgcatggcattcggccatgtgcacgcatgcacaaccgaagcaccactgtccatgcttgcatatgcacatgccagtgcatgtatacaagctcctcttccattctccattctgttcgcgaacccggcacttgcacttgaccttgcgaagtccgttgcgaagacctccttacacggtgttcgtccaccgtgtgcaaccttatgtccaatcttgtcatccggcatccttgatcgctttggacctcaactcctccctgagtctagtcccgatccgccgttgaccaagatcgaccccgatcacctgcacacacatgaaccaaacaaccgttgtcttggcacagatgtcgcaatctgaccaatgttagtccacgcacacacttcttgcacttccagtacttgtcaatttcccatcacaaaagaactataaccacacatggtttcacaatctcccccttgatgggaacattgacaatcccaagcaaaaattttgaaaatttgatttttgattcacaaagcaaaccattttgcaaacgtcgaactttggtcattttgaaatcgtgaaaaatcaagaccaagtgaagtgacaagaagaaaagggatgcgaatgcaaatgcaagaatgctccccctatgtgccaaactcccccttttaccaagatctaaagcaagttttaataagtgcaaatttctctccccctttgtcaatgatgccatcaagatcaaaagagacaaaaatgcaagataaaaatgagatgaaacttacaaattttagtgttttgagagctttgagagttatctaaaggcatcaaaaggtagacatggatcacacagatacaagcatgtgctcaagcctagctaagcatgtgcataagaagtatgaaacatgtcatggatatcaagttagtatcgccagcaagcaaaaagttttcaagtgaattagtgatttagtgtgcaaagctatttctagaagaagcttaaaaggaagcaaaccagctcataatcatgcaagatttacataatcaaagcaatgaacccatgctaatgtgctaatgcccagttcataaagagtatcaacatgataacaaagcatagaacatgagcttttaatcttttctcatgacttttatatttaagatttttttttaatttctttaaagacaatagcacaatcacgacggtccacctgatcttatcagtcagcaagtgatggttgtgccaaacactgccgtctgacctcaatcaagttttccagctagagttcccattacaggctgtctcagtgctatcttcggcactactcatgcgtaaacgcactcagtagcccggacaaaaacagagataaagcttgtaaagcatgattgatacaaagtatggacgcataagcatgagcattcataagcatgtactgacagttattgcaaaaagaatgtaaacatggcatgagtatgagagggatacttcaatttaaacaaacttctagagcaagcattgcacattgattaagttcaaatgaatagtcaatttaagcaggtttcaacaagcttgaacagcataacatgatcacacaagctacttaagcaaatgaaagctagacaagagatcaaactagcataagagtgatacatgcatagcatagtgatgaccaagagataacaagcaaagctcaattgaagagtgtataaaacaatgcataaagtaaacatgatgcaatatgttacaaatgcatgcaaaagaaaaacaactccccctcaaatcaagccataggggtggatcacccctaactcactccgcaagaactcaaaacgagagcgatcaagtggttttgtaaaaatgtctgccaattgtttttcagattcaacaaattctagcacaatggcacccttctcaacattgtctcggagaaagtggtaccgtatctcaatgtgcttggtcctggagtgttgaactggattttttgcaatattgattgcacttgtattatcacaaagcagaggaacaccagagaaaaacagaccataatctttcagagttgaaatcatccaaagaacttgactacatgcactagcagcagctacgtactcagcctcagctgttgattaagcaacagaagactgcttacgagaggaccaagagaccaaagaagtgccaagaaaatgacaagtgccagaagtacttttgcgatcaatcttacacccagcaaaatcagcatctgaaaaagctcgaactgaaagggcagaagagcaggagtaccaaataccgtactcaagtgtagacttgatgtagcgaaagatgcgcttgactgcttggcgatgtgatgttcttggagaagcctggaacctcgcgcacaggcacacggagaagtggatgtccggccttgacgcagtcaagtagaggagggagccaatcatacttctgtactcgcgctggtcaacttcttcaccgtcctcatcaggaccaagcgatgaagtagttgccatgggagtggcgattggcttgcagtcggccatgtcgaacttcttcaggagctctttggagtacttggtctgatgtacaaagattccttccttggtttgcttaatttgaagtccaaggaagaaagtcagctctcccatcatgctcatttcgaattccctgctcatcacatcagaaaactgggcaacaagtgcatgagaggagccaccaaatatgatgtcatcaacatatatctggacaagaagaaaatcaatgccactatgaagagtaaagagagttttatcaactgcccccatttcaaaaccattttgaagcaaaaaggttttcaatctttcataccaggctctgggagcttgttttaaaccataaagagctttatcaagtttgaacacatgatttggaaattttggattttcaaaaccaggaggttgtttgacatagacctcttcctcaataactccattcagaaaagcacttttcacatccatttgaaaaagcttgaaaccttttgaagcagcaaaagccaaaagaattcgaatagcttctaatctagcaactggtgcaaaggtttcttcaaaatccaagccctcaacttgggtgaaaccctgtgcaaccagtctggctttgtttcgaacaattgaaccatcttcacctagtttgtttttgaaaacccattttgttccaatcacattaaaacccaagggtggttctaccaaagaccaaactttgtttctttcaaaattttctaactcttcatgcatggcattaacccaattctcatcagataaagcatgacaaacatttttgggctcaaaagaggcaacaaacgctgaattgacaagatcataagaccgatttctagttaccctttcacccaggcctctgatcatcgagtcaggcggatgtcggttctggatgtgtcggggagctgtcggtcctgatgtgccaccatcaatctcctcagctgctgaagatgatgtagttggtgcatctcctgaaggtgatgtagtcgaaggagaaccggtttcttgcactggtggtgtactgtctagaggtggaggaatggaatcatcgtcatcatcatctgaatcctcatccacaaagatgctttcatctagaacacctgaaatttctggtctagctcctgggctagcctcatcaaaagtgacttcacaagtctccacaattttgttagttgaaagaacataaactcgataagcccgagaatgagtagcatagcca

SEQ ID NO: 29453 - DNA, 8284 bp, Oryza sativa
  unsure (1)..(8284): unsure at all n locations
caatcacagctcacatgcaccaatgggctagcaagctcttcatgaacacatgcatgtcttgcccctgtgcatggcatccggccatgtgcacgcatgcacaacataagcaccactgtccatgcttgcatatgcacatgccagtgcatgtatacaagctcctcttccattctccattctgttcgcgaacccggcacttgcacttgaccttgcgaagtccgttgcgaagacctcctcacacggtgttcgtccaccgtgtgcaaccttatgtccaatcttgtcacccggcatccttgatcgctttggacctcaactcctccctgagtctagtcccgatccgccgttgaccaagatcgaccccgatcacctgcacacacatgaaccaaacaaccgttgtcttggcacagatgtcgcaatctgaccaatgttagtccacgcacacacttcttacacttccagtacttgtcaatttcccatcacaaaagaactataaccacacatggtttcacacgaagctacggtggctcctagcgttcaagggagaggatacaacactaagcatacactaccccgtctcagggctatcaagctcgtgcccaagtgtcgcccggtgccggagagcagcacgagcctctccaaccttgccctccaggaaccagccaagcttcccagacttgcaagtgcgacgaccacaagcaccatcaaacgcgatgcgctctattgcgttgaatactatggaggagcacaatggcggaacacgggaacagtacggtgagctcctacttcctcgaagtcgtcgctctgcccgattgtcaccttgccaacttcatctcggccatcgtttttccgttcatggctgcatcgattggctactctctcacgctaccgtcgggcccagtcttttggagcgcgtgtgtagctcagcgactaaatagtcatcggcttatgttctttctcttcatttatcccctccagctcactattcgagcctacatggaatcactatcaccagcgttcacctgaagcttgcttggtcatctctcccagacccatctattttctggtgcaggggtgggcggtggcacgctccggtgtcacccgttgccgctgggagtggatacctatcaatttttgatactgtgccatttccctccaccaatgttgcttcagcttcatgctgccggaagtagcaaagccattgctggggctgatatttcgggatttggtccctatgcagtttttagcgtgactacaactcaaatagtcacactatggttgttgatattacattcaaggattcttggagcactgttcaacagaaaaaaaaaacacggtatagctgatacaacaatggtattgtagctctcgatatatagacccttcatctgaaaaataaattgatatgatatgatgccgttactaacttgcggttctagttaggactgcatgttatctcaatccaattgtgaggtgtggcgtttaccagatccagcaaaggtaacgcctttccagtttcctcagcttgtttattgattgctgttcacttgatccggtcgataaagtgtctgctttacgcaatgccatgctacttttttttttccacgctgttagtcaatcaggcgttttttggtggtctacgcggtagtgttcgttgtctgttgtctgtagattctagtaaatccaaacagaaaagacaatcccctgcaatgcaaactaaaccaaagcttgaactgaacggtgtggttagattgttcgtcggcaagctagtgagcgcagctctacaccaatcgaatcgtgaaaatgattattcagaaacaaagattcatattgccgaactctagtaccgagtaccgacaaccagcatcaatatcacctctcctcctccttccataacgggtggtgttggtgtgccctgcacgtgaagagccgaacaagcttacacgcgagagaaccgctaatccgtggaaagggaagccaagaaaaacctaagaaaagaacgctcacatgcgcgccgggacggggcctacccccggcgggcggcgtgcaccgccatgtgaccgcgccatcggctggcccgcgtgtagcgtgctcccccccgcaagcaaaaaagccgcgcggcatccgattctgcacgttgctgtgctgcgatcgctcgtccgttgatggaatcagctaccatgaacgcacagatcacacagacgctaaacgccaatggcgcgcgggccacaccctggacagagcacggcgcgcagacttttgtgtggatttggaccatatgcagacacgtacatgcccagtctacatgaacagagggacccgttcttcgctacccgtagatggtttacaggccggcgtacgtgtctagctgcttatcttttctacggccattttgccgaatttgcaatggcagctgcttggctgttcgagaggtataattcctgaaagcggaaaagtactaatcctatttccactaccaaagtgcacggctaattgaacatcccatgtgacgcgagtttgggcgtttgacaagctaagctatagctagcaaaggcgcgtgcttccgttccgatcaaaagctgtcctggagcacaaacacgccatgatgggttttgccgtttcctgtgcaaccaaagctcccccaatgcacctcgtcggtggtccaaaaacactgatatgccgcggcagtgcgggcaccgtccacggccaaacacactaatccaacgccaaactccactatcaccggcgcgaggagaggcggagcgcatcggtgaaacagagcccacgaatgcgggaaacacacaccgggaaaaaaaagaaaggtggaggcgagacgcgcgcgagaccgacacacattctccgccgcgacgaccggcgcttcagcacgtgaacgcgcgctgcggttgctgtcaccttgagaaattgacaaaattttccacttcgattaatcaccaccgtagtagtagcagactagcagtacaaaaaaaaattattacagattgcgaccccgtaggtagtagaaacagagtgacactggctatgacacgtgtatactggtagtactcactattactagtaactgcacgcagcggccaaccactggatgcgtcgtcaccgttgcacaacgctggccgtagctgtaataacacggtaacagtaggcaggctgcagttaatgaaacgagacgcgagcgatggatgggatcgagcacggtcccggcccctctccgtcctgccggtttgtggcggaggaaccaattaacgtactcgtggccgtagcgatggacgatggaatctcgccgtactactccaaagaaaggtaaaaaagaaaaatgtaatcacctcatcaatcctcactagtggctaattactcactgtaatagtacggtagaattcgagttactgcgtgcgtgcgtgcgtgctagttgcggttgatgaaggcgacgagcgtggccatctcggcttgcgcctgcggcgtgctgagcttggtgaggaagtagacgtggccctcgccgggggtctcgtagagctcggcctgctcccggccagccgctgcttctgtagtcgtggcgtagtaggcgcgctgccatgggctcaagcgggcctgctccgacacggtgaccagcacgccggagcaaccgaagcgctgccacgacgacgccgggagcgcgagcgggttcgcgtacgggtggtcgatcgggtacttgccggcgcagatgaagctccaggtgcgcgccgccgactggaggtaggccgggtccatggcgtcggcgcccatcggactccgaccctggaagtacgggtcgagcagcgccacgcccttgatcctggccccgccgtcgaggccctcctcgccggcgcgcaatgcgaggttgtgcgcgatgtttccgccggcgctgtcaccggcgaggaagaggcgggacaggtcgccgtactgggagacccactggtccgtcccgggcgccgcgttcgccagcacccacttgagcgccgcccacgagtcgtcgtacgctgccgggagcgggtgctccggcgcgaggcggtagttcaccgacacggccaggacgcccgccttggccgcgagcgtgttgaggtaggcgtggtagatgggcgtgaacgccgactccgacgacgaacgcgccgccgtggaagtaaagcagaaccgggaccttggcggtggcgcggaagctggggaggtagagccgcgcgcggacatcgttggccggatcaatggcgacgtccctggacgacacgccggtgagcacgtncgtcgacgccgncaccacgtcggtgcccatgagccgcttcaccctgccgctcttgtactcgatcaagaacggggagaagtcgaacttgaccgggtccccacccaacggcggcacgcgcattccccgcctcgccgccggcgccccgctgccgccacgcgagcagaggaggaagaggaggatggggagcaagatccgcgaggccatcggggggaggagacacgcactgctgcgctgcagctggagagtggcagtggcagagtgtggagtgtgagagagtgaactggctcggctctccgctgcctgcgagtgtctcggagacgacgctgccacgggatgggtcgggttttatgtggagcggggcagccgacaaggctgggcgcaccgcaccattttccgggcgcggatcgtggtgggctttcgaccgctttaacggcgcggcccgggccttctctttcccgcgcgcgcgccaccgtgcatgcaccgcatgtgcctgcgtgcccgcgcggttcacacttcacactcgatcgcttcgcccccaaaaaagttcagagaccatctctgaaatggcgcgttttctgcacttaatttacacccgaaattcctctctttttgacgaactgtacagcagcgctttatttcatggttagtactactgttaatgctaaactatgcctggttgtcagaacctctgctgatcgatgagtttaaaagattcaggtttttctgaaactgtcagttcacacgtcttttactaatcgtttcggcgctgcaatgctacggtacaaacctacaacgacaagccgaccctgagccgctcgttgcttgaggcccatcgaccattcaatgcccttcgtacaattaggcaattagcacgctcgctttgtgttggttgtgtgcccgtcttcctactccacacaccggcgcttcgcctagatggtctcgcatggtaggactaggagagtatagggtgcccccatatcggcctgtctcagttgagtggggcggcacgtaccaattactgctcaattagtggcctgaattgaaagattcagcaccgtcacccaagagcacgtccctaactttgtcgcaaaagcaaggaactcgcagtgatgcccggagcttgcacaacctgtactcgtgaaagtttagggctcctttgaatcacacgaatgaaaaaacagagaaataggaaaaatataggattctaacaggaatgcaagtgtaaaacagaggattgcaaaacacaggaaaaacataggaatgactgtttgattgggccgcagaaaaaacacagaaattcgaggagagataaagattcaaagaattctttccatgaggttctacctcatgttaaactttctccaaaacttgcatgggaaaagacaattcatagaaattttataggattctatagaatccattccttaattcaaagggctatctctaaaatttctatgaatatcctttgaatcaaattggggggggggggggggttcagtagttgtgtgttctggcagtttcactgctgacaaactgtttgccactactccagctctctcccctttttgatcgtgcggtttatgcagcaatcaccattaccgatcccaaagatctcggttgatgataggctttcggtgccgaggatgatcatttgcctatttggtgcttcctttgtcatcgggttatactgccggcaggatctattaataaaccttaggtagcgccttctgtgccatcgatgctgtgctgtggcgccaccaaacccaataattccgaactgaaaccaacctgacatgacatgagtaatacagcagcaacatcgtgcagacacgtagtgatgcgatctgctgaaatggaaaaggagctcctatcatatgtacagtgctaccgcgttatgtgatcttgggaacgtactgattccgagcatggccgaatcaataaaccaatctgatgcactggttcattttattggttcgatctgtggtgatcatcatgtgggggcaatgctacaaggtgtgagctttactcctactatttcccggctgtaggttgcgttgctctcggtgtaaaactagctcccatctactaacagtccatcttgtactaaattccgagctgccgagctgtgcccgttcttaaataggatgacaatgatctttgacagcgatttcgagtcatcattctgaagatttggagctgctgaaatgacgagccgaaaaaaccgtttctctgctctttccgaagagaattttcctcacctgtgaatggagcagtcttgtaatggatctgaatgtgcatcagcctcactatcgtatcctgctgtacttcaaggtttggcggaaccgatgtgtcggatcgaccctgcacgggttctatcaccacgaagctgacctctcgacttttctttgcctgaaaagctgaaactgttttgcgatccataacgctaacatgatcactcatggtcccggatcactgcatgtaactatgtaagtatacacatgcatgtgtgcgtgttctaggtcgccggagctcggaaggaatgcgccatgaatgatgttgagcagatcggcgcactctgcatggtttgcctggcgaatgctgagcaaacgtgagcctgcttctgctccgtgccgttgtactcctatgcgatgtccattccgccctacgctgaattttcacagaatcactgtgctcctggtgagctcaggcttgtcagtgaaactgtaccggtcgtagcccaaaggacatgccaaacaatctgcaggagtagtaattatggggtgtttagattcaggtgtaaagttttagtgtattacatcgggtattatatagggtgtcgcatgtgatgttcggacattaataaaagaactaattacaacatatgtcagtaaaccacgagacgaatttattaagcctaataaatccgccattagtacatgtttactgtagcacaatattgtcaaatcatagagcaattaggcttaaaacgttcatctcgcaaaatagtcacaatctgtacaattagttattttttagtctatatttaatacttcatacagatgttcaaacgtttgatgtgatatggtgtaaaattttaggatgaaatcaaaacagaccctcaaccatagtaccatactccctccgtccaaaaaaaaagtgaatctaggactagatatgatatattctaatataacgaatctgaacatacatctatctagattcgttgtactaggatgtgtcatatccggtgctagttggtatttatgggacggtgggattacacagctggtgaattgcactgcacatgactcagatggtgtttggaaaggagggactaaagtttagttcctctcacaaaaattttagtccctaccataaggacttgtacttttgtgcgagggactaaatttagtccctagttcccaaaaaccacctcaagtatgggcgtatggcgtcctgaacagaactgtttattactcccctccatcatcgacagtaacaaactgtactacttctagactctagagttgcatggagtgccacacagcggtgctgaactgctgcctggtcactgccatatcctgcatccaattcgcctgtcagagcatcagtctgttgcgaagctgtactgaacttccgtgcacgctggtttaaaaaaaaaaaaacttccgtgcacgcacaggttcggagcgcacttggcatgtcacatggtggcaactttgcttcgctagcttaagcaccgcattcacgaaccacgatctccatccagatgaatgaatttcgacgaaacggtgccccgttgcactgttctttacagaatgttgatgggggtgtgcgtgtgtgtgtgagagaaaaagagaattgatttccagtctgtttgtacctcgtgaaagttcagttcggagtcctttccagctaatatgttctcgcgaacctctttttttgcgagcaatgcgagcaaatgcatttgttgagcacaggcgtgactcccgtaactgtgatgagcgatgcatgactgtgctc

SEQ ID NO: 29454 - DNA, 1129 bp, Oryza sativa
cactcaggacactgtaggacgatggcagtagattgcgtttgaaacacgcagacttgggcgaaaaatgtttccgtgaatactactggtactgggaggctgggagcatcgctaactgtaccaaacgtgcgcaccaaccaacctaaaaccgatcggacgacacgcgcgcaccacacagtaccaccacgcccatgtgcggcgttcaatgcggtccggaaggcggaggccgacgaagaccgagacatcagcggcggagcggcgtcgtcttgtacgtggctgcatctgcgtgtacgtggccgcgcgcacgcacgagtccccagcgcgtgattgttggcgacctccgctcccggttcccggccgcgcgaagcgaacgcacgagccaaagtagtaggagtaaactggagtagtagtagcagatgccgcaaaacacggtggaaaccgtggaatcacgcggcaatcatcgcgaaaactgtggcagtgaccacaccccgcaatgataacgtaacgccgaccaccgctccgcgaggttaacgccggaaaatcacgcgcatcaatggatgcgcgactcgcctcttttcccctgcaaccggggctgctccggcggttgggaacggcgagtgattcgatcgagctcctttccggcgatgattagatcggctttatttcctgcatggttgttgcatggccaggaggagcccacgatgtacagggcaccaactctgggcccacaccattttgtgtcccgtgccctccgggaagagagagaggaccaaaggaggagaggcatccacaccaccgagctcgtcggaaagagagaaagaggactggaccggcgccggcgatggcaatgcagccacctcggaggaagactgggccggcaccgacgatgacgacgcagccactgcggataaggatcggaaggggtgaagaagaggggagggggagaggggagctcgaggtcgatccgcgccgtcgcttgggccacaccgctgccaccgtcgttgggggtggaggagagggcgccgccgctactccgctcgacagccgccgtagcgaggaggaggagaggagtggtggtcgccgcggagcttgtccgcgcgttggccaggaggggcgcccgtcaaaggaggag

SEQ ID NO: 29455 - DNA, 755 bp, Oryza sativa
gccaccaccgcctgcatggtcgtcactcacctccgcctcgcgctctctcgctcgctcgctgtctctgcggcaacgcctgtgtgtgaagaggaagagaggatttggaggcgagaggagggaagaggaggagaggagagctcgcgggatgctaaataaagcaggcggcggcggaggatatgggggcgcgagagccgtccgatggtgccgcgtggatggcttcgcgaccgtcgctttgggattttgaccggatccgcgtcgatgtcggcctcctgaccaagccttgcccctgcgggttacacgtacagccgtttctgactttcgattagggtgagcgggtgaggagtggatgcagcgccacagatgataatgataaaatactagtattagtttagttaatattgatattctctccgattcatttcataattgacagccgtaactatttactttttaagcatttatcaaatcaatggtattcttttaatatttacaaatacaagaaaataataacattattaaagtgtgatatgctttaaatattttagctttcctctaacaattcaaagcaactaattgtcaaagcttaaataggaaagttgaaattgacatatattaagaaacggaatgaatagcatggagaatatataaaactcaaatgaaaactcttgaaaatataaacgatggtaaaaattataaaaaattaatatatgtataagctaataaaaaatatttttttaataaattaggtcttgttt

SEQ ID NO: 29456 - DNA, 276 bp, Oryza sativa
tgtgtacaaggtgcagtaaaacaccctcgaattcactcgctgattgctgctactcactggcctctcttcatgaggccagcaggtacctgaatctgaattcgtacggcaggacctgcacgcggcgcgactcggcggcgacaccccttttgccgtcctccacgatcctcatcgccttctgccgcagctcgctcggcagctggaggcacacccagtccatgagggagtccacgtccttggcgaagtcgaggaggtaccagtgcagcagcttcgggatcg

SEQ ID NO: 29457 - DNA, 9626 bp, Oryza sativa
caggcatgcaagctttgggagcaaagttcataccaaaggcttcttttcgattgtgtcaatgttgctcttgttgagatcggcgagaacaccttgctaagtacattcccatggagcaaagcacactcaagaacatggatggacgcctcctctcctgcattggggatagaagtctggagcatcctgaaagattggatttacggggcacggatgttcgtggtgagcaggagagataatgctgggatcatgatagagagagttgtgaagcaggaggttgaaggaacatgctgggtgaaaacgatgaggacgcagttggttgacatcaccgagcaaattgagggtggagtctgggaggagctcgtgggagaagctgtgctggattttgttcctgcctgtcaacgatgatatatgtctttgcaagttacaactggtgaatttctgccctttttttgtacactgtttatgtcattttacgccaggaacaaatgtgtactcgcttcgtcccaaaataaatcaacttctgtaattcaaactttgtcctaaaataaatcaacttctatcttcttatctactctcggttcgcaaattgagaaattttatttattaataccccttaccacctacccaccaatactaatttgctatcaatagggggtattttagtcttttatcctctcctttaattttgcactggattgctatgagttgcttctttgtaagacagagggagtatgtatttctagctgattggaagcttgtagtagcattttaaacttttgacaaattttgctatagtacaatcaaagttttttctgcataatttgttagtggacatcgaaaaacgtgacatagctgaagaatctaataatctaaagttggctcttttgctagctttcgattggtccacgtggcgcctcttactttgaaggaaaatcataaatttatactacagagaaacacctaacaatcatatatgaggaaaaatctagagaaaaatattacataatcatatgtgaggaaaaatctaaagaaaaatattacatatggattccagaggcttccaaaactatcttccctttccaatcacacaaacttctactcattttccttctataaatataccacacgtccacgcgtactagtattactcctaaaactcttgaatatatagtaaattcaaaattattaagtaaacaaaaatctaaaacaacaaatttacattcattttccttctttaaatatactacacttactcggtactactcctataactctataatatattgtaaatccgaaatcattattaaaaaaattacaaaacaaagaaagaagacaacattgctttcgtatatcacggaatatgatcgttaataactcatcagccaaaaaagccaaaaaaatcattaatacatcgttagccaaaaaatgtttttttacacatgatatattaaaaaaaatctaaatataccaatgattaatctttcaaatattaaaattcacaaccatgaatatgaattctgagtcagtataatattttaagtatataatatgtgcgatttggttgcctaggacatgaagaaatgagttaaatagtaaccatgagaagtgtgtcgagttaggttgtaataggcttcgttggggtaagtgatccttaatggattcgtttggtatggaagtttgatataaccagtggtgtctgggttgggtttaaactcatattctgccttgtattacgtagcattactgctaaatacttcacttttcctttataccttagtgaaagctgtcactatctgtcatccatagatagggccagcaatcacctttctaataatagcaatataagggtatttttaaaactttcttcatttatatcactaaatagcatgataactcctataaaacatggccaccttcctaacattgccaacacacagtagttgaaaggcggtaagcattccttttgcaataagtaacactttttatatgttctttgagagcctaagtcaatgtacagttgaaatccccaaattcgctctaaaattcataatgataactcatggtcactttaagtagattttttgatgccaaactaagttttagatgagatttgtgcagtgcgttgctaaactagctaaatataacactgtagctgaactaacccataaatatcgttttcttttcttttatttttcttacatagaggcttaaatctcatctaaaagttcagcagaaaaatctgctcaagtaatcgcaagttgtcaaacaaatataacgttctcacaaacaaagatactgttgtaaatattgattactattaaccatattatatgtaacatcattagaactgtagttcttaaccggttttttatttaagaagttttatgtatgtcgttccttatttttgcttatttagaatataatgtaatacttcaatatgttcaggaattgtgattgaccaagacatatgccatccttcgggttttgatttttatttgtgtagacatacttattaggtatatacattttagaaaatcatactgtaatttaagctagttattccaaaaatctttagttccgtttatcagatagggttttgatttttatttgtgtagccaaacttttcaggtatataaattttatgaaacaataccgcaatttaagctagtcatttaaaacatctttagttctgtttgtcagataggtttgggcagccatgtcatgcgcacgtgcagtaatccaaccaatgcacattcggcccacatattaaacacaagtacggttttagtctttgataaatcgtgtattattactgtagttccgcaaaatgtcaaattaaaattaaaggtaaatgatagttttcatatttacaattttgtgaaatttgctgcgtataattcggtacttctatgatggtataagtattaatgaatatttgtttataatctattgtatataatgtcatttctagtgtaatatcagacctacgcattatacaattatcttcaatgaaaatcatttcactgctgacaggcttcaactgcttacacgcaacctaatgttacatgtaagttaacgtctacctttggttattttatttacttttttgtgctcatcttgattgttttttccatttaactctaatctttttaatatgtagttatgcacgatgcacccgtgctgtttctataggtgagacaactttcggtttatgtttgatgataatatcttttatataggtgtggttaacaaaatatagattgggtaccatttgatagcttactttattgagacacgaattagggtcataattgtgccccttctaaacattatagccactttttgatctatcctctcagtgtactgtatttttgctggacaaacttgtctgtgaacttttctgaaactaatgttttgtgtctttttatttggactattaagggctactgattaggcttgaagtaatatactttttaactttgctatgcagttcccccatatactatcttgctgtagcccgagaacgaagctatttcgggaagtttggcgatggatcaagcatcaagaatgaagtttcttcagagttgcctgagtttctaaacgttccaaagattgctggtcgtgtcctaggcgtgatgttctactgttaaatgcttgtggactgtggtcgataggacctgtctcccagggttgtactcccttctttccatactataagatgtttcgacctcaacatctcttattcagatttactaacattcatccatatgaattgacttgtatataaagcacatacatcgatccacatatctatttaaaactcaaaacactttataatatgaaacggaggaagtaggagtgtggtattgttgtggagatcgatggcttgaatgaacctccagctagctaactcaccatcaccaccgttgcctgaaggctgagcctctagcatcaatatcacaaagacgggagcagagcgtcaccatcatgggaacatttgctgctctccatttatgcgactgttcacggagttaacgcttgggaggatttgggagcacgatgggctttactctgggcctataccaactccaggacatccaattctgatccacctaaaatcaactgggttttacgagtttggaaatgaaaaagtacatgaaaggtccctcaacttatcactgaattataaaatcgtcactcaaccgaaaaaccaaatatataacatatcttagcttacaaaatcaggtcactctgggtccttatacggtattaaccctcgatcttctctcccctcatctcccatcctacttctctccacgcggctgaagatgagcagggggtgcgcgtggtggccaacggcaggcaatgcggccgcctgaggacccctcccctcctcctcgccggccagcctatggtagtgcggaaaagcagccctcctcctacggccacctcgccgccgcccaccaattcgtcatccccaacgccatccgcctcgtctccaccggcgccgccaaatccccatggcggcggtgcaacccaccatcgccggccagggtcccctcccatcttgtgcctggagccccgagcagtaaccgtcgcaacgaactcctctcctctttgcgctctctcctcgccggagcaccaagaagccaagagctcgtcaccttcgctgctcgccgatcggagcaccaataaagcaagaacgcccccctcccccgcgcgcgcgctatctccgtcacttcactgacccaagcgccaagaaaccaagagcaccaagctcctccgcccgcctgctaaccggagcaccaagaaaccaagagccccgcgccgcctctgctgctcgccgaaggcaatgaagcagttccacagcaggcatcacatctggctgtggagccgcgtccatgacacatacctctgcgcagacgacgacgggagcagcgtttccatgtagttgggctgtgcgtttgtgcacgtgacgtgggcggtgcataatggcggatccatagggtggtccggacggcaatcggtcctactattaagaaaaaaggagaatagcgatcccgcgcccgcacgcgcgtggatcaaaaggaaggaaagaaactgaagcgtcgcggtcgcgcgacttgcgccgggcccagacatgcctttctcctcctcgccctgacgccctagcgacacgtcgagccgccaacgtgattagaatcacgcgatcatatcagactagcgtcgtgccgccgccggcccatgcgctgacgtcatgacgcgccatgccgcctggcccgcccaccccagtccgctcactgccttggcagctgcagagccgcagtgctgtagtgtgtgcccgccgcaatgagctgttgtcgagccgaggaaaactagaaaggagccacggactcacagagacttgcctcctaacctccttgctgcagtgtgccgcgcgcccgcccgcgtagacccataagggcacccacaatggttatctataggctctctacaagagatccatgtcagcatattttcttacttggaaagtattaaatgaagagagagagcaaagctatctactaacatagagatagtctatagagaaaaacgagtcaatgcataagagagctatagataccaatgtagacatactattaaggtggtttactattaatcgagtctattgctgatatgtacatgttttatagagagcaccttactttaccattgcgggtgctctaataaacaaaaagtagtacttaattttctttaaactttcatagtcttataagcttcgttaaatgaaaattttaattaattaataattttggatgttttaagatgctttaatatatcattgtaaacttttggtgatttagtctattctgtgtattgtactccatgtattagtatcattagatttattgtgtttagaaaaaaaaattaggtcggaccacccatatcctaaatccgttaccggtggtgcacatactccactagaacggcttccccatcctcatgctccacagcgccgcaaatggatgatacctcgtggccacaaacaacaccaccatcgttcatctttgtcgactggctcgctatgctatcaggtgaggatacacacactactctcatagaagcacaccatgcatgggctcgaatgagtagagtagcgtccaattaatgtgtcgacgccggcaacccgcggcacgttgaccggcacggcgccgtacgtacccacgatgaggttgaggtgatctcgtctcccgcgtcatcgctaccgccacggcttcgcccgtcaccaccgccgcctcgcaggccgccggaccttctcctctcccacctcgtcctgccgggtggcctgcccagagaggagaatagtgagagagagggagaggagggggagagatgatgatgtgtcatcctgatatgtggggttcatgtagagtctcacgctaactcagctgccatgttggataaaaccgcggttaaaaccgtgcaaggaccaaaagtgatcaggttttataaatcgagggatgatatatatctagttttatggttggacgatgattttataatccgatgataagttgagggaccttctatgtacgttttccatttggaaataaaacagcatcctagtatcctacacgtctgtaggttggtaatatctcatcgcgaaaaaaaaaggttgctgatatcggatacggaatacccaaaggatctcgtatacacacgcaaaacatgaatatagaacgaggggttcgcgctagtggcatggattcagttgatcggaatttcatcccaagtccatccacgtcgtcaacggaggctcaatactctgtgaggttgttatatggaagacggcgtggagttagatcgggatttggcggcgacgagagaggaagcagagcgcgagatactcaacacctggatatgggacaaggagatcgacttattgcaaagggagatcgaggagcaagacgaactaagagtttaatagtatcgcccgttgatgggctgaaaatttatacacgtaagtaatagatggtaccaatagatgatacgtataataactagctgctaagttacctacccacacatccctaagcagttgatttttatttttttaatcagacttgtttccttctacccaatctttgatggagcaatggttaagtcattggacaaaagctaggactgagggctggttctcaggatttgcatcgtttcctgtgctggagctcggcgattgcattagcgcccgctgccttctctctccggttttctctctcttccacctatgatttctatgacgtggatgcttgtgtcgctggcttatcgtactctattatacctgctctaagtcgcctttgacgcgagcaagagagagaagacgacctatacgtgtggaggatgatcgaggagcgacacggagaaccctgtcatctcgaagatcatgaattggagaaaatatatgggccgcccgcatacgaaactgataatgactctgatgagggtggagtgtctttttacagcaatggaaggaacattttcatgaaatacggcgatgggtttaggtatgaagacgggaacccttattatgcagctgatagggaggagacatgggagaagcaaattctcagacaaatgaagtttcccatccccgatctttcagaatcttgggaggggtctcttgtggttgaagggccattcaacttagatctaaacctaacatttacggatcatttgagtaagtccactagtccaattcgtgtactaacaatccaaatgccatctgttatagaaatagtttttatcagtacagactcctttatctaatcacatttagatcacaaacaataattcaagatgtactgatttgactttttttttttgattttctacttctagtgcctgcactccccaagtgggaaaggcgatggttagatagggacgggaaggaaccatgacgtcgggctatccaagtacttggtctgaatctgtcttctcctagtaatgttccattggagatctatggtatatttgcattcagagatacacgcaatagtcagatgcgcaactatgtctttgactactcaagagaaaacccatgtaaacttaagccggtaagtacttgacgatgccataccggtttctctggtacttcctgaacaattaatatatactacatattgcaggtctaatctttttcaaaaatatgttaattacaatccagggtgctcattgcctccaatctctgatgacccctcctcgaggcatttatgcagttgggattgtgctaattgagtatcgcctaattattaagggtcaaaaggaggaagaagatcaagtgttaatagatggatactctatgtacgctccatctttctatgcagattttcaaaagctcatatggcacatcaacactggtcatttcggcaccatttatctgacaatttttgctatcccgaaagctgtcctggttgatttggagtttgaggtgtgtcaaattgaagataaccacgagcatgattcactcgcaatagttgcaacctactttaacattaatacttcttttattatcttcaacggtaagctgggtgttggcaagctacctccgctcacattgagcgcgagacatgataaacatttctccataaaagtttataaatactacaaccattcgggttgccatcccgatggtgttgtcaggaactgtagattcggtacagaatattattttgaggattttctatgtgaaagcttgtcttttacacctcaaaaatatggaaagagttcaaaaatattgtcccgtaatctggacggcattcagatggctatgaagtcgacatggtttattatgtgtgaaccatgtctataaagatcaaggccaaagttcatgtaaagtggtatgctgtcatatatattctctattctctcatatataattctgtattttataccacagtttttagattgaatatataaataattgatacgagtaccagctggatatctttgtactctgtatttgatgtcacagttagcttttctttttctttcctttttcttttcaattcattcgtgatggttctatgcgacccgtcgcgtctcggcctggcttgcttgtttttcaacgaagcagaggcactgcagagcatcgcaacacgagggagcagaggcgctgtgaaatccaagtgctcgctcaacgcgcttgttcgcgtgaaattctcgaggggatcggtctcatctcagtcgtcatcgacgacggatcagcggcccaaatcacgtgtaggcgtaaacggacctgactgaaaccgcagggcagttgaacagggcagggctaatgggcgatcgatcgcatccccacgccccattacacacctctccttcctttctcctcctcttcttctcttcctactacgctataaatttaaaaaaataaaaaaaaagttgaaaaaatttatgtatagaaatactatatatataaaaaatatttgaatttaaatttaaatttgaatcgggtatgtaaacttttggtttataaactttgggtctataaactttaggtgtataaactttagatgtatagacatactatgtatagaaaatatttaaattcaaatttaaatttgaattag

SEQ ID NO: 29458 - DNA, 10840 bp, Oryza sativa
tgtataaactttagatgcataaaaatactatatatagaaaatatttgaattcaaattcaaatttgaatcagatataattcaaattcaaatttgaaacgggtatgtaaacttttgacttataaactttgggtctataaactttaggtgtataaactttagatgtatagaaatactatatataaaaaaaatttgaattcaaattcaaatttgaatcggatatataaacttttgacttataaacttttggtctctaaactttagatgtgtaaacttaaggtgtataaactttaggtgtataaatttactaaaatagaaaagtaatgtggtgccaaaaaagaaaaccaggtagagggaggcggagacccgatccgatcgcccctggcagcccctagcgatcaatcgcccaataggagtttcgagttgaacacacacctggccctatctgggccggttctcctgcactactaagggcccgtttagttccttaaattttttttcccaaaaacatcacatcgaatcttttgacacatgcatgaagcattaaatatagataaaaagaaaaactaattgcacagttatggaggaaatcgtgagacgaatcttttatgcctaattagtccgtgattagccataagtgctacagtacccacatgtgctaatgacggcttaattactctcaagagattcgtctcgcggtttccaggcgagttctgaaattagttttttcattcgtgtccgaaaaccccttccgacatccggtcaaacattcgatgtgacaccaacaaattttcttttctccaactaaacacaccctaacatacaggcctactgccatgtgaactttcccaagtccaataggcatgttcatttcgtgggcctgatttcaggttatgtccggaaaagcccggcactgcaccaatcaattttgacatggtgacaaaagctttgcatcaatcttgagataacaagagatgcatgcggtggcaaagagctaaagagtatgtacggttttaactctgaggtgtcgtgttcaatcctcaatatatttacaagaaaaaaaatgtttggagtgtaatcccactcttcaaatctcgttttttttcacaagcggaagaatcattgtcccagtgaaccatcgtctccacggtatatgaaggcgtattgttgcctgcaataaatctggatgcaggctgtcttgatgcacactgttcgttggcaccgacacttatgttctagctacaaccacgggaaaacttcaaaagcgattttcagcacggcacgggccacgtacgggcacatggtgcatcccagctttttgttgatcaatgatcatgccaaggtagcgtaccgcgtagcgatacatccaaatgagatttttcaggcgagaacccccccgcatcacaagcaaccacggcatacggtccctaacgcacatggtgagatgcacgaattaacgcgtcgacacgacacgcacaacggacgacgacgagcagtaccagcaatccaacatgcatggggcggcgctcgtactccgcgacgagcccacggacacgggcgatatgaagccaaagtgccaaaacaccaccggccggggcgcacggtcccatcgtatacgtagctgcggcgtcgcagtcatggagagtggatacgtcaatactggttgaactatacgaagaagtacaggagatccttctaaaaaatggtttatgttacaggcccagcctgtacaccttattagcaggtaatcacgcaggaggttctgtcattctttttacgttttctttttttttttttacgaaaaacgtatatgctgatataaacgcgcgccgcgcctactcactccggtattcttaaatgcataattctcgatagttgtatcttgtttatttttatttatttatttttgcaatgagggtgctcgcatatagaaatgcattactttgggaaaagatgtgaaatagcttgttgggatttccaactttagtatattctggtgttcgacaatcgacagtagtgtaacaatcatggccatgtatatattaacaataactagaaagaaagcccgcgcagatgcgcgggcatcttattgaatgttttataaaaataatgctaaaagaagttacatctcactatttctacttaaatgttataaaataataagaatatatctcagattaaaaatacactttgattgagtgacataaattctcatattgtcaccactacttactatgctttaaaacctaatacatcattaatacactaaattatccactacttacgttttatgtctcatttttttctaaatacatttataaatattgtaaaaataccaccacttctatccattaatggaatagcaccattaaagttaaacacgaatactactctaatgggtgaagttgattgtagccaccaagacttcctttctctattgccttgaaacatgggtcccgcatcgatgtagccatgctcctgaagaccagtttggagcataattttaatatacttcctccttccaaaagtctaagttatatttctttttcactaaaaccaaggtgtagttaactcattcatcatgtaacaaaaccaatgaacatgcaaccaataagtactaaaatgactttttgggttctgataaaaaatttaatatagtacatagtgactacaaataggacttagacttttggaaaaatcaaagaatgaaataggacttagatatttggaaggagggagtataattcattatcacacgctcatggagtattgcgttggtaagtagaaagttgagtactattagcgatggtggcctccactgggactgtcttaacttagccatatattccatgctatacttagtacaccatagtaaactttgttgttcatgtttggtgtcctttaggaaagaacaaagacaagatggaggtgaccaaagtagtttttaaaaatgttttgagcatatttgtggtgcagtgtagatacgatttgtttatgttgttgatcattactactcattttttttatgatatagatagaatactctcttttgaacatgactgaggttaatggttcgacgatattttttaaaaaatatagctaatgagacataccaccacgataatatccagagcatcatgttattatttatattttgacaaatatgtatagtaaaatagttctaataatataaaactactttgagaatcttaatctcaaacaaattataatttaatcagacctacttgaaaaacacaactaaattgtgttgtttttatttttacatatgcagatttaaattaatgttgtatatttgtgaagtgatatttccctccctaaaatatgatgtgatttttttgaaaaattatcatacatatgtcagcctcatgtgccatggtgtatttaggtccataatataacttttataatttaattaaagaaatacaacatgattacaaattggatatataatttcaaaataatttagaagatggtttaaagaatatttattgggtattctatgtttttattatagatcttagtttaacttatatatatttatattatatttgtgaagtaatatatttcatatttatattgtggaaaataaccgtccgtttttatatatctatgtttcttttctatctatgctcatatggtttttttccgttccgtgaacaggagaaatttaaattgcacgcactactcataatagatctaatctaatggtgtagaataacgggtccaccaatatcggagaacggttgtagtgtttgtttctaaacaggaggaagttattattttgcaataatagatctaatctaatggtgtagaataacgggtccaccaatttaagtgaaaatcaacgatgagattagatagtgccacatggcggcttaggagtgtttatagaaataccacatggcggcttaagagcgtttataggaagtttaatggacttttagtatataatagatagataaagatagatagatagaagatagatagatagatagatagatagataatagatagatagatattccaacaatgcttgaatggtgggataacacgacagacatgaaaggagttcccaaagcaccctaacactgctaatgacatgagagatatggaatgaaagaaaccgtaaaacttttcaacgtaaagagctctcgccaatcagcttgctagcaaaaagaaaagaggaggccaaaacttggaatttgacggacgtaagaagtcttggtgtctgggtaactctttagttcactcggaccaaacgtcctgagcttgtacagtgttattggttgtaaaactttcattgtattttatcctttgtctattcaataaaattgacggcttgccgattcgttaaaaaaaaaatcggtggacagttcaacacaccctggccacgtttgggtcagctctatcatcccattggccctagcaaatggcactcattttgcaactagaatatttggatgtcctctggggcacaggtaaagcggaatatattaggccctatgtattactaaaatgtgaaccttccctagtcaatagacatgatccttcgtgggcctggcttcatgttatcgaatttcacaaaactatacatatatttgattaaactattacaaaacaataaattcgaaatggtgtaccatggagtaaaagatgttagcattaatttatcacagaattataaatttaaatcgaagtatcacaaaactacataatgaagttatcacaaaactaagtgatgtatttagagaataaattctgagcactaataatgctcttccggagttacaaaacatgcaatttcaggataaaatcggtgcttctgtagttttgggatactatgcgataaatttggagttccgtgataaatttagtactaaactatagttttatgatatattattcatagttttacaatagtttatttaaaatatgtatagttttgtgaaatttgtattcaacctattttgacatagtgaaagctctaccatccagaattgaagtacacttcaagtggaaaaaccattctcgatgcagcctgtcttatgcacacgtcgttggcaccgacacttgcatttctagctaaacggcatgccatggtgaaaaacagaaaagcgatcaacacctcacgggcacatggtgcatcccaacttcattggtcacgcaagggcgtaccgcatagcgtacatccaaatgagattcgcaggcggaatccccccgcaaacacggcaacgaacagaaaatgcacatgctgacatgcattatacgcactggcacgtacaacggacaccgagcaccaacaaacccaacatgcacgacagcacgagtggtacaccgcgacgagccctacgaacgaacacgggcgaaatagccaagcgcaccaccgtggtggcgtgacgcaaggtcccatcgctagctgcggcatctcagtcgtgcggagtggcatatcatgtcacgtagctggagaacgaccgagccggcgcctctctacccgtctccggcaccatcatgtccttatcgatcgccagcaacgacgcacaccgcgtatgtcatggccgattcaggtgacttcacgtggtgcgcgcggtcgctggggaagtcctgcggctgtgcggggctggacgatgctgagctcgtcccttctgatggttcagctgttgctgcagcgaagcagagcagcgcgacgaggagatgggtggtccgcaatttgacgtggctcgctatttctaagatgttgtaccgctcacaacgcgcgtacagtcacacctataaacacacacatacactctatccttataagtatctccggaagactggatcggtatttcttaagattgttaaagtcacccatacccttataaacatcttcggaatactgagccggtatttcttaaaattgatgaaatcactacgagtatctcgctttcacacaccctacctctgtgcacacctctggaagactgggtcggcatttcttgagattgacgacgtcaccacaaccggtatttcttgagattgatgaagtcaccacgggtgtctcactgccacacaccctacccctatgtgcacctctggaagattctaccactgataaaattattagccgcaactgtgagcacccgtgtcaaatctaggatgtgaacttgggtgggctgattccagaagaagtaacctaaccagtcgagttacactcacttcacttctaagatgttatttgatgataaaatagtattgaaatgggggtgttgcttattatctataatacttgtgtgttcgcatggctcgatctgtatgtaatgtcggtatgtcaacgctatgaagttttacatttaatttgtattcacaatggagaagatttaaaaaagacacgaatattagggaatgacctaatatcaaataattagaaagggtaaggttttgaatccaggtcgtctagcccaccatctttgtggagctagccggaaaacctctgggtgtttctcacaatggagaggatttttaattgcatgttattatcttaaagataatggacataaatttgtctctatatttacaggtgaatatacacagtccaatattacataagtgaatcacgtaatgtagatcgtcgctagaagattaagcttcaagcattttatcctcacctaaaacttcagggagatgcggagctagaccaccgttccgccgccacatccactcgctaccactgcagccatcacaaaagctacttcgtttcgccttgggcgaacgaaagggatggaagtagttcgcctagctaccgtgcgaacaacctacgcaccctacaatgcgaacaaatctgttgccgcaacgttgccatctcctcacctagcataccatagcctctgctgagcttataatttaacgaagataaaagatctacacaataaagattttccattttcactactaagattatgctaaatagaggaccaaatatactagctacagaagaaaatataatctagagtttgtacttgcgtgaaaaacagagtaactctgtttcatgcgtgaggtccttgtaaaaaacagagtaactctgtttcagtcatttaaaaagaaaagcgtgacgttctcgtcgaaaacagaggaactgggtgacagtctttaaaaatagcgtacagacgtaccgtacgtgatatgttcagccccatgttcccaatgccaccgacattttggtgctttacatgatgttattttgaaagatacgctttatatgatgtaaactttatcaaacatgtagggcagggcacacaccaaactttggtaatcaccaatgattttcacatagtacaggtacacaagagtacaagaggtgagatctagacgtgacagccatagctagccacacgtgcagagaaaacaaaccacaatgacgactcacgagaacacgaaacgaacacaagaatacaaagagcaaataccaccgagacgctagcttctagctgtcccctactgcatgcatgcaagcctcacttgtgaagtgtagcgtacgtcacgtagctggagtagtcctttgccaccctgtccgccggcgccgccgcggcgttggcagctgcggcggggcaggccgcgtgggtggcgctcgccgccgggcaagtcttcggctggctgtggaacgacgcgcactccgctggccgccgctggttggcgaagcccggaatgcagttgttcttgacgttgaggacgccgtccttgatcagcgacaagcacgccggcccgaccgacgtgaagtagttgctcgacagcgtgaggttggcgaggcggccggccgggccggcggcgagcttgcagagcgcgtcggggatctctccgtagaggcggttgccgcccaggttgagctgctcgacgctggtgaggcatgagaaggaggagggtatcgggccggtgagctggttcatgccggcgtcgatcacggccgcattgatgagcatgccgagctcgcgcggaaggcagccggagagctggttgttcaggagaagcacctcatggagagtgtcctgcaagtgcgagattgatggcgggattggcccggtgagcttgttgttggcgagggcgaggtagctcaacttagagaagccaagggtggcgggaagaggaccagctagattgttgtaattcagaagaagcgcctttgaactcgtggctccaggaaatcctcctcccttcttgtcaggagttccaatgaaaaatttgaatcttatgctgccctgtaaacagtggagaacatcgaggtctacgcctcctcctccagatgtataaacagaaggatgggctgggagatcgttgttgacattgatcttgtacatgtaagtgaggcctgccagacgaggaatgtcgccaccaaaatagttggaggcagcatggaaaaatgcgagatcggggagttggtcgatgaagccctgcagtttcggggcacgcatttcatatccattcaaaatgactgccgtgactgtgagcatcttatcttgtccaggtgtggaacagtggaacccgagatatgacgtatcgccgcagatgtcatggccactccaggtggatgtgatgttcttggggtcggacgtgacggtgctcttgaaacgctggattacaaggtaggcgtggtacagccggtcgtttgggaaatcccgtggctgcaggctgtgcgatgccgaatattggctcgtcttgtagggtatttcttcggagagagcattatcagctaccagcacagaaatgtaagtgagtagtaggaagaggaactgagcaaagggccttttatgttggctggccatgtcgatctatttcaactcagatggtgttctgctagaggagatgatcaggccgtttcgaatatgaaatgaggcctaattctcatcacatatatatagagagagagagatacagggagggccatatttcaatggaagccatagtatgacttatcatgtgcggtgtctccttgccaacaacaataaccttcgcgatcagtctccagcgaatttgttaaaacttaaaacttaaaagggtatgttttgtccccaagtatcaggtgcacccagtcctgatacgattttgctatatatttgttgacaaattttttccccaaaaatttgatagatgtaattacagtacaatcgtagtgtaattacactgtaacttgtatgtaattacacagtaactatagtgtaaattatatgtaacttttaaaaatctctccataacatattatttcggtaaaatggaggtcgtgggaacaaattctttcatatatgtgtgtgctatgatttgttttcttcctcaccaaaacaaatcgtgtaatagatttaacgattcaaaattatgtgacacttacatataagttacattgtagttacatgcaagttacagtataattatatacaagttacagtgtaattacactacgattgtactataattacatctgttaaatttttggggaaaaatttgtcgacaaatatacaggtagtcccgtcctgataatgcacacatgtcaaacaatcagttcccttcaatcttcacccaaaggctagccttgaagtgtagaaattctgcatggggtagcctttggatggagaaggacgagggtcagttttttttcctagtaatatacccacgcattggaacaggatcataccgccgaaaatgggctaggcctcaaaaatggatctgatttttatcattatattttcctttttttcatatttcctttttagcgatttttccccataagtatagggtatctcatatttaggacaccgactacagcctccgaacttataatgctccaattttcgccccgtcaaaaaaatctatttttaataatgttggggaataaccccacggtatattgttggagaagacctcccataacttgggtgttgtataaactaatgtagtaatggactagaacgcccttagggcaatgcccctctgatgtaaccaattaaggatagtactgtaattttctattatatatgaataaaaggagccctccaagagcaggggggatctccccattccattcaatgaacaaccatcctcactctcttcctctcatcttatcccccatggatctaagcttaggctccctccaagaaaaggggtgcctttgccacgcttgttagactttgttccaacattcaacaattaaaaccctatattaaaaaaattggatctttgagtgtatctaggtttgtttgtgtgccggatattccaatttctttcattcattgcgaacttagaatagtggccaaatcttttatcctaaattaaatttcctatgatttgaaatttgaagttcaagttttcccctcctaaatctttcaaaaaaaattgcttttaaacttcaagcatcccttctaagccactcataaaatttacattcaaactcccgatgaaagtcctcgttacatcctatattttatttctccacaaatttatctaaggaaaaagtacacccgaggtccctcatcttatcatcgagttacaaaattgtccctgaaccgaaaaaccagatacaaacgcaccctccaacttccaaaactagtggaaacgaggtccctcggcggttttgccctgtttttggcggatgtggcgcttacatggctcctttgactaggtctttgttccacgtggcactgacgtgacagtttgatccaaaaataataatgaagtaataaaaatggtggggcccactagtccttcctttttctctcttcttcctctctttcttgcgttaggcagggaggaagggcagaggagggggcgccatcgacggcggcgggggggggggggggggagg

SEQ ID NO: 29459 - DNA, 29495 bp, Oryza sativa
taaccattacaggcaaaatgtagtgtgaaggagggccgacgtgcagattgttaagctgacgcgtggaggacaagaatgaccgatttgtgaccattctgacaccggtcatgtcgccagcagacagccatgattctacgtcgcgcctgctcccggcgaaagtggaggtaggtgcgggccgtcccatcagaaggtgactcaaacggcaaccatgcagatctccgtccatttatgaaaaggtagggtaagtccccataaaaaagggggatgggacatgtggtatccccttaagatataaaaggaggaccttgcccacggagagaaggggagatagattttgggggagagagagctttttcttggactggacctttccagattaggagcccataacaagggagaggctggctgatactttgtagctctttgatacacagatctcccaaaaacacaggagtagggtattacgcttctcagcggcccgaacctgtatacatcgccagtgtcttctgtgcttcctgtctcacgaaccttccacatacagattgggagtttagagtttcacccagggtccccggccgaactggcaaaggggggccagcgcggtctcccggtgaggagccccacgctccgtcatctggcgcgccaggtaggggactctgcgagtgatcttcagagctcttgcgctctttcgtgtgcaccaagcttttcctgttcagcctcatggctgagcaagcaaaggcgcacgacctctctccgagtgtgagtggcgacgacggggagccgaacccacgccgtcgagctcgtactccaccgccccctccacgccaaagtcctgggcgggagaaggcgcccgagagggctgaagggtccgcgacttcgacatccacaggaggtggaaaagggcggcgagatggggagcgtcgcctcctcgtctatggtgacaacagcacgccccagggcgcgctccaagctgcgggcgcgctcctacgtcatccgcccgtcgcccatgacccggagtctccagcccaacgttggctggacgatgtggccaaattggtcatgacggcacggcagcgcctagatgctggtgggcggtcctccgccaccaaggcctctggcgctgctaccaccggctccgtgtcgtcaaggcggagggcgcggcgagcggcggctgttgctcgccattcggccgccactccttcgtcgactccttcgacccgggaagatctgcgtggggggccggacgcccgcgccagcatcgagcgccggcgtaatgaccgacgtgctgcccacgcaacggagggcgcttcctcgtccagagtgtcacctcgacacggacgcggggaccagccctccgtgcccccggttggtggtgtcggctgtagagcctttgtggcgagtcttcggaatgtccattggcccccaaggttccggcccaccatcgccgaaaaatatgatggcagcgtcaaccccgccgagtttctccaggtctacacgaccgggattgaggccgccgggggtgacgacagggtcatggcgaatttctttcccatggccctgaaggggcaggcgcggggttggctaatgaacttgccacctgcatctgtccactcttgggaggatttgtgccaacagttcacaatgaacttccaaggcacatatccgcgccccggtgaggaagcggacttgcacgcagtacagcgaagggacgatgagtcacttcgatcgtacattcagcggttctgtcaagtccgcaataccataccatgcatccctgcacacgcggtaatctacgcgttcagggggggtgtgcggcacaaccgcatgctcgaaaagatcgcctccaaagagccccagactaccgcggagctttttcagctcgcggaccgagtggctcgtaaggaggaggcatggacctggaacccctccggttccggagtggcagcttcggccgcccccggatccgccgctcagacagggcggcgtgacaggaggaggaagaagaggtcagtccattccgacgacgagggtcatgtcctcgccgtcgagggcgcttcgcgggccacccaaaaggggaggccagcgagcgacaaaaagaaaaaggccggcgctcccagcagggagcgcccagccggcaagtggtgcaccgtccacaacacttcccttcacgacctcgcggactgccgtgcagtcaaaagtttggctgagcggacgaggaaatgggaggaagagaggaggcaggagcgccgagagggcaagtccccggcggttccttccggcaatcggcgaagtgaggccaagcagaaggcccccgccgaggacatcgatgacggcgatgatgacctaggtttccaagagcctggggccaccattgccactgtcgatggaggagcgtgtgctcacgtttctcgccggagcctcaaggccatgaagcgagagcttctggccgcggcccctactcatgaggcgacgcgccgggcgcggtggtcgaggttgccctcactttcgaccagaccgaccacccaccgtgcgttgcccggggagggcagattgcgatggtggtttctcccaccgtttgcaacgtgaagttggggcgtgtcctcattgatggaggagcagccctcaacatcctttcccccgcagcctttgatgccatcaaggccccggggatgatgctccggccgtcccagccaatcatcggtgtgacgccggggcacacttggccgctaggtcatatcgacctcccggtcaccttcggtggacccgccaatttccgcacggtgcgggtgaacttcgatgtggcggacctcagtctgccctacaacgcggtcctggggaggcccgcgttggtgaagttcatggcggcggtccactacgcctacctccagatgaagatgccgggccccgatggccccatctctgtccatggcgacctcaaagtcgcgctcgcttgtatggagcagcgcgcggaccgcctcgccgtcgtgtccaagcccgagggtggcgacgagaggcttggcacatccgcccccgccgccccgaggcagcggatagtcacgtgcgatgaggtcccggtcaaggaggttgtcctgggcgacggcccgtccaagaccacacggatcggtggtctcttggatggcaaataggaagacgcgctcgtctctttcctgcgggcaaacgctgacgtcttcgcatggagaccggcggatatgcccggggtccccagggaggtgattgagcaccgtctcgccgtacggccgggcgcaatgccggtccggcagaaagtgcggcgcccgcataaaacttttgagagcctccgctccgcccgcataaaactgaaccccgataagtgcgtgttcggtgtacctgcgggcaagcttctcgggttcttggtctctgcccgaggcatcgaggccaaccccgagaagatacgagctatagagcggatgcgcccccccagcaagcttagggatgtgcaatgcgtcaccggttgcatggccgccctaagtcggttcatatcgaggctgggagagaaggcgttacccttatttaagctcctcaaacgctccgggccgtttacttggacggaggaggctgaacgtgccctcactcagttgaaggcgtatctcagctctcccccagttctagtcgccccggagccaaatgaacccttgctactctacttagcggcgaccccacaagtggttagtgcggcgttggtcgtggagcgcgatgaggacaatcctcattccgcgcacccccaccttgtgcagacttggcccgggagagagcagggaggagaggcccccgagccgaacggtggcccgaggcccccgacgaccggagatggccctctgcccgcttgtcagacggtgctaggagcccccgacccccaggaaggccccgaggccactgcgggaaggccgcacctatcgccctctgaccccgaggctaaccctgtgccgatttggcccgggagagagcagggagaagaggcccccgagccgaacggtggcccaaggctcccgacgaccggagatggccctctgcccgcttgtccgacgacgccaggggcccccgacccccaggacggccccgaggccactgtgggaaggccgcccctgtcgtcctccgaccccgaggtcgtcggcacagaagacgagtgcgccccgcgaggccgctcgggtgaagagcgccccagggatgcggcccctagcgaagaggatcggccccaccgaaaggtgcagcggcccgtctactttgttagtgaggccctccgggatgccaagacccgataccctcaggcccagaaaatgctttacgctgttctgatggcctcgaggaaactgcgccattatttccaggcgcatcgggtcactgtggttacgtcttaccccctcggtcaaatcttgcataatcgagagggtactggacgggtggtgaaatgggcaatcgaactttctgagtttgatttgcactttgaaccacgccacgctatcaagagccaggccctcgccgactttgtggcagaatggaccccggctcccgagctcgtctcggtccccgaaaccggctcgggtccctcgcagctgcctcacaccgcccactgggtgatgcagttcgacggctccctgtctcttcagggcgccggtgcgggggtcacgttgacctctccgagtggagacgtcctcaaatacttggtccgcctcgactttcgagcgaccaataatatggcagagtacgagggactccttgccggactcagagtggcagctggactggggatccgccgcctcctggtgttaggcgactcctagctggtcgttaaccaagtctgtaaggagtaccggtgctctgactcgcagatggacgcctacgtgcgccaagtacggcgtatggagcgccattttgacgggattgagcttcggcacgttcccagacgggataacatgatggccgacgagctctcacggctcgcgtcttcgcgagcccagaccccaccttgcgcctttgaagaaaggcttacccagccgtcggcgcgacccgaccccttaggggagacggatgcgcctgaccggcccccgaggcccgtcggagtccaggcctcgggacccgaggggagtgctcccagctcccttagattgattgcttggatcgccgagatccaagcatacctcacagataagactctacccgaggaccgcgaagggagtgaacgcgtccatcgcatctccaaacgctacgtgctggtagaagggaccctctatcggcgcgcggctaatggaatcctcctgaagtgcattcctcgggaacaaggcgttgtgcttcttgccgatatccatgaaggcgaatgcggagcccactccgcctcgcgcaccttggttggtaaagcttttcgccaaggtttctattggccgacagctctcaatgatgcggtcgacctggtccgccgatgtagagcgtgtcaattccacgccaagcaaatctatcagccggcccaggccctgcagaccataccactttcgtggccatttgctgtctggggactcgatatcctgggaccgtttaggcggaccccgggcgggtttgagtatctgtatgtcgcgatcgacaagttcactaagtggcccgaggcttatccggtcgtcaagatcgataagcactccgcacttaaattcattaagggcatcacagcccggtttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcggaaatcctcaaaggtcttaaaaccaagaccttcaacacactcaagaagcacggcgtttcatggatcgaggagttgccagcggtgctctgggcaaaccgaactacaccaagccgagcaaccggggaaacgcctttcttcctcgtctacggcgcggaagcggttctcccatccgagctcaccctgaggtcttctcgggccaccatgtactgcgaggctaatcaagatcagcttcgcagagatgacctcgactacttggaagagcgaaggcggcgcacggccctccgagccgcgcgctaccagcagagcctgcggcgctaccatcagcgtcacgtccgggcccgatcactctgcgtcgacgacctcgtcctacgccgcgtccaaacgcgtgctggattgagcaagctctcaccaatgtgggagggtccgtatcgagtggtcggcgtcccccggccgggctccatacggctggccacgggcgacggcactgagctgcctaacccgtggaacatcgaacaccttcgtcgcttctacccctgaggggggagttgggtgtcaggtttcaggctcgggccaaccccgcaccccctcgggcgtgcagggttggccgggggctgccacacatgcactttcttatttctcttatttcagaatttcaataaaagcagtttcaatttcctaaaggttgtatctgtgctgttttttccttttgaagaatcttgacttgaaataggtcactcgcgctcaatcctgccctcgggggctcgggtcggctaaaaatcgccaaacggggcccagaaccgagccgtgccccgtggcgtggtgaactccgggggggggaatcggcaaaaacccacaatcgggtcacccataaccctcggtcaccacgttcccggcctggccagtctcgacatgtggatctccccaggcactagccccgacccgcgccttttgaggaccagaacctgggcacgagcccttattcaagctaagacacaaaaggaccacggcacagatcatcctcatctcatacacatagcaagatgaaattaacacaaaaatttcttcattttttgattacagattaagttgatctatacaaaaaagaggcccgagggccttagaagaaagaaaagaagaaaaaactgaagaatggcgggggtctgggggctcattccgatgcgcccggatcgccggcctcgacgtcactgtcgtctgcaccaccggcattgccctcctcgtcggagttgggggcaaacgcaagccgaggggccgagccctcgaagctgtcgacgatatagtcggcggcatcccggacttgcgcgcgcgcgcggtcctcggtcccaggagggaactcatccagcgccatccatggagagaagttggggtccctggcctggtagctcgccaggacgagctccaccgctccttgggcgaggtccctcgaggatgacttaattgtcttctcgagctcctcgggaagccgttggagggccccggccatcttcgagaggtgctgggcgaggcctccctggttgtcggcgtactttacggtctgccctctccagaggcccacctgccgaccggcgcgatctaggcgggagacggcgtcccaaagcatgccgggcccgacctcgcctgccaagcggagggcttcgacctccccggcggatgagtccagcgcgctctgcagaccggcgatggtgtgttcggcatctgcgaggcgggcggctaagtcgctttcgcccgcggccgccccgccgctgcgcgccctcgcgtccagctccttcgcccgcgcctcgagctcagcggcccgttggtttagtgcggccctctcggcgcgggcaccttccagattgcggcgcgcctgctcctcctgcgctgcctcgtggagggacaggctgtccgccagctgttgcgccgcggcctcgaccccctcgagagctcgctcccgctcggtgagcgcgtcctcgcggaggcggagcacgagctcttcttcggcgcaggcagcctcgtgcgccgccagtgtcgcttcccggatggtgacagcggcctcgcggtccgccagatccctctccacgacgcaggctgtcacgtcctgataaattcattccgaaataaaattcattttctaaaaggaataatagaattaattaaaattcgaaaagaaattggcaaacactaaaatacgtacaagaaaaattcgaatgtggtccggagaatttttgttaaattctccttggtctaaaaggagccctcaaattttacttgaattttcagagcatgggaattatttattaagcaacaacaaccttgatcaaagtttattaaaaagaaaaagctaaaaataatccccctcctccctttgggccaagtctggcccaaggtttctcccctcttcctctcagcccggccaaaagtttgtttaacctcccccgcgctacagtgctccttcttccagctcaggcagagcccgagctctccagccgtgccgtgcacagtgccgccgcctcctccttccaaatctcgcctccccgttgctccttttttcaaattagttgcgggaatggaatcctctcaatctcctcttccttcccccaactttccccctttaatcccgcccccaatcaccgggatttaatccctcttctttgaccaccattgatgccgccggccacctcctccggcgccgttttcggcctctcccgtgaccggcactccgtccttgccctataaaacgaagccctcctccttcctttggtccattttgctctctcccgagcccctagccacctccccgccgccctgctctctctcccacgccgccggccgcctccagccgcctgtgccacctcgcccgtgcaccgtccggccgtgccgtcgcctcctccagcgtcgcagccgcctcctctcccacggcctgccctccgtttcgcgcagtgaccgccggaggcacgttcccgccgtcgcccttctctttcctccacgccggccgcctccagccgcctctccctcctcgccggagcgtcgtccggtcgcgccgtcgccgccagcagcgtcgcagctgcttcccctccaccggcgtcgcctccgtttcacgcggagaccaccggaggcgcgtccccgccggcaaccagtggcattggtgccactgtactccctccagccggctgctgttcgtcgccggtacgccgatcgacgtcgccgtctcctccgtcgacgtcgcagcgtcgtcctctcctccggctgctcctcggtttcgccggaacaccgccgtcacgcgcgccgcctctccctcggtttcgtcggcacccactccggcagcccctttcgccgtgccagtgcgccggccgacgtcgccgtctgcacccccggcattgcagcggcaaggtcgccctcgccctcgccctcgcctcccctccacccgaacgccaccggtgtccgtcgtcgtcttcaccgttcattctcgcccagttcgtcgtctcgcggtgccgcctccgtcgtgggcatcgctgcggcgtgttccacgccgtcctcgtctccgtgcagccgctgccggctgccctcgtcgcctcctcgccggccccggtcgtcgtcgtcgtcgtcctctcgtcgttcccggtcgtcgtggcgttcgtccctccgtcgagccgttctcgtccgtcgtccgcatccgtcaagcaagccgcggcagccccgtcctcgtcttcgtcctcggctccgcgtcgtcaagccttgtccaaggatcgccgccgaagtcgttccctcaccgttcgcctccgtcgtccccgagctgtcttcgccgcgcccgttcgtcgttgtcgttcccacgcctcgtcgcgtggtggtaaggatccgtcctctcgcttccccgccctcgtcctttcggtgtcgccccgtacccgttgtgcggttgtcgacaccgatacccgtgtaccggtgtcggtagtcgttcgcttgtgggtgtggtgaccgtgttagtgtgcccgctcggtagccgcgtggtttctacgtgtgcagcccgtgtggtgtctagtggagtccgtttgttggccactcgcctcggttgacacacggggtccgcttccgtcgacccgtggaccgtctctgtgtactcggtctaccgtggtcctttaggttgacatgtggggtccgcatgtcaacagcgcagccttcctgtctcttccaggctagcgcttacacatgttttataattgcaaagcttaattataataatccgcaaatctccatataacagcactaaacttcggatgatcatatcttggtcatacgaactccgaatcgacccgttcaagtctcttaatgtttgttataacctaaagaaccctgtgctttctttttatgtattgttattgcttctttttaggcttgtagctttgcttgtgtgtttcgcgtagtcttcgtcgttccggaggttcccgaagcgtggttcgtggtcgtcgctgaaggttcggaaggccgttctctctgagcaaggcaagtcacatcatctttgaacatattgaatcccaatttataaaattatgttgatttaaattattgcattatcgctttatttaaattcccgcgttatcactgttttatctagccatgcctatttacctttgttatgaccttattattgttattgttattatttccttgttcaccctagagtaaacaaaaccccaactagtggacactctactcatggcaccactagtttaattttaggtagatgcttcgcaatttaattaggtaacattaggtggttttacaactctagactttgggaatattcatatcatttggacactatggaatggttggcttatggtggaattggacatacacctctcttcctctttcaaaacccctaaaacctgttttccggtggggtttgggtgcatgccagttgtgggaagtagcaccccggccactataaggattaagctcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggctggtgtcctgctgctagggggctcaatcctgcctgcctgtcccgggggttccggccgtaggtggggttgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgtgggttcacggccttgattaataatactgtgtagctctaggatcgtcttataaaatggctttgggcaactaagtgacttttaaatgctgttttctgcaaagcttaacccctatattattaccccttgtatccccttgcattaatcatgcatctgccggtgtggcttgctgagtactgtggttgtactcattcttgctcaatcttttcccccattcagtaagagaagctttggagaagaagtcttaggtggagtcctggcttacaccccagttgagcgcctgtgaagatggagccgtaggcccgctagtccgctgctgtttattttttgattgccaggtctaaagcgcctttgtaataatgtaaatattatcgatataataaagatgtgccttttgtatcatgtttgtgtggtgtaccccggcttttcctgggatggggattaatacactagcgttcgggaaaaggcaattttctcggtcgcgacacaggcgcgctcttccagcgccatggcgcgcgcctcgagggtctcttcgcgccgccgggacgccgcttcggtctccgccgcccgctgttctcgggcagcggcagcgtcaagcaccccctgggcggcgtcgagcttcttccctagctccgcctcccagctcccgtattgaaggcggagggtgtcctgcgcctcgttcattacggtggtggcaatgagggcagccccccgctcctcctccacttccttggcgatctccgccaacaccttcttacgggtttcaagctccgagacatgccggcggtgagccttacggcccacctccaccatggcctccaccgagcgtcgcccctcttcgacgcgcgcccacgcggcgtcgagctccgcccgctctgcctgcagggcctccacctgggcacttaacccgtccaacaccgtggtgtttgcggcggccaaggcttgcagaaggggctctgcgctcagtagggcagcagaaggcgtggggaaaagtcgcctcggagaagatgccgcgcggctcggcccgccgatggacgtgccagacgcagggatgtcctccggacctggttgagcctgagcgtcgcccgagggagtgggcccaagcgacgcgcccgcagcttcgtcgccagctgccccggaagttgtcgcctgagcgtcgcccgagggagtgggcccgagcgacgcacccgtggcctcgtcgcgaactgcctcggaagtcgccatcgcctcgtcctggcgaaatccagcctcctcccgagcggcttcctcggcctggtgggcttgggcagcctcctcccgagcggcttcctcggcctggtgggcttgggcggcctcctcccgagcagtttcctcggcctggtgggctcgagcagcctcctcccgagcagtttcctcggcctggcgagcccgggcggcctcctgggcggcctcctcggcttcccgtaggcgatccgcggcctctcgccggtcagcttcccgcctgcgggcctctgcggccgccggatcctcggcctcaggctggccggacttggaatgatgggagggacgtgacgggatctcgctgaaacaaaagaaaagaccagaagacgaacaagatgggcgagtgaaaactcatgttgagagaatgaatatagccacgatgggtgagagacgaacctgcgagggggtcggttaaacgaccactttggaggggaaatgaggtttccccgagatggttctgtctcctccatcttgcggggccgcttcttcttgcgctccccctcgagctgcgatgctggcgcggccccctccgggcgcttgctgctggcacgcgccgccccgccccctcggggaggagaagggggaagtgttcctccctgcttcctcttcccccgggcgtcggcagggcggctgctccccgggcccctgacacgggacccagaagcacgaccccctctcggggtagattgctccccccggcggctccctcctgcgccgtcatggccctttggagctcgctcctcagaggccccgacccccatcataatggtcaggatcgaggcgcggtctggatcgctgcagagggggaggattccttggggaatgagggccgcctccacggagttgagattcagcacccgttggaccaatatcttgaagtcctcaggagcccagtcccatctcactccctggtgggtcctcatgtaatcttcggacccggtgtactcccaggcgccccgagcgcgccgctggagcggcgcaatccgacgacggaggtagtcgccatacaccatggcccctgtgagccactgggatcgcaggcccgccaggcggtcgaggacggcgtcatagccatcccccagatctaccggcgcccgccagctggaggcctgcgccgggggctggctcggaagtcggaggcgcgcttcgtcggcgaggggagtgtagaaccaatcgctcttccagtcgtcccacttcttgcggagggcgcaggggatgtagcggttcagcgccggcccccgtggctggaagtagcagccaccgactaccgatggcggcgacaccgactgcacggtgaagaaccaccggaacagccgaagagatgggcgcaccccaatgaacatctcgcacagatgcgcgaagatggccaatgtcatcaccgcgttgggggtgaggtgcgccatctggagatcgtagaactctagaacatccatgaagaaagaagaaaatggcggaaccagccctgccattgcaaaagggagaaagaagacggaccgccccgggtagtctggcgccgagcgtccctcgcccagcgtgactatctcccggccggcggcagattccggcatgaagcggcgcggcagcccagcctgcctctcgctcacgatgcgggagggcggcagcacgctaccatcgagcagagcggagccccgtgccatggcgccggaggaagagaagattaagagcgagcgcgtgtggcgagggtagggcgcaggaaagaaggagttagggcgcaagcggcaaagacaaggggaataatggcgaaaggaaggaaacaaatcccttcctcagtgcctttatacccttgccaacgctgtgcccggctcctcgtttctcgcgcccactatttcgccccctcgtttctcgcgcccacgcttccactattcccattcgcccgcttgcggcgcatgaggtggatatgcggttgtggcggtcgaggtagatcatatcgtgcgcgcgttaattacgctcgccaaccgaagcgacgttaccatatcttcagatgaaacgaatcgccatgtccagattcgtgtgctactcgagtaatgtggcagtcttgaagagaccgctcattattgacagccgagttaccattgccgatgtgcgtgatttttgaccgttggttttctgcccaattgtggagaccggtcccacctgtcaccgggccttaggagtggcgtcacgcccgaccgcttcccttgaggagggcgatcgccctggcataacgccgggggctactgtcggtgacatgggatcgggagtatcatgactagaggtttgaggcagacacagtcgcccacgtggcctggcaccctcgggggacgtcgggcccgaaggtggtgtgttcgccctcctcttagtccccccgagggggtcgggctgcacccccctcggccccgagggccgaggcgccccgacccctcgtgggttttcgctccgcgtgtatggggtaggtgagcacagtggggctcacctaaccacatttattgcggtttggctgagcgtgtcacgacgcatgtaacgtagtgcattgcactcatttatccagtctgtgaccagtcacagaccggtcagatcgcgggattaggtggcgacaggcggtctgacgcacgcctcgccccatcccgtcaggacgagggcttctaggtgctcgtccccagctggagctagcgtgttacctcccagagatggcacgttagccctgatcagatatatgccaggcttcatcctaaccattacaggcaaaatgtagtgtgaaggagggccgacgtgcagattgttaagctgacgcgtggaggacaagaatgaccgatttgtgaccattctgacaccggtcatgtcgccagcagacagccatgattctacgtcgcgcctgctcccggcgaaagtggaggtaggtgcgggccgtcccatcagaaggtgactcaaacggcaaccatgcagatctccgtccatttatgaaaaggtagggtaagtccccataaaaaagggggatgggacatgtggtatccccttaagatataaaaggaggaccttgcccacggagagaaggggagatagattttgggggagagagagctttttcttggactggacctttccagattaggagcccataacaagggagaggctggctgatactttgtagctctttgatacacagatctcccaaaaacacaggagtagggtattacgcttctcagcggcccgaacctgtatacatcgccggtgtcttctgtgcttcctgtctcgcgaaccttccacatacagattgggagtttagagtttcacccagggtccccggccgaactggcaaaggggggccagcgcggtctcccggtgaggagccccacgctccgtcacatctgttgcatcttgaaaggaccttaatgtcgcctagaggaggggggggggggttaataggcgttcctaaaaattatcacaacctcatagcatattagagagatgagaacttttggttcaaattggaacttccggtatgggattggaagttctggtctcaaccgaaaagtttggcggataatggaataaaacactagctatgaacttgtagctcgaataaagaaaatgtatatgaatcagaaggtgacaaataaggtatctaagcaagatataaggtcaccaactatattaattaagcatgcaagtatagatcgggtaaaaacaagctcaagcacaatatgagagatggcaagaacgagcaaactaagagaggagacacattggtttgtttcccgaagttcggatccatggatcctaggtctccgttgaggggccactctatttcaacccttacctcacgaggttgcacaaatgcactcctcggtttcactcttgatttcttcccttgcagaggcgaaatcgaagccttcacaaacttcccgtggcacaccacaagcttgggtgctcactggcgacgcctagccgtctaggagaccttagtccccaagagtaacaaacacaatcgaagatttgcttgctatgaactcgagtgctcaaagtatggagtgaagttcacaagctctcaacttctcaatctctcaatccaactctctccccttctcaaatccctctcacaaagaggaaccacaaaggatggagtgaagctcactagctctcaactcctcactctctcaatccaactctcttcccttctcaaatccccctcacaaagaggcaccacaaaggatgggaaatggggatggctatttggctttggatgtgtctaatgttgcccaagaacagcagccactcaaaggagggtggaggagtttatatacccgagcctctcaaaaactagccgttggaggcaaagacatgaattttcggaactttcggaaagcattttcggaacttccgaaaatttacagaagctaaactcagttttgcagccattttcggaacttccgaaaagcacagagtaaaacgaccataaaattttgctcgggagcccctttttgatgatcttggactctatggaaagctcacttagaggactacccaactcaaccaaaaacaaggtctaaaaccactcaaaggataggttaaagcttgggtttctctcaaggtagcactataataggtcactttgaacatcgagacatacacaaactcatcgacgttgcatccctcttaatagtacggcattcctatactcaaatataaatagaagagaattataccaataggaatgccttctttccatttccttcctttgtcttaagggacgccaacgccaaaaccgtttcaccgtatattcttcaaatgattgatgcggttacttgtagattcaaatggtctagcatggtccatcatgacaaagccatcactcgcccttcaccaccggattttgttcttcggcaccaagctccttgcttgcccttcaccccggcatggtccatcgcgaccgagcatcacttgcccttcaccgtcttgccatagtagtcactttgtatcccaaatcttcaatatcttcgctttgttattcttggtattttaggtgtaatcatatcacttgagcgtcaacatattttcaatccttggaacctatttttctcattcaacttagtgaaattattagtctcaatgatccggttgtcaacctccacatgttgactaaccgatcgcatgtataaaaggatatgaataaatgatgagtattaatcaacaccacaagtgtcatatactcaaatatatgctcaaatgtaaagatcccaattaaatgaaagtgaataacttggatcaaatacatgcataactaaggtataggatttgcttcccctaaatgtatgcataaggaatatttgtgtgaagcaagagtatgcataaatagagatgaaacattgggagcttatcctatataaaaatagaaggcatttctcaaatacagatattaaaataaaaacataccttcatcatctccacgttctcaatgtaaatagactaaataagagataagattcaaacaaaatattagtttcacatgcatatgtcaatcacgtggaaatattatatatgaacatatcaatatgtacatggagagaaagaatgatacatatagcttgatcttcatacatttcatccttgtgatttaggtccaccatcaatgaacgtttctatctcaactcatatgaagtccgtgaatcatctctcacacactccacttttatatccatatgagactagacaaagaaatgcttacaacaatattagtctcatggaattggatttgtcattaatcaccaaaaccaaattaatagcacttgaactttcacatctgttgaaccagtttctccatatctgctttttgctcatcggacaaatgctcaaccgtgactgggatgacgttcttctcgtcgatctttgtgatggacggtgtcatgatgaatggtgaagtggttccactgggcatgccaaaagcgtgttaatgtgaaacacggctgcctgagagatttgcttcactctggtgcaggtccaaaacttgcctcgagtgtcaagagtgtcacgaccggaaataacccaacatgcgttccttacgtgcgtgtattattccttgtcccaggaggcgaggtacaccaaaagttgatacaattcagagtttaacaagcggaagcgtaaatagttaattattacatgggcaacgaaggcccagcacacacgaagacaacgaaaaacagcggaagactagggtgacgaccacaggcgcttgacggcaggcacgagctagacaccaaagccttcatcatccaggagctcctcttctgggtttgggaaaaattgagtaagactgagtacaaccaccgtactcaacaagacacacccacaagtgcagagtaaatgcaaaggagtacaaaggagttataatacagggggttagggtttgcagtaaacagcatttaaaagacacttagttgctcaaagctaaatttaaaacacgatcctagaactatttgatattattaaataaggccgtgaacccacacgaacccgccttaacccaaggcccacgatgattcagaccggactggcaacccgaccctgggtcccagctcgtcccaagacaacccaggccaaccattccacattttagttgttaagcaggttttaagaattaaaacactaacttgggtgcattgcttggcttgcccataaccgagggcgcggctattcgaataggttttactctgatcagaggtgtacatctttccccacaagacacgtcttcctcacgtgcagccacgtgccacataccaccacggcatatggacggaagacatgacatagtttccaacccatcctagccatagacatgagtaccgacccaaccccacctatggccggaacctccgggacaggtaggcaggactgagcccctagcagcaggacaccagccctgtgccatgacatctcgactaccgggccgcagctcgtgtagccttcatctgtcctagagatgtccattgacccccgacttcgtccatctccatccgtgtacttttgtttataaccagactgagccacaaactaagccttacccactagacatgtggaagtacggtagtactttgcaacagaggcccgaagaccggtccttatgtggccgaggtgctactatcaaaaccatgcaccccaagcctagcctaaaaccattttgagggttttgaatagagggggaggtgtgcatccagttccacaataatccaaccattccataatgtccaagcgatatgaatatccccaaagtctagaattataaaatcacctaatgttgcctaaataataagcgaagcatctacctaagttcagactagtggaaccatgagtagagtgcccactagttggggttttgtttattctagggtgaacaaggtaataataacaatagcaataataaggtcataacaaaggtaaataggcatggctaattaaaacagtgataacgcgggaatttaaataaagcaaaaatgcattaatttaaatcaaaataatttcgcaaagtgggatccaatatgttcaaagatgatgtgacttgccttactcgctttcccaaacgtcggcttcaacctccacgaagagcggatcttccgaagctgcagcgtctacacgatcaacggaaaagaaaagggcttttactctaataaactccatataacaagcaagaacaaaacacaaaaatgggttcttcacttcttaaggaaaaattagagacttgaacggtccaattccgagttcaaatgcccaagttatggctatttgaagtttatatgctctttacatgaatatttacgaatttcttcatttaaattttaatttaaaaatggtttattgcgttagccgagggggaggggcgcgcggaccgggtccacgggagtggggcccacgcggcagcctcacggtccacggtggaccgggtgcacccgggctcacaccggccggcgccgtgggccccacgcgtcagccgcacccgagggcgtgggcggctgacggccgggccccacgcggcagccgctcggcgcgcccggaggcggccacgtcggcgcggcggcgggaggcggcgcccgcgcccctatggtcgccgacagcggccataggcacagcggaacggcggccgagagaggggaagggaagggggaaaagaggcggcggtccccggctcaccccgggtcgacggcgatgacgaaagaggcggccggagcggaggaaggcggcggcgcggctcgggtggacggggacgacggtgttccggcggtcggcgagctcggcgaggtagtggacggggtcggcggcggtgcggcgaagctggaggaggcgacgccggggcgggagacggtcccggcgagcgaggagggccggccggaggtcgtcggcgatggaggagggagagggcgacggcgcgagctcgaatccggcgaggaggaagggtggtgagaggcggaaacggacgggagaagcgcggggagagtttaaatagggttggaagggggagagggcggccggggaggaaggaaaccggcgcgggaggtccggccaccatcaatggcgccggcgagatttgtgggagcaaatccgcccgtttgaatgagagagagagagaggggaaaatggggggaaagggagaggggatcacggggagtaattcccccctattgatttcacgcgggggcgacgggatgcggcggattcggcggcggcggtggcgctaagcgcgggcggggcggcaggagcagcgggaggaaggggatgacgggtgggccccacccgtcagcgagggtggcgggcgggccgcggggaggggccgagtgggccgcggggaagaggagagagggggagggaaatgggccgagccggcccaagagagggagggagggatttttttagggttttttctttttatgaaatcattttaactttgtttatttcttaataattattatttgtgctctgaaaattccactaaaatttatttacacattttaggcttttaggaaatattaaaaaatcctccaagccttaattgacttttaactttgcacattttaatttttgaaggctttcacaaggattttaattattctaggcataatttaaaggatatattttagggtcgttttgggacgcgacaaagagcgtgccaactggtttgatcacagaaaatatagttagcttcacgatagccgatcgctcgataagccgatgacgtattgtttaatacctagccgatacgctcaaaccagatcggctgtatgtttatgataaaacagatagggcaaaactctaaatatgttctatccgctataatattgtccttttattttttgtcagtcaattttggacaatactataaagagccgattatccaatacttagagcaaagtagataaagtaccggatattactccaattaaccttatgtaaacaaatcaatctcagatacaatgatgtaatcaagattgattaagacttgatatatttagatagagtgatctctctatataagtggcatatatatatatatatatatatatatatatatatatatatatatatatatatagaactactatacagcaccctaaggtgctaagtattaaacagcacctgatacagcctccaaccccaaccccacccacccacgctcccaccaggtccatagtacgcagttaaaatttaactcacagacgaccaattttaatcccacccttgcacgccctcccctcactcccatagtccgggtaaattttttacttgatgttatccaacttcttattagttctatatatagttaaaatttaactcatcgacgaccaatctcgatcccacccctgcacccctacccccactccaatagtccgagtaaatttttaactcgcgcaccactaagagccacccccacaccaccctgtcaacgctcctgcccaaacaatagtaatttttttactcacaccaatagctctatttataccatccataaccatctcactgtatccaaacccccattcatactcccgtcctcttccatttttttcggatctgagaaattggggattcagcggcgacgggtgaccggtctgctcgtcggggcgatggtgtggaggccgagctccgagtggtggcgaggagatccatcagtgaggggtggcgtcatcatacacagcgcgtgtgtagcatcacgaagcaaaatagcgcgactctgagcgcttccttcccacaccacatccggattttccgttttttctctgttccgcttatccaggtaccaaggcccgtatatatatctttaccaccccttccatcacaagtaaaaaaatttctgattcaacataacactgagtaaaaaaattacttctatctctaccctaatttgaactgggagttaaaaaatcactctcgagtaaaatatttttcacattcactgagtaaaaaaattacttctatctctaccctaatttgaactgggagttaaaaaaatcactctcgagtaaaatatttttcacatcagatcagttaatagtaaaatttttactcatgtatttttttatcactttccggtgtgttcataataatacttttattcatgtctatttaaggtgcataaaatcacacacaatattcaatcgtgcaaatcaatcataccaccacagtaaaaatattatagatcgtgcgaaagatgaaaaaaaaagagatgcatatctactttgtccttctctgatccacttttttcgttccagttcatatccacagtccactttttccgttatttgcctttttttgctttttcctccgttcctatcaagtattaattcacgttcctaaccacgtaaaggttatcctctccggtttttctgtttgttaactccctttccgattttttcgttcaatacgaacacctcctgctgattccaaggaggggagtggggccttcctgtgccgcatgtatccaacaacctcgagtaaaaaaatcactgcctaattaaattaggttccgttaaaaaaattaccatgtcttttctttcataatttcatcccagtaaaaaagtcactgatcagcttactccattaactaagagacccaataagaaatgatagtaaaatagtagtaaaaaagttttaactaacatatagtaactttttaactgcaagcctcgctctcacagacccacacattcatcatttagtgatttttttttaccaatcacaatgacccctatatgcatcgtttggtaattttcttaccaacacgacacatgtatttgatttgcttggacaatgaataataggaattttatactccactatgatatgtggattctttttttttaataatacttctgttgcatccagtcatacagtgaatcacatgtataaaataatcacacagccctggtggaaaaaaaatacagaatacacaaaaaggaaacattggccatcggcagctctcatcggcatcggcaaagagcagcacgcatctgtcgccggttgtatttgctgatctacagcctagaacattttgcatccactctcgatcggcatgggtacgttggacagcccgggggcgtgcggcgattgactacaatcacggcgaccggcgcaagcagcaccttccaggccaccgtcgatgtggattgaccacgatggagccgtcgaggcatcggtcctcctctgcgttgtcaaaaatactaaagacaaaaaaaagaaacacggaaaaaaaccaaatatgtgctgccgatgacttgcgcaggcggcgcctcgctcctgcagctgcatggccgctaaaccgacagcttgtgcgagatccctcacgccgccgagagtgcctcccacggtcgagctcgtagttgccgggagtggaatgtaatggagccgctcgtggtccatgtcgctgcccatgccgtcggtcgagcttccaccagcttcggcggccacctctcagtccacatcaatggtggcatggaaggtgcttcttgcgccggtcgccgtgattgcagtcagtcggcgctgcacggggttgacgagagacgatgcggccccatcatcttcaccggcccccaccgccgctgcttcttcaccgcatcccagctggtccagccatcttgacggcaggctaaggcgttcgacggctgagtcgatggatccaaaaaattcggggattaggggttggatggttactgccggatagaaacgcatataaatagatggtgccatacatagtaaaaaaattactatcacgttttttcagggatcgcttctaaggtgggattgggaaggatgttcggtacgcctgcagtaaaaaaatgggagtacctatacatctttcgaaagatttttatgatcgtatcacactaaattaccatatcctcaagaaaaagaccaaatccaatacaaaatttaaaatttacatgcgaggattcaaaaattacagtgtaacttacaaaagttacagtgtaagtttcataaattacactgtaacttacaagaaaatatactgtaaatttgagtgagaaaatcgagtgagagataagaaaaaatctttcgagtgagatatagcaaaatcgtaaaaaaaactttggtgggtgcaggcggggtgggctgggcctggtagggacacgcaaggaaactctgtgagacgtgttaactaactaggtagcaccttatagtaccatatagtagttttatatatatatatatatatatatataaactattctacacccgggcatagaatagctattctatacccccctcccaacggtcacatccacttccccctccttaccaaggcctaaaacccacctcccacctcggtcaaaggcccctcccaccgatcaaacccgcctactaactccccccaccacccacctcttctcagctctcgtcccaggatggtgcagtaacacgacgaccactgtgcagtaacattgtgtcttacgtgcagtaacagcgttaaaatatagttgaaatatagttatgacggatctacctttgataagctctttttttctaacatcatggtgtaaacggttttaaaaaaccttacatcacttgggagatattgttcttcaaagcttgacttttttgcaatttgtttctccacaagtagtaatactatactattacttgttattacttgtctgttgtacgttactacaatcacatcacgatgttactacactgcgttttactatattttttgggtagtgttactgcataaacacgtgataacgtgtaccttccgtgcagtaacccttttacttttgtgcagtaacaagtatatggttagcatctgagacttttaacctatatatttttgtttcaattcctaatttactataattcaccacaatattactgtcacatcttacacatgcagtaacgctatattggagggaggagaccaattttcttgagaagagggaggaagaacggttcttgaggaggggagtatatagatgcatcttgaagtttaatccttcacatgcagtaacactataacatcatggtggaaacgattttaaaaaataatacatatcttgtgagatattgcttttcaaagattgacattttgaactttagccctccacatgcagtaacagaatgtgtaatttacagtaacaggggtatatacatgcagtaacatggttttaccaaatgtataaaattgttcaaaacactcctacatcaatcagacatcgctcaaagccacctacagactttacctatggcccacctatttgatcttcatctcgtaaaaatgacacagtaacactgcatttatcatgcagtaacatagctacttagaagtggtaacatgcacctattatgtagtaacacttctacttttgtgtagtaacaagtatacggttagcatgtgaggctttaacccatatatttttgtttcaattcctagtttatgtagtaatactattcaagaaatgcaagacactttgttactgcaaagcttattgtctttactagactcttatattaacgttgtgatagaactgtagtaacgcacagtagtaacaagtaatgctattgtattactacttgtggagagtcaaattccaaaaagaaaagcttttaagaacaatatctctgatgtcatgtatggttttttaaaattatttgcaccatgatgctagaaaaaaaatgcttaacaaaagtagatccatcatggggtgggctgggccggacttgctctatacatatatatacacacacacacatacatacatacacatacatatacatacttgtaaatatgaaaatacaacttcatgtttatagttcaacgatgggcactaagttttacaacaagcgtatatagatcattatctggccacacaagtgcgcaagaatattctctcttttattttgcgacaggaatattcaggcatgctatctaaatgtatattagttgaattacgttctgcagtgctgtgtttggttcagtctagtgtagcagtcttttgtttccatccaagatatgacgtcctgattgtgtgcagtttgctggctatttgtttcatgttggctcgttcacttggtaactggcgcgtacaagaacgtgccaatcctagcagagacaccatgcattggtagaatccactctcttcaaaaatgcctggttgatcatagtccttgcattcttctttcagatgatcatcgatgatatctaaaacttgacgtggagcactgttgtttacatagttgatgatgtcgagtccgtccttgaacataggatcagttggtcttttccctgtgataatctccaatagcactatcccaaaactgtagacgtctccagaaggtgacacatgaccaccatgtgcatactctaaaagggtgcatacagaaagtattgttcgttacataaaagcatatatgtgtactaatgctagcctgtgtaagtgtatggttgacgacttttatattattaaaatgcggaaaatcacaaacatacctggagcaatatatccgattgtgcccttcagaccgactgaattaactgaacctgctgttgtagagaaagaatcaacataaaaccttgcaatgccaaagtctcctaagagtgcggtcatgtcatcgtctagaaggatgttgctaggcttcagatcacaatggacagtaggccttccgcaatcgtggtgtaagtaatccaatgcatcagctacattaacagcgatgctcattctttgagataagcgtagaccttttgaagcttttccgtccactctgtgatgcagccatgaatccaagcttctctcggcaccacgcatttcaagattgaaaaccttcaccgccacttcaacttttggttccttcagccttcccctgtacaccgaaccgtgggcccccctcccaataagattagattccgagaaattcgttgtggcttgagctagatcgttgtaagagaccttaagaaagttttcgccaaaagaagtttgttctgaatattttcttcttggcttcttcttctcaaggattacaaagtagataagcaatataagggacatgaacccaaatattggaatcaatattctgattaaataatattgtttgctcattctatgagaaacagttgggcttgggcatgagggcatatggagatccttatttcctccacagagtccccaattgccaccgagtgaaacagatgtagcgtctgcaaatactccgttcgtcggtatttgtccatagagatgattatatgaaaggtccagactcttaagctgcagatcacttaaagttttaggaattgtacccgataagttgttatgagaaagattgagcgccaacaagcccacgatattcccgaaaggtggaacctctccaatgaaaaaattttgatccatcaaaatgttcactaaatttttacattcgctcaaagaatcaggaattccaccagtaagcttgtttgatgaaaggattaagttaactagctgcctaagcaaaccgatctctataggtatgttgccttggagattattataactaaggtccaatgatgtgagtagagaaagacttcccaggcttggtggtatgggaccttggaatctattgtttgctaaagagagtcttcccaattgtgcaagattgccgatagaggatggaataggcccaatgaagttgttgtttgcaataattagaacttgaaggtttttcaactttccaagccattctccgatagtaccaataagaaaattagaatctaatgtcaacagaattaacccagaaagtttccctatgctatctggaactattcctgaaagtttatttccacctaatactaggttttgaagagttttcgatagattcccaatcgaatctgggataggtccagttaatttattttttgctaatgatagagtttgcagagaactacagttccccaacgcatgtaagaatgcccagcttactctgtcgcttgcttcaaggtcattgttatcaaggtttagagcaagtagtcccgaaagcttaccaaaagaactgggcactgggccagtgaaaacattgtttgacagataaacccttgttagccctgaagcattgcccaaggaagctgggatgttatcttcaaacatattatcttgcaagaaaatacttacgagatttgggagcttgtcaccaatgtcaggtgctaatgccttgcctagcttattgtcacgcaaagatagtccttgaagagatgagaggttgtagaagggacgtggaatttcgcctgagagattgttgtcagccaatgataaggactgcaaattggacaattggccaagctcactgggaatggttccctcgagttgattacttgcaa

SEQ ID NO: 29460 - DNA, 1438 bp, Oryza sativa
gccaataacataagcatggtgggtttcactggttgaatagtagacatagtgccacaccgctgttacctgcaaaataaagggaataaccatttgggcaactttactcactgtcggagtcattttttcccatgcatgtttgttctgtaacagtttaaaactcgaggaagaaatattctcgtccaaaatatttattccctcggtcaaaaatatttaacttggatgaaaatttgatcaaacctctaaaattttgagaataaattatatataaagtaagtttatagtattatgatactagttttcaagacaaatatctgtatataatttatttcgtctttaaaacacacatttgaaaaattattgaaatatatagaattttaaattttttatcaaatcttattgtaaatattcttcttttttgcagagggagtataatataatgctaaaaagcaggaaggctaagctttgttaaatccgcacacatagggtatgtgaaaggcaatagagggttgaaataccaatcaggagaggagagaacacgcaccttcgcccggccggagtgcagagcactgcaacctcttcggcttggctatgcgcggtggtgtgtgtgatctgggctctgggttggatatgcttatctgactcaggccccaggggtttaaaaactattttacagcagccttacctccacacatttgagctgtcacaccttatcttagcttgaccgccgtaacagcggagaccttgattcggagtcgttgagactaatccattgcaacttttcagcccactcaggcactcacgggttcacggcctcacccacctcagcggtcgctgtttgaggtcgacaaggttgttgcagcttgttcagcctcgaatacgatctctctatttcccctccggctctgtactttccatccgaaaccgggcatatatattctgcactgatgtgcgacttgtctccggcggcttcgatcctgacaagcttagcacatggacggtatacttttcaatattctcgttcaactacatcgttctttctttagtgagagccacgagtttggctttggttctttgtgacattggtgcttccagaatatttttatgtggacgtgattcgttctttggcagagcagcgggtcaagcaaatttgcacgtattcagtttggacaacgttgcaacgtactaatgccgtgtcgtccacggttatacatacatcaaaatggtgaaatatctagcagggaccaccaattcagtggaggggtcaaaaaaattgttttgaaaataaaagaaaccaaaagaattatgtagtatatggctagtatttgttggcggtaggtttacacacagatcctctcatctgtgacggcccattacatgcctgggcaacgtgggccgtcagaacgaagtcatctcaattgggcctaagggctgcaggaat

SEQ ID NO: 29461 - DNA, 8720 bp, Oryza sativa
cggtagacttccaaattttggcaatctttcctattttaatcctaggtgacaaatttgggtgtaaacacatgcctccctgcctttttgatgaacaacgtgaatctaaaagcatagaccatgtttttggtcttaggacgataacccaattaccggccatagtacctcctaagcgtcttgccaaacgctcatgaagtatttcttcaagtatttcccgttgattgctcgctgaaaacgctccccttgaagtgtctccaaaaagtatgcgttccctcgaacggtgccgcacactcgataaggaccctcccaactaggagaccacttaccgaactccttggatcgagtacccaaaggcaaaattgtcttccaaaccaagtctctaacctgaaacaactttgctttcatcctcttgttgtataccttggccacccttttcttctctttctctatctcttcgaatgccttcaagcgcctgtcgatgacttcatcaaggttatctcccatcaacgtcttgtaatcttcactggacaaatcatcttgcttgatataacgaagagaaccaagatttacctcctccggtaaaacggcttcttgaccataaaccaactcaaaaggagtgactttagtagcactatgtttagatatcctatgcacccacaatgcttcggaaagcacctcatgccactttgggtattcctcaatctttttcttcactaacttcaacaacgtcttattactcgactcggcctgtccattagcctgagcatagtaaggagaagaactcaacaatttaataccataagattcggtaaaactcttcacttccttagacataaaagaagcaccttgatccgtagttaatgtttgcggaatactgaatctatgaataatatgtttcaaaataaagtcaattacctccgtatgagtcatattattcaaaggcacagcttcggcccacttggtgaagtaatccgtagcaactagcacgaacctatgcccctttgatgacgaaggataaatttgaccaatgaaatccaaagcccatcctcggaacggccatggtttgattatagggttcaacacggcggcgggcgccaattgaacattgccgaaccgttgacaagcctcgcatcctctataatatttgaagcaatcatcaatcatcttcggccaatagaatcccgctctcctaagcaaccaattcatcttgtgggccgattgatgagttccacaaattccttcatgtacctcccccatagccactttagattgatctttatctaagcacttcaacaagacaccatctatgttttggcgatacaaatctccatcaagcaatgtatatttgaatgcttgccgctgaattttccgatcacccttaagtgtaggatctttcaaatatctaatcaaaggaattctccaagctatttctaattcatgggcacaaatgtccgaattcacaattaattcggccttttaatcaattgtaacatgcccccccagctctctacccgagatcggttagaccggccacgcaatgccggtcagaccacaatgtctgcccggtcagaccggccatgcaaagccggtcagaccgctggctaccaccggtcagaccggccgtgcaatgccggtcagaccgtccctggtctataactttgccaatttcgtccaaacttttgaaatcaagcatcggcttttagtatataaatttttcttcacataatagccagatgcttggtatatcaaattattgaaccaaaactccttctttctagacatatgaaaaatcataatatccaactaatatgtctagatgaatactaattcaattggcttttgaaacaataatcatcatggcatcacaacacttagccaattgaagtatgatcaataatgaatcaccaaagtcatatgtgtcacatgcatagattccaataaactaaaaatgtaagtaatcggcttgagcatgtatgcaaaatattaacaatgccaatgttcctaaagaaaactactctagagcaaatcatcacattgaccattgacattagccgaattactagtaagcaaaactttcatggtgcaataaatatgaaatctatatcttatatggtgatccataaaaacacatatgatttggctttaaataaatatcaaagagtcatgagccaaatcatacttcaaacaaattatatgccaacctaccaattctactacctagaattggcatttgcaacatgtatgtataatatcaatttgataagcaaaaacacacatgtgctagatagcaagcaatgttctaataacatggcataggcatataatataatggtaaacacaataaactcataccttgccttagcatccaacaaacggcggctcaaagatgtgatgttgtatccatcgccgttcatcttctcttggttccctaatgaacatattaatgtcttgccccccaagcaaaatcggctttctagattgcgcgatttcgaaggcaagacggataccgcactaacagtcatagcatcatgtgaaggagacttatctctaatgaccgatgattcttctcccatcaaattggatttatctctactatgggaaatcaccggtatcttaacttttacctctttggatctccacacttgcctaggtgcttttcgaggctctaaattattacatgttttgttctccacatcttcggcctccttttccttttgacctatggcccgaagacgttgtagcctcctcttttgagagcgagataagccggaaggtatgcacttcggctgtggttgttttccaggagctaaacaatgattcttcatatttttggtcgaagtggaagctcctatgttgctctcaattttcctactcttctcaaatgccccccggtcagaccggcctctgagcccggtcagaccggccacaagccgtcggtcagactggccagtaaggtcggtcagaccggctgtagactggcggttagacaggccagctgtctcgattagacccccaatgttggcagtcatggcgtcggcttcgatctcctttgcctgcgtggtttccaccgcatctccagtacatgaacatcttgagactcctctttggcagcaacaacctccggagctttggtttctttcctcacccacatcttcttaaactttttcacctttgatccaccggaccgattcttttgtgggaaacggtcttgtcttgaattagatgaatgatttggcactgtcctaggtgattcctcccatccttgatgaaacggcgtagagaattgagacatccatggcatgtaatacataaaaggataaccatatagtgacattggatatggataccatggcatcacaaccggaggtttgtatggagttggtatagttgatggctccgattgctttggtgtttgaccaaatctcttcctacgagacgatcttggtctttttgaatcactagtttgattattaaatcgttgaccggctaatcctttcttgtacttagccataaacatctcaaaaatgagcttcggctttttggtcttttgagaactagatgactcaccctttgcaactttatgatctttggccatcgcatttttgatcctattcttagggagaacatcactaataattccggtcttaggcatagatgtaaccgaaatagtttcacaagtgaccgatgaagtatcaatcggtctttgctccatcaagcttgcatctttaaaataatcatgaaactcatgctccatttgtgaccatgtagaaattgaattaggagcaagtaaactataccatgtagatgcaaagtttgacaaagaaagaggaaacaactttaacttaagcaaatcattactaccggccttaccacattgatcaataaattggccgatatgctccattgttgttctagcatcctcacctgtaaattttgtgaagttgggcacctcaaatccttgcgggtatgggaccgaatctacgtgttcaggatacggcctttgatatgtatgcatagcttctttggatcctatttcactactatcccgcaagacattgtcattatcttttccaacatctacatgaccgatttgtgattcggtcttaggtgacaatgctatttcattttctcttgtaatacaatccgaaccgtcatctagttcggctatatcttcaatgatgctatcatccaagctagcaacacaatccgaaccaccatttggttcggctattccatcgttgtctaaactagtaacacaatccgaaccaacacttggttcggctataatggttattgcattatcatccaagctagtaagacaatccgaaccaacacttggttcggctataatcgttatagcattattgcacaaattattaacacaatccgaatcatcgcttggttcggctatacatgatattgcactatcatctaaactagcatttaagttattgtcatccactcgtcttccctgagccagagcttcatgcaacacatgatcaatatcaagaaatacttggccattcaatttctttttattagaatcaagcaatctatcatatgcaatgttggccaaatctttgtcagttattttcaaactaaaacatcggcttttaatatctctaaatctttcaatataatcaacgacagattcattgtatttttgcctaaccaatgttaaatcaaacaacctaagctcagttttatcagtgcaaaaatgatcatggaatttttgttctaattgaacccaagtataaatagaatttgccggtaaagaagtaaaccatgtaaaagcagtaccggacaaagataaagaaaacaagcgcaatttaaaagtatcactattagcctcaccacattgcgccaaaaattgacctacatgctctcatgtggtcttactatcctcaccactaaacttggtaaattcgggaactctataattacggggaaacggcacattatcataataatcaggatacggctttttgtaaaccctagcatgattcctagtttcaatcccgaatctattcctaataatctcactaattatatcctccatattattaggcccatgttgatttggcggtgaattaggtggcctaataggttgtgtttgtggcgcaatatgattatattggccttgtctagtatcgggaggataccccctagcaacgtcattataagcattaggaacacgtgggggaacttggggactatttgtagtagtagatataggaggatcaaatgttttaaagtgatacaaataactagcattagtcatcggatctattccctgtattggaacaattgcgccggtctgaccggcccagggcccggtctgaccgacatccagaggtgcggtcggaccggcctgagtgccggtctgaccgccggggtaatacccggtctaaccggccgtttggccggtcggaccgacggctaagtcccagtttgaccggccgtcaggcctggtcagatcgaccgtgtgcgccgctccatcggttttactacccgtttgatctataggaggttggttagcagtggtagaggctttatcctttaacgtgtaatcgtccataagagggccgaatttaatccttaaaaactcatcagatttacccttaaaagttgcatctaacttatttttaaaaacaatcatagatgaatctattgtagatgctatttgttgttgggtagattgtattacctcatcattacttaccaagtcgggagcgagcttaggaagtggctcgggcttaatgatcacgccttgacgagtcctagtgcacgccctcatcaacgcttcctgtgtcatctccttgatgtactcctccatggacttgcggtcttctccttcgaaatcatccaatgagatcggcatgatctcattcccgctcatcatggttgatgaagaaattccttgattaatttcggccatatagctcatagctgaaatatttgaccgaataaattaatatacggtcttcttagaaaacagccgaaacaaatgaatcagctttaatatttctttttcttaaaaatacgtgagcggtagtaaatcggctttgttagcctgatttttcttttttaaataacttcactcggtttctgtacacaacaaagaatatacagaaaccaatactactgttgctggctctagatagactgatagatcggctttgtacagcctgatcgttttcttttcagaacgcgttagatttctgattttttttttcagaccgtgtacaggaaggatactgccggtcgcttgttgctgtttccacacgtggataaagatagattccggctgtatagccgaaacactcgattagacgggaaatcgatgaatcgatggcagcagttagcttgatgaccgaacagtgtcgccgccaaatagattgatccgatcaaaaatacgtagcggcagtgacggattttgtatagattgatttcggctgtttggccgaaattcttgactcgacgaaacgaaaaggtgactagtttaaacggaattcggccgtgatatggccgattagatcgtttcccagcggagtcgccaaaaatcgtgttggcaacttttttttgacaagttgacaagcacgatcgaagcaccttaagccttgcggtgatcctagagtcgccaaccacctcgatctagcaaagagctaaacctagatgggttttgataactaaaccggctagcggagccgatttctagataactacccgtctcgtgagcaaaacggaaggttttcaggacaaacctacaaagatgtgtcgcactctcgcagcggcggcggacggtttacggcgcaaaccgacaaagatggacaaactaagagaaaactaaaagcaatatgaaaaacgattcgattgattgattgtagattggtttttacaatgaaccggccatgtcccttatataggggttggtcttgccctctacaggccctcctccacgtccaactcgggatagaaaccaaaggaaaccagaaacatgccttcccgagtaaggaaatctcgagacccgacgaaacacaatcggactcggacctgccggtcagaccggctacacaccgccggtttggccgaccctcaaccggcggtctgaccgcccaacacacggcggtcagaccggcccactcggaggaaaccggttgacttccaaattttggcaatctttcctattttaatcctaggtgccaaatttgggtgtaaacaaaagggtactaatcatttcctattaatttagtagtacttatgtcatgagatgttaactaatattttgttcattgttcagcgatggatcgaagttggatgtacacgactgacttgaggcgtcagtacaaggagtatagagatggcgtattaagttttatgaaagccgcagaggaagataggataagaagaaacgacaagtacatgtgttgtccatgtaacgattgcaggaatgatattttgttggacgatgaaaaggaagtacacgctcacttgatacgccggggattcatggagagacacacatgttgggtgaagcatggagagcaagatctgggtactgatggtgcaactgcagacagaagtggtgcagacaatcacgaagaaggagatgaagaagagcatgacatgtttgtcccatctccattgggcggtgaaatggttgatgtggaccctgatatgctgcaagacatgttacgtgacgttgatgacccaactatgaacgagagagattccatgaagttcagcaggttggtcagtgactcggacactcctctatacgcaggatgcaagccaaagcacaccaaattatcagcaacattagacctaatgaagttgaaggctagtagtggatggtcagacaagagttttacagaacttttgggaatactgaaggacatacttcctcaagagaatacattgcccgagacgacatatgaagcaaaacaggttctgtgtcccctagggttagaggtccggagaattcacgcatgtccaaacgattgcatattgtaccacaaacaatacgcggacttagatgcttgtcctgtctgcaaggcttctcgatacaagcgaaagaagagcgcggctgtgcgggggagggaaagaagtcaaagcggggtggtccggcgaaggttgtgtggtatctaccaatcattgatcgtttcaagagaaaatttgccaaccccaatgaagcaaagttagtatgttggcatgccatagagagaaggaatgacggtttgctaagacaccctgcggattcgattcaatggaggaatatcgatcgaaagcacaaagactttgctgccgaccttagaaacatgaggatatgtttgtgtacggatggcatgaatcctttcggagacatgagcagttctcacagcacttggccagttctcattgcgaactataacctcccgccatggttgtgcttcaaaaggaaatatattatgttgtgcttgttaatccaaggtccgagacaaccccgcaatgatatcgatgtgttcttggagcctgttatcgatgaccttgagattatgtggaaagagggtgtggaaacttgggatgcatatggtcaggagaacttcacgctatgagttctattgttctgcaccattaatgattatcccgcactgggtaatctttctggacaaaccgtgaaaggaaggaggccatgctctgactgtatggaacatacacgcagtaggtggctgaagaaatcaaga

SEQ ID NO: 29462 - DNA, 690 bp, Oryza sativa
cccataaacatctagggttggagggattcctaggctcccaggcactcaggctcagccgcccaccagccagcgccgatagccgaccgcacccggcgccgtcccctgcgattccgcgccgccggcgccgtcccctgcgattccgcgccgccggcgccaccaccggcgtcccctcccggcctccccaccccgcaagcccgcgtctctgcgccggggcggcgccgccacctccgtccgcaccgacaaccgtcccctcccctcctccgcgccggcgccgtgcggcctcccctccagcctcccctcctccgtgccggcgccgcgcggcctcccctccgacctccccgccgtccgtggctccgcgccgagtcgccgacgacgacgccgcgccgtgctgctgacctgccgcgccggcgccgcgcggcctccccgccgtccgcggctccgcgccgtgctgccgacctgccgactgccatccgcccgtcccttccccttccgtggctcagcccactagccaggtaacaaatagatgcctaaactaaatgactagatttgtgaatttgtgattagaagatttgtgaatttgtgattagagattagttagtctgtgaataactgagaatgcaatttataaattgttactaattagtgaatgtgtgctaaatggtaattgctattgtttgtaggatctatgtt

SEQ ID NO: 29463 - DNA, 339 bp, Oryza sativa
ctattccgcgcttatcattcaggagttaggactatcacaacctaagttgggtcgatccctaaatccaaatccgaacctgcagttactcatcactagaggagtatatataagattgaggaaaccctcgggtacctatacagtgcagtggtatatgcccactcgccgaatgccgatccgtgcgccgccgcggcgtcttcctcttcccactaggagaatcgacggcctcggccaggacgaagtgtctgactccggtgatgatgagggcccgccggagcctgcgcccccagccaaagcagaacgcgtctccagagctcaaggggaaggcgcccctgactgagg

SEQ ID NO: 29464 - DNA, 2684 bp, Oryza sativa
ttgtgtgaaagatctagcttactgaggagctgtaggccactcaaagcagttggtatggtccctggcaaactgttataggaaagatttagtacgttcaagctttttagattgccaaaatatactggaatgtctccagtgagaatgttttggcccaattggataactaccaagttttggctttgccccagagcatcaggaatttccccagaaaacttgtttgatgaaagatgtagttcgaccagttgtttaagatttccatctcctagatgtatgttaccttggaggttgttacagctaaggtctaactctgagagcttcgtaagatggcctatgttaggtggcataagacctttgaatttattattttgtaagaagagctctgtcaactgagtaaggtttccgatggagggcgtaattggtccgatgaagttgttctcacggagaaatagaccttgcagatttttcaggtttccaatccattctccaatttcaccacaaaaactattgctactgagaaagagtctgattaagtttggaaagttccctatacttggcgggatcgttccctgatatgttatttccgaccaatattaagtgctgaagattgattgatagattaccaacggaatctggtagggatccctgcagattattataagctaatgcgagcacagttaaagaagtacagtttctcagcgcatgtaagaattcccatcctaggttttcattcgcttcaagcttgttaaactgaaggcttagtacagacaaatttgaaagccttccaaaagaggtaggaatttgtccagcgaaattgttgtttgcgaaatctataggtaatagcgctgaagcattgcctaccgaaggtggaatctgaccttccaaaatgttttgactcaaggatactatttggagatgaaggaaggcatcatcaaaggttgtgtttggttaggcttttcaacctgcttttgcttttgcaaaagccaaaagccaactaaagggcccaaaagccacatctatttttgcctaaagccagtttttggtgtagtacaaatcataaacatccctaattaaggtccggcagtaatagttgttggaaccttcatattcattccttccaaagagaagcactacaacttgatcctaagattgccaatcagaagatggaatttggccaatatgtagtgaaactgtcatcttcgagcaatcagccactctagttttgctagccttccaacccatcccttcaattgtaccacttaaactgttggtatctagtgcaagtgtagttaagcctttaagtctccctatgcttgggggaactattcctgataactcattaccacctagatataactgttgaagatcggttgataagttaccaattgaacttggaatagatccttgtagctgattcgcagctagtgagagaacttgtagaagactacaatttgttaatgcgtgaaaaaattcccagctttgatggctgttactagcttcaagctggttttcctcgagatttagatgatacagattacgaagcttaccgaaagaactaggaatttctccattaaaattgttgttttctaggtctagtctttccaaccctgagatatttcctacggaagctgggatgtaactttcaaacatgttatgatttaacataagccattggagattggggagggcatctccaatattcggtggcagtgtagtaccaaacttattcaattccaaagctagcatctttagagaagacatattaaagaggacatgtggaatttcacctgacaggtcattgccacctaggagcaacctcgacaaatgtgacaaattccctagttggtcaggaattgttccagtgaagtgattagaagctagagctaatctctctaggtgagtgatgttgctgagggttggtggaataattccagtgaaattgttccaggaaagccgtaagaccaaaagattggagaggagatctagtttgaggggaatttcaccagccatgaaattcttagacagttccaatattcttaggctggagcaattgacaagtgtttccggaatcacatcttgcaatgagttcgtgctcagattaaggacttgcagcatatgcagatggttcagaggaggtaacaagccagagaactgatttgtggacaggtccaatttctcaaggaatgttaggtttccaagagagcttgtgattacgcccgctaagctttggccggagagatccaacgccacaactcgccctggccgagttgggctgcatttgacgcctttccacctgcacaacggggtggttctattccaggaactcaagcttcctttcggatcgttagtaacggcctccttaaagtcgagcaacgagagcatgtcagtggtgttgtcgtagagctgggagcagttggtttggctagaatttagcagcaatagcaacagtgtaggcatgacgagtttcatgagcgtcattagctgttatctgcagaagataaagcattgcacaatttatttcaacacaaaatatcgaaacgtaaatgggcaattgacataagcatttatattgacgtgcaattcttttcacgaaaaaataagcattggtaagaagatatatgttttgtactgtaaaaatctaatctaaaggcttaggaaaactgcacttgactatcttgaacagaact

SEQ ID NO: 29465 - DNA, 5149 bp, Oryza sativa
tttgggcatagagattcaccgagatagaacaaagtatgcattgggactttctcaaaagacatatatagaaaaggtgttgaagaaattcaacatgtacagatgcagtgctacacctgctcctataatgaaaggcgaaaagtatggggcatcgcaatgtcccagaaatcagtatgagctcaatgaaatgaaaacaaagccatatgcgtcagctgtaggaagcctacagtacgcgcaagtgtgcacacgacctgacttggcattcgttaccgggttacttggcagatttcagagtaatccaggcctagagcactggaaattggtaaagaaagtcttgcgttatttgcaaggaacaaaaggcctcatgctatcttacagaagatcagaatcactccagatagtggggtactcagattctgactttgcaaaagataatacaaagtcaacatcgggatacgtgtttaccctggcaggaggagctatttcatggaaaagctcaaaacagactatcactgcagggtctactatgtatgccgagtttatagcatgctatgaggcaacggggcaggtgaactggctaaagaagttcatacccggtttaaaggtggttgacagtattgagaaaccactaaagttatactgcgacaacgaacccgcagtaatgtacactcacaacaatcagtcaagtggtgctgccaaacacattgacataaagtactatgttgtgaaggacaaagtccgggatcaaacaatcagtctcgagcacattaaaacagaaaggatgctcgcggatccgctcacgaaaggcctaccacccaacgtgttcaaggaacatgtagccggcatgggtttaagggaagccttatgaatcctggactacagggcccaaaagtaaagtatctgtttctgaatagagatgtgtatagtggctgtcgaatccatcggcgattgaccgtgacgatgaaacatgctctatttacaaatctgtgatggaatagaaaaagctaaaagaaaaagtgagatcaagggggagaatgttagatagatctctctccccttgagcccaacggctcaagggggccttgaccgcgccctgatcgggggcgcccagcccaatggctggtgggcccccgtcacactgcgccatataaaagaggggtggaggccggcacggcacaaggtacgagattcaccgccgccgccaactccaccctacaaaccctaatccgatcgagagggggcgcagccagtgacgggaagcgccaccgccgcgccacacctcatcgccgggacatctacgaccgtcactcccgcagccgtcatcgtcgtcgacctcaccggcgccgcatccacgacaaccgagcgccaacgacgacgatggccggcacttcttcatcctccaacacctcaaccggtcggtctatctaaaccctctcccgttttcaatctctacaatgtcattcatcaaacccaaatagaaccacccgactagatctaacctaggtgatcctagtgcaaagtctaacaatggtatcagagcaaccctagggcttagatcggttcgggaaaagaaatccaaagaaagaaaagcacaagatccgcacggatcaaaagaaccgaaaaccctaaccctaatcttacctcgtcgccggccgtcgccgacgccggcaacggagggggggaggggcaaagaggcgccgcctaggagccactcgacggccgcgcgcgcacctgcacgcgcgtaccgtcgagggggcccgcggcggcgccgccatctccgtcgtcgccatctctctctcacacggtgggggttagagacggtggggggagcggagaagaagagaaaaggcgccggccatggcgcggcggcgcgagggccgccggcgtcggcgacgccgctccgcgcggccgcgcgcccgcgagagaagagaagctagggttttcggcggccggccgggagagggggttttgatcctccgatctcggcgcccggccgtccgatcgaaaccctagctgatcggacggtcgacgccggtcgggccaaaaacggcccaagagggagagcgcgcgcggcgactttcccggcccaggcccaggttgcggcctggtgggaggggggagcgcccgcgcgcgccaaaaaggccgcgggccgacctgaaaaagtccgtatgaggtccctcgggggccgaaaatgaataaaagagaacagtagcaattttccattttattttgtcaattttcatgcaaattttcaatagaattttgaatagatttttgcatgttttacctctgtttaaatttgaaccaacgggagaattttcacagagagagaattacagagattttgctactgttcatatgttttttatatagttttccgctgcaaatagatgaaattgatgaaaattagtgtttctaaaattaaatttcgaaccaacgggagaatttaattttaggaacattaattatgtgctatgatgttgtaatttttctgaccaacgttgataattgcaatattatagttatggttatatgtgttatgtctatttctgcccaacggtgatgtaggcttaatgcataatattttaatgttaattttgttctcaccgcacatgattatttcaggtggctactccttgatgggttgcattaaagatattccgaccctgaaaggagataactacgcagaatggaaaagaaaactcgaccttgcttttatcttgggagaggtggactgggtgttgactaccccatgtcctatagaacctgctgaacttgtcagaggtgaaaatgagtcagatgctgactggcaaaagagacagagggacaatgctcctctcgtcatgtcgtatgacattgaacaaaagaaatggtccttagccaacaagaaatgtttggctgtggtaaagaatacgattgagcctaccatattgggctcgatcccagagtgtgacgctgtctcagagtaccttgaaagaataaagagtcagtttactggctcttcaaagacttatgctacacagctgatcaagcagcttgtgacagaaaggtaccatggaggtggtgttagagaccacatacttagaatgagcaacatggcttccaagttgaagccaatggatttgggcataacagatgactttctggtccatctggttatggcctcattgccaaagcagtttgacaattttattgtcaactacaacatagtccagagaaatggaactttgagaagctcattgctaattgtgtgcaagaggaggagagaatcaaagaatcaaatggtggttcaataaactatgttaaagataagaaaaagaaccacaagtctcccacctcaaaaggtaaacagtctcagcatctgcctcaacaacaacagttcgctgttgagaaagatcaatgtctccactgcaagaagacaggacactacaagaaagattgtcctgactttttgaaaatgatcatggcaaagaaaggtgagaacattattacatttgtaaatgaatctcattatgttggttactctagatccacatggtggattgattctggagcaactattcatgcttgtaattgtttaaaggcattccgttcgacgaggactacgcaaagaagagaaaacaccattagagttgccaatggagttgaagaaaaagttgaagctgttggagatcttcctctagagctcgcgaatggcttcatacttttacttcgagatgtcttttatgttccttctttgcaaaggaacttaataagtgtatcaaagttggattttgatggatatgattgccgctttggaagtggcaaatgtgaactatggcataataatgcatgtattggtcttgctgtgttgcgagacgagctttatttgttatctctttctgagaatgtgaatgttgtgtcctcgttgacaaaagaaaacaagaaaagaaagcgaactcccgatgtctcatcgaaattatggcactgtcgtttgggccatatttcgagggggagagttgagagactagttaagaatgaaattcttcctccattggagttctcagacttagaacaatgcatagaatgcattaaaggaaaatttgtaaagagcatcaaaaagggtgcaaaacgaagcgcaggaattttagagatcattcatacagatatttgtggtccattttctgtgaaaagtgtggatggctatgactcgttcataacattcacagatgattactcccgctatggttatatttatccaattaaagagcgatcagaagcattggataaatttaagatattcaaagctgaagttgaaaatcagcatgatataaagattaaagtagtaagatctgaccgtgggggggagtactatggtcgacatacgccttatgggcaagtccctggaccttttgcaaggttcttgctagagaatggaatagtagcccagtattcaacaccgggcgaacctcaacagaatggggtagctgaaaggcgcaaccgtacccttatggatatggtgcgcagcatgatgagctactccacactaccactcggtttatggatggaggcgttaaaaaccgccattcatattctcaacagagttccaagcaaatcggtgcccaaaacaccgtatgagctatggacagggagagtaccctcgctaactcacctccgtgtgtgggggagtcctgcagaggccaaagtatttaacccaaatattgggaagttggaccccaaaacagtcagctgccattttattggctatcctgaaagatcaaaacgctatcgtttctactgtccaaacagttatacaaagtttgtagaaacgagacacgccgtcttcttggaagacgaaatgattagggggagctcggtagttcgagaaattgatcttgaggagaggcgggtgtctgtacccgctccgtcgactcaggaacctttcttctctctacctgctgatgttgtgcctgcaatgcctgtcattgaggtaccagcacctgttgttacccctcctgtggcaacaatgaatgagagtgaggaacctgttatacaggattcaacagaaatggttgtcacaccagaggaggagctacaacagcctcaaatagataatgtgccagtacaggagactcatcaagagcctcaggtacaggatgtgccaaatgtgcag

SEQ ID NO: 29466 - DNA, 527 bp, Oryza sativa
ttgggaagaaaagaaaacatagcaagaaggacaagaagaggatgtggaagaaaaaatccatattttggcggctaccttacagggaagatcttgaggtccgtcaatgcattgatctgatgcacgtagagaagaatgtgtgcgatagcttgctggggctattgctgaatatgcttggcaggacaaaggacgggttgaatgcgcgtctcgatctacaggagatgaacattcacagtgaacttcagcctgttacagatgagaagacaggaagagtgtacctcccaccagcttgccacacattgtcaaaggatgagaagatcaatgctatcatgtctggcagatattaaagttccttcgggctagtgcacgagaataagtaagtacgttaaattggaggatctaaagctggttggaatgaagtctcatgatcgccacgtgctaatcacacagatcttactagttgctatcagaggcattctaccaccacaagtccgtcacacgatccaactgctttgtgccttcttcaatgc

SEQ ID NO: 29467 - DNA, 5696 bp, Oryza sativa
atgcagtgtatggatgaattggatgtatggatgcaatggatgcagtagatgttttttgcattgtagtagttggatgatctagatattgctatgcagaggatgaattttgcatgatttttggtggaaatgccatgttggatgtatttgtgatgtaatggccaatgatgattgctcaagaacagaccctatacacttgtgatttttggggttttttcaataagaacagaccatctacacttgttcattttattttggggggggtggcagtatgggatgttttgcaaaatggatgcattttttggccggcctcactcttgttcttgtttaggtttaaatgtgggtttttaatgcataataacagaccatatatacttgtgatttttgggttttttcaataagaacagaccgtctacacttgttcattttatttgggggggggggagtggcagtatgggatcattttatatggctgttttttttttttgcataaggacagaccctctacacttgttcttatatggttgtttgataatgtgacaccttgaaaaccttaaatcagtaaaaatcaagtctaatttgatatattaacaaataggtagaaccgagtctaatttgatgaattagcataggatttagggtttagttttagatttattttttggagcctacttaggagtttatccaacagactttaatttaaaaaatctgagtcacattgtttgatcaaatttgctttcggcctaggtcttcccaagccggcccaaacttaggttggcccatcttcggcaaaccgagtcaattcgatggcccgcaagccgagcagctgagcgcggcccacttatgcggggacggtccgatgcacttccgcggcccattttgcgcagcgtaatcggcaacggcggcccaacgttgccgatatctgagccgtccgatctaatggacgtctctgatattccccgctcggatgaagcgccgaccgagagagaggggcaaaaccctagctcccaaatccctctctccccatcccatttctctcccgcgacgagcgtgtggaacgacggcgaaggcggcgatgacggtccggctaggcggccgcgcaaacggcaacgagcgccgagcggcctagacctcgtcggcaggaggggcgacgccaaggacaatggaggggtgctccaggacagcgcgcgcacagggaacccaatgtgactgtgaggaggtgaaggtgcggtggtgccgcttcccgggaagctctggtgagcttaggggcttcaagtctgttaagtaacccgaacccatagtttaattgatttggattttaactcttatggttcttaccctaaattagggttcttcgaatttagggaattttgtcgggaaatttcaatgtattttattccctcttttcgagttaggggagttttaatatcgtttatcctcttttaattttgggaacttcaacttggtggttcggccgaacctccctcgcctctgttggatccaggttttggctagacggttgagatgaagccccaatgacggttggagggtattaccgaccattccaaccgtcacaaccgtcatagttcagctataaaaggacttcaccttctcacttcactcacacacctaaagcaagagctctctcattcctctcaagtttagtttagtagtatctagctggtggaatagaattagaataggaatcaggagtccggaagcctttggaagagttcgggtatggctctagcagctttcctttcctcttttgtaagctttgtacttttattagaatattcttctatataaatttatggtattggaatacttttcgagtatatgaataccaactttacattatgttcatgttatactgattatgctgctagcttatctgggagatgctttggtacgggtatagtgtttgcttatgcaattactctatgtcatgacgatgatattagagtattatctggtagtttaggcgtagtgtctagattacgggatatcattatttggggttatatattacggatgagaggtgggccgctgatggtgacagctcagtacaggtattcctccgcgcctatatataatcctaagttaatttcttggggagggtattcctccgtatttagccctggttggatggtcatgacgggctgtcgtaaggaactcggcagtcaggggtggcttctcgaagtaccaggagggcattggatagagggtattagctagtatatcagctaactagaatgtatgtataatatgtatactagaagtatatgaataggtttcttttctcttctttccacctagcttagataaattattatgaggatgagtagtaatgcttgtgtgtcactctacccttggattatcttaacccctgcttagaatatgattatcacaagtaatatataaattattagttgagttctctctacatgatctttccatgggataaaataaatacgatacccttggaatactctcgggtaaaatactacaatgatatatccgtgcgcttgcggatgaactctgtaaccataatataccagaaatatttctacgccattgctgggaattatatttctattaatatcgttaagaaataccaacagtccatagaatcggattttttttttgcccggtttttttcacccaatttttaagcccggttttttcgcccgatttctctttttttggaatcggaccaatttttatttttatttttttgcccttttttttgtaggaatcagattcttttttttcgcctgattttttttgcccggtttatttagcctgattccttttttttaatcagaccgatttttttttatttttttcgcctttttttttcacggaatcggatttttttcgcccttttttttggatcggacaattacggttttttcggccggtttttttctcttgcccggtttttttgtcaccttttttttgcacagaatcggattattttttcgcccctttttttgatcgaacagttatggttttttcgccggttttttctcactcgcctggttttttcgccggtttttttgacggacgatggaagcagcgcttattttttaagtagtagagatatggttgtttgcataatttttgggatattttgggtccaatgggatggatgaattgatgtgggctgtgatggttgaattattatggctgtttttatatggctgtttcttttttcataaggacagaccctctacacttgttcttaatttcttttggggatgggggcagttgcaaatgatggtaattgaagcataatttctgagcaaaactgaggccaaacttattatatgtcatgacttgtgtttttttaggtacaaaaataatatatatgtgacttgtgtaatataggctgttttgggtgattttgagggaaatgggatggatatgcatagaaatctgttattaaatgaagttactgaaattatggcatttaggagaatacgaagtgtcccggttgccaaatctggtttggtcgggttacagcctgcacagtaccagccaagaaaaattggtaaacagaacatttcgttcaaatacaacatttctagaaatctgttatcgttaccaatatcctagattgctttcaaggtcatttctttagggaaccccattcccataaattcagtatccaaagctggttgttgtatctatgggaataagggttccctaacaaaataatcttggacgcaatctaggagtttgctgatgataacattagggatcttggatagaaagggttttggttgcctatgtgttctatctgcgtctgcctcgtcagcagatatgtagcatccatgttccttaaggctggagcagacgggatcttgacctcgacatccatatcccactagattttgctaccgttgccactatcttatggtagtgacattgatagcaagttcgagtgggatactgatgtcgaggtcgagttcccggctgcttcggccttattgagcatggatgctatggttccgtcgacgaggcgaacgcaggtaggagatagaggaatatcaaactatcagagaatgtgtgtagatgcaattttgtgtttaaaaagtactttctccccatacaacagtgacataggacatgttgcagcaaggcgaaccaatgtcgacgaccactactgggactacttcgagtcggaatcctaggacctagaataagattcctaagaaagtctacaccataatagaggtggacgatgttggatatccgacggctccgacaaaagctgtcaaaaagttccctacgatatgcggagtcctagggaggtggaacttcactattctgaaggaccacatcgatctggtccaagaaaaagaagaggcctggaggcagttcaaggaaagcttccaataccctacagaggtcgaggcaggactcaagcagcaggctatccgcaagatggagaattgttggaaaaatttcaagacaacgctggtcacggagtacgtcctcaaccccgcccagccagaaccatttgggaaatacccattcatcactgtcatgcccagaaatttagcccaaatttccagactattctgtgtactaaatccctgtccaggaccagccagggtacacaaaacgacaagtaatatacagttccaaacttaaataaagcgtaaaatacttacagaagaggcacttagtcctcacaccgaaacgaaagtagcagcagcggaaaaaggcaatcctagtggggcttcagctccactccacaggcaaaactcaactggggtctgagccttggtcttctaacttcgtcttcaactcagaaacactacacttctgaaaagggggaataatagcaaggctgagtacaaccaccgtactcagcaagccacaccaatgatgcagacgtgcaagcggatacaaggaggggtttgtggctatttgcataaaggcagttgtaaaacattttattgagcaaaacagtaaaacaattaagtaattaaagtaatattgaatctccactgatcaacgctacaccacgttgaacaggcccaaccaacccacctgaactacagtgcattgggtcgatttattaagtgtgagactaatcacggtgaatctggtcgaccgcccataaccgcgggcacggctattcgaatagttttactctgatcagaggtgtacaactgtacccacaagacacagccccacgacacatttccgtgcgccgacatgccaccacgacatatcggaaagaggccgtgacaggacccttcgcataaccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcagctaaaggaaagctacactacaagccctgccgttgcccacgctggcttgtggtaagtacgataagttcttccagggcatcccgcgaaccggtccttaattgccatgggtgcgactagcaaaactgtcacgtcctgataaattcatcccgaaataaaaatcattccctaaaaggaataatagaattaattaaaattcgaaaagaaattggcaaacactaaaatacgtacaagaaaaattcaaatgtggcccggagaatttt

SEQ ID NO: 29468 - DNA, 8404 bp, Oryza sativa
atgtgcccaaggattgccaacttagtgtgttgttgaccaagaccgcagaaatccaacgaacaactctacgattgtctcatcagctagtcagctccaacaacaacatcgatgatatcatccaccgcaccaatgctcctcttgctccacctaactttgcaataaatcatggcaataataccttcagcaccaaccactctctgcatcgacagcctcagcaaagaattgtcgtagatggaagaagttgtgtctctccccgacctactccaggccaagcaaagggcaatcaacctcaggagggcgataccaagcagaaaaccgtcatccgcttcaaacagcaatcagaaggaagcttctcctgtgaatgatagcaatatgcagtcctaacacatcatcacggaaccaatcaaggatgatgcagtcactagaacaacgccagctatatctctccagaatcaaaatgagcagccacgcttgtggttttcagttcgctacttatcattgtgtaatcgaaagtttgcagcaatcatgtaataaataaatatattcatgtctataaacagtgagcttgctatgtttatggatgattcatgttgaggatacaatgtaccgatgataagcaccttccctttttgtttaaggcagtgccttgtattcgggtaataagggagaaatcaatatttgagaacataatagtcgatggttggtaattagtctatcaggtatcagaaaagggtcaaaggtgatatggcagaagaacaatatggatgctccccatctcgaggaagcactaaagatgaccatcggcaaataaaccctagtggcatagatacaaatagcaagcaatgtatttcccggaaggtagtcagtgcagctttttgacgaaccacatcaaggtttcaccgaaaggcagcaagccaaaggacctcatcgtccccagaagcgtccgcaatccacattaaagaataccacctgttagagataagccgaaagatgattgataaaagagattggcaaagatgttctctagcatgaaagaagtaggccgaaaggtgattgataaacagaaacatgctctgcatcgctcaaggaagacccctgatagtaattgcccccccacaacagtcaccttgtcattaagtaagcaagatgacctaggtaaaagtgtttctattaaggcaaggagtgaaatcttcaactcggtatcagatgctacacggagtgaaaagtgcaagccccggttaccaggcaacgccatgtcttgggagatgatccaatgggaaagaacacatcaaggctgaaggtgcacaggaatacgttgaatgctaaatgatgacaacatgaagagaatagcggaaagtaaactgaacataaagaaagtgaatctgagttgcttgttcgtgggagctattcccagttatgaaccaagtgatatcttcgaagatagtctacagaggtcagagtaaaatcacatctaacaacgaagcttcaaatttggccggataacgatcagacaataagaagtccagcagtaaaactatttgggaagacgtcaaagtatatccagtgggataagttggttctcttgggaagcataattcaaaggcaaagttatcgacccttgcatcaaatagcagaagtagctatcacccggagaccaggaaagctaatatgaggcagttggtggcgagttagaagcaaatgacaagctcaacttagaagtaaatgacaagcatgatattctcatgatgacaagcatgatattctcatgatgacaagcatggtatcctagtaatgacgagctgatctcgacgcataacgtgaaatgggtaacttgtatgaggttgactccaaagatatgaactatacgaagttctggaactgaagccccatcttcaagtgccgcaacccagacgaagtcagctaaaggttcaaccagggacaagtcaggtgaagagaagattccacctgcaacaggagatcgagacaagcagtacagagtggagaagctttgctaggcaagtttgttatagaaaacgcgacggaagaagtcagataagaagagaagaccgcccaacctatcttcctgctagcctcctcgaatctcggggacgagattcttgtaaggggggtggatttgtcacgtcctgataaattcatcccgaaataaaaatcattccctaaaaggaataatagaattaattaaaattcgaaaagaaattggcaaacactaaaatacgtacaagaaaaattcaaatgtggcccggagaatttttgttaaattctccttggtctaaaaggagccctcaaattttagtggaattttcagagcacaaataataattgagaagaaataaacaaagttgaaaaggttttatagttttactctgatcagaggtgtacaactgtacccacaagacacagccccacgacacatttccgtgcgccgacatgccaccacgacatatcggaaagaggccgtgacaggacccttcgcataaccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcagctaaaggaaagctacactacaagccctgccgttgcccacgctggcttgtggtaagtacgataagttcttccagggcatcccgcgaaccggtccttaattgccatgggtgcgactagcaaaactgtcacgtcctgataaattcatcccgaaataaaaatcattccctaaaaggaataatagaattaattaaaattcgaaaagaaattggcaaacactaaaatacgtacaagaaaaattcaaatgtggcccggagaatttttgttaaattctccttggtctaaaaggagccctcaaattttagtggaattttcagagcacaaataataattgagaagaaataaacaaagttgaaaaggttttataaaaagaaaaatccctaaaagtcttcttttcccccctttttccctcttgggccggctcagcccaattccctccctctctctcctctcccccgcggcccaccggcctcctcccccgcgcgcgcgccgctgacaggcgggcccgcccgccaccctcgctaacgggtggggcccacctgtcatccctatcctcgcgccgcgcccgccgcccgcccgtgccctagcgccgccgccgccgccgattccgccgcatcccgccgtccccgcgcgcaataaagtggggggaatcattccccgtgattccctctccgttttcccccgcttttccctctctctctccctcggattcgttcggatttaatcccgcaagtttcaccggcgtcattgatggagccgagatctccgcggccgattcctccctctccggccgctctctccctctcccgacgctatataattgttccccgtgcctccctcctccgtttccgccactcgccgctcgctctccccgtcggattcgtgctcgcgccgtcctcctctctctccgccgtcgccgccgagctccggttcgccgccgccgtcgctccggacttcctcccgactcggcgtcacctccatcggcttcgccgcgtcgtcgtcgacctcgtccgctcctccgtttcgcccgccgaccgccggagcaccgtcgtcctcgccgtcccgaaccgcgccgccgctttcctccactccggtcgtcgtttccgccgtcctcgtcgtcccggggtgagccgtggaccgcccctttcgcttccctctcttctccgctctctcgggcgccgctccgccgcgccggtggtcgccggcggtgaccatcggggcgcgggtgcgccgcctcccgtcggccgtgccggcgaggccgccttcgggcgcgccccgcggctgccaagtggggcccggccgtcagccgcccgcgctcgcgggtgcggctgacgcgtgggacccacggcgccggccagcgccagccgcgtgcacccggtccaccgtggaccgaggggctgccgcgtgggccccactcccgtggacccggtccgcgcgccctctctctcggctgacgcaataaacccgatttttaattaaaatttaaatgaagaaattcgcaaatatccatttaaagagcatataaacttcaaatggccatatcttggccatttgaactcggaattggaccgttcaagtctctaatttttccttaagaagtaaagaacccatttttgtgctttgtttctgctgttatatggagtttattagagtaaaagccttttcttttccgttggtcgtgtagacgctgcagcttcggaagattcgctcttcgtggaagttgaagccgacgtctgggaaagcgagcaaggcaagtcacatcatccttgagcatattgaagcccagtttacaaaattatttttttaatttaaattaatgcattatcgctttatttaaattcccgcgttatcactgttttatttagccatgcctatttacctttgttatgaccttattattattgctatggttattattaccttgttcaccctagaataaacaaaaccccaactagtggacactctatttatggttccactagtatgaatttaggtagatgcttcgctgattaataggacaacattaggtggttttataattttagactttgggaatattcatatcatttggacactatggaattgttggtttatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggtcataaacaaaagtacacggattggagatggatgaagtcgggggtcgatggacattctccagggcaaatgaaggctacacgagctgcggcccggtagtcgagatgtcatggcagagggttggtgccctgctgctagggggctcagtcctgcctgcctgtcccgggtgtcccggccgtaggtgggattgggtcggtactcttgtctatggctaggaggggttggaaactatgtcacgtcttccgtctgtataccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaagtcagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgtttaataatactgtgtagctctaggatcgtctttataaaatggctttgggcaactaagtgacttttaaatgctgtttactgcaaaacttaacccctatattattatccccttgtactcctttgcattaattgtgcatctccggtgtggcttgctgagtactgtggttgtactcattcttgctctatctttctccccccttcagtaagagaagctttggagaagaagtcttaggtggagtcctggcttataccccagttgagcgcctgtgaagatggagccgcaggcccgctagtccgctgctgtttatttttgattgtcaggcctgaagcgcctctgtaataatgtaaatattatcgatataataaagatgtgtcttttatatcatgtttgtgtggtgtaccccggcttttcctgggacggggattgatacactagcgttcgggaaaaggcaattttcccggtcgcgacaagatggtatcagagccatctcgactgtaggataagccgagtggataaaacctaaggacatattttataaataaaactatttgcgaaagttcctttttctcctttcccctgcgctatttgcaaaaggtttactcccttcttccttcttcggatttcaactagtactagatggtcaggtcagtgaagaagaagacatcgtcagttgtttgccgaagctccggaagactgcaggatccgctagtgaaatgaaggaaacagtgaagccagctgtgaagcaggagtgaagatcttggagaacccgtcgcaaaacctaagccaccctatagggtagtgttgttagtcgtgtgttccttgcttgtgtgtgtagcgcgtggtttgcatcggtgggttgtgatgtaaccatgctaggttgtttgcttaatcaacttgcagaataagtgaaacaaacaacacatcagcaagaagaattagttcctttaaggtcctgtctctagttctggtctattctttcctggcttgtttcctctctcacctcaacccctgtaacagatgtttaacagagaaaaaggaaagaatgtcagcgggtatgcctcaagtaactcaagttttcaactcaatccaccactggcctcaagagagttaaccagggcacacccttggtccattccaagcatgctgcttagttcacagctaccattagttggaagtcaagaccaaaatcagtatgtgtttgatcgagcgtttgccacccaggtcaatgagcttccaatgccagaagaggatgtccccttttgtcacgattgtagagagcaaggacactatgccctgaattgtccatgggtatatgtcaaagaagccccttcctttggtttagcagggcagacatcgctaaaccagcctcctcgcaccaagtcaagtttgcagcctagtgtgcaaagtgaagagcccaatggagacaatccattgaatcctagaaaatgctttcctcctagcctttcgcaccacgtggggtcacgtactaagcaagccaaaggcaggaagagtaagaatcagaagagaaaggcaccgatgcgaactgaagaagaagtacgtaagatgactattaccagcacagaatggcctccaccaggaatgacaaaacgtcagagaagaaataccttccgaggtgcgccacagttgacagagcaacttttagctaatggaggtagagtgtctgatagtgaagattcagatcaagtctcctcagatgatgaagatgagaagtctccccaaggtttcaaccagaataaaatggaacataaggcatgctctcgttgtagagaaatcggtcatgttgccagctcgtgtgccactacatgcgttcattgtgaggaagaccatccacccgacaggtgtccaacgagcaggatcacttgtttcttttgtgaaggaactgatcatgtaccaaaagattgtcaattcagttttctgctgacgaagaagatggccaaccaacccgccagttccaacggagagaagcatcaaggcaacacaaatcctcgccaagattacagtttcagcctgactccagtgccaggacagaggaatcaaaatgagaaaagaaaatgccgagtccgggaagatatctgttgcttcaattgtcaaggaatgggtcatttcgccgacaagtgcccaaaaccgagaaacatagctgccggcacgtcagtccacgtaactccctgcactcagaagcttgctcctcagcgaattgtcatccatgcatcccgaagcagtcctatagcccgcgttgcaacagctccaactccagcgagagcattaccacaaggtgtcaatgctcaatttcagccccagccatcagttgacaagacagaggccagtatcggcattgtacctttggatgttccagcacagcagccaaggaatcaagtacaagatgaagaacctgagcgtgagaaagttattgtctgttacaactgtagtacctgttaagggagcagacatgccaatcgccaagtggtcactggagcaaatgcagtacctgttaagcctagcgctagtcagaagcaaccataatactcttatatcagtgttcaaatacttttgttttatagttgatccccgtcaatcatgtaatgacagagaaacatgagattatgaaggagtttgataagtttatgaaggatccatgttaagattgcaagtgctgtgagttgtgtacattttgttgttgattagggagacctagggtctcatttccgtaaactcataatctattatgaatcaaataacctagcgattgatggcgaagaaaatcaagtgattaacccaagagacatttgtttggactaagagtttcagatgtgtcttcttcggatcaaaggcatgcacccgttgtggagaaattggacacgttgctagcatgtgtctcacactctgcactcattgtgaag

SEQ ID NO: 29469 - DNA, 15542 bp, Oryza sativa
  unsure (1)..(15542): unsure at all n locations
agtactgtggttgtactcattcttgctctatctttctcccccattcagtaagagaagctttggagaagaagtcttaggtggagtcctggcttataccccagttgagcgcctgtgaagatggagccgtaggcccgctagtccgctgctgtttatttttgattgtcaggcctgaagcgcctctgtaataatgtaaatattatcgatataataaagatgtgtcttttatatcatgtttgtgtggtgtaccccggcttttcctgggacggggattgatacactagcgttcgggaaaaggcaattttcccggtcgcgacaaaaaccatgcacccacagcccaccattcagtcgcattttagttggataattacgaccatgaagcatggccagatgtctcgagcacgcagctcattctgatactaaaaaggtctaatactgtaattatcccatcaactgagttagtggtaattaaggatggctaagcatacaattctagctaggtcacataagtaacatgagctagtcgatttattacccaaggttgacaaaggacagatatcaagtaaacatggcacaagcaagcagataggtaatacccgaatcccatgtaattagcaagacatgcatgtttatttgcaaacggtaaaacatttataaattgggattaacatgctcaaggggaatgtgtgacttgccttgcttcttcaaaacaatcttccgaactcttttcctcacgatcgcggacttccgaaacgacggattctacacgctggcacacaaaacgaggaaaaactctaataaaaaccaaggaaacagtacataaaaagtaaacaaacatgtagagctcaattttagatgaattttgcaagttgaacggctcaattcggagttccaatgaattagatatgaattttagaagttttgagccatttaaatgaatttctagaattaaatacgatttatgacacaattaataattattcttccaaaggagaaggggatgctgacgtcatcaagggggagaggcggcgccggcaagcgggccccaccggtcagcgacacaagggcgccggtccaccgtggaccgggaccaccgaggcggtccatcgccggtccacgggaaccgacggcccggatcggcccaaagccgatcgggcggccacgaggcggcgcggctggggcacggcacggctcaggccggcccagccaagcgatggcgcgcggcagcgcggccaccggcgacgacggccggcgacggcgcggggagcggcggcgcacgcgggcagcggcgacgcacgccagggagtggtggcgcaacgcggcaaggggaggtggcaaccggctgcccagcacaaccggcagcggcgcgggcgcggagcgcgccggcgatgaaccggccagacggccaccggcggcgacagggagcggggaggagaggagggatgctcaccaagggcggcgacggcgagacgacaacagggaagccggtggcgggctcctcggggaggcaacggtggtccggcggcataccacaggcgcgaggcggcggacggtgaccgggacgaccggggcgcggagagggcgatttcagcggttcccggtggcgaggaagtggtggccggggtgcggctcggagttgccgatccgagggaggaaacggcgcagtccggcgtcgaccggggaggcggggcgacacagatggagacggcaaacacggcggcgatctcgggttggtggtgaagttggtgctcgaggggtggagagggggaaataagaggcggccgggcttctccttgcggtggcgaagctggcggtggcggcggctcggcgcggctacggctgtggaggcgggaaacggcgaccggagttcgccggagtgtggcggcgcatgggtgcggcgtggggagagcgagggagagtatgccaggctcgggaaaaatggggaaacggacgaggggagcacggggatgctttttataggctagggaaggcgggatcgagcccgggagaggcggcaaccggcgacggagtggggcggcatcgtggcgggtgtggcggctcggcgtggcgtcgattcccgcggggagagagggggagtggggcgggatgtggtcgcgaggtggaaggggactcgggtccacgccggttgggacgaggggaggcgcgggatcggcggggggagtgggcggcgtggccgacggttggagctggccggaggttggggatgacaggtggggcccaccggtcccacctgtcggcctgagagaggaggaggaaacgggctagggaggcagtgtagacttgagggaggggagagagagagccgagctgggccgacgggctgagagaggggaagtggagggcggccgggtccaaaagagagggggggggaatttgggccgagcccgaaagggaggaaggggaagattatttccttttctttttatttaaattgattaaatgaactttgtgactttaaaattatttcttgagctccgaaaattcacgggaaaaatccggagagtatttgaaggcacaaagaatattacaaaatattcccggccaatgatttttaagggaaaattttaaattctcccattatttcacttgattaaattgatttaacttttatttaatttctagaaaatgcattattgaatgatttttaatcccgagcgaaaatcgaggcgttacaatcacccgaactatgtgggatgagttccatgccgccaaatcaacgaaagagtctcgggcaaaaagccaggcctaccgtgaactgcaggcaaggaaacttcacccgcaccggcttggcaccggaggctacgcggggaaacaggcagaatgggacaaggaggatgaagctgcagcggaatctaacaccccgcaagtgcttgctgatatcccggtctagcgggcaaggaactaggcaagggcaagggtgaagaagaatagtgacggaattctttcgttcccaaatcccaaagatcaagcggtgtaccagaaaatcgtaagttgaacacatagaataagtttcattatgttgtatcgtattcttcgtctaacgcgtcctaactgtaccccaggtcgaactgaatgctgagagacatgcctcctaagaggtctgctcacaaaaacgcgaggatgacatcctcacgaaagcgttgggaaatgaaaaacaccgtggacgaacaaggggcattggctccaatgctccatggaagtttgggtttccccaatacgcgtggcagtacaagaagcacaagctttccaaggtgcagaaagctgtacgcattaaggcccaacttcgggtggagcttaaagaagagcttagagaagagctcactgccgagctgttaggtatggaggctcggatggaggcacgcatcagggataggtcgaccaatgccactcccggtcccatagtacaagtaagccccacgcagaggagtagcaactgtgcatcaactgaggctctagcagaacagcctgaaggccccgctgcggtggaccacataacggtaaaaacaacttaataacgcatatattgtattagcaccataatacattgcaacatatactatggacactaatgaatctatcgcaggaacccacatcgtgtaccctattcgctagggtgacaccaggatttgcaattcctgccgcagagggtcaagcattctagcctaccccggagacccgagtgcatgggacgcagctgctagccggcaatgccaaagttcaggtggacttaatgaagcccgattgggttggctacactattccacacccacctaatgacgagattctgacccttggggctgcatgtgggacctttattcaatggcccaagcacaacattgagatcaatataactccaaggctagcgccaagttctcgtccgccgccgacgcgtccccattcaactgttgtatctctccctcctgccattgaacaaagagatgaagatctccaattacagtatgatactgattttggggacgacggtatggaggtcgacagcaggccgcacctcccctctcctgccaaaaggagcaagagggcgaaatcttctccacccaagcttgacacacgcagaaaagctgctggaatggggagagcaaaagtaaaggtgccattagccccaacgaagcttgatcttggcaaggcgccagtagctcctccaaagcctccagccgaattcacattgggcataccattggtcggagacgacgccttattcaagatgggccctgcatgcaaggagttgcacgggtactacatggagaagtccaacgcaaggaggaagaatagagagacctccatgttgggccagcacgatggtcagtcgttcctcgggcctactgccttcatcgtcgtagacttcaaagatctatgggacctctacagggtacgagcgatcgacaccaacctccttaagtgctactcctcgtaagtatttcttggtacgcgatatggtagtaactgtctataaattacgcttaccctgactcttgtcttgctcgtaggttaacctggaagcatgtccatcgtaaagcaccccatgttgccttactcgatccagttgtcgtcaatgagacaacactgaaaaacgatcgagcaaacatggtgggctatatcaaggactgcttatttgcccgtcaagacaagggcttcattatgtgtgcctacaatcaacagtaaacgtgtaccatacttatactcaaatactcggcgcgtacagctgtagtatgtaactggcaatttaataatttggcaagcaacattggattcttctagtaataacgccgaagtggagtttggtacactaccttaactccaatatcaagccagaaatatacgattggtcggccatcgaatctgccttgaacgaggcatgggaccaatacgtggcaagaggcgggaggcataaggatgggcatcccaaactcggtcacaagaaagacttcccaatacgtcaacaagttggcgaccagtgcgggttccatgtctgccataacataaggagcttcgcagacaaggtgacattgctcgacccagaggtgtgtaattcaattgtttatacacacataggacgacaaatttacaagtatgtagactaacttggcgccgaacatgcaggaatttatttcaaggattccggaaatcaactttgaaatcattagagaggagatagcacaattcatactagatgatatcttgtcaccgaaagggatgttagagtgaagtcctaggtatctcgtctcggaatggcagaacatttgcaatgcatatgcgacaaacatttgatttttgtaaatattctttgtaatacaattaaattctttagagtaaagtcctaggtagctcgtctctgtatatacttgcatttctaattacatataaaattgttccaatttataacttagttttgcaggttttgatgcatgtcggcggtttagagagaaaaatggatgtgaatgacatatacttcctccttttcacaatgtaagactttctagcattgccacattcatttagatgttaataaatctagacatatgtatgtgtctaaattcattaacatctatatgtatgtggccaatgctagaaagccttagattgtgaaacagagggagtatatgtgatgtgaatgcatgtgttgtgatggaatacaaatgtgaatgagttgtgaattggctgtgaatgcatgttttgtgatggaatgtaaatgctgtgatgctgggaatataaatgttgtgaattggctgtgaatgctgtgatattgggaatggggttgctgggaatgggactatatatatgtgcttctgtcaatttttgcagcgggcatggctagcaaaggcttgaggctagccaaattataaaactttattttttttttgttccaaactcatccctgatgggcatattaataatgccggaaagagaaaagtcatccatgacgggcttttagaataagcccgaaagagctaagtcatttgtgacgggctttcagagtaagcccgatagagataagtcatctgagccgggctcgtttaaataaacacgtggggtcaaaccaatcggtgacgggctctatctaaatgcccgattgagatgactagtcatctgtgacaggcttagtggtgcccgattgatattaatcatccgtgacgggctcctaacaacgctggtttgactggtcatactcatctatgacgggctttgttttcggcccgattaagataacatccatccatgacgggcttttgctcaattgagatttttcctcacatcagtgacctttacccagtgacggtggccttacccgatagtgatgatgctttcagcccatcacagataagcgatcacgttctagtgttaggtaatagagaaaatcccttgtatacccctaaaattttacctaatcccttctatacccctgaattttccttacttccttgtatacctccaaaatttgattttgatcccttgcatacctgtaacatacccgaattctaggattaaggaatttctatcaaaactagttgaaaggaaagttcttcaattttgtaaaccaaaaatttccattttaaacctaggtgaagttgatctaactcttgcatgataaaattttagaacaaattaaaacctttgcatctctaacctaggacaaaaatataaatttatgtgtaagcatgcatactctcatagacatgtttgacttgagtccttcatatgcatttggatttggattgcatttggattttcgatttgcatttcataataggtctcatgaatattaactaagatctagataaacaactaaaccattagggcctagtgctagctagaggaagttaaaatagaaaccatacaccttaaaatacatcaacaaggccaatgtcaagccccacaaaactattttggtcatccatctgaagactagtcatgaacatggaagtgaccaaataaattatatcatatagggtatattctatcttaatcatctctataagcattctcttaatttaatactaaagtaaacttatgcataataggtaaggagcttatgacctgtgtaatgtaaattgtaattctaacatatcaacatcacctcaggttaatgagagtccaaatataacttttataaacatttacatgcatttaggaaagggaaacatatataagacataagtcttgcgaattatctaaaataattcgtgcaagataaaatcatgagaaaattcatgtaggctctactcaacacatacaactcactgtaattttggtatgattcaataactaaatttggtacctcaaataaatcagtcaaactaataaaaactagattaactgtagttcttaatcggctaaaaccatactttgtctaaaagtgcatttaactgcataaaagtgtataagtaaaataatttattcaaatactaggtcatttataatgaataaaaataatttttccagaatttatcttctctgtttaggtctcctaaaaattcgaactagtttccaaagaacccatattcctctaatttctgtaagtaatctatccataatttttgagtgcaaccaaagaaaatagaaactaggtacatacacctacctccagtaaaatcaacactagttaatctgatcaacacattaagtattgaagctacaaaattagaggagaaaataattccggaaattcgtccaaaaaccaagctcacccatgtttctgcctacacatctctcttccacctagtttacctcgacctgggcccccttgtcagtccctccggcttgcctttcctctgtgcaacttccctagccagaaacactgagagggagagatcgagcgccgaccggctctggacgccgcgcgacgcgtggccacgacgtgtcgacgccctaaaaacgctgagctccatctctgcctctcccagacgcgtcgccactcttcacccaccattccagtgccgatccatccgagggagagcatcctcgctgctcttctccactggttctccatcgccggctgcgaagaagacgatggccgcaatcgttgatgagccgcggtcgtttcctcttctcttgcgttccatactctcctcaccatgccgaatatttctccttttgatttcatcctctctggtgcagccaatcggcgggaacgctgccgtgcacaccggagctctggagctgcgcaccgccgcagcgacatcgtcgccgttgccatcaatctagatcaagtcggagcgagccaccacgccaccagcttcacctcaacctcctctccatttaccctcaagaaacccatccaatggcgcagcgatcttggaggtcgacatcgtcttttccaattccgttcaaccgcttccatcatcgattccattctctctggtgagcgtcagtcaaattccatgcatgcatggcctctctagatagcctttgacctcttgcatgcaccgtattagtgactccccatacagatcgagcagcggacgtcatccctggagttgtgccatgccgccatggagcttcgccgtcgctgtgactctgcagacatccccagccttgtctagcatctcggtgagcacccagaagcctatagaacatacatgcatgcacccaattaaccaatacatgattgtagaagcacatgcatcaccacccgaaaacatcctcctttcggactcgccgccggcgttactccgatgtccactgaccaagaaaagtagaggaatggaatcgcaatagcatgatcttcattttgtcttttggtcgcacccccaaacgagccatcgtttgtcgccggtgagctcgagattgagctcagccatggctgttctgcctctctgcgtgagaaaagaagtcagggaccttgtttcgagaatttaaacaactataaggtttaatgtgcaacttttcaactcactgacatatgagcctaggtctgcgggttgattcttagaaacctcagggatctttttgtatattgatctctcactgacagtggaccccttggaaacaaaatctgaaattataaaagaacagtaactaaaacttgtaaaaatccatataaaattaaatatagctcattttaagatgattcaaatttccgtgaactcaccaaattgggaactttgatgttatggaataaaaacttgcactcacagtacaaatttagcctctaaaatttatccaagttaaatcacacataaagcacacacaaatttataaaatgcatacaaaattcattacaactcattttggagcaaactcagtttctacagatccaccaacttatgttctcctataaagcaaaatgaaatagtatacatactatacatcaaatgcctctaaaactattacctttaaatgactagttttagataagctgaattttagaagttcatataaaattcatcttagatcctttttgagtaaacccaagttctgtagaatcaccaaaacatatacttccaagttataaaataaaattatatacttactgtatgataaaagcctctaaatacttatgtaagtaataaccaccatagagcaaccttaaattgtaaaatttgtagaaaattcatctttagtctaaatgaagtgaaccaaatatctatagaaccagcaaacagtgggcttcaacatagtaaaataaaatatggaaccttctgtacaggttatagctctaaactttaaatttataggataggttctaatcacatagtatcgattgagcaatatgtatatatataaatgtacatagaaatacactctagctataatgaaacccaaataaaacttgttagaccagtgaattcatagttccattcccatccaccaaaacttaaagcacttagctcatataataatttctaggttgatataataaattgctaacatggactagagctcccctagtttataaaatatgaaccatgataataaagaccataagcctatgaactaaggttagattagttaactaaaatactcattttatacatcactagctagatgaggcaagttctagacctaaacctctaaagccatgaacctatagaacactatacacctataacacgttataatttgtaaaatacataaagaattcatattaactctaaaaattatgaaaccaaatgtgttagtcttagaaaacacatatcttcaccccagcaaacataaacttaataagaatcaccttacaacagcatttcacaatagtacctaagtaaatcctacactataccgacgaaacttctaaaattcataactcccaaataaaatgagataaaatagaaattctttcacctaaattaattttagaccagtacctattcactgtgcacaaatcatccattttagagcattttggatttttcgcatatttcggtgtttaattgcataacgtgtactttgtatagatgattgcttaaacggtgaagaagtgatttaggtgctgacattttcctgattcaaggcaagtcccacctccctctctttgatcactttgaacctatgttttggaggttattgaaaatgtttgcaaatcttgcatgtcgattgtacactaataaattaaaattttgttaaacttgttagacaaactcctattgtttgcattcaccttgaccccacatatatccatatccctcattcctaaccttaggaacaatatgactaacctcactaggttactataatgcttagccatgcttagaatggtcttccttgtcattatgggctcattacaaatatgaaaaattgattttgaaataatctggacagaactttaatacttgtgattttgataaataaaatgatggaaaacatggattttaggtttgggcctcaagtggtgcacatatggtgattagttgtgtaccgatagggggagagtgtgcccaaaccgacctaaggacttcactcaacgtcagttcatttcgtatacagtgcaaccacatgtgctagtatgggatagcccaagcttagtaaattatttatggtttagccttacattctggtaggccggtgtgtatgagttcgtataattcagaggagcttcctatttaccccgaagtggtagtttaggtgactaagcgtgtccaatacaacggtattgtgccacgtggtgggttcccgttgtgtccgccaccacggcgttaagtttaaggcgtgggcccgccacttaacggttctaggtcatataacgtgtatggcttaggatggagtaacacgtatcgtgctggtgtaaggctaaatcatgaattttggaaaagctttgttgtgggtaataaatcgggtacttatgtatcgcgtgccatgctcttgcatgattattacttcgcatcatgtgggaaaagtgtacaaactctgcagagtaaaaactaatcgattagccgtgctcgcggtcatgagcggcgtgtggatatgtattgagtatagacttgtgtttattcttctaaatgctgaaatttaccttcaaattgtgatgagatttgagaatgatctccttgctgccatggatggcaatgaggtgtacatttatacatgattaatgcctaccttgatgcccaatatgtcaagtactagcttgctgaaatttatttgaaagtaaacctgatttagaaatgttttatgcaaataaaacttgctttatgctaaaaagaaccatattatgccttccttgattatatgccttgcaagtagggtcttaggcttgtcttggtgcttgccagtacattatttctaataatgtactgactcttgctattgaattaaccttttgcttgcaggttttagatttagtctttgagtgatgcgggtaatcgactgcttcttctaggacttgaacttaatggggtaaacccctagtcggtgtgcttgtagattgggtagacaagcttccgctgttctatatatttatttggccagttggccaatgtaactaaagtagatgtagtttataatcgctttcattttatttgtgtttgctatgtataatcatgcttgagatgaaagtgtgaatctagtgcacatcctgggaactagattcacatgagtatgagttaagaatatttgagatgttgtagatctttagccatttttgtcaagtctcctgaatgtgtaacacatctggtcaccgccttcgagtggtttgacgggcacatctcaggctgaagttgactggcaggctaaaggcccggcaatgtctccaatattcctctctcgaggcgtcggatatttcattatacttgtttgatgacttgaattatacatttcatctctcaattataatggaaggtccggagagcctacgacaatacccctcccgtcagttgaccattagttgaccgtctattttctataaaaatgaccattttaaccttggatgaacaaagaaattcatgaattacattattaaaaatataaaagcttctcgcatgagactattatacttatgagtttgttgtgcaatgcattatttatcccaaaaaatatttttagataataaaataaaaaatacatatttattttttttataaaaaagtcataaaaatgaggagcattcaaataaagataggactaccaatgttcacaacattttttttataaatgctcccgataaaaaaaatctattatcctattaaaatttcaaataaaaattttaatttattacatttattttattttcaaaatttatgtcaaaattttctgcactaattatttagtctcattagttttataaaatgcacatgctgtgcaatcaaacaaaattttcaattgtttttgaagcttacatttaaacctaaagcatcaagggcaaaaaggacatttgcaaccaaacgtaacagtgaaataatggaaaatgtaacggtaggggcatggaagggatcaaactgaaatttcaggggcatagaagggatcgggtaaatttcaggggtatggaagggattgagtgagttttcaggggtacacagggaatttactctaggtaatattatacctagggtttaattatattggagccgattgtggagcatgacaatatatcggctaggctctatattttatgtacagattctaggtaggtagagaatatatagtggaggtgaggaagattatgggaagtggtatagaggtagtattgtagctgatatggagtttggatgatgactggaatttgactagcaaggtatcgactaggatttggctatgtgctagtcgatgctaaagttgggtattataacgattaggttttatatcttctctagtcggtgtcaatggacagtataacggttagagaaataagaagtttgtgcaggaagtgttactccgacaaccgtgagtggtggcggagctgttaggatcacacagagcctgagagctaactgtgcggcgtgttgtagaggtgtggggtgccaagagcagcactttgatcttgtgttaggattttgttgggctttacaaccaacggttcgacgtcgggaccagtaaaccgcgaacgtccccatagaaggcgtaaagttctaaccggcggtttttagtggctaaaggatattttgggataaaaaggaaatatttgaaaaataaaatataagtttaaattagaaattcaaatataggattaaatcaaatataacttcaaatggtatttaaatagattaaggaaattcaaataaaatatgaaaatagaaaattgggtataaaaatgtagggtttgaatttagatgaattttggtccaagtttcactgaaatcggatttacggtttaggagatatgggcttctaaagattagattttggattaaaatctagaaattgcgaaaatgtactgtgcagggcccactcttgtcagaccctttnttttctttattctctttctcttttccttcctcctcccgccttcttctttcttctcctccttccagccggttaacananaaaananagggagtngcgcccggntgctgtggtggctgngaggcnncaaccgcggcnatcggtggtgttcccgggcggcgcacctagggagggcagtggccggcagagggggttaggggaatggctggaacggcgagcgcaagtccatgaaccggcaggagagagagagaaggagaaggggaaaagtggaaaaatgggttcgccggagtgaggcaaggctggtggtgagagagtttggctagtggagctctgatgagggagatcggccgacagtggtggcagccggtcttgaggaagagagaggaagacagagctcgatgagctcggatagtgtggggaatatggacgacttcgtcggctatttataggtgatggaggtcagtggttggaggcggttccagaggcggttggcggcttggccacggcgacggtggtggcgcaaggcgaaggacggttccggaggatggcaggcggcagcgcaagccgtgggcggcggctgcggcttgggcggcacgcgcgcccatggcgcacggtggttggtggcggcgcccacgggaaggagaaaggcgactgcctctcgtgctgggcctaactgggccggaaagaggagagaaaggagaggaaaaagggatgggccggctgagggggtttcggcccaaaaaagataggaccttttaggaaattttgtagggatagaatttaaaggagatttgaatagaaaagtttgaaaggaaattatatttggatataatttctgaaagagatatttttctagtttatttgagtgcaatatttttggaaatagaatatggtggaatttatattgatgcactcaaataggagggagagatagatgaattcctaaaattgaatttgagaatgtgggataaaatagatggagagaaataaataggattttagcctcaaattatttggcattaattttggaggatataattatttgaggctaataggtaattttggatgagaaaattaattatgagctaaatgaggttttacaacttttggatgaaaggatataattgaaaactattttcttagcacaagagcaattattcacaatatttgtaataaactattcttgtgccgaaaaggaaatcaagccatggggattaaattggcggctagatcaaaaggagaaatttcagatatttggatcaaatattaagaataggtttgagatcaaagggatggtttaacaattaattccaataaaattggaattgctttggtttaggtttaagagctaaattggagggtttcttggaccacaattcataacattaaaaagggttttcaaactaaatttaaataaggaaattttagtcgaagggaggtttttaaattaaaatcaaatcaagaaataacccaagataattttaaatgaaaaccacaaaataaattaaataaaaggagaggttttatgtgagttagtttttttaaaaaagttcctctaattataatttcctaggtttacgagggttaataagaatataagaaccgacatgatgcaagattagaaaatggttaaatttagggatgttaatatatatatatatatatgtatatat

SEQ ID NO: 29470 - DNA, 14379 bp, Oryza sativa
tatatatatatgtatgtatatatatatatatatatatatatatatatatatatatatatatatatatatatatatatatatatgtatatatgtatatatatatatgtatatatgtatatatatatatatgtatatatgtatatatatatatgtatatatatatatgtatgtatgtatatatgtatgtatgtatgtatgtatgccagtgcatacacttgtgaggtgggtatgatttactacgtgaacttgtaaatcgtttattttggtgtataaacttgtctagtatgtgtaaatcaaagccaaaacatgtggtaactaattacactatgttggacgttgaataggatgttatattggcttacatgtcaagatgatattattgaatcaaatatataataagtcctgttaattataaaattaaaaatatatatagagggagtatataatggatagaaaataatagaacaaaataactacagtatgcataatggttgattttttactcatacgacatatctcatatcctcatgtgtgagtgacatataatcatactaagtcaacatgactggtcacaatataccgtttcggactaggtcgaatgcactagacaagttcgtgcaacataataagcattttacaaatttatatactaagctacgtctatgtgataagtttgtataccaccaacacagcatacttttttagatttgtatttatatatgtttgtgaggaagttacgaaaatatacgcggctcacagcacggcgatgcgggatagctgagccgcgtatattttcgtaatatacaggaccaacgacagagacggtcctgcgccctggtacggcagcaccgcatcggcctgcgcagtgcagcatcagggcaagtaccataataccacatatgttgcctctaagagtctcatattggattaaatgataagatgaaggagagaagtgaggagaaagaagatgagccacccctaaatcaagaaacaacctttacacaaatttcaagaagggtgtaagagtattaaagatattggtatttgtgtactatgggtgatatattgtataggttgtcttttagtttatgagtaaataaaatagataattttgaaggtagtagtcatatttatcatagtacttgtcctcagcatagcatcggtgccgcggccctacgcaggaccgataggagccggaaatgtgtgaggtaccggtacggtctcgtgtctcggcctcgtggaaccgatggtggaattgctgttttagttccggaaaatgcttctcatcgaacgcccgaaccaacgagaaaaatcggacggggagtctctgacacacatgcacctattcaacttgtatctctatctccaaacatgcacctttaacgatattcaaaacgaattttctctgaaattacttatccaatctacaatccgatcacaccgttgtattcgttgtaattaaatctttacaacaagatatcacatgattatattccgataaaaaataatcatatgtttcaatacgttaacactttttgtttcatacgtgatagggacatgtttcaatatgtgtcttcagcgtgtttcacaaaattcacaaaactaactgttactactctctctcctctctctctccatctcatgcatgcatacatgcattttagctagttttgaaaatgaattttctcttaaactaattatccaatctacgatccgatcacaccgttgtattctttgtaattaaatctttacaacaagatatcacatgattatattttgatgaaagaaaaatatatgtttcaatccattaacatttgttgtttcatatgtgatagcgatatgttccaacgtgtattttcatcatgtttcataaactttttaaatgttttagttgctgatattttttttcatcctatataacttgatgttccactcattagttaactggaacatttgattgactgattctttttttgagaatgctgcgcgccgggcgcccgatggcagaggaaaaatcggacgcctcgggctttctttcgctatttgctgaaacattatttttatataaggtgaaacaacacccgatttaaacgagtgaaacatttttgatctatttagtgaaacaattccgatatacctggtggaacatcgtgcaacatttaaaaataattcaataataagctaaaaaaatttcgtcggaatatatccatgtgtggttttgttttaaagatttaattgcaacgaatttaatgatgcaatcgaatcatgatttggataaataatttaagagaaaaatcagtttaaaatagtttttacacgtaaatcgggcgctgacgtcagcgtccgatttttcaccaaacatcggacgtccgaactggagttgcctcctttagttgtggttgcctgggaagtctttcaaggataacgggcggcagtactaaggctcttcacagtgcaatgagctggccagttgcttcacaactccacgcaggatggttgatggcgtggaggagagagggtgtgggccagagttccttcacatggttgctcggttccttggtgagcaacgagttcctcatcaaaaatggcttaaaaaatgcctgcaaaaaggactgagcatgcacaaaaccatcgggagacggaggggagaagaaaagcgaactgcaaagcgattccgtggtggggccggcctgaaaaaaattgagggtgggttacgcgtgcgtgcactgtggagagaggagcttcaaccacttttcctgggtttctttcatacgtggacatttgggttgcttgcccaggctcaccgcactgctactgccctaatgataatgcttgtcgcccgcgcgcgcccttggcccacgtgctacctgttggcccacccacttcttcctctctttttccacaaagatgttttatctagtgtacttataatgtttcactatttatagatctaatattgtagtgaattaaaatactcttttgcaaaaaaaaaacccacatattttggaaactctctattaagaaaatttggtttatttatgtatagatctaatgttgcagtgaacgaaatattcgattgcaacaaaaaacccacatattttggaaaccccctattaaggtaatttggtttattttttattccaccaaaaaatgttttacctagtgtaatcacaatgtttcactatgtataaatctaatgttacagtgaactgaaacattctttcgctatttgctgaaacattatttttatataaggtgaaacaacacccgatttaaacgagtgaaacattttcgatctacttaatgagacaattccgatatatctggtggaacattgtgcaacatttaaaaaaaatttaataataagctatttttttcgtcggaatatatccatgtgtggtcttgttttgaagatttaattgcaacgaatttaatagtgcaatcggattatgatttggataagtaatttaagagaaaaatcggtttaaagtagtcttgcacgtaaatcgggtgctgacgtcgagctgacgtcagcgcccgatttctcagccccggatcggccgcccgatccgtaggcgctccccagtactaatggtgtggcaactgatggcttggacgaaattccgcgtttaaacatgagaattgaatcgctgtgagatactaacctgcttccagcagtcccgagattgcaagttaggccctgtttaaacatgagatacgaatggtgtggcaaccgatggcttggacgaaattctgcgtttaaacatgagaattgaacagctgtgagatactaacctgcttccagcagtcccgagatctcaccttaaattttttttcgccatatcacatcgaacatttgaatacctgcataaatataggttaaaaaataattaattgcgaaagggcctgtagcctagtggttacaagagcctcagtagcacctgaggtcctgggttcgactccccataggagcgaattttccaggatttaacggcgctgtgctttcagtggtaggcgacgtacccgtcgacaacgaggcgcttatggtgacttcgtcagactccccataggagcgaattttccaggatttaacggcgctgtgctttcagtggtaggcgacgtacccgtcgacaacgaggcgcttatggtgacttcgtcaatctctccagaatttaccggcccagtcttcgaagatgctcagagggatagggtttgcgtgcgtgtgttcataggggtgagtgcgcgtgcgttgtaagtgtctgcgttgtactgtgtaattttcaaaaaaaaaagtttgcgtgcgtgtgttcatagaggcgtgcgtgtattcataggggtgagtgcgcgtgcgttgtgagtgtctacgttgtactgtgtaatttttttaaaaaaaaataattaattgcacatattgcgactaatttacgagacgaatcttttaaacctaattgtttcatgattttacaatgtggtgctacagtaaatatgtgctaatgatggattaattaggtttaataaattcgtctcccggtttgattctgtaattgggttttctgttagtgtccaagcacctcttacgacacgttatataatatccgatgtgacgcgctaaaacgttacatcctgaatctaaccatctagtaagttggaaacaagtgacctgttaaggctttttttcttctttgccgtgtggactgtcccgggccgtcgatcggtcccgtagctccacgtcgcgtcatgcaagctatccgcctatcccacgtctccacgccacgctatgaagcatgtacattttcgcaatttcccacaaacatgtactcactccatctcactttaagataaagataagaatgaagataaatatgaagattaagtgtttgacgtaaaataaggttgtaataacgtgtgattaattgagttttaattattttaaacttgaaaaatagattaatctaatattttagaacaattttcatatagaaagttttcgcacaaaacataccgtttagcagtttgaaaaggcgtaccatgagtgtcgacgtttgatgtcacgactacgatatttggacagtatagggatcgttggtgctaggatatacgcgagactgaggtaaaagagatggagacgaggatttgtatccaagttcgggtccctgagcggtcaggtaatagccctacatcctgttggccggagccgatgttgctttttatttaccataatcacaccagtacaatatgtgggtagcctatctaactgttgtcgacatgtcggtcggaaggtctgactcgtagtcgacaacagggtagccttcctcctcgaatccgtgcccggcgagatcagagatagcgctttcgtctctcctgacggtatccggagacaccgtaggggaatagccatgcctatccctaaagtcgatatccggcgtcttgtcttggagtatgttggcttctatgttgtggcttctatgtcgattgtgttgggtgttgattgtctcatatcatgggtgtcccatggtcggtgtccccctgtcctcctaggggggcttgtatttatacccataagtgtccccttgtccaagtagaactagagaaaccaatatagatacaatccgagtagtccttattgttttcatgtagtactctggttgtttttccttatcggaactcctcctatatccgaagattgtttccgtataggacatggtatgtggtgggtcctgccgagatttagtcaactattattaggtatgtggtatccaaaatttaatccaacttttgttggagaaaagaacaaggcctaagtgtaaccatgagttttcatgtccaattttgatcgtccgtttatttaatttttttataattagtatttttattgttatgagatgataaaacataaattgtattttgcatgtgacttatgtttttaaattttttcataaaaaatttcaaataagacagtaggcacgaaaaataacggctacacttaaaatgggacagagggagtatataaatgcaaatccatctattatatactaaaagtctattaaacttccacaaaacgctctcaagccagacgctctaataaattagaaaaatactagaaaatctgagaaaaagcaaaacaataatctcttaattttcacttaaatcgatgatccaatattataaaccgttagattaaatttcttaaaacaaattgatcgagttactcctcctcctccgctgcacaggcccacctttccttccgtttggtaagagtaagaacgtacatacatgtcattcctttttttcttttttccatttatatatagttgtgacaacaacaattattattattattaacgataataaattaaaatattggttactttacaaacatcaaatatatatatatatatatatatatatatatatatatatatataactcttttacaaatagacataaataaattacctctacaacatttggaaatgaaatttacacccattatattatattatatacccgttatattagactacttctaataaaagtatttatccattaattttttcttaaatcagcagacctattatttagaccatcatatgtatcttttgttaaaaaaacagtgcctcggaagacttctgtctgtctctctacgcaacgcaagtgggcacgtctttgccttccgaacgcatgacgaagcatcgtacctaaagcagctaaggtgatcacaatgctgcaactctactgctttgctaaggtaaagacataccaaatcatcaacggataatgattggtttttttttataacatggaaacaaaatcgaagatgtgatgtagagagaagaagaatcaaacaccgcgagttgaatataattgatttctctgtacatgtatataaatagagagaatacactcagtaccactgagtttatcgcaattctacagtctaccactgacttggttaagttccacaattaatataccatcgtgttttcttcaacttctgctctatgccatcaccatcacgagccgtcagttagaaacttagaattcgttttgtagtgttaattctctcgtaagagcaagtttaatagtatagccaactactagctctaattcatctatagccaatctaatagctcattcatacaatagttacatactacactattaatacctagtcccacctgtcatagacacactgcatcttggagtccgtgctacagctggctacaaatctgtagcccgctgctcttctctctcctgatttatctctttaaaatatatttgcagctggcttatagcttactattgtacctgctctaatgactgatatagcctttgtaaccctagataccactgcccctcgcctcacctaattccccatcgttcccctcacccccaccgaaatgcaccgccgcccatgagcctctccccatcgagatcccatggcgctgccaccgccgcgccgtcgcccaacggcgtctctactagcgacgacctggcactgccacaaccgggcaccacgcccccatcaccccaatcgcagacatcctggtggcgtcgtccccaggaccccagcaccgcagcaagcgtctgcccaccgcgcctccaacgccgccggcctccaggcgccaccgtccccatcgtcaccgatagcagtgccgcagcaaccatcgctcaccatgcctccaccaccgtgtcctggcacttccattcccaacgccgccgcaaccgccgcaatcctcccaccacgccccgaccgccccaatcatcgatgtcctggtggcgtcgtcaccggtgctgcggcaagcttctgccttccgcgcctccaccgccgatggtctcctggcgctgctgtccctagcgcagccgtccccatcgccgtcagcagcggcgccacaaccgtccgcccgcagcatctccaccatcgggacgcgccacttccgtccccaatgcgacagcaaccggacgtgggccgtgcctcccaggagctggacacagggaatgactccctggagctagctgtcgttgatgactgcatgccatgcctgttgctattgctgctccctcaattgtgtatgaactgcatgaacgtgtgttgactttctagttgactaatctaatgaaatattttggtattaaaccgtatggagttggctaatataatgaaatattttggtatgcactcctatatctataggagcttagtgtcatccatcatgttgaaaattgtttgattggatagctaaaatgagcaaaatgtgtgattttttttcctatctagttggctgaaaccatttgatggtttgcataccttttatgtgtggtgtggttgcttaaaagacaactaattaccccattgcgatggcagagagcaaaggttgaagaaaactcggtagtatattatggaacttaacaaagtcagtggtacattgtagaattacgataagctcagttgtactaagtggattctctcgtataaatataggacgaggctaaaacaaaaactaccatgtcacatacataatacacaggtaataatctaattagatgtgttaataaagaacttggtttggaaaaaaaaatttggaccccatgccccatgcatgagagaggagaagtgccatgttgcctaatatcactacaagataattaagatatcaccactaatttattacaacgaaaaataattcgtggtactatcgcaatgatatttttttttgcaaataactatactttgttgcaacgatatataatcgttgttttattcagtatttttgttgcaataggaaatgagctatcgccacaaaaaaacattactcttgcaaaaaaaacatgttttatcaccacacatttaatttttgtggcaatttgcatagtacatggtactttttactattttccattgccatgatcaacaaattcgttgcaataaaaaaaattatcatctcataatttaacttattcttttcatatggacacggattaggacaaattttatatgaaatttatagctctcgatgagatctacaacttaaaattttcatttgaaatcttttaaatactcgaattcatgattcaaatctcacttaggcagtctcaaatggaattgtatgtatttttaaacaaaattgatgcgtagatgagttggtcatggagagcgtgcgtgaggtagagatcttggatttgaatcctggtcatgacaagatatcaaaagaaaatagttaggatgagaaattaatattgaaacatttaatttggtacgtagaactaatgccacacatggagtggtggcaatagttatttattgcaacgatgtgaagtgttgcaatatatatattttgccacatccattttatggcaatatcaaattttattacaactaaataaaaatcattgcaataacctattaccacgctacttattaccacagctagcaacgattttaagattgtggcaaaatgtatctattaccacaattttagcatttcgatgctacaatttttttcatgaagataaattatttttctagtagtgatatgtaaattaaatatgatctatacgactatcattagatgatgggtgagtggaagatatataccaccgagaaataagcggagtgaaaataatgacaaatagtttacatctattatctatatgtgatggagtgacggcacgatgtgtcagcagtacaacaagtttttctttgattacgaataatgacaaagacatcgttaaggacaatatgtgcttatttgaatttccaaaagaaaaataaaagacaaatcattaaaaatgatattaattctggtgtaaatcatattaaatttattgattataatttaggcaaaattggttatatatcatcgaaagttcacgctttttgttttaaagcaccgaaagataccggttcactttaatagcacccaaagttcaccctgtttccatttttaacacttccattaattctcgatcgttttccgtccgccttgatcactattaacctagctacgcacacgatatgacatctctacccctcattgctatgcattctacttataattgtgaggggcagaaacatcatatcgcgtgtgtggctgggtcaatagcaatcaaggcggacggaaaacgactgaaaattgacagaggtgattcaatcacaagattttgagtttcttgatcccatcttttgtcttgtagctatatttgcgcggtatgcgtacaaatgatatgcatgataattcactggaggtagtttaatatttactcgatgtaaaagtcaaattaacttaatccatcttctattcggtgaatggattttgagatatgttaagaagtagaactcctaaactattttaaaatgatattgttgttcgctatctataagacaacttttgaacaaattataattttacttttcaatggtataaatgcccgcgtataagcgtgggccaccttcctagttctaaaaaaatgtatattttcgggaaaaaaaaacagattttctcccctaaaattgtcgcaagtattttagcgatttcgtattttagttgtttagctgattctagatatctccatgttgatgttttgaatcagcaataaatttttagggcttcgaaccggtgctaaaagcatatatatacggagacaaggatttagataggttcagactatttagataagaggtaataccctactcctattttagtgaattgtatccaccgagttgtattgattgtgttgtggttgttgccctggagaggctacttgggggatataaggttataataaggaaaacctggctggagtcagtatcagttttttaatctatgtacatagtagtatgcagtcggggttctatgccatgttttaagatgcaacgcaacatgacgatcaagtcctacttcattacatattgtatggatttgacctatcttctgcatcttagatatagatacgcagaccgtattgatatacgatacccatgttctctgcactccataaattaccatattaggccgcgaagctgtgagcaagttattccatcaacctcctttttttagcacaatggcaagctgctccaatgatgtcacggcgtcaccggaagacgtacgcgcctacaaatcgggtgtccaattttttttttaaaatcggacgctgtttcaccaagtagattgaaaatgtttcaatcttttgaaaagctgaaacacaaccaaatcaccttacgaaacattttgctacaacgtatgaaacaacagtttccaaaaaattgggcgttgtttcaccctatataaaaacaatgtttcagcaaatagcgaaaaaatgtttcaattcttagaaaaagtaaaacacggtcagatcgctagatgaaacaacctggttcaacgtataaaacaaacgatttaaagccattgcaacacttaaaccccgtgtacattaacaaaccacgtgtccagcaggatgaaataaacagtttcaaaatccactgcaacatttgatccatacatagtgaaacatcacgacactagctgaaacattgttggcggaacaaaaaaataaaacggatcctctttaatagagcgttttcgttatatccgggtggttgttgcaacgggcacatgcatgtggtgggggcgcggaggcgtagcgtggtgcggggcgcccaattttttctcctccatcaggctcccgacgcggaggattttcaccggatgactggtcgatcggttcatcctagagaagttcttcatcaacaatttaagctcgccttgtatgattttccagaaaccaaaaacaccatagtgaagaagaaatcctgaggtccgatccagttggtcagcacatgggcctgtttgcagttttcaggctttcaagatggtcttaaagttggtatgggaccttcaaatctattgtttcgcaattggagtcttcccaattttgtaagattgccgatagaggatggaataggcccaatgaagttgttgttttcaagaattagaacttgaaggttttccaacttttcaatccattctccgatagtaccagtaagaaaattataatctagtgtcaatagaattaaccgagaaagtttcccaatgcaatttggaactattcctgaaagtttatttccacctaatactaggttttgaagagttttcgatagattcccaatcgaatctgggataggtccagttaatttattttgtgctaatgatagagtttgcagagaactacagttccccaacgcatgtaagaatgcccagcttactctgtcgcttgcttcaaggtcattgttatcaaggtttagagcaagtagtcccgaaagcttaccaaaagaactgggcactgggccagtgaaaacattgtttgacagatctacctttcttagccctgaagcattgcccagggaagctgggatgctatcttcaaacatattatcttgcaagaaaatctgcaagagattggagagcttgtcaccaatgtcaggtgctaatgtcttgcctagcttattatcacgcaaagatagtacttgcagagatgagaggttgtagaagggatgtggaatttcgcctgagagattgttgtcagccaatgataagagctgcaaactggacaattggccaagctcactgggaatggttccctcgagttgattacttgcaatgaccatctgtcgaaggttagtgatgttcttgagggtcggaggaatggtcccagtgaaattattaacggaaaggcccagtttctttaaattggaaagcaaacttattttcggaggaattgcacctactaacgtattcttactgaggtctaaaaccgatagggtagagcaatttgtaagccaatctggaaaattcccttccaacgagttcatgctcatatcgaggatttcaagtttgtggagattgctgagaggaggtatctgcccagagaagtaattagcggacagatcaagtatacgaaggaaagtcaggtttccaacagagggggcaattgggcctgacaagccttggccggtgaggttgagcaccgtgactcgcccggggtgcttcgttgcgcatgtgacgccgttccactggcaatggggagatgttttgttccagctgttcagggctccagccgtatcgttaatggcttttctgaaatggagcaatgagagcatgtccgtgctgttttcggggacagttgcgcaacggatgccaccagctccgcgtagtagcactagcagcggcagcagctcaagaactacaagcatgctgtgtttcacagttcgctgcttagctgcaatcaaaaaagcataactcaatacatgtcagtcaaacggagggaagaatgcagtaggtcagccatacgattcccgtgcattttcttgaacgagcatgactcaaaattaaagtttttttttttttgggcgggggactcaaaattaaagttgattcgatctactgtgcatgcttatcgcctctaaagtcctataatatgttcatactgagaaaattgacaaccataattaaggcgcacgaagtgtaggaaatattaccgaagggaataaattaggttctaacctctagttggaggctgggagcaacacgctgttactgcctggaaagtggaaacgagtgtgagttgtatgtggttggctcaggcccgtggcgcccagaggtttaagaacagttgtgccgcagatttacaaccacacgcttaaattcgttctgcgattccttgtccgatatcatatacgttgccgtcgcctgaccgcaatacagaacaggccaaagctgacgactttggctttacaagatcaagcttcgttggtcgtgaactcgtgatctactccctctagacgccattgccgtccgagcaatcgtattcctgtctagactctgcattttgttccatcacgttgatgtggagctcgaagatgcaaataattcttctttttttttagaactaagatgcaaataattcgcatagacatttgggtcgccgttactaggccaacaagaggacacgaacaggcccaacaaaacgggctatgaatggagggaggcatgtggcccattgaaaggccacaggcccataatgtcacagtctgctactcatcgctaccagttcgccacgaagaaactagggctttcttctccagtcctccggttcctccgcaatgcacgcccgaagcgcggcggcgcgagccgtcgccggagggcgacggtgagacgccgcccgcgaccaaccagccaccgcccgaaggtattccgtggttcctagatctcatcagtctttactcgtagaacagtcagggtcgtcctggatgggaggcgggtaatcttttaccctggggcagctgcttgcggggttgatgttgtatttgtaaacctgtaacct

SEQ ID NO: 29471 - DNA, 803 bp, Oryza sativa
ggatccaacacgtacaagaaagggctaattgtgcaagagaaaccaagcattggtatgttgcattttctgttttagttgttgcgtgaatgaatcccttgcattcttcctggagatgaacatcaatgatatgtaatatatgatctggaaagttcctctccacaaaattggtaatggtcagctcattctcgaacatagagtctgttggtcttttgcctattagcatctccataagtactaccccaaaactataaacatcaccgctggttgatgcacggacactttgagcatactctgacaaaagggattaaatggtacttattagtgcaatttgaatctttatatagcaccatatgtggcaatgaaatttacctagagctatgtatcccatggttcccttcacaacaattgaactgttacaaccagaattcccatctgatgtcaatgaagaatcaagaacaagacttgcaatgccgaagtcccccaaatgggcactcatatcctcatctagaaggatattcgtgggcttcacatcacaatggacaataggccttccacagtcatggtgtaaatagaccaaagcatcagctatgttgacagctatgcttactctttgatccatggacaaatgtttgcgaactacaccagcatgtccatgatgcaaccatttgtccaaattaccgttatgcataaactcataaattagagctttgaaatctttacctccattgtctatcgtggagcatgcagctagtacaggaagaaggttccggtgccgaatggttcttaaaacctcacattctgat

SEQ ID NO: 29472 - DNA, 592 bp, Oryza sativa
atttgaccgttcaaatttgaaattaactgttgggaggctaaaaaattcataaaaaattcgaaaaaattccaaaaaatctcaaatttcgccctataaatagggcatgaaccccagccatttctcctcatcccacactcctcatcttgtgctctcaagtgttttaagtgctctctttgttctcaagtgtgcatttttttttattttgacaaaatttgctcaaattttgtcaaaaatcaaaattagtttcgtagttcaacagtttgatcgcagaggtttgaagagctcgcggttggaaagatgtaagtaatattcaaatttgtgtattatttgtattgtgtttgtgaattcaataaatattcgaaaatttgtttatgtcggtttaaattttcagaatggatccgaactttccataccagtcgccgtcgttcaccttgggtgatttcgaccccaactacatgtcggggtttgacggtacctccggatcggctccaactccaccatctgtggaggaggtaccggttcatacgactgtcgttgagaggtaccggttcaggcggaaacagcttcggaaggattttccggaaccgcgagc

SEQ ID NO: 29473 - DNA, 19796 bp, Oryza sativa
caatgtcattcatcaaacccaaatagaaccacccgactagatctaacctaggtgatcctagtgcaaagtctaacagttggaagacattatttctatcgcattttcactaaatttgtatttgtatatcagttttatggtgcaagaaagttttatcacgtgacatgaacttgtgaactaggactacccaaagaaaaattcctgcctatgccactgggcaagaggtgtaagcaccgataaaagttttcccaaagaagcagaaacttgtcccataaactgtttgctgataaagtgaactaactacgatatgctctctaattaactatttcatctactgtactgtaagacatatacaaatatgtagcgtctcttgttaccgtctgctcgttcggtaaaattgacgaccggaaacaagataagcagtgcttacagaaataccactcaccaatatgtcaatacggaacagcagggcgacttgtccttgtaattgattttgctcgagccgagtattacttgcttgcgttgtggtatgtacaattggctcgagaccctggactcgggcctttaaaacacagttctgtagcaccgttacatccacaggtcccgtttctcctactgtgaaaaatgccctgccgtgtcttgaccgttttgtacataataagaggataagacactgactcctttggtgtctactccgatttccatgtcctctagccatactcttcttattggcatcaccgcgtgctagagaatcaaagcaagcagtagagacttttatcttcgcagggcagtcgcggcacggctctcgccattgctgcgctgcagtccgcagctgtctgtctcttctcacgccttcaggcgatgaagcgagtcttcggcgttgctgcggttccgtcagggttcgccgtgcgcgcgaaagcgcacacactgacacacggagtttgtgcgtaagccagtgcccaagtgggccagaaggcctacaagtagtgatgcggcccagtaaaagaaaactacccatgtgggcttggaaaaagtacaccaaagatccctcaacttgtcatcgagttacaaaatcgtcccccaaccacaaaccagatatgcgggtccctcaacttacaaaactgggttgtcatttggcggttttggtcccgattttatctaacgtggcagctgagtcagcatgagacctacgtagaccccacacgtcaggacgaccacgtcatcatctctctcccctcatctcttccttccccctctctttctttctcactttcccctcgcgccggctgaccatcagggcgaggcgggatgggcggtgcggtggtgcggggacgcgacggcagtaggccgggcacaggtgggcgccgcggcggtgggcaatggtcaatccagatgtggctggggcaccgaagatggagatggcgtcatcaagatgtggctggcaccgaagatggagacgccgtcggccatggtgcgccatcaagagtggcttgtcgcggatgatggcgtagcagagcgtgcccttcctggggttcatggcgtcgtcgtcgttggggttggtgaccatgttggcgttgcggccgaagccgatgtcgctgttggttgttgcgcaagtccgggtagcaccgccagcaatggtgccgcacgacaggtagcccaaacgcctcctcgccgtgctgttcctgatccctgatgatgatgaattccagtgttaaaaaactccatcttttaatcacatcatgaatcaatcaaccaagatcgtgttcaccatttcagtgctaaaattttcagttttaattatcacatgaagcaatcaggcatcttgttcatgagtgacaagatgggatttcaattcaggcacagcacagagagtgtgatcatcaacgcgcacaattctaccagcaggtgaagaagatactactagtatgtttgcaatgcgaaacagccatcggatcgatcagtagtggttggcggtggggcagagaggtggaggcaaccgtcaatcgccctgagcaatttatcctccacctctgggtgcttggcgatgaggtagaccaccggggagatggtgaacgacgtcgtggctgacctgatgagggggtgctcgtaggtgagcatgctgatgtaatccgacgtgagcagctccctcgaggatttgttcgactctctcgccgcgagcacgacggacaggaagtccttgcgcttccgcagtgcgccaggtcgcgctccatcgccgccgcctgctcggcgacgagcggagggtccatgcgaagcccatcgccgcggcggcgaacgggatcccgcctccaccttcgcgcctaccgctgtggcctgcggcacccgacctgccaccgccgcatcgcccatcgccggcctccctttcccgccttgcctcgccccgccggccaacactatgagaaaagtgaggaagagagagggagggaggagggagagaaggggggggggttgagagatgatgacgtggtcaccctgacatgtgggacccacgttgactcagctgccacgtaggaccaaatcagggtcaaacccgctgagggatctactgcgaccggttttatatagttaagggatcccatatatcttttattgtttgaggacgttttttatcccgatgataagttgagggaccttcggtgcactttttcctgtgggctttaacattggctaaactatagctggccaaatgggccgggccaaacgggcggcccggggcacggccgaccctgtagcaggcacggcccggcacggcctgctacagtaacgggccgtgccggcacggcccgtgtagccgtgccgtgcttgggccgctggccgagcccgcgggccggcacggcacggcacggctactgtagcaggccggcacggcacggcccgggcggcccgtcaggccgaaagcgccagcggcgcactgacagggcgggcggcggtcgaatgggaaggcgccacgtggcactaacggctatttgaccgttcaaatttgaaattaactgttgggaggctaaaaaattcataaaaaattcgaaaaaattccaaaaaatctcaaatttcgccctataaatagggcatgaaccccagccatttctcctcatcccacactcctcatcttgtgctctcaagtgttttaagtgctctctttgttctcaagtgtgcatttttttttattttgacaaaatttgctcaaattttgtcaaaaatcaaaattagtttcgtagttcaacagtttgatcgcagaggtttgaagagctcgcggttggaaagatgtaagtaatattcaaatttgtgtattatttgtattgtgtttgtgaattcaataaatattcgaaaatttgtttatgtcggtttaaattttcagaatggatccgaactttccataccagtcgccgtcgttcaccttgggtgatttcgaccccaactacatgtcggggtttgacggtacctccggatcggctccaactccaccatctgtggaggaggtaccggttcatacgactgtcgttgaggaggtaccggttcaggcggagacagcttcggaaggattttccggaaccgcgagcggaagtgttttgacacacaccggctcgaagagatcgagaacctccggtgtgtggcaaagcttcgacgagataaaggaaacatgccccgacggaagggaggtatcgaaagcccgttgtagaatatgtaggcaaattttatctgctcgttcttctggtggtacaggtcacctcaagcgccatgcggagtcgtgtgccaagaagcaaggaatacaactccggcagcagcaacttatgctaaacccagacggtacggtacgcagttgggagtacgatcccatggttgctcgggaatctcttgtccggttaatcgccaggcaagatttacccctgaactttggggagtcccctgcttttgaacattacattcagcaatctcataaccctaggtttaaagctgtgagtaggcaaacatcaactagagatttagagaatgtttatcacaaggaagcaactgcacttaaggaactgtttagtacatgtactttctctgtttgtgttacttcagatatatggagtagtagagctagagaggattatcttagcgtagttgttcattttgttgatgatgattggcaattacaaaagagagttttagggcttaggttaatagatgtctcacatacaggagaaaacatagctgaaagaattagggaagtaattaatgaatttaatcttgctgataaaatatttgttgtcaccctagataatgcatctgctaattctagagctattgaaatattgcaacatttattttgtgtgtatgctcaatcttttctactccatcagcgttgtgcatgtcatataattaatttgattgttaagactggcatgaagagggtaggtgaccacatcgatgctgttcgtcaagcaatcgcgtggttaactgcttctaacccgcggattgctgcatggaagaggttttgcaatgcggccggtgtggaagctcgtaagtttgccaccgatgcagagcatcggtggaatgcaacgtatttaatgttaaaagttgttttaccttatagtagtttactttctgattttgttcagtcacgtggtggcccaagaaacagtgacgggtcttcagtactgaacgagcatgtttgggcaattgtccaaaaattttaccaatttctagaaactttttatgattgtactctaactttgtcacatgtttattatccaactgctaatataattttgcacaaccttcttgaaattgctactttatttaaagaatacgaaaatgatgacgttctaactgaacctgtctttcacatgaaacaaaaatatttgaaatattggaaaaatatacctatgttgtatgctcttgcttttgttttagatcctaggtgtaaattaaggggattgtctgctattttatcacttgttggagatactataggtgtagattatagttctttttatactgaggttagacgtaaattatatgaggtttttggaagatatgaagtaaagtttcaggaagttcgccagcggagaccccctcctatccccactacaggtaagaagaagatacagtggggtaggatttggggtggatcgtcttcaagttcaatccaaggtggtggcagttcgtcggctacaagtggagacgcctcttcgcatgttgtggccgaagagttgtccggttatttggacagcgacgccatccaccacgaagcacaagatttcaacgtcctcgggtggtggaatgaccacaagataacatatcctgtgctttcaaaactagcacgggatgtgttgacggtgcccgtgtcgacggtgtcctccgaatcggccttcagtctatgcggccgaatcatcgaagaccggaggacgactctgcgcagcgaccacgtcgaaatgctactaagcgttaaagactgggagcttgctcgacaacatgcccaatacactgcggacaaccaagaattggccgcccacttcgagcaactctacctggatccagaccaaccccagtagaattttgttagaagtagttctgacctttgagctgtactcttttctttgtcatggttttctcattttcccctatgagtttttacatgacaaagtttttaacgaggcagcatgtatcattgtatcctgtaatgatataaacattaataaaggtcattactatttttaacaaattcttttgcaatattttcgcaagtgtggatttacctttaaattatttcaaaataatgaatcacaatctatatttttaaatttttcaacacaacaaaaaaataccattttttctttttttttttaacattagcaaatcattacttttttaaaaaacttttatttccattttttaaataccattttttcattttttaacattagtaaatcattacttttttttaaacattttatttccatttttaatttttttttccttatacatttcctttgcttttttttttttaaaaaaacactgtgcacagtgcactgcaggctggcggcctgccttcacgggccgccgtgccccgaacggcccgtgggccgcgggcgtgccgtgccggcacgggcacggcccggccatccacgggccgtgcttgggccggcggctcggcacgtgggccggcacggcacggcccgtttcatcagccgtgcctaacgggccgtgccgaaacgggccgtgccggaaccgtgcccgtgccgggccgggccgtgccgcccgtttggacacctataggctaaaccagtccacaaggagcctaatagagccccatagcccatccatcgtcgtggcgaccagcaaggctgccctatctttgctccgcttccaccgttccacttcatggcaaggcaagcgccgcggcggcgcacgtcgtcggagggcagagcgaggaggcgcacggatcggcacccgtagtgggagcattgtgggtacaggtatccgagggttttctaaatctcatataatcctcgagttgttactgattaggatctgcaggttgggattgggatttagggatggaaccatctctggttgcgatattccttgcttctcagtgaaaagtgtggattagtagtattgttccatgaaatctgacattagatgtgtagattatgatttatgtgcttataaatcgccatgataagctgtgcataaacagaatcacctagcttagaaccttcacaatcctaaccagccaaactgtaaaaaccgtttaccaaaatggtgactccaaaatcaaggttagtgcgtagtgcacaccatccacatccatatgttgcaatacagaatagtagtttctcgcatctcccggatatacggagggccaatttatcatgttttatgcacatcgcattcaaagcctacaagagcacaaaattacacaacttccatcacacactgtaactctttcctgcaaagcaaatcctcccgcttggtcgcttcagcataggatgttctaattgcaagcaacttgatagctatttctctcatgttcattcgttcttttgggatcagaggagtgcaggaaagagccacttgcactacagacaacaagcatacatagaaacaattttctttcttggtcactgcttgattgaagcccttgtattcttcttggagtcgagcatcaattatctgtggtatctgctctgggaagttcttctccacaaagttgacaatgttgagctcgttctcaaacatagggtctgttggtcttttacctatcagcatctctagaagtactattccaaaactataaacatccccacaggtcgatgcatggccacattgcgcatactctaaaagaaaagacaaaatcacactaattaatacattattatgtataagtattaatgcagaaaacagattgcctttcatgaatttaaggtgtaacaagaagcatatatacctggagctatatacccgatggttcccttcaatccaatagagctatttggactgtaatgtccaagtgaggtgaatctagattcaagaatgaggcttgaaatgccgaagtctcccaaacatgcattcatatcattgtcaagaaggatattcgttggcttcaaatcacaatggacaatagacctttcacattcgtggtgtaaataggataatgcattagcaatgtcaacagctatatttactctttgagataagctcaaacattttgaagcaacactggtgttttttttatgcaaccacatgtccaagttcccattaggcatgtaatcataaatcagagctttgaaagcatttccgctatagtctattgttgaacatgcagttaggacaggaagaaggttgcgatgtcgaatgcttcttaagatctcacattctgatacgaaccttttgtctgcgcatctcatctctaggtcaaaaactttaattgcaacttttattttaaccagacttaacttcgctctatatactgaaccgtagcttcctcttccaattaagtttgactgtgagaagttccctgtagcttgggctagatccttgtaagaaaccctagggaactgctttccaaaagaaagcaacgatagatatgttcttcttggtgtcttcttcacaaggtatataaggcatatcagtactgtgagtgacaagaaaccaaatattggaatcaacaatctggcccaattgctcttcctttctgttctgtgagaaacttggtggcacgatggcatgtggagatccatcacacctccgcatagtgccctattgccttcaagataaacaaatgtagcatttctgaataatccattccttggtatttctccttggagattattacaagaaaggtccagcttgctgagtagaggtagatcccccaatactgctgggatggtgcccgataagcagttatgggaaagatttagtatgctcaagccttttaggttgccaaaagaaattggaatggttcctgtgaagaagttttggtccatttggatggtcactaagttttggcacatctccaaagcatcaggtattttcccagtaagcttgtttgatgtaagttttaggtagatgagttgtgtaagattaccaatctccagaggtatggtgccttcaagattgttgtaggtaagatccagctttaagagtagcggagggcttcccaaggagggtggtatgtgaccttcaaatgcattgttttccagatagagctctgtcaaatgtgtaagattaccaatattgtatggaataggcccagtgaacttattgtttccaagacacaaatactgcaagtatttaagatttccaatccatgggccgatggaacctgtgagattgtttacatctaacgtcagttgaattaacctggagaggtttcctatgctcggtggaactataccagacaggttgtttcctcccaaaattagaatctcaagatttgttggtaggttaccaatcgaatctggtatgactccatgtagctgatttctggctaatgacagtatttctagagtagtgcagtttcccaaagcattcaagaatgaccagctttcactgtcttttgctctaagtttgtttgcctggaggtccaatttatggatctttggaagctctccaaaggaggtaggaatcaggcctgtgaaattattaaactgaaaaactatttcttctagcattgaagcattgcctaaggaagctgggatataaccttcaagcatgttatggctcatgtagagtattttcagattagtgaaatgatcacccatgttatttggtagagtcccaccaaactgatttccgctcaactctagagcttgaagagaggacaaattaaaaaggcttgctggtataccacctgatagcatattatcccctagccccagcactgttatattggaaaattggctaagttcatcaggaatgtttcctccaagttgattcagctcaagatagacctggtctaaataggtaatgttacccagagattgagggatggcaccagttagattgttgttgttaagggccaaaaaaactagattgatgaggatacctatttgcctgggaatctcacctcgcagggagttatgatagagatgtaattccttcaggttggaacaattagtgagcgtatctgggataattccacctaacgaattgtagctcagattaaggacttgcatcttctggagattgctaagatcaggcatctggccggagaagttattacttgacagatcaagagtacgaacaaaagtcaggtttccgagtgaggcggggattgtgcctgacaagccttggccggcgaggttgagtgctgtgactcgcccggggtgcttcatcgtgcatctgacgccgttccactggcaatggggagctctcgtgtcccagttgctcagggctccagccggatcgttaattgcttttctgaaagtgagcaacgagagcatatctgtgctgttctcaggaacagttgagcaacggatgccaccaactccgtggagaagtagcaggagctcaagtacaaaaagcatgctgtgttaatttcacagttcgctgcttagctgcaacaatgaaagcataactcagtacatgtcaaccggaaggaagaatgcagtagatcagccgtatgactcccgtgcattttcttgagcgagcatgattcgttaaagttgattccatctacttatcacctccagaagtccagagtcctatagtatgttcatattgagaaaattgatacccataattaagccacacgaagtgcgtaggaaatattaccgaagagaagaaattaggtagtaacttgtagttggaggctggagcggaacaacacgctgttactgcctggaaacgagtgtgagttgagtgtggttggctcaggccccgtggcgcccagaggtttaagaacagttgtgccgcggatttacaaccacacgcttaatttcgttctacaattccttgtccggtaccatcatatacgttgccgtcgcctgaccgcaatacagaacaggccaaagctgacgactttggctttacaagaccaagcttcgttggtcgtaaattagactcatcagccgcatcccttctttgtagctgcaccccccccccatcccccacgcacccgctttatttttcctttcttattgtaatctcttagcctcttgggctattgaacagtttttccctctattttaatacaaatacaccctgcagggtttaaaaaaaaaagctccggagcgacaaagctacaggagtttggaattttgggagatatcacctagtgcttttttccgtttgcaggttggcttttggctgaccctgtacatattttctcttgtttttctgctcctctattaatataccaggcaaagcttttgccctcctttaaagaaaaaaaagcttcgttggtcgtgaactcgtgatctactccctctagacgccgttgccgtccgagcaatcgtattcctgtgtagactctgcattttgttccatcacgttgatgtggagctcgaagatgcaaataattcttctttttttttagaactaagatgcaaataattcgcatagacatttgggtcgccgtcactaggccaaccagaggacacgaacgggcccaacaaaacgggctatgaatggagggaggcatgtggcccattgaaaggccacaggcccataatgtcacggtctgctacgcatcgctaccagttcgccacgaagaaactggggctttcttctccagtcctccggttcctccgcagtgcacgcccgaagggcgcaggagcggaggcgcaaaccgtcgccggagggcggacggtgagacgtcgcccgcgaccgaccagccgccgcccgaaggtattccgtggttcctagatctcatcagtctttactcgtggggcagtcagggtcgtcctggatgggaggcgggtaatcttttaccctggggcagctgcttgcggggttaatgttgtatttgtaaacctgtaacctgaactatcttctaaatcttaataaacttcgaccggctttgcgccggtccggcaaaaaagagatcacatcagtctttactcactcgtgattagccgctgcagattctgaatttgaatcaggaaattgattttagtttggttaaaattgtgctagggagtttatgtagaatagcggtaatgttccatccatgttagttggtatatggattaagatctttgttcatctccatggctacttgtacacctactattatggccacaccattacaccacccatctgagatacttatgtacttttatgaaatccttgatgatacatcaaatccaaatccataatgtttaattcatgatagcagaaaaaatattttttcctcgcattaaagatatcaggttcatgcaaaaatcatcatctttgtgcatttatcgacaaacctggctgttacacacgcttcatggcacgctataaatcactttagcgaaccatgactagctctcttgcctaattgcatcgacatatgaagtttgaatcgcatgcaatctaatggctacttctctcatgttcatacgttttgttgggatccgacacgtacaagaaagggctaattgtgcaagagaaaccaagcattggtatgttgcattttctgttttagttgttgcatgaatgaatcccttgcattcttcctggagatgaacatcaatgatatgtaatatatgatctggaaagttcctctccacaaatttggtaatggtcagctcattctcgaacatagagtctgttggtcttttgcctattagcatctccataagtactaccccaaaactataaacatcaccgctggttgatgcacggacactttgagcatactctgacaaaagggattaaatggtacttaactacttattagtgcaatttgaatctttatatagcaccatatgtagcaatgaaatttacctggagctatgtatcccatggttcccttcacagcaattgaactgttacaactagaattcccatctgatgtcaatgaagaatcaagaacaagacttgcaatgccgaagtcccccaaatgggcactcatatcctcatctagaaggatattcgtgggcttcacatcacaatggacaataggccttccacagtcatggtgtaaatagaccaaagcatcagctatgttgacagctatgcttactctttgatccatggacaaatgtttgcgaactacaccagcatgtccatgatgcaaccatttgtccaaattaccgttatgcataaactcataaattagagctttgaaatctttacctccattgtctatcgtggagcatgcagctagtacaggaagaaggttccggtgccgaatggttcttaaaacctcacattctgatacaaaacttccgtttgcacgcctcatctcaagattaaaaaccttaatagccacttctattttggcttgagttaacttccctttatatactgaaccatagcttcctcttccaattaggttcaactcagagaagtttcctgtagcttgagctagatcgctataagaaactttagggaattgcttaccgaaagaagacagaaataagtaggttcttcttgatgtcttctttccaagagttataacataaatcaacatggtgagggacatgaagccaaatattggaatcaataatctcacgatattaggcttcctttctattttctgtgaaattgaagcgcacaaaggcatatggaaatccactgctcctccacaaagcctccagttgccatcaagtgaaacagctgtaacattttcaaatattccatttcttggtatttctccatggagatgattgtgtgaaagctctagcttactgaggagctgtaggccactcaaagcagttggtatggtccctgacaaactgttataggaaagatttagtacgttcaagctttttagattgccaaaatatactggaatgtctccagtgagaatgttttggcccaattggataactaccaagttttggctttgccccagagcattaggaatttccccagaaaacttgtttgatgaaagatgtagttcgaccagttcttgaagattaccaacctcttcaggtatgctaccttggaggttattgtagctcaggttcaatattgagagttgcgaaagatgtccaatgttgggtggaatgatgccttcgaatttattattttgcagcgagagcattgtcaactgagtaaggtttccgatggagggagtaattggtccgatcaagttgttctcacggagaaatagaccttgtagatttttcagatttccaatccattctccaatttcaccactgaaattatttttaccgagggatagtctgattaagttaggaaagttgccaatacttggggggactacccctgatatgttatttaccgaaaatattaaattttgaagattgattgatagattacctaccgaatgtggtagggatccctgcagattattttcagctactgagagcgttgttagagcagtgcagtttgtcaatgaatgcaagaattcccatccttggtttccatttgcttcaagcttgttgtacgcaaggtttagtctagacaactctgaaagccttccaaaagacgtaggaatttgcccagtgaaataattcgatgacaaatctatataccacagtcctgaagcattgcctagcgaagttggaatctgaccttcaaaattgttataatccaaggtggcctgttggagcctagggaaggcatcgccaaagttctttggcaatgccttgcctagcatattcaactccaaacttagcaactcgatacgggacaggtttagggtcgatgggatttcacctgatagcgtgttattacctataagaagaatagatagatttggcaattgccaaatcctgttaggaatgctgccctctaaataattgtttataagcctgataaagtttaagtgggtgaggttttgaacagatgctgggatgatcccagtgatattgttagctgcaaggtccaagtattctagcttggtaagggagcctatattaggaggaattacaccatgcagcaaattaccagagatgtctaatgcccttaggttggaacaatttatgagttcattgggtatagccccctctagtgcgttgatactcaagttaagggtgtccagttgctttagatggttaaggagaggaacctggccaaagaagcgatttgaggacaagtcaaggatactaagagatgtgaggtttgcaagagaggaggtgattttgcctgccaagcttctgtcggtgagattcagacctgagacgcgccatggccgtgtagtagtgcagatgacgccattccaccggcagaagtgggtgctagtgttccaagagatcaagactcctcctggatcttcagtgatacccttcttgaaatctatcagcgattgtagatctgtgttgttatcgcggacagttgagcaatggacgacgacattgttgccaactccataacatagcagcagcaacaccagttgtatgaacacggcgagtttcgtgggttgctcttgctcggaacacatatcacctgcaaaacagtaagaatgaacagggatattatgtccattttcataagatgaacatcgctgagccagtgctgcagtgcatagggcatactaccaatgaagaatcgaagataaccggtactcagctcgaacaacgcgtggccaggttttggctaagatgaataccaccggcttgggcagttgggcccctggacaatggccttaaaaacacaagtcttcagcagtgtcacacatctagcgccttgctctgctctgccgtgtcttgaccgctcctactgatcagaatcgaagatgcctactcctccggtattactcggattttccatctccagtagcagtagaccagtattccgtccgctttccaaaattttactacacgcgatgcggagtgtcagccactcagccgtggcactccactgccgactgtcttcactcttcaggcgctgcccgcggttcactcaggaaaactggactttttcctagagaatttcagcatgcggcctgttgtatcttacggcccgtgcccggccgacgaacggccgactaagaatgggccagattaacgacaaaacggcccagaaaatcagaattaaatcaagggagcaacgctgcagcatcgcccagcccagaaggacactgcctaccttcatcgacggctttgcctgaccaagctccgccgccgaccaccgcactcgatctaggtttgcaggctgtgacgcgcgcggtcgccccgtcgccagatggcggagcgtgaggcctggactcctagatctcatttgtgatagccgatgcgtatctgcagtttgggatttggatcaggaacctggtctttgttcggttgaaattgtgctaaggtttttatccatgaaacttgacgcctggatggatggatcaggattatgatatttgtttagccccacgacagtttgtccaaaacaaattgcctatacttgaaacgatccttaacgagccattagtatagaacttttggattctgaatggggcaccagggagagcttagtagcttatgcaatcatagccagatgtagcagtaaaatagcggcgcaatttatctctctcaacgtgagagaattaccatgtttatgcctatgcctacgatactggctcagatcatggtatcactgcggtgattggtgaaacctggctagcttgcattcggttggccgttacatcatatgacattttaatcgcatgtaacctgttagctacttctttcatgttcattcgttcccttgggcataggcgtgtacaagaaaaagcaacttgcaggagggacagcaagcatgcatggataaacgccattttcttctactgctgttgcttcaataaatcccttgcactcttcttggagatgaacatcaattacgtgtgctaatcttatccggaaggttcctctcagacaaaattgagagtgttcagtccattgttaaacacgggatccgaaggtcttttgccgggcactatttctagaaatactattccgaaactgtagacatccccactaattgagcgaaaaaacgaaaaaaaaagaacgaaaattgatgttttacactttgagtacaatgtaaaagctcactttttagagtaaacaatagattgctttacatgatttcaagatgtgggaataacggagcaatatatccaaatagttcccttcaatccgattgaattgttaaaacttgaatctaaacctgaatggcaagccgatgtttatgtactagaatttttttctcgaaccacatggtcccgaattcccaattagtgaaacactgtagcactactgaatacacaagggtattactcctcggaatttattgtaagacatatctagtttagtgaggttcaaatcatttggagaaattgaaggggcctgacaaattgttatgggaaaactccttagaagatggtcggaatgtttcctatagaactgaaattagcaagggaccagacatattggtccatttgaatgatcagtaactactgagtactgacattggcccaaggtttaaggaatttccccactaaatttgtttgacgaaaggtctagtcgtgagagttgtttaagattaccaaactcaaaaggtatgctcccttggagattgttatagctaaggtttagtatcagcaagttttgaagacctccccagctaggtggtacagaaccagttaagtcatttttcgcaatagacaaaaacaccaattgtgtaagattgcaaatggagggtggaattgtcccgacaaagttgttcatttggagatttaagcgttgtagcttggtgagttttccgatccattcttcaattgtaccggtaagattactttcgtctagcgagagttgaattaaatcatgaagttttcctatgcttggaggaacaattcccgatagcttgtttccacccatcagtacatattgaagatttacagaaaagttaccaatcgaatttggtatgactccctgtagctgattattagataatgaaaacccattgagagaagtacaatttgccaatgcatggaagaattcccagctttcgctgtcatttgcttcaagcttgttattctcaaggtttagataggacacacttgaaagcttcccaaaagagcttgggacatggccacttaaatgattgagccttagatccaattctgttaactctgaagcattgcctattgaatatgggatgttacctttgaacatgttgtttcctaagtataggagttggatgtttggtagggcgtcgccgatgttagatggcaatgtgctgcctaacatattggacgtcaaggataacatcgtaagagaagacttgttagggagactttgtgggagttcacctgacagattattttggtttaggtacaacaccccgatgttttgcaactgccaaaactcgttaggaatgcgaccgttgagttgattttctgaaagatcgacatactgtaaactggcaatttttccgagggcttccgggatgatcccagcgagattgttctgggaaaggtccaaaccaagtagcatggaaagattccatatggtaggaggaatcctacccgttagattgttgctagagaggactaaggcggtcaggctggagcaatttgcaagtccatctggaataattccgttcaaactgttttgactcagattaaggacttctaggtgttgaagatcatttagaagaggtatgggaccataaaagttattatcacggagaagaagctttcgtaggaacgttaagtttccaagagaagatgagatctggcctgatagactttttctagtgaggttgagccccgtgacgcgccaaggcctcgcctggctgcagttgacaccgttccaactacagaagtggatgctggcgttccaattgctcaaggctccatttggatcgctggtgatgccctgcttgaacccgagcagcgcctgcagatcgacgctgtaatcatcatggttaggtaggcacctgacgttgccaaatccgcaagtcagtagcagcaatgccaacagtacaaccatgttgctttgcacacatgaagctttcgtcacctgcaaaagataaaaggcatatatgtataatcgttcaagtagattagcagaccttattatgtataataaggtccgaggaacttattgtctcctctgcagctgaccataatcgattgaacgatcatacggttcacatcgaccttatcttttttctttttcgaatggtcagccgttgccgacgttttatataaagaagaaggtgtcctattttaaagagaaaatgggaccaaacctggtagtgcacagttcattaaggaaaagtgggcaaaaaccacaactactcatatgtaagcaggatatgcgcctaccctaagtaatcttgcaacaagaaataagagaaacggcatgtatgaaatactaactgacaagagattagcagacctcttcctcgttctgacatgtcaaaatttcctcggacctgttctgctagaccttaatacagttgtacttggctcaggcaccagcgccatggggttgggtttaaaagagttgtatttcactgtcacgtccgcaagatattattctgttcatcatgcatgctttgccgtagcttgaccgcttttacagatgtgacactcgacttcatcagaatagtaaacgatttctcccaagcactttgtcctcgtgctggtgttgctatctagtaacaagatttacgaacaaggctccgtcgtttcgtttattcgatatttacaaataaaaaataatttttgaataaaacttttatatacgagcaaaggctgaaaaataaactttaatgaaaaaacccccaaaatcaacttcaaatttaaggttggaaattcaaattttggctgataagcataagtataagtataagcgaaaagataaaaccgatatttactatctagccagggacaaaaacgtccgcaaaaaatatttaaatgaaaaatgctttacaaatgcaagaaacaacgaaaatggcattagaactaatgcccacggtttgaaagtgggcattcgagcaaatatcatttaacgattacatcctagttgaaatttctcgttatttaccacctcttcctaacttatattcttttttgagtaaaatgcaccagcggtccttaaacttgtcaggaggtttcacttagatccataaacttgcaaagcgcacattgaggtccctaaacttggtttattata

SEQ ID NO: 29474 - DNA, 2978 bp, Oryza sativa
atgtcatcgttcacgtggcgtgccacataggcaagaccatggtcaaaagtggctttggacctggatgatacaataaaccaagtttagagattttgatgtgcgctttgcaagttcgtgaacctaagtaaaaccttctgacaagtttaaggaccgtttgtgcattttactcttcttttttttacacgcacattttccaaaccgctaatcctaaaccctaaacggcttttttttaaaaaaagtttatatagaaaagttgctttaaaaattatattaatctatcttttaaatttattttatctttaattaattatacgctaattgatcaccccgttttacgtgaaggttggtgaagtttttaaccactaccttcaaacgcagcctgaagatgttatctgtggagatatatatatcatataagtcgagcacacacaagtattatattgtcattgcgaggtagacgggaattaggagtggttaggcctattcaagccagagcccgcagtaaataagacatgcagtgctttatgcatacagtctaatcagaaaacaaaacaagagaaagttaacgaacctctgctcgaacagggagcaccgccacggcgaactctccctgtaatcgtcggtttgccgtagactagagatactaatgccgtgtgtttagttttttcttcaaactttcaatttttccatcacatcaaaactttactacacatagaaactttcaatttttccatcacatcattctaatttcaacaaaacttccaattttgatgtgaactaaacacagcctaattaacatacatatatagcgggtttagtcccctggatacataaaacgcagttccacggctctacagtagtgttgcatccactgccatggcccattgctaagagaagagaagacagagcgactcctttggtgtttactgtttactccgatttttcgtctccaggagtttgtcctctttgctagtgttctctgattcgcgtgttagggaaatgggaatgaaatccggcaggaccgcagaagattttccttttcttatctttttcccctcttaaggtagtgggctagtggctgcatatgcttctcgtgaggaagcgtcttcggcgtcgaataagttcacctgacgtcccttaactttacattgaatttgtctgagatccccaatcctcaatgccagaaatctctacccctcaactatccctgaccatgtaaaaaaggtcttgaggcagtatagacccaatttatccctggttttactgacgtggtgtacggtgggccccacatgttagcgctcacttggtgtcagcgtcgtcagctcctctgtcgagccggaacatcagcccggtgtgggtgcaggccactgttgcacctgctgcgagttgccgtcggcggtcaccgccgaggccacctcactttggatcggctgcaccatggaggggccttcatcatcgcctcctactgctgaggccgctcctcttgcgcgcttcgtgccgccctcctcatcgtcccccatgactgtctacgacacggttagtccataaggatcagacacctatatcccaggaccatacaaacccgttacatgaaatgcgccaaagccaaagcaagccccgtcaacatgcttaaacttgaaaagcttcaatgcagaaaaagtgacgcttgtggtgattgttgtggtggtgatggtggtggtggacacggtgaccgccacagatccagcggaaaatgtggcatgtcacagatgatccacgactcgctagtgttcgacgatggtcaccgtgtagtgggtggcaaggtgcggtcatggagcaccattcaccaccctcgacaagcctgtggtggtgatgggaccaggggcagccggagccacgccgtggaggcgcagcaggcgtcgccgctatcgatgcccgtctaaacactgaagccgcaaggcgagtcgtcctctagtgtgggctacagagacggcagcgagccacgggcgatgtgcccgtgcaagatctcataggatacgcctaggggtggcggcgacggtggccatgaaaaggtggtggaaccaggcggtgacctcggtgaccgcgggtcacaccaccgctccacctcgagcagcgggtcgccacccacgaagaccgttggttcatgatgctcgcccgcctgtcccacaccctattccccgtcaccaagccgctcgccttgccgtccccatcgccacggctcccccgtgaaggaggcactgagttgccatcacaacgcctgcctgccctgcgctccgtcccccatcgcctcgtagtccctgtcatcatgcacgcgccccccgtcccctatcacctcgccgtccccatcaccgtgcctctcccctcccatctcataccggccgcctcccctctaccctgttccctcctcccatcgcgaggcgctcaaggcgacggagcttggccgggctcaccagtcaccagctgcctctcccctctctcacgccaccggcctcccaagattgctaaagagaagataagaaagaaaagaaaacgaggagagaagaaaagaaagaaagaagagataagggccccacatttttttactcacttacatgtggatctcgtaattttattattttttattttgctgactaggatgccacgttaaaaaaaccaaagaccatacttgccctgggtcttgtataatttaaaggtgaagatggcgttgccccctggtggcatgctcgttacaacgcagggtttgcacgcgccgtggctctagaagtggtagaacggcccaggtagtatacatatggcccaacaaagcaaagctatcagcagccgaagtgccgaacaaagccatcttctgttccacttcaccgcgaggttgcaaccctgcaggagcggcggtgcacgttggcgccgggcggaagactcgccgacctcgcgcggcggcgtcttcctcttcttcaccttaggagaatcgacggcctcagtca

SEQ ID NO: 29475 - DNA, 2600 bp, Oryza sativa
  unsure (1)..(2600): unsure at all n locations
tacccccactatatattgcagtacagaagagtagtttctcacacacacatccagtgtatgctgatggccaatttatcatgttttatgcacgttgcattcaaaatcaacagacaacacaattacacaagttccatggtacattgtaactcccttcttcgaagcttatcgtctcgcttggttgcttcagcataggatgttctgattgcttgcagcttaatagctatttctctaatgtccattcgttctcttgggatcggatgagtgcaagaaagagcaacctgcactacagacaacaagcatttatagaacctattttcttgctcgatcctttcttgattgaagcctttgcattcttcttggagttgagcatcaattatatgtggtatctgctctgggaagctcttctccacaaagttgacaatgttgagctcattctcaaacataggatctgttggtcttttacctgtcagcatctctagaagtactattccaaaaccgtaaacatccccataggtcgatgcattgccacactgtgcatactctaaaagaaaagataaaatcacactaattagtacaatgcaacgtctaagtattacttcagaaaacaaattgcctttcatgaattgaagatgtggcaataaccatatatacctggagctatataccctatggttcctttcaatccaattaagctattcggacaggaatgtccaagtgaggcaaatttagactcaagaatgaggcttgaaattccgaagtctcccaaatatgcattcatatcactgtcaagaaggatattcgttggcttcaaatcacaatggataatagatctttcacattcgtggtgtaaataggacagtgcattagcaatgtcaacagctatatttactctctgagataagctcaaacattttgaagcaacactggtattttttttatgcaaccacatatccaagttcccattaggcatgtattcataaatcagagctttgaaatcatttccactatagtctattgttgaacacgccgttaggataggaagaaggtttcgatgtcgaatgcttcttaagatctcacattctgatatgaagctttcgtctgcgcatctcgtctctaggtcaaaaactttaatagcaacttgtattttaaccggacttaacttagctctatatactgaactgtagcttcctcttccaattaagtttaaccgtgagaagttccctgtagcttgggctatatccttgtaagaaaccctagggaactgctttccaaaagaaagcaacgatagatatgttcttcttggtgtcttcttcacaaggtatataaggcatatcagcaccgtgagtgacaagaaaccaactattggaatcaacaatctggtcaaattgctcttcctttctattctgtgagaaacttgggggcacgatggcatatggagatccataactcctccgcatagtcccctattgccttcaagataaacagatgtagcatttctgaataatccattccttggtatttctccttggagattgttataagcaaggtccagattgctgagtagaggtagatcccccagtactgctgggatggtgcccgataagatgttatgggaaaggtccagattgctgagtagaggtagatcccccagtactgctgggatggtgcccgataagatgttatgggaaagatttagtacgctcaagccttttaggttgtaaagagtaattggaatggttcctgtgagaaagttttggtccatttggatgatcactaagttgtggcacatccccagagaatcaggtattttcccagtaagcttgtttgatgtaagttgtaggtagatgagttgtctaagattactgatctctggaggtatggtaccttgaagactgttgtagctaagatccagctttaacattagcgaagggtttcccaaggagggtggtatgtgaccttcgaatgcattgttttccatatagagctctgtcagctgtgtaagattgccaatggagtatggaataggcccagtgaacatgttcttttgaagatataaagattgcaagtttttaagattaccaatccattggtcgatggcacctgctaaactgttttcatcaagtgccagtagaatcaacccagagaggttccctatgctaggtggaattataccagataatttgtttccacccaaaatgagatattgaagagtgctaggtaggcaaccaattgaattcggtataactccctgtagttgatttgcatttagtgcgagcatttttagcgccgtgcagtttgtcaacacatccaggaatttccatccttctgtatcttttgcttcaagcatgtttagctgaaggtctagtttagacagtcgtaaaagcttaaccaaggaagtagggatccggcctgtgaaattgttggattgtagaacaatatcttctagcattgaggcattgcttaaggaagctggaatgtgaccctcgagtatgttgtgacccatgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 29476 - DNA, 501 bp, Oryza sativa
  unsure (1)..(501): unsure at all n locations
aaaagaaacaacggaaaaaaaccaaatatgtgctgccgatgacttgcgcaggcggcgcctcgctcctgcagctgcatggccgctaaaccgacagcttgtgcgagatccctcacgccgccgagagtgcctcccacggtcgagctcgtagttgccgggagtggaatgtaatggagccgctcgtggtccatgtcgctgcccatgccgtcggtcgagcttccaccagcttcggcggccacctctcagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 29477 - DNA, 834 bp, Oryza sativa
gagacatgcttgtataaccaccggcggcaattgagtcggagataaagtgggatgattggggaggcgacgttggcggcctcgtcgttgtcgtgttcaccacggccggccatgtcttggaagggagaggggagaagaggatggggtcgcagctcgcaaatctcgacctcctccctgacgttgccacccccgacgcctagctcctctccagtggccgcccgccattgcgccgaccctcctctctgccgcgctccgccctcgttggccgctgacagtcgcccatcgcgtcggccctcctcttcgccgcgctcctcccctaccagccgccggccgctggccgcacccgcgatttgatgctgtccacttctcaagtcggtctttaaagttctataaaggtaggaaaatatgatttggaaaatatattagccccttagctttttcttcaccaattgaccaatctaccacagatttgatcatgtatgtcaaggtattgactagcactccagattgattaatcaaggcataatgcacggctgagtcaatatgatcctgtagagttggcttgcattcttctttagtcccatcttgtgcatcttcagtcttcttactagtctcctccagtaagcttcggcaactcaactttattcttctgaatcaacttgccttgccgagtaatgtgtaagaatcaagatacatcttgtcggtgacatgggatcgggagtatcatgactagaggtttgaggcagacacagtcgcccacgtggcctggcaccctcgggggacgtcgggcccgaaggtggtgtgttcgccctcctcttagtccccccgagggggtcg

SEQ ID NO: 29478 - DNA, 285 bp, Oryza sativa
tggatcccccagtttttaggctttactctgggcctataccaactccaggacatccaattctgatccacctaaaatcaactgggttttacgagtttggaaatgaaaaagtacatgataaggtccctcaacttatcacttgaattataaaaatcgtgcactcaacccgaaaaaccagaatatataaacatactcttaagcttacaaaaatcaggctcacgtctggtgtcctccataccggtattaaaccctcgtatcttctcctccccgtcatgctcccatgcctac

SEQ ID NO: 29479 - DNA, 630 bp, Oryza sativa
atttttgcaccttccaaatacaacttgctgtgtagacaagttgaaaactcaaattcttatccaggatattgctactattgtacagttaagttatgccagtttgtggagaaattagtgtttcataccataactttgaatgcagttggcaccatggcatctacagagtaccatctcagtttactgaatctctgattatttttgctctacttggattggaggaagaggaattgtgaagccagtatactgtccaaaggagagctcatatagtcttcttaatatttgttgtctcagaggatgtgtcggcttcctgccaagtgccgaccaccaaaaaatcaattctccttcaaattcttcccgtgacatctctgtttcttgttgtattgttcctttgttgaaaatttgaagacatcaagctgatctctgaactggtgacatcatctgccactttgcattggctgttctgcaggtatgaccatatgaatattttgttttgacaaacaagtgcaatttatggtgctttttgttaggaaaatgccaacattctttatagaaagttaacatgcaggttgtggttagttctctgatgcctgaatataattgcaattcgattacaaccaagcctgcatattt

SEQ ID NO: 29480 - DNA, 410 bp, Oryza sativa
cctcggcggcaagaagtcggacgccaaccgccgcatgcaggtgcccggcctagacaactgaagatcgccttaccaaacaaatccttttgttatctgtgatacccatgttacagtgcagcttactagtttttacattgcgcaacgagattttgtactaatgctttagcatgagattttaagtatggtcaatccagcaattatgttggtatgaatgatgttgggtgcaggttcgttgctgattttctgtgttccatgcattgctgattgcctgcttgaaattatcttaggattaattttaggtgttctctttgtgaatttcattgattgttattatctgttttgatgattgctgagaagagagggggaaaaaatccacccatcaaaattcaaaatctctttggactgaaaca

SEQ ID NO: 29481 - DNA, 559 bp, Oryza sativa
gtcaaacgttagacataaatagtgtaaaactgcatttattttgggacggagggagtataacgaatctaaactggagcagatttattatactaaattatgtcatattttattttaggttaggtttttcagtgacggcagagtgccaagagaagaaaatactagcagaggcagagacgatcagacgaatggctggcctctctacccacacccatgccaaggcatgaggatgatgttgtccttgtccacagtgcacagacactggtgcaccgtgatgcacagtcgcacacaggcacacagccttcttcacgaagccatatccctcattcccctctatatataagccagcaagctgcgccatgtcatatcccccgctaaactctccgcccgcgcagccttgcactcgcgtcgcacatatcgacccatccatccggcacgcatgcaggcgcagcaggccatggacgagcccgccaacgcgcagctgtacggccacgctcacgcgcactcgcaccaccaccggagcaagcgcccgtcgcccggtggcggcggcggcggcgcggcg

SEQ ID NO: 29482 - DNA, 994 bp, Oryza sativa
aatggaacatcttccggtgcaccttgtgaggcaaacaaagtgctgtggtccagcattcatgacgcagatgtatccttgcgaaaggtacctggggatccttaagggttatgtacggaaccgttcacaccccgaggggagtatcatcgagagttacaccaccgaagaggcctcgaattttgtgtggactacatgtcagaaacatcttcaatggattaccacgatctcatcacgaagggaggcttgacggtgttggtactgttggaagaaagactattaggttggatcgtaaggtgtacgataaagctcatttcacggtactacagcatatgactgaggtggtgccgtacgttgacgaacaccttgcagttatccgacaagagacccaggccgatcagagagttgggtcaggaataagcacatgtcttctttcaacgagtggctgaagaaccgaattgccaggttgcagaacttgcctagtgaaacacttcagtggttgtcacagggtcctgaatggagtgccaccacctggcaaggatatgacataaatggatacacctttcacacggtcaagcaagacagcaaatgcacagtgcagaacagtgggttacgcatcgaggctgctagtgacggtggtcgtcgtgatcaatactatggtagagttgagcaaatattggagctagattacttgaagttcaaagtcccgttgtttcgttgtcgatgggtctatcttcgcaatgtaaaagttgacaatgaaggtttcaccactgtcaacttggctaacaacgcgtacaaggatgaaccgttcgttctcgccaaacaagttgttcaagtgttctacatagttgacccgtgtaaaaagaaactacatgttgttcgtgaagggaaaaggagaattgttggattggacaatattgcagacgaggatgattacaaccagcacgtccacggcataggtcaagaaatacctttagaagaggaggaggaagaagatgaa

SEQ ID NO: 29483 - DNA, 5563 bp, Oryza sativa
tgcgaaattgcgttcatgaatgcacatagctttgttattgatgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgtttcatatgcttcagatcattacgtgcttccagtgtatctttcgactttccgtatacacctaggaagccaagaaggtttacgcaaaggttcttagtgaggtgcatcacgtcgattgcgtggcgtacgtccatgaattcccaatatggtaactcccaaaatatagagttctttttccacatcgccgcgtgaccatcttcgctctctatatgctggcttcaggcccctttccgaacactactttaagatctttaaccatagcaaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtaggttaaactcctcctgtttgtcctcgtcccacacggggacaccttccttcttccacaactgtttaagatcttcgaccagtggtcttaggtacacgtcgatgtcgttaccaggttgcttggggccttgaataataatcggcatcattatgtacttcctcttcatgcatagccagggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcacaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttcccccccgaaagaatgttcttgacgagtttcaataaatcgccaaatgccttgtcactaaccccattttttgccttccattgcaacaactccagagtggtatccaacgttttgttcccctgctcgcaacctgggtacaacgaagttctgtggtcctccaacatcttgtccaatttatgggcctccttttcactttcgcagtcctccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcttggatgcagaatactccttctgattcttacacttattgcatggacaacaaataaaacccctttgcctgttagcttcggccactcaaaaaatagtgcacgccgtcaataaactctttggaccgccggtcagcgtacatccattgccgatccatctacatgagtcaaaaaaaccgcacacaaataattattcttacaataatgacagtcatacaataattataagatatctttattcatacaaaaattataaaatattacaccaaataattcttaaaaactatttgtaaatttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaaagtgtgcaaaacataggtgcaaatgtagtatgacaaaaaaaaacattggaggatgaagttgcaaaccttttaggcacctccgatttgtatgtaatcaccaaaataaattcaatagaaattttggcatgacctcccctcttttttaaagtaattttgaagcttgctcgggcagctggaggaggaagaagacatatatataggggtgggactttagtcccggttggtagcaccaaccgggactaaagatcactgggatcattagtcccggttagtattaccaaccgggactaaagttaagatctttagtcccggttggtagcaccaaccggggctaaagatcaccgggatctttagtcccggttggtaagttaagatctttagtcccggttggtgttaccaaccgggactaaagatcccgggggggcctgacaggtcctgacagcattcgaaccgggactaaagatgatttttagtcccggttggtaacacaaaccgggactaaagatcaaatatgcccgtttcccttttgaaccggggctaaagatgatctttagccccggtttttattgcatccgggactattgtggaaatcggccgaccgacgaaagatggtttctccaccagtggactataccgtaaagataaacatcacagggaaatacgatataagcatgcattcttgggtgcatgcatgtcaataaaaggaatttgggagcaacaaatatcatgctgagttgatgactatgtgcacgattgcattcttggcaccacctattgtatcctcatttgttgcacgtttggcatgcattgtcgaagaaaacctttcatgtaattatggattaaatgcgttccagacttatcaaaattattggtcctaatagtttgctacttatggaacaatttttttttgttaaccatcctaaccaacaagatcgattattggattactcaactattgcaaaagcatacccttctatcaacaatttcagatatttgacacccttaaactataagaaaattcttctatacccttgaatttttagctaatcccttctatgtccctaaattttgcttactttcttgtatacctccaaaatttgattttgatcccttccatacccctatcgtcagttgaccgtctaatttctataacaatgaccattttaccctttggacgaacatagaaattcataaattacattattaaaaatgtaaaagtttatcgcataagactattatagttatgagtttgttgtgcgatgcattatttatcacacaatttatttttagataaagaaataaaaaatatgtatttattttttaaaaaaagtcataaaaaatgatgagcattcgtataaggataggactaccaatgctcacaataatttttttatgaatgctgccaatcaaaaatatccattgtcctattaaaatttcaaataaaaaatttaatttatttttattttcaaaatttatgtcaaaatttttcgcactaattatttagtctcattagttttataaaatgcacatattgtgcacttaaacaaaattttcaatcatttttcaaccttatattcaaacctaaagcatcatgggcaaaaaagacatttgcaaccaaaggaaaatgtaatagtaggggtatggaagggatcaagttaaaattttaggggtatataagggatcaggtaaatttcagaggtatgaaaagaattgagtgagttttcaggggcacacagggaatttactcttaaactatttaatctggacaaattacctagcacgcaaacaaatattggtacaacagctgaaccaaatacaacagtgtacgtacgtgtaccatagtcactgcctataaaaccatcatgatatttatcgtgacaggttccttttctttatatgacatgcacccacactaatgcacactttatcgtatttccatgtactatggtacactacaggtcagcctctaccttgatttgccgagaggtttgctagagtgacttttagcgatgagcggtaaagccccaagcccccaatcagcacttcaaacatttcttagaatcgtagggaaaaaaaagggcaattgcgcacgtgtttgttggctgtacatgatagttagagcgggcgggtcactggctctcgggttgcacagggtcgtaacaaattaggcttggctaggctcggacgctcggttagagaaacgagttaaagcgtgagctcgtcttggcttgttttctggcttgagctggcttgtgagcctacctgttgaagcatctcttcatgtataatttgtaatcattaagaaagcaagaacaaattattgacatgtaaaattaaaacaagttcatatattcaattcttcaaaatccagatgataaattacaatttgatatattaataactccactaaaaagtaaaataatccatataagtacatgacgacataggctcataagccaactcgtgctcacgagccaaataagcggctctagagccatcaacgagctgaaaacggaagcttgggcttgactctttggcatagagccgagccgagccatgctcgagctggacccaaacaaactggatggttggatctcgatccaaccgtttaagcctcgctcgtcagtgttgttcgttatcatcggaacaattgaaaaggtaacatatgctgacttgcactttagtgctaacattttcctgttcttgtttgttcaaagaagaattatgaaactgtttcaaaaaaaagaagaattaggaaacagtaacatgttagtagtagtagtagtattatgagcaaaagcatgggcagaaattgcctgagagattgtgtgtgtgtgtttgttattacaaggaggagcagtgtctgacgttaattggagaccatgatggtgccgggcctgctaatgggctggatggcaatgggctaaatcgactggtttgtaattaagattgcctttggttggcggattaagtctactaatcatccctcaactttacgtcgagtttatttgacatcccttgtctcccaacaccagaaatcatcactcctaaactatacaaaccgtgcaatttaggtcctataatagtataggctgtgttaagttcctgaaa

SEQ ID NO: 29484 - DNA, 14353 bp, Oryza sativa
ccgtgcaatttaggtcctataatagtataggctgtgttaagttcctgaaaaaagttggaagttcagaaaaaaagttggaagtttgtgtataggaaagtttgggatgtgatgtgatgtgatggaaagttgaaagtttgtggtagttgggggtgaactaaacacggccatagttatctggtttcgttgacgtggcatactagttaaaaaaaagatatggggcccacaaattagcctattctttcttctcttttcttgccaactatgggagggagggggaggcggaggagtcggccaccggcgggatggccggcgacggcacctccaaggacggcaagctcggcagcaccacgacaaccatctcgccagctcggtgatggtggagaagagaagggtggcggcgaggttgcattcttcccttctcactccttcctcttcctcctgatccggtgtcttcttccttttccctccgtatccggcgtctcggcgaggtcttgtgttggcctcgcccgagggaagccgtcgccagaagtagagatgggccaccatggcgaaggtccgagaggtggcggccgcgggagcccatggccggccacttttggtgtccgtacccgttgcgatgaccgagttgagccggtcgacgatcggctattgggtcggtatcaaccaacgctttgcgcatcaagtgaaagatgcaccatttgactgatgattgggtagcactggtagctggtggcccctatgggagtgggtgggcgtcggcctcagtgtttgcgggcatgcatattagtattattgagaaagacctagcgctagcggctagtgatcgatcagctcatgctgatattgcacggtctgatcgacgaggaaatctcactacgcggctcttcacgaggtggctacagcaagataggtgggcatgcaaatgagtatgcccgccctcagatacccatatatgtgttcattctagaaataaaacccgtttgctaaacctgtattttttcgtacagtatatccaagaagcttcatagaatttttatcctacttactggataaactgaatatttatatgatgatcaaagatagagtacaaatttacaaacatacactacttaaaagaacatttttgcatgcgatcaaaaccattttttctgtgcggttgggccgcctgtctacccaatttattaatgatgaaatttgttaattttcattagtcaaggccgggtcaaaggaagccttcatactgtagaaattcggtttgacaaatttatccaagattgagtaagctccggagaaaacgaaggtgtatcatagtctctattcttgttaatagagttctgagctgatggagtcgtgtgaggttcaaactcggatatgtttaagtaacgattagccgatatgagtcgtttgggagtcgaagtctataataatttccttaattagagatagagttctatatcaatacaatcgtaatagagtcggacttagtattgtatatggatataaatatgtacactcagggtctttgtaaaatatacaactttcggcgcatcaccaccctaatttttctgacgaattcttgttttcgagtttaggatgcatcggttaagttcgatctctggcaaaaaagttagtttcgtcaaaacccattgtttgtatcggtggaattagtacttctcggttaggtccaatatactggttcttcttttgctcgcattgcttaccagatttattggctcttgctttgattgatttgctttcttagttacggtttctatatcaatcgctccggaaagtacttatcaactggttcaaatctatttaagcatcttgttaatcttgaactgtcttggttatttccaatcttatttcttagactaggcgatacctattgctgcgggaattgaagaatacaactttgtagcatgggtgaaagattgagatagaagtcaattaagaccaggcaaattttggctttgttcatgaatcatggggtgtgtagataatagcattaattcaatttgtgatgactaggtagaatggagatacactcttgcccaggtagaatataaatccaagcagtatggatattctcgttgtatgggtagaatcacccatcgtaccaatcaaagtacagaccgtacacttttgattcattgactggttaagaaaagaagaaagaaaggttgggaagcaggcctcctgctattgcatctctgcgaggcggcagagagccatagagcgagaggggagaggaaaccctctattttttctctctattttctttgtcatgagaaaaagattccaaaggatagcattgaagttaatgattccttaatgaatttcttaatgtgtattgactatgggggtgtttagaaagctaaaactttttagcccatgtcacatcggatgtttggacattaatttagaatattaaacatagactaataaaaaaactaatttcataaataagagctaatccgcgagacgaattttttaagcctaattaatccataattatcaaaagtttactgtagcatcacattgtcaaaatcatggcgtaattagactcaaaagattcgtctcgtgaattagtccaaagttatggaatgggttttgtaattagtgtatctttaatactccaagttaatatccaaacatccgatatgacagggacttggaataagtccctagaaaccaaacaagccctatgttccaaaagaactacagaaaaatattgaacacagtgtctgatcattctgcaatagtaactgtcaaaggtgcagcagctgacatcaggtcatctgctgccatacagacatcattatctagatcctcagctttacatgcatatgatgaagaacaaaatgaatcacattaccaagcaagcatttccatgtgaaggaaacaatattagcaattttacacacacagagtatcaaaatcagacatcagtaaacagaaaagtatctttctttgaagttcttgaaatctgaaaagcaaatcttggttcaagatgacaactaatgccactccagtaatatctaattcttggaatgtatgctttgcatccttttgctttccccgtgattattttaccttccatgacatatgaatacactacattagcaaccgagaaaaacctaatacatcttaggtgtgattccactaacacattaatgataactgatgtaacgaactctgtttaacaatatgaggaagaaaacttttttatttttatgtcaccactaacaaatggatcacatctactctaaccatgtgtacgtgtaatgcaagatgtgtagaatcatatgatgattaatctgggtaatgaacaattgtcaaatgtaagtatttgtgaaaatgcagcgtatcgtgtttttgaatgatgaacagatcggtcgcttttaggaggccggttagaccggatgtgtaccgccggtcagacaagtggtgatcgggtggcccgacggtcagaccgatatactccaggttggagccagtttcgggttgtattcatggaacttgtagattgcttcatgttatggtttctagaaggtttctattgatatgtgatactattgtgtgttgatgtgagtcaagttggtataaacttgtactcggatatggagtctttttgttgttcatgtgcagatcttgcttgaaatcatgggagtatggctagtgatggatcgagactaggcttgggtgaagttgaggtccagatgatcaaggatatccttatgtgggatccttaggctagaaagcaatacacgtgaaagtgaaggttttcatatggcatactcatggtgttgtgtgtgtatgaaaataggagtcaaactaggattgaagtccaagtatggaagattgaagaatggaattgtatgagcatgttgtttccctggtttggtatgttttctatatgattaggagtactagttctagttggattcatggctagggaccgcgatgttgtaggtataaataaaagaggagttcaagttagaagatatcgacttcttgggggagaaaaaaatataatttgctttgaggctttggttctagtttatgagttgagagagaagtgctttaggtgcacttcgtaaagttgatctactttaaagtgtttcatcgatatgtgttttttctgaatcttaatagtcatactggctcctggcgagtggtctaaccggcaggatgatggcggtctaaccgatagcaaacaaccggttagactggcggcggtgagaagacagctgacaaggaggtagtggtctaaccggttggataacaccggttagtctagcggcaaaggtgtagtcagaccagtgtgcacacggcggttagacccactacgccgaggacttcatcaggtttgagggttatttccactaaaagttttggtttttgtgtttctaccattcacctttctggtaggcttggttggttcttgtattcgatcctataagtggtgtgaaagccacattttctcttttttctcttaccgatcttgggtttttacccacatgttttttatggagttgattttccttgttggtgcgataagatgaaatcttatatgatggttgtggattatgatatttggttaaaagttgcaaatcattacaaatttctcctcatattaattctactgctttaaatactgaatttgaaagcaattgtaaagctcgggggcacaaagacagtggcctcgggggtgggcggcgccagtgggcttggtgcagattcgccgccccagccctcgggagcggctcctgcacgcggatccggtagtcacgggatggatccgcctcccccaccctcaggagcgatgacgacgcttggaactggcggcctcgggatagggacggtggcggcggcatcggactaggctgatccgccaccggtgctaacggaagcagcagatctgtatccaatctgaatacggggggcgttgcgacggcggcctcaagcggcgagagcaagcaatggcggcggatgtgaggacaacgacggtgacagcggccttaggtgaaggaagcgagcggcggcggctgcgacgacgatgatgacgaggacgacgacagtggtggtggctgtgacgacaatggctagggtttgggatgaatcggggagctagggtttcgaattttatcctgggaatttttattttttttgctgaaattattttcgcgttcgcttgacatagatgaccgcacacaaaaatcctatttttgcatacgtttgctctgctcgcatggaaaattttggttttcacacacctaggttcatgcgggctgtctagccgcatgctaaaatttattttggacgcatacaaaaatcgttgttgtactagtgtaatccggtgcccagagcttagcgtggctgaatacggtggcggtgaggttccggttgcggtggtggaggttgggaagctgacctcctgctattccatctcgcgaggtggccgaaagccagagagtgagaggcggagagaaagagagtgagacgctagagaagggaccatggggagggaaatgtgggagattggtttagtggtaggaccaactcgatgatgcgtcccatatttcatcccacatcgaatgctcgagacgaagcattttcggcaaacaacactcagtaatataagtctgttcttaccaagattaaataacatttaaaagttgacaagacgaattctagggtattacaccactaattttatatattattccattttacggtatggtttatgcaaccttaagtgactagtaaacacgcaagtcaggtaaaatagcaaacgcaaaacaaggagtctagctgtggcatttcccaacctacaaatgcctagcagcgtgcactcatcatatatccgcccccttctgtagctttcttttgcgttaggttgtgttcctcttttgcctcttcctcgattgtgtccattggaggtgttgcggattccatcttggccttcttcagtgtttgcactaaacctgccaggcattcgtccgcgtctctcttcctcttgcaccgtagcatgaagttattggccacgtctgccggcggtgacccatccatctcgtcgtcgagcagcagtcgactgatttcaccgttcctcttgctccttaccatgaggttatcggcaacgtctgccggagtcgtgtcggtctcgtctagcagctgcccgatttcagcgaatagtgagtggtcggtgatgtccaggtagctcttggcgagcaccttgaaggcctcgaagcggcagtatgacatctcgatgtgcttgtccatcctccccggccagattagggccgggtcgagccagtcgatgtggttcgttgtgaacatgaagaccctctcgctgccgcacgccgaccacagcctgttgacgaagctgagcaggcccgacagtgtcactctgctcttctcatcgttcttgtcggcaaactctaccagcatatatatgcttgtcgcggatttcgtcgtcgccgttgactaccttgttgcccttgcgcttggtagtgagttcgtcctcgatcgcgtcaatgtcctctataacgatgatggacttgtccgtcgtgtcaaggaagagcttccgcagctcgctgttgttcttgacggaaattaggtcgaggtcgtagacgtcgtagtcgaggaagttggccatggccccgatcatggtggacttgcccgtgcccggtagcccacgcagaaggtacccgcgcttccacgccttgccgaccttggagtggtactccttccccttctggaacaccgtgagatcctccatgatgtcgaccttcttcgcgtggtccatggcgagcatgtcgaacgtcgcgggtggattgtaagggacgctggtccacacgctcttgttcccctcgctggcgtggtttgtgaacagccgcctctgccggttcttggcggtgagctcgcgccaccgccggacgacgcttggtaggtaggagctgaggacgagctggcggtggcgcttgtggaacaccagccggaagcagcgcggctcgtccgtttcgccggggtagtagctgacggtgatggcccccttgttcttggaggccttggggcacagcctccaccacatgcgcgcgccgtcgaagctgtcgacgacctcctggttctcgtcgagggtgacaaccgggtcgtccttggtgttgttgcagagctcggccttgagcttgcaggcgccaccggcacacacgcggctcaggtaggtggagacggcgccgaacatcttgttccgccggaaccgctcctcgccgtactcggacacggtgatctgctcgtaggggttgaagtaggacatcgccatggggaccaggctgctgatgatgtacctagcctcctcatggacgtgctccggcatccgggaccaaagcaagcccacgccggccatggccgacccgaaccctacccacgtctccacggatgccatgacttgccccttgcaggttgcagccactgctcacctaactagcagccactgcccactgctagctagctctctgcaatgattaattgccgttgtgtggatgtgtgcttgtttaccgttgcttcgtctgtggcggtgtggctcggcttatataattggcgtggtgtggctttaaatggttcccgccgtttcatcgtggaagaaggtgagaacgcgtcgtcgaagtttcgtcgaagcaaagcgagcgaggtgatttgacttactccacatgaaacatgtagatattgcaagtgactcagagaccacaagaggggcggcctatcaccgtatcgggtttagcaattactccttcccttgtaatatatgtgatttatactatctttttaaaaagaaaatacctagttatgatgaatccaaaaaattaactttaataataacaaatataactttcgaacattagtgtgacttatatgcaataatatgcagagaaactcataatcctatggtataggttatatagatgtaaggtatttgaaaattgttataaaaatggaacatgcaatggttggttcaattttaatggaagagccaatttttttatgaacttattacattttctccaaatagttgaatttattccctattgacattttctatttcttgttttattttatacaagttcaaatattagcgttatggatctttaaattattggtttaattatgaatacaacaatagttcgattagaggttacatgtgtagcttaaaagttatgcattgttttaataattttaattatttctcgctataaaaaatagggaggggtagagtggatagctaaagccgagaggggagggggtgggtagtactgtgttgtgcgcatgtgtgggggaggacgaagtggaggggcattttttttctacctttctaaactagaaaaaatgcccgtgcgttgtaacgggtgaagatattttaatcatgtaattgttatacggtttagctatggtgaaattcatcgtggaaattcgcttggatattttagtttagaaaatcatgagatgcagttaggtgcctgacttttatctcaagttagaatgcatgtttttttaaagagatttcttatgcgactcctttcgtatttccaaaagcaaacgaacttaaaatttgactcaaatacatatatgtatttctaaaagcgaacagacttataaaccaactcaaatacgaatgaagtactaaaataccaacaaaaacatcttcaatttttataatagtagagatgatttaagtgaaatctgatgatttgatttttttctcatattttctaatatgtcttctaatctaatatttaagatgtaatacatgttggcttaagctttttttaaaagtatacatattggctaaaaaataatggatccacctattcaagtggaaactgattgtcaaatgtttttttcttccaacttataaggttttatttttatttaagacgtaacacgtgacatgttaagtgcaattctaagaatgtacaacgatttaaggtgaaatagtacttattataattttttataatgttatataccttttgctattttgttaccatgcaaaggatcagtgtctatgttcaaataacatacttttatttttatatgttaatataggtaatacggatcttaaactatttttcttaattataaataaaaaaagttcaaatatactaaaaatcggatataacttaagaattataatcatttggctttctaattatcgatcattttgtattaattagctaaaaattaggagacgaaggaattgaatgagagaagagaggaggagagagttgaaggggagagaattaaattatattgttttatttgttattaatttattaactaaatatagaatagaagctttattgattgattaaaatttatcgtttttattcgtcttttcccatagcttcttattcatagtagatagtaaaaatatgaacattacaaatcaaataatattattttgagttattagaatgttagatgggggagtattattttaaaaacattaattggaattaggttcattttagtttttgtgaagttatatatgctgataaaatctatatcatcgttttgtttaataatgcagaaatcagaaaatacaaccgtaaaatgacatatttcttttcaaagttgaattactgtgcatatgtgtctttaaatgtaaactaatctaaaaatataaggggatcaaatattagtttttgatttagatgttgtagttgcttactttttagcataacttttgctttctactccctcggtcccataatacaacggacttttgacttcttgcttgcactgtttgattagtcgtcttatttaaaaaaaagacacaaatataaaaaataaaaagttgtacttaaagtactttgaattataaagtaagtcacaaataaaataaataataattccaatttttttttaataaaatgaatggttaaacagtgtaaacaaaaagtcaaaatcccttatattatgggatggagggagtaacatattttgggaacattactttttatgattgcagatcttatttaattactatgaagttatgtatgatgataaattatactccctccgtcccaaaatataacaacttttagctctcaggatttatcccaaaatataacaacttctccaccaacatttctcttcccaacctatcacaactctccaccattcacttttcccacctacctccactactcatccagtcataaccctccaccattcatttctacctactttcttaataaccgtgtctaactctaaaacttcttatattctgatacggagggagtatattgttactttatttcatattttttataattgcttgaatggtatgcaaaggttagaagatataaaccaaaataaaatttgttttcaaagttgaattatagtgaatttttgtcgtaaataatttaaagatataagtggacaaaaaaaattctatgatctaagttctatgatttagatattataacttaattgtttaacacaatttttatttttcgtaactaataaaaactaataaagcaagaaaaaataagagaaggaataggtagaaaataggaggaaaaaattgagggaagagcagagagctgacaaatgtgagtaatgtacgtacgtaaaagccctggtgggcctgggtttgagagagaatttattgtttcgaagataaatctaatggtcataaatagtgggtcaccaaatttaataaacattaatagttggatgttttattttttttctcagaattttttatgaatttgtctaactaggaaggtagcccgtcacatgtgtggacatcttatttaatttgtttggatttttattatgaatgtttatcttactttattaaattttttctagataatttatttgggatttatttgaatgctactaatattttttttcctaatggagttgctacctatgaaactatagatcatttgtactaatatcttgtttttcgagcttctaaactgtaactaacatttttttcttgtatactatatattaattgaagatattttctaaattactacatcatataattaaatgagatagatatgttgaactattgatttagttgtaaggacgtagtattgcattagtaaatatttttgctgaatcagagcatcttagaaaaggagacttttactgctctctgtagtttagggctatacactttgaattgaaattatgttagactttatttccaaaataatgccggaaaaatcaattttctgttagattttatttgaaattttaaatattttactcttaaaatgtttgaactttgctatttagaatgggtcaaatccaaaaacaatgttacacttagaaaaaaatgttcagttttaaattattttttccatgttattttttattttgatctttgcaacttggaacgaaaatataagtgggttaaggccatataatttggcataaggttctaaatttctctctctaattaagtcagaaatgttaaaataatagtcatcggtggcgctacgaagcgctcctcaccatttcccccaccaccgaggcaaccaaccttcgtgtggagttaaaatttaacttagatacaattgggtgtgggttgagatgacatcgttgtggagttaaaatttaactttacaacgtgagttatctatcttggagctacgtaaactcaaaaaatggatgagttaactattaactttgaatcgatgtgataataactgacgttaaaaacatttgttttattactaaaaattcataatgttgtacaaaaacttgtacggggactacatatgtagttaaaatttaacttgtagatgtaagattttctaattgtagttaaaaactaaattaagaaatttatgttatgttattattgttggatttaatagttaaaaataacttattgttttaaaaacacctatatgatgtctgaaatacgtagttaaaaaaataacttttagtttaagaaaaaatatgcgtgatcatagggattagtgattcggcgttaatagaaaaaacagttagatgaggtgccgaaaacaggggattttttcgtgcgataattccacttaataaaaccagtgctacgtattcatttgaaaccctttttcatatacatcgtatgcttggtatccttactgagtaaaaaattaacttgatatgacaacaaaatttttactcaacaaaatttaagcataagttaaatttttgttggcgcttgctccggacatcgacggcggcgcatcgtggaggtggccgccgctgctcctccatatccattcgagtccaagcttgccgcggcggaggtcgcgctgtgcgcgtgggggtggagcggcggccggatccgctgccgcctcgcctcctgcccgcagtcagcaatcacagccacgccctccgtcacccgtgcaggatccgcatcggatccaacgtcgcaccgcccgtatcacgccggatacgccccaccttagtggctaagatccgcgcgcgtggggcgttgagcggtgtccggatgcgcagcctcctcaccttccgtcagcagtcgccagtcaccaccacccccgcagccatgccaagccggatccgccgatatcgcacccgccgccagtcggcggtagaggtggagctgccacgcctcctgcccacagtcgcccatcgtcgccccgccagcaaccgtgccatgccagatccgctgaagcggcgcccgacgccgctcggcggtagaggcggcgcagaaaacctgagtggagcatgcaggtgaaggtcgccgtcatccgatcccaagcccgccgctctcgtctaggccccgtcatcgtcaaccctagctcgacaatgtcaccggacagacattactagaaatataactcccagcaatggcgcagaaatactcctggtatattatggttacagagttcattcgcaagcgcacggatataccattgtatcatttcacccgagagtattcgaaggacatcgtatttatttaatcccgtgggaagatcatagtagagacaacctgactaataatttatatgttactggtaataatcatagtctaagcaggggttaagataatccaagggtagaatgacacacaagcagggagctactcattatcatattaaattatctaagctaagtggaaagagaagataaatgaaatctattcctatacttctagtatatatagtatacatacattctagttatctgacatattacctaataccctctatccgaagccctcctggtacttcgagaagccagccctgattgccaagttccttacaacaacccgtcatgaccatacaactggggctaaatacggatgagtaccctccccaggaaattaacttaggactgtatacacgagcggaggaatacccgtactgagttgtcaccatcagcggcccacctctcatccatatcatataaccccaaataatgatatcccgtaatctagacaccacgcctaaactaccagatactactcaaatatcatcgtcatgacatagattagttgcataaacaaacactaaatccgtaccgatgcatctcccagataagctagcagtataatcagtataacatgaacataatgtaaagttggcattcatatacttggaaagtatttcaataccataaatgtataaagaagagtattcgaaataaagtacaaagcttacaaaagagaagagaagagctactagagctatacccgaactcttccgaaagcttccggactccgatttatattctattcctattccactagcttaaaagcactaaactaaacttgagagaatatgagagagctttgcttgaggtgtgtgagtgaagtgagaatggcaactccttttatagtgtggaccctcgtttttataacaggaatcaatcgtgtaaacagtaccatttccctggatcaagtagtttggtacacacgaattcatagctgaaatatcaagtgcacatacacgagtgtctgatacgaattattacatcataggcccgcaggcatagtcttaaatcatcggaccgagaggtccggaatacatccaaaagcagaaatagataaggcagcggaattcaggcagcggcatgccattgccacaggcaacgaccgtactaagacctactggacgccatcgtcttcatctccctcctgatagtaggcatagggatcctccgaggcttcatctcccgcttctgataaattttatatttgcaaggatgagtaccaaccgtactcagcaagccaccacagcaacaatgcatatgaaagggggagttcaaaggatggccatagttcttttgcgcaaagcaagttttgtaattcttttta

SEQ ID NO: 29485 - DNA, 11985 bp, Oryza sativa
aatggctttgggcaactaagtgacttttaaatgctgtttactgcaaaacctaacccctactattatccccttgtacccccttgcattaatcatgcatctgccggtgtggcttgctgaatactgtggttgtactcattcttgctcaatcttttcccccttcagtaagagaagctttggagaagatgtcttaggtggagtcctggcttataccccagttgagcgcctgtgaagatggagccgtaggcccgctagtccgctgccgtttatttttgattgtcaggccttaagtgcctttgtaataatgtaaatattatcgatataataaagatgtgtctttatatcatgtttgtgtggtgtaccccggcttttcctgggacggggattaatacactagcgttcgggaaaaggcaattttcccggtcgcgacattgcccgggggtcgtgtgctcttgcgagcagtgctgagggtgcgaggtcctccaaggaaggtgatgcggggagcaggagcctcatcctctgaaggatcagtgatgtctggctcgatctccggctcggtgtcggtcccctccgtctcggagtcgatctggatcggagtctccaaaccggaacccagctgcggagaaggtgtagggatcagtggagtgtgcaccaactccggaacaggtggctgtgctgctgtagggtccactaggtagggcgctgactcggtagctagcatactagcctctcccagaagagcgtggaacgccggtgggtacggcggggtgaggaagaagtagcggtcacggcctactgctgtggaagtagaggcccctgtggtgctgatcttggctgctcgaagctgctcctccagctggctgacgtgctcctgactctctctcagctgctcctcaagagtatccatcatcccgcggcgatcgttgtactggtcagataactgctggaactggtcgccgtggacctggagctgtgccttcagtgagtctatctcactgccccaagcctggtgctcctcctccaactgaagctgctgtgctgtgaggtcggtcacctcagtctctaactcctccatacgtctctggtggtcgtcaatctccaacagagcctcctcgtagaagtcatctactgcctcagcccatcgtgacaaccgagtcaccatcgggttgtagcagcagggcgtgtcctgaactgtgcaaactgagttgccctcctcccggaacgggtgatgagcaaactcggtactcactaactcagctcggtggatagagctgagtcggaggaaggcctcccgggcggcatcctgcatcgctgtctctggcaggtctcggtggtgacgtgtctggaagctgtagtctaactcggaagggactcgggggtgaatctcgacccgagcctcccaaactgggccacactgcctcactcggtatgacggaaaaccagggtatcgcagacgcctcaacatccgatgcagctcaataacataaccctccgattggggtaagctcaactcccaggtagcgggtgaatccgaatctgccatctaattttaaggaaaacccaaagtcagttgagagtaaaacttgttttgtaaagaaaatagttaagagtaagataaaaattgtgccgagttttgtaaacatagcgtttttatttttgaaagtattactaaatgggaatttctcccttggccaacttagaaaaggggtggggcgccttttggtcttttcctacagtcgtatggctctgataccagctctgtggacccccgtttttataacaggaatcaatcgtgtaaacagtaccatttccctggatcaagtagtttggtacacacgaattcatagctgaaatatcaagtgcacatacacgagtgtctgatacgaattattacatcataggcccgcaggcatagtcttaaatcatcggaccgagaggtccggaatacatccaaaagcagaaatagataaggcagcggaattcaggcagcggcatgccattgccacaggcaacgaccgtactaagacctactggacgccatcgtcttcatctccctcctgatagtaggcatagggatcctccgaggcttcatctcccgcttctgataaattttatatttgcaaggatgagtaccaaccgtactcagcaagccaccacagcaacaatgcatatgaaagggggagttcaaaggatggccatagttcttttgcgcaaagcaagttttgtaattctttttacgagcctaagacctagcattgactgatcaaattttagtaccagagtttgtatttaaacaacgacggttctgtccaccatccattgtgatcccaaggatagcttcccgccattgattcgtcatggttttctgaggacgtccaccttcccgcttctcaggaagtggctccatcagcataaaaaaaaatcatcatgcaatatcccatcccacacaagttaagaatttagagtctagccaagtgtaatacatgtcccggtgctcaataaccgcgagcacggctattcgaatagatttggtttactcacactgcagtggatgtacactttacccgtactccgcaacttgcccaacacatgagcctacgtcccaacgaatgagacttgccacggcaaagcctttcaataacctcactttggcagtatccgctccatgaacttaagccctcatgcactctaggcgtacacggtttttagcagtgagaggagttctggcgctcccgagggggaaaactcacgcacgcctaacatcgcattctgtagttgaacccaatccatgctgtccccttttgggtatctccttgtagtcttgtagtcttgccaagtcagtctctagccatccgtatcgggtatccgccatttggccatccgtatcgggtatccgccagtagactgcttgttcgtccacacacctaagtgaaaccactatgcagggatactgcctccgctcggctatctactccgctaggtctatacccattcgagaagtacggctgtactgaggtcgtttcatgtttaactttatggctcggtccttaactgaccagggacggcactagcctttaccggacaccacccaagtcctccagccgccccagtcgaaaacatttgtttaattttatttctcctttcacaaatcatgtcatcaacatcatggcaatgtggtgctcatgtctccacatgccgcatctcaattaccttcccaaaggtaattgcccaagcatatagcatttgataaatatgagtatgcatgattctagaatagcatttctaagcaattgtcataattgactagggactcatacgtagacatggttacaaagatttaagggtaaacaataatcaaggcatggcataatcccaagtaggatattcatcattgcatgcaattttatttataaacaaaataatttcgcaattgggatcaacatgttcaaggaatagtgatgacttgccttgctcaaagtcttgcgggtcttggccttcgcttggatccgcaactccctcgggctctatagttacgtgcaagaattgatttgaattcggttagaattcaaataaaaatccaaacaaatccaaataaaagtcgcatgcgaaagtcgattcccttttattaatcttcactatccgcgaactacggcaaacccaatttcgatttaaactgttttgcgggtataatattttgttgtcataagtttttaatttaatttacccgagcattatatccatatattagattagaaatttcttctcgcgagctaaatgtcggacggaatcctaaaaatattataccatttaatttagtctatgactaaacgattaaacataatatacgtctaaaattcctatcgattgaatccgaatttctaccgtgaatcgattacttatagggtttacccaaaaatactctataataatctataggaattcgtctatttgtttagttattaatttcatctaaaatactaccgcgaatcgattaccaagaataatccgtaatttatattacatttttgcaattctacgactataattaatctataattaaattctaattattttaaatttcctaaacttccccaaactccctctaatttctatttatttcctttttcctttttctccctttccttttttcttttcttttctcttttcccttttccttttcactttcttctcttctttttctttttctctctcctctcttcttcttttctctgccggcctctcttttcctctccctttctctctcggctctctctctctctcacccgagcggcggcggtggacgcaaggggaaaagagggcggctcaccggcggcggcagcggcgacgacggcggcggcgacggtggcgcacgacggcgtgggagcggcgacacggcggcacgggaacggcggcgcgggaacgacggcgcggcgtcacgggaatgacagcgcggcggcacgggaacggcggcgcggcgacttcgaaggtggcggcgcaacggcacgagaacggcggcgcgtggagaaggggaagagggagaggatggggagatggagtggggagaaatggggaggggtggagttttataggggagaggagggggaaagaaagggaaggggaggggcgacgcgacagcggcgcggcggcgcggggcgcgaggtggcgatgggacgcgcggcgacgggacgttgacggcggcggcgacagcggtggcgcgcggctcggggcgggacgcgacggtagcgcggcgcgacggcgacagggcgagacgacgggcgagcggcgatgggacgggcggctcggggcgcgaggtagcgcggggcttggcgcacggtggtggcgacgggcgacgcgcgggctcgaggcgcgggcgacgatgcgcggcggcaggcgacgatggtgacggcgcggcggctcggggcgcgaggcggcgatgggacgtcgacggcgacggcgacagcggcgacgcgacgggcggcgacagagaggaggcggagcggcgcgcggcgcgcggtgcgcgaggcggcgtggcagaggaggggctagcgctaggggaaccacgtcgaacacttggcggccgatgaacagtgacttttcccatttatcccggttttagtgtattttccatataaatttgattccacgattcctaattttacatatatgcattttactcaatattcatgtaatcttaactaatgaattctccctagattaatattactcatattttatttttatataatttattttaattagggttattccatcgtactaaaatttaattattgctaatatggttgcgatattattttatttatttcaatcccacctaacctttattttaatttatattttaattatttatttagtcaactagattttattttatggtttgttcctagctagttattcattattcgcgattaattagactccgacatcaaaatccaatgaaacaggcgaataaagtcggcatgatgcaattggtttaaaaagtttttgaaagtccgcatttttagagttttgatttcgttggtcgaattttcagggtgttacatatagcctcccaatgatggttgtgacggacggaatggtcggaaataccctccaaccgtcattggagactaatccacactgtccaggcgaagccctggatcggatggtgctgaccctggttgtcacgtcctgataaattcatcccgaaataaaaatcattctctaaatggaataatagaattaattaaaattcgaaaagaaattggcaaacactaaaatacgtacaagaaaaattcaaatgtggcccgaagaatttttattgaattcttcttggtaaaaaaggagccctcaaattttacttgaattttcagaacaacggaaataattattaagcaacaacaacaattatcaaagtttactaaaaagaaaacctaaaataaatcctcctcctcagattgggccctttttggccattcccttccatcctctctctctcccgacgtcgcaacccgagctgcagcagcccctccctctcggccgaagctgtttcccgttcctccttttctttccttttgggccggtcattttccaaagtctactttgcctcccccatgctacagtgcatcttcaacctccagccgccagcctcctcttctctctcccgttaacccttgcaccaattcctccctcaaatccgctcgattcaaatgactaattccaaaattgattagggggaattaatcccctttcccacctctctctttcccccttaattcccccttgattcgtgcttttaatcacctggaacgcccgcaccaatcccggccgctttccatggccgccgggcgacttatccgccgccgttcccacctctcccgtgcccggctccctcccccatcctataaaatggaaccccctcgatccgttctccagtttttgccccctcccgcgctctcccgtggcctcaccacccctccccgccgtcccccttctctttcccccgcgccggccgcctccagccgcctgtgccgccgcgcctgagcatcggtcggccgtgccgtcgcgtcccttggctccgcgacgccgtcctcgtctccggcctcacctcctcctcgctcgaagctcgccggagtggtctcctcgtcggcgtccagtacctcccctcctccgggcggctactgttcctcgccggtgagcagccgacgtcgccgtctcctcctccggcatcgcagaggcaacgacgaagatatcacagtcgcccctgacataagctcgggggctacagaggcagaacgcgccgttgccgacatcgagaccacagacgactggcggaccccacccatcaagttcctgaatagtgacgagttgcccgaggacgacgcagaagccgagaaaataactcgacaagccaagatctactgtatgatcggcaacgatctatacaaaaaggcgccaaacgaagtacttctcaaatgcatttcgttcgacgacggcaactatctcttcctagacatacatgaagggatctgcgggtcacacgccgccggccgcacattagtcggaaaagcttttcgacaaggtttttctggccgaccgcgctcaaagacgcttgtgacatggttcagcggtgtgaagcctgcgaattccacagcaaacacacaagtctaccagcgcaggcgctctagactatccctcttacctggccgttctcgtgctgggggctcgacatactcggaccattcccacgaggacagggcggctacaggttcctattcgtggcgatcgacaagttcaccaagtggattgaagcaacgcccacgggggaaattaaggccgacaacgccatcaaatttatcaaagggatattcggcagatatggattgcctcaccgcatcataatagacaacggctcctagttcatcagtgccgacttccaggattactgcatcggattgggagtcaagatttgctttgcctcggtttctcaccctcagagcaatggacaggtcgagagggcaaacggcatagtactacaagggatcaagacccgtgtctacgacagactcatgtcacacgacaagaagtgggtcgaagaactcccctctgtcctatgggccgtgcgtaccacgctgacaacaaccaacaaggagacacccttcttcctcgtgtatggctcagaagccatgctccccacggagctacgacatcagagcacacgagtttagaagtactccgacgaggatcaggaggagcagcgaagtgatgacgtgaatctactcgaagaacatcgagaaagagttgccgtcagagcagccagctaccagcaggtccttcgccgatgtcacgcccagaaatttagcccaaatttccagactattttgtgtattaaatccctgtccaggaccagccaaggtacacaaaacgacaagtaatatacagttccaaacgtaaataaagcgtcaaatacttacagaaatacttacagaagaggcacttagtcctcacaccgaaacgaaagcagcagcagcggaaaaaggcgatcctagcggggcttcagctccactccacaggcaaaactcaactggggtctgagccttggtcttctaacatcgtcttcaactcagaagcactgcacttctgaaaagggggaataatagcaggctgagtacaaccaccgtactcagcaagccacaccaacgatgcagacgtgcaaggggaacacaaggacagtttgtggctatttgcataaaggcggctgtaaaacattttattgagcaaacagtaaaacaattgagtaattaaagtaacattaaatctccactgatcaacgctacaccacgttgaacaggcccaaccaacccacctgaactacagtgcattgggtcgatttattaagtgtgagactaatcacggtgaatctggtcgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacatcacacctcaggtttcacccccgtccccagcgggcgacgggcagtcccctctcgtgcctaggtgaatccggaagccgtataggccgtcgcagggcccatccaaactccatcacgcccacccttgtctggatgcgtcagctagagaaaagctatactacaagcccagccgttgcccacgctggcttgtggtaagtacgataagttcttctagggcatcccgcgaaccggtccttaattgccatgggtgcgactagcaaaaccatgcacccacagcccaccattcagtcgcattttagttgaataattacgaccatgaagcatggccagatgtctcgagcacgcagctcattctgatactaaaaatgtctaatactgtaattatcccatcaactaagctagtggtaattaagcatggctaagcatatagttctagctaggtcacataagtaacatgagctagtcgatttattacccccggttgacaaaggacagatatcaagtaaacatggcacaagcgagcagataggtaatacccggatcccatgtaattaacaaaacatgcatacttatttgcaaacggtaaaacatttataaaataggctcaatatgctcaaggggaatgtgtgacttgccttgcttcttcactttgatcttccgaactcttttcctcgcgaccgcggacttccgaaacgacggattctacacgccggcacgcaaaacgaggaaaaactctaataaaaaccaagggaacagtacataaaaactaaacaaacatgtagagttcaattttagatgaattttgcaagttgaacggctcaattcggaattcgaatgaattagatatggattttagaaggttttgagccattaaatgaatttctataattattaatgatttattgcgcaattattaatggtttatgacgtcaccgggggggaataggtggcgccgacgagcgggccccacctgtcggtggctcaaaggaggtcggcgcacagtggactcggtccacgcacgtgctacccgcgggcgcaccacgtggcagccacgtggtggccacggcggacggggaggacaaggtggcgccgacgtggcgccacaggggcagcaacgccgggcggcacggggagggtcacgtggacggcccaaatcgacccggggtgaatcgggcggtcgcgggcgagcgggaaccggcccaccggccggccggggagcggtggcgtgtggcccgatggtcaccgatggcgaccactagcgcggcggcacagccgggaggcagcggaggaaggtgaggggttgaaggggagatgctcaccgagcgcccgacggcaaaacgacgaaggaaggcggccggcggagctcaggcggagagggggtggcggcgctccggcgacgccaaggggcgccgtgacctcgcgcggggcagatggcgttccgatgggttttagagccgagggagtggtggccgaggtgctgctccaccccaaaacctggatgtctgagcggcgcggcacgggatggtccccgtcgacggcaatcggtggctggaggtggtagaaatggcggtagctcgggtttgcggcgggaatggtgcttcgggggtggattggaggagtgggccggtggccgggatgcggcgcggagcggcggcgctgtgggaggcagccgcacgaccgggcgaggtcagtatcgccggcggcgagcggctggagacggagggaagagcggcggctcggttttcacggtggggtggtatttcggtggtggtttgggggaaaaggagtggaggccggggccggacggcgaggcgaagccgacggcatacacggcgcggcgcggtggtggctggggcggcgggaaaaagtggccggtgaactccggcgagcggcggctgctcggcttggcgaggggagagcgggcgagggcgccgggagctcgggaaagttggggaaatgggaaggagaccacggggatcgtttttattggctcggggcggagggctcatggccgcggagggcggaatcgaccggcaacggtcttcggagtgggctccggcgacgtgggcgaagtggggtggttcggcgccggttttggagggggaaagtgggggaggagagtggaggaggtggggcgacgcggtcccgcggtcggggcgagcgcgcgggtggaggaggacgcggaatcggcgtcgacgtggggaggccgtggcggcggtttcggctgagggagtcggaggttagggatggccctgacaggtgggacccacctgtcggcggctcggggggaaggagagaggaggagacggttgggggacgccaagtagacttcgagagagagagccgagcgggccgagggagggaaggccggcctgggggggaagggaacttgggccggaagtggcccaaagcaaagaaggaggactttaattcgttttctttttttatttaattggtttaatgaactttgtattattaaaattatttattgagctccgaaaattcacgggaaattttcggagagtatattagggcacagagaatattacaaaatattctcggccaatgatttttaaaggaaaatttcaaattctcccattatttcacttgattaaattgctttaacttttatttaatttccagaaaatgcattattaaatgatttttaattccgaacgaaaatcggggcgttacagccgataccacgagaagcgcatcagagcacgcacactttcgatcggcgattacgtccttcgacgggttcaaagtcaagcagggcgcaacaatctcttacccaagtgggagggaccatacacgatcacgcaagtcttgcgaccaggtgcattcaagattgcagacggcgatggccgcgagttagcaaattcctggaatattgatcaattacgtaaattctatgtataaatcaatagcattcatatttgtaagacatctcatgatttccataaagttgattttaggtaaaaatttcgggcaaaatgttccttcccgacaatcccttaccacgacgacacctagcgttgaaacctatcctcatgtccctttacgccgtcttgacaaggcctctgaggaacctaagggaacttcggctagggacgcccagagcggataaggccttgtcagatcatgtagagacaaacgatcatgtaagatctggtcatgtaagagttctcgctgtgcatattaaccaggccgtgtaatcggaaattgagttttccaacttcacggctgggggctagggtcagtgcttttttcaaccgaggcaggtcaagggtccaagagccttatcctccgagaacaattctccgacgacaaggctgggggctagggagagtgtatgactcaagtgattgattgaagttgcgaaatgagaa

SEQ ID NO: 29486 - DNA, 720 bp, Oryza sativa
caaaatatattacatgtttccttgaggtattttctacaggatacaaaaactaccaggacggccaacaccaatccatggagtgaaagaccttctcggcgagtggcgccatcgacttcgccagaccgtctatctctgcggcagccctccgagaacatgaaaacccttcgtggaggaactcgagatgcagctgtgggcggtgatctcggatacaggccagcacgtgccctccgacaaaccggctcgaccgacgacactcctgcttcagggcctcgtcgctacgcttgccgatgccttcgagctgggcgcaggccccattcaaccacgagatatatctggccgccgactcctcgggattcctgcgaggtacctggagttcccggcagactccagccattgccatatagcagctcctgaggtacgagttgaaccacacctcgcgacctcggagcgcttccacggcttggtcttttttcacttccaccatggtcctctcgagttcggccacctcgaacttcgtccgccagtattggattcgacgatctctgtcagccaactcactctcgaggtctgcccaaacacggaaatgactaagtcaagtcattcttctctctcgagaacacgacatattaagtcaacccgaacaaaagagtaaaggaagtgaaaaccaaggcacgaacctagggaagtcatcgccatgtccgctcccacggacaagcttga

SEQ ID NO: 29487 - DNA, 691 bp, Oryza sativa
gctctatctgtagggccgtcacaggtgacctcacctgtgacggcccagagtgttgggcccgtcacaggtggtcttacctgtgacggctccacggttggcgcccgtcacaggtgaggccacctgtgacggccacatagttggagcccgtcacaggtgagtttgactagggttgacctagggttggacatcttctagatcgatccagatccggcgcccactctcactcactcactctctcgaccgccgcctcgcctctctcgacctctctgccgccctctacgcgccctcctctccaccaccgccctcgccgccgccaaatccgccgccctctccgccctctccgccaccctctacgccctcctctccaccgcctcgacctcgacctctccgccaccatctctgccgccgccctctctaccgccatctccgccctctacgccgccctccccaccgccgctcgacctccccaccgctgccgcctcactcactctctcgacggccgccgggacctcctctcagtcgccacgccaggaccgtcgtcgccgccaccgggatctcctctccgccgcctcctcctctcgaccgggacctccacggtgagcccactccccccgcctcccctcgtttactattggtcgcccgattaaccccctcttctcctcctcagcgccgccgtgccaagaagccgccg

SEQ ID NO: 29488 - DNA, 7114 bp, Oryza sativa
tgctgcccaatgtgttccttgttaaatggccagtgatgaattgctcaataagaacaaattatctacacttgttttttttttatgcacaagaacagattttctgcacttgctcttttttctggattgataagagagactatatacacttgttttctgtcattctttgatgatttatatacccttgctgctgctgcccaatgtgttccttattaaatggccagtgatgaattgctcaataagaacagattatctacacttgttcatttttttgcccctacacttgttcatttatataccactgctgttgctacccctgtggcatatatactcctcctgctgctgttttatgtcaatcatgcaaattctgtacccttgctgctgctgttttttaaatttgcatgattgattcagtggttatatacctctacacttgttctttttttatgcataagaacagattttctgcacttgctctttttttatgcataagaacagattttctgcacttgctcttttcttctggattgataagaggagtatatctagacatgttgttttagttaatttgcccctgctgttgctacccctgtggcatatatactcctcctgctgctgttttatgtcaatcatgcaaattctgtacccttgctgctgctgttttttaaatttgcatgattgattcagtggttatatacctctacacttgttctttttttatgcataagaacagattttctgcacttgctcttttgatgttatgattttctctttttatcccttcatgcaaatgattgtaattgatgcatatttctcagcaaaactgaggccatatctttcatagtataccccgtattacattggatctaatgctatttagtctaatggtaggaaatttataatctttttcgtgaaagttaaaccatgtcaacgcccggcgcaaacccgccctccccaacacctgcgaggatccaggaagaagcaaacccagccacagaggcagttgccgaaggtcatcccgcgacaacggcggtccaacaacccgaaattcatggtaatttataggataaattttcaccacataaccacataaattttagctagcaccccttagcaaatattgccttctgtttgtgctgcagaattgccgcaggaacaacatacgtcgatgtcgggcgagacaagtgcaagtaggtctagtagaaatccgcggtcacaaaatatatggccgaccacagtgcaagttataagagaggttgacgctagtggtaggcccacggcgcccaggaatgtcattggaagatggtctaactgctgcgggatagcggcacgtgagaacttcgggatcctccataaagatatcgggaaggtcacagaagccgagaaagagcgagcttggacggcaatggagaaatggttcacatttccagccgaagcaaaggataggctcaagcggaaggcattccaaaagatgggcaaagcttggaagaattggaagtcgaagctcttcaccgagtatgtcaacccgcccggcaatcatacgccgttcgatgaataccctcaaataactgaagcggtgtgggaggaattctgctctctcaagaccacccaagagtttagggaatccagcgaggcacatcgcgtactgcaacagcggaatgagcacccgcatcggctgggcaccgcagggtacatcggcaaggaggcaatatgggcccaagaagatgcagccgctgcagcagcgaatgtacctgccccgttttcagacatccctgaacaaagagctcgcaactgggcgcgggcaaggggtaaggtcaacccggacggctctgtcacatttgagaacaaaagtgatgccgtcgtctatcaggaactggtgagttcactacttaacctaactaatttccgttcgtataaagtacaagttcgtataaacgactatcttcttttctagttgggcttggttgctgaacaagcttcacaaagcgaggttgagtccgcgccgaagaggcgcgaagatgacatcctcacaaaggcgctcggaaccaaagaacatcctggccgaactcggggaattggtagcgatgtgccctggaagcatggactccctcagtacagctcccaatacaggaaacggaaagtctccaaggaagagagggacgctcgtttgaaggccgaacttaaggttgaggtcattcaagaactagaagctagcatgaatgcaagggtggaagaaagggttaacaaggtgctcgccgacatgaatataccccgagtcacaacacctgctgtgcaaccaactcctcgtgtacaacacgacgcgagtccgtcacagcataggagtagttgtgcatccacagaggtgccggcccctggtctcccgatcgcaccactagctgcagtggaccacatcgaggtaattattgttatccgatccatatctaataaaagacatttacacattccaatattaaattcaaactttcaccttatgcagggcgcagcacagtgtgtcctactagcgagagtccacccaactttcgctcctgaagtcgctgagggcatggctttcaagccctcggttacagacaaggtccacggcgcagacctgctagctgggtatgccaaggtgtccatcgatacagtaaaggacacctggtcaggctatccgctgcccgtgcccccaaatgatgaaatcatgactttgggcgatgcgcgcaagacattcatacaatggcccaaagaagacatagttgtgaagatgactcctcgtccaagtcgaccgacggagcttacacctcccaagtctaagctatcaattgaggctccccgtggaccggcattgtcagtacctcattctcccggtggagctgatatggacttggcagatatagctcaaagcttggctccaataaagaccacaagaaaggccgatagctccccaccacttgtcaagagccagaagcgtgaacgaggcaaggggaaggtcggggagttggcgccggagccaaaaaggggcaagctgcgacgtcgatgccggtgagcaaatcggggaaggtcgtgagggcgccagcccaatttgagctaggcatgccattggtggaggacaatgtgttagctgtgatgggtattgcttgccgagagctacataagcaatacatggagctaagcaatgccaagcggaaaatgagggagtcatccatagttggacatcacgaccaccagccgttcctatcgtcgcctgcctatataactataggctttgatgacctcttcgaccttttcaggatccggaagttggacactggtcttctaaaatgctactccttgtaagtgcataccttctatacttgtgatatgactggactatatctcctaattaaattagttctaatacgtaaatattttaaggttgtgttggatcgagagtcgtcgccatggtaatcaggttgggttccttgatccatccatggtgaatgaggttaatttacaacagagctccactgaggtggttgactatgtcaaccggtgtttatgggcccatcaagacaaggagtacatcatgtgcgcacacaaccaagagtaagaggacaatacccttcgtgtatattgtttttgaagttaaggttcttagtactaacgctacataaccactgcgcaggcgacattggattctcctagtcatcgtacctaagtggagtagggttacctaccttaactccaataagtccaaagattatgatttcagtgaaatcaccaaggccttaaatatggcttggggcccatatgtggaaaagggtggtaggcacaaggagggcaagaacgaactttatcatgacaccaagtttgcatgcgcacaacagatcggagaccaatgtggtttccacgtgtgccacaacatgtcaacacttctaagagaggtgaaagatttcgaccctgaggttgttgctaatggcgaataagctcatttcaatatctacattgctattcaaaacgtgctaattaacctcttatttattaaacagaaaggtagagctggcttcaagatctcacccatcaaccccccgctatcagagacgaattgtgtgcctttattcttgcagaaataatgaacaagaaaggacgttttcatgccaaatagactcatgaacttggctagataatttattgtgatgtaaaaaagatgtttttataatttctggcgatgtaaaaaattatgtttttatagagtgcaatgtaatttactttcatatgtgcaatatttatggtactttactaaattgtcatcacatttgatcaactacgatttatgttgtacgtctcatctgttttctccttttttttttccttattgacaggttgtgcaggtcgatgacatcatggctttaatccatttggtaagtatatatgcggttctatgagcaacgaccgaaattgtggctttcaaggggtgtgaatttgctgtgcaaaattgtggcatttgaactgcatatatgtgttgttggggatctgtgatgttatattgggggggtgatgtatctgtgatggatctgtgactggaatatatctgtgatgtttctatttttcagagggcatggctagcaaatcctgaggctagccaatatttagcatttattttttttctggaattaactcatcagtgacgggtcagaacaaaaatccgtcaaaggtaacataacctgtgacggactagcaaataaaggcccgtcagaggtgacctacctgtgacgggcctttacttttggggccgtcacaggtagatcacctgtgacagcttctaactacggagacctcaacctctgacggcctttatttaaagggccgtcagagatgagtcacctgtgacgggtcctaactcgctcaaggctagcggagaccaacacctctgacggccttctagtaacttgcccgtcagaggtgggtgtcacctgtgacggccggccacccgtcaaaggtgactggactcaccagtgaccactgatcactgaccatgcgcgaagccgtcaaagatgagggtttgggcccgtcacaggtgaccttggccagtgtagtgtgacaatgaaagacatttggcgtgaacaaacaaacagaagggcccaataaataatcactctgtctgtaaatgagagaagaacaaccaaagaaacacagtacagggttgcggcatagttaccttaagacggcggcatattcagaaatcactgtaatagacttctagagcatatattgtctgtcccgagaacaatgtccctcggttgataaaaacaactgacaattcaaaaacatacacagctagcaagggatctattaatctccgttaacaaaagtatttgttcattaagcagaactcaaataaggcatcgctggtacactgcacactagcttggcatgcaagagaactgaactaattgcaaaatcaagagatagcacataagatcaaaataccggagagaagataaatattatttgcatgcttgtattcctaggtcatcaaatatactgctgaagcaaatgcaaatgaagtcatacattactagatatatgaaaggaataattattacagggcttttggatgtttcatacctttgattcttcaaccgcttgttgcggtacaaatctcttttcatctaatacaactctagggatgtgagaaaacaagtgtgaaaacagggcataaataagtgtaagactacatatagcaaacaaattacaaattaatagatctttgaccatacgtggttcagccaataaccatgcacaaatcacacatgtccagaccatagaatgcagatcaaacatggaaagcctgaagaagaggattggttttcaaaaagaaaaaaaaaagaaagcctgaaagaggggatttactgacaggaatagaaaaattactccgtggtgatgggcattttgcccgctgctcagcgacggaggtgctgctttagtgccggccatagagggttaacgctgctatgggatcgggggacggtggctgccagccttagcccctaagcccgacggcggaggggctgcgacacggcccggtaaaggcagtgctgcacctgccggcagaggaggcgttgtgcaatgcggaggcgagcggcggcggcggcagcgggagaagcgtcggaggctgcgacctgcgagggtggtggaggcggcaaatgtgaagaggaaggaggacgggcggtggaggcggcgatggaggggcacgagcgtcggagacgtgggaagcgattggaggtaacggcagaatacaatcgaccgtctgctagggctagcaaacaaaaaattacgattatacccctccgcacattattttatatggacaataatgcccctacacatttctactcccatcaagtatggtggtagtagaaataaatctcaatccttcgatcaaatatgatccgcggttcagattaatttatactgcaagtagagtgtgccggagtggagctcatatatatatatatatacacacacacagagacacgatgatgagaaaacaagtaacaaaagaatgatgtttgcatattttttaaaaaatataataaatggtcaaacgttacaacactatatatacacatttgaaaatggaggttgtattttacaacgacttcacaaaaaattgacaagcgcagcagtatcatcacagaagcggccagcagcttcgagcgttagctggtcttcttcttcggtggcacgcggcagctgtggaatttcctccagggccgccatctccgcgagctccgacgcctcggcggcgtcgcgctgctgcagcagacgctcatagtctgcctccatcgcctccatggccgcctccagagccgcctccgccccctgcccatggccgaggagctcgaccaggcgcgccacggaagcggcgtgctccatggcgccgccgccaccggcgacgacggcgagccgccgcagcgttcgccggacgccggcgcgcgcctactcgaacctgccgctcgccgcgccgaggtccatgccgaggtcgcggatgcggcgcgcgacggacagccgcctggacgtggcgtcgcgcagccgctccacgtgcgccgcccgccgctcccggatcgcgtggcgcgcc

SEQ ID NO: 29489 - DNA, 40839 bp, Oryza sativa
ttatagtaaaaagtttacatatccgttttaagtttaaatttgattcaatttttttatatataatatttctatacataaatacttttcaactttgtgtttttatttttaaaaaatttatgatgtagtaggaagagaagaaggggaataggaaggaagaaaatagtgtataggggatgggggatcacccgcccattagctgcccccaaccattacgggaggcaagcaaaatagggcaaatctgccgaccgctgtgctgccgttagcctcaatttttctttgacccccatcgctctctctttactaatccaacaaactattttccctgagtttagatattgtttttttatgttggaaattagatctgcataggcagctgtgaccggtgagctccaaatataatccatctgcttagtgtaatatgttcatagtaagcaaaaaaaaatattaaacaacttcgattggctgaaaaaaaaaaagagacttactctccctctgtcccataaaaaaaccctagtaccgaatgtgacacatcctaatactatgaatctagatatatatttgtccagattcataataataagatatgtcacatctaatcttcgatcttagatttgtttttttataaaacggagggagtatgctactggggctgctagtagtgtacgttacggctagaaacaaggcagcagaaggccaaaaggcccattaattacatggacatttagttaaactaggaagatagcccgcgcgaatgcgcgggcatgtatcgtagactatgtttgagcatctacaatatatgatttctccaaaaattgttttcattagcattgctttataattttctaacctagctattagttatttttataacatgtcatatttaattaatccctacaagcaattatttataatattcttcatcatctaaaaagtaggtagacatattttgtgttagaaaacatgtattgcaaattaagtgtaaattcaaaagtaaggtgtttttttaattgaatgtaggttgtcattgtttgttgacggatgaattgggtgggatatgaggctccactaaatgcatgggtttatatagtctaatattattgtttagtttgagagagaatccatatgtgaacattctatgtagagtgtgggtgagactccatgcaacttagcatgaataatattggatgaagaaatatagttgtgcaatatattattttggaagatgatgtattatgaatacacacttgtcttttaatatgagataaatctaatggctggaaataatgggttcatcagtttaaaaacgcctaggaggatttatggggtaacatgtagagactttatataaaaaagaaaccatcatcaaaaatcgattagatgatatataaaataaaattataagtgtagcttaaaattatggtctttttaatatttgtttctctctttagtttagtagctgaaaatagggaggagactggagaaaaacgaatagcatagaactcgaatcaggtataagaaagggttcgcagtgtaatagtgttatgtgcatgtgattggagaggcaggtggagggtacattatttttttttcaatctttgtaaacaatctaagtgagaacctatgatgttgttttctcattgtaaggatctttaagacaagacatgtggtggcttaagtttttttataaagacaaaggtgatctaatagttaaaaataatgggtcatcaaattaagtggaaaccaatgtatagatatatactcccttcatccacacatattacttttatcaccaaaaccaagaaaatattaaatcatcttggatgttataaaatcaaggtgtaaatgcaagcatgcaagtatgcaactaatgagtatttagatgactcctccggttctaatcaaacattcagggaaaatttgaaccatgccacataaattttgcaaaatttatgatatgccaccctgacccacatgttattgacttatgtgggacctacatgtcattgagatacgggtggcatatatcaaattttgcaaaattagggtggcatggttccaacaaaccctttaatttatctcttcatttaagtcttaaatacataaagactataaataggaacaacttatttggaaaaactcaaatgtgaaatatgtctaacttttgtggatggagggagtactttatttttttctttgaatttcaatttttttcaaagttttaaaatatcatacgtggtgacttaagagtgctatagagcacgtttaattgatctttactatgtaaaacgattcaagaatatctaatatgcgctgtcatgttttttaatgttttgttgttatttggtaaggagattttttttattgaggtagatttaatgcgttcatctgtttgaattatttatgtctttaaatccaatttttaaaattataactccactgatttaaatgaaaattgatgaaattataagtccaacaatttaattgaaaattgatggttagatttgttttcttcataatattttttataattaatttttttatttataaaaaaggaaggtgagagaaagaattattgaagacggagaaagtgtatatatgtatacttacatgcgtggggtggtcggaagggtgggccagtggggagaggagagttatgccggtgggagacaggcgatggatgtggattgtggttttttttaagaaaaaaaagataaatctaatagtcgaaaatagatggtttaccgatttattataattccacgtggcggtttagttgtgtttataggcgtaccacgtggtagtataggagtgtttgtatacctttagtatataattttttttatttttaaatggtaattaggatgacatgccctagaaattattcttttccgtagaagtttaccacggttgaatcattaagtattttaaagacaccatggatctaaatttaaatatgttcgcaaatttgatgattaagataaatctagtagagcttagcaggatgaaaacatgtgcacaccctcatttgtagcagacctaatgctaattgcattgataatccctagcaagaataggttagtctatttggataaccacattaaagcaagcagcacgcacgttgaaaacatattcaacgttttgatttctctgcatctttatggtttattatactccctccatttcaaaatgtttgacgccgttgaccttttttaagtcatctttgaccattcgtcttattaaaaaaatttaagtaattattaattcttttcctatcatttgaattctatgtatatatatagttttacatatttcataaaattttttgaataagacgaacggccaaacatgtttaaaaaaatcaacgttgttaaatatttagggacagagtgagtataatttagtaacttaagattttatatggggttgctagcaataaagtaggaaattcacgtacttaccacagagagaggagtacgtatatatagagagaggagatttcttttttattgaaaacagatccttgagatatatctaattgttagaaataatagattcattgagatatatctaattgttcgaaataatagattcatcggtttataagttataacggatggtcagatttttttttcttttttctcataatttcaaagattttttctaatttattagagtgcgacatgacagcttaggagagtatataggatgtcacgtggtgactaaagtgcattcgtaggaagtttaatggacttgtgcgtagaatacaacttgaaataacattatatttttttacaactattagctgaaattattaatttggtttttatctctcatgagtgaaaaaaagaaaaaaaagaaaagaagggaaggggggacacgtacgtacgaattatatacgtacatgcacgtacacgtacggatggatcgatatagaacgtggcgctttctaaatataaatctatttggtattttttagttagatgtaatggttagaaaatatgggtcccccagattaaatgaaaatcaatggttagatattttattttttttcctagaatttctctaatttattagagcaccacttggcggcctaggaacatttgtagggatgacatgtggcggcttaagagcgtttgtaggaagtttaatggacttttagtatataataataataataatagatacatcctatttatttcgttgggcatcagctcaaccggatttgacatggtctaacaagcatgctgtttagaaatagaaattcaaacattacgtgctcacatctggaattttggagctgcatgtgtttagatgcaaaaaaaaattcggcataatacgttaactttcggcatttgaattttgtgtagcacttctccaattactcagtatctcaattaatcacggccatctctaatttaatttctacacatattctattatctttactaattacaattatttacggccatccgctactgcagctatcgtcggatccgcccatgggagaagcagccaccgccggatccgccaacaggagccgctgcaccacagtaaatatgcacccgcctccagtggagtggggatgccgccgagcacaaagatgtggtcctctcagtcccgcgcgacaaggaggaggaagaggtggggacggagttggtggcgtaggagaaaggggagaggtagctatcgcatcagtgggaacaccgccgagaacaacgatgcggtcctctccgctccgcacaactacgaggagggggaggaagtggtgggagtcaagttgcgatctgcagcaagccagcaagcatgtgggccaccagtagagatgtgaagcagtccacataccataaagtctatataactccctcatataagaatcaagttcaatttcccttgttcaattgaaataccatatataacacctcctacagctaccaataccggttcaatttgccttcccaaatggttttgatgatggtttcatcctgcatgaaataaaacatatagtcagacccacataaaagtagccacgtttattatttttttcctcacctctcaccaagggtggatccagcgtgggtgctaggggactcgagcccccctacaccgcgagatcaccattgatagaaggagagagaggagggagaaggagagaggggaggaaaagaagggggctgaaggagaaagaaggacatgagtcccccatatatctggatccatccttgcctctcgcctatctctccttggataatggctcggttgcgctgcgatcaacggtatagttttagatgggcgtcaacgaactccaacagacaaaagggcggtcacagatgacactttctattgcccccgtcctgagcatgtagctcaccaaccgcgtgtacgtagcaccaccaccaccagcagcactgccctcaccactgccagcattgcaatgaggcctagtatgtgagcatgcagaggtccaccattttcttcatccccgtcttctcatgcgttcgatgttgtctcggcactacggagcaagcactataaaaaagtctatattactgtttatgcgtttgatgttatctcgccactataggtaatatagaccatttctttctacacataaacctagtcgtcgaccaaaccaccatcgctggcaaactcttctttgcggaggctttgggcactggtcaccctgacgctcatgatgtgatgtctatggtctaacagttgggctcgtgtgtctgataggtggggtcagctggtgtgcttgcaaccatggctacagcttacgtgttgtttgcttgggaacttggcatgtatactcaagtttcgtaagttgttgggcgtaattttgttcctaaaaattaacaattattagtaactaagttagtcgttgctttcaagaaattggtaaattgtttttcaattaaaggcactagcagtccatcgtgctgaataatcgcatatatatattctgttttagcatcgtggtgatggccttttgcatggagtggtattatcactctcaagagtagtacaatgcacataagggaaatgcgcagataactaattcaattgacgtacaacataacttcagtgtgatttcctttttaagctggtgtcccccagccccttattgattttggactgaaaagttttgaaagtttgggctttcaatggctcctgtataatgtgctctgaaaatttggacttgtttagtttgacaaaaaaagtccaaatcctgtggaaattcgttaaagttgaaaaaaaagaattaagggatgtttggttgctagctatacactacaccacactttaccacagtctaccacgcctaaggttaggcaagtttagctaatttggcaactgtttagttgagttgccacagtcacggtaaaattccttatcatcatattaggtctcaaatgtcaatgacttaaaaaaaagtgtaacaaaattctcctaggtttgctaaggcgtgatcaagaatttgatcacctcatgttagacaagtgtgacaatttttatttgcacgtggtgccaaagtctggctaggaaccaaacaacccttagtatttcggtcccctgaaatgtttctatacgtgtgtttcaaaatagtgaatcctagccatctttgtattctcaatctttgtctaaaaactgtagaaccacaaagagtgataccgtttggaatatttgttgttcttgtatttatttctttcacatgtatggcttacataccggttgaaatatttactgttcttgtaatgtgattacagttcacaggaactacacaatactttttacaagacaatatcataaccttattattgtactctcttcgtcccataatataaggtattttgggtggatattatacatactaatactataaatatggacatggtgtcacatccacctaaaattctttatattatggaacagatggattaagtaattattctttatattatggaacagatggattaagtaattgttcgacgtgacatgacctctgtgatggcacattttgtcatttatagaacgacatttaaggtctccttttggtttgagaatcacttcctacaaagtacaaacagtttaatttattcaaattagaaaaaagaaacctttccaaaacccaattcctctccagttaggaggtgtttaaattcaggggtgtaaagttttggcgtgtcacatcgggtattatataaggtgtcgtatggggtgttcgggctctaacaaaaaaaaactaattacaatatccgtcagtaaaccgcgagacgaaattattaagcctaattaatctgttattagcacatgtttactgtagcaccgcattgtcaaattatagagcaattagacttaaaagattcgtccgcaaagtagtcgcaatcggtacaattagttatttttttagactatatttaatgtttcatatatgtgttcaaacattcgatgcgatgtaaaattttaggtgggatctaaacaggcctcatgggtaggatgtgtgtctctggtactggcaatttcacagcctgctataaggtgaaagcctaaaactgtgggcgagtttgctgaacacatcacgtattaacccaccgtttcccaacgcctgacgccctagatcctgcagcatacggaggattcatcctctggagatttgacagccacaacaacacacaagccactctgtcacaagggacaatgtcacggatctcccatacatgcttcagttaattgtttgctccataaaatctccacaaaaaaatatcctctccttgggcggtccagcctcttcttcttcctctgcccaattgcaactcacaagtcacaagcttcgaggtatatctgctactactagtacaacctatgtcaccatgaattccatgtcctttgtctccctttccaactgttcctatgcaagaactaagaagtcacggtacattccaaacgatgatgcttccagaacaccggatccaaatattctttttcaaaatttctcacgggtagagcccgtgacaaaagtttgtgtgtgtgtgagagagagagtgcttgaaaccctgaaaaagaattcaagagtttttgtaccctcctgttaattggtagctagagcaatggcacaaaaggtccagatgcccttcacatgttcttgtttcatgtgagttggattggagtgatgtgtcccacccccctcccaatccctttctctctggcctcaggagtcagcatgcatgagcaatgccctgctcaattacacattttcccttaatttgatcatctcccaaccactagtttaggttttcgctacgcgtacaaccgggttttcggtgtattcttccctcgacggtcactgacatgtggggtctctattgtgccggagtatacagggcccacctgtcagcgagagcgagcgggttttcaggacatttgtctttgtgtttgtggatgccactctcacaaactcagcctgaaatggacatgctactacactctatagaccttgggtataaagctggagtagaggcctatcagcttctccagctcttgcagaagctcaccactcgagctctgtctgaactctgaagatggaggagcactacaccatgaagaagccgaggttgcttcttctttccttggaggtgatactgattgctcttcttcttcctctccgtggtgcacattgtgagagctctactcaaggtgaaggcggcggtggcggcgccggcgccggcgcggcgaacctgacggtgaccggcacggtgttctgcgacgcctgctcctccagctccttctccaaccacagctacttcttgccaggtactactgtacttcagttatcatcaggcattcagcctgaagtcaatggtgatgtgtcccctaattaattttggaggattactttgttgtttagatttctgataatattttggtagaagactattgtcagaaatttcattcttctaaacctttgtggaatgtttgggtggacataatctgtttcttggaattcaaaattcccttttttttttctgattgatgtcatttcaaaccatttcatttttttataaatttgttcaaaatgtacatacatttatttttttaccaaattttggtaaatacacaagaaattttgataaaatttcttggtaactacacattagtggctatcctatcaaaacttaataatattatcaacttatcaaaatttcagtaggtttattttggatataatctgaacaatctatttttcctccattagttggaagaagcttggaacttgggagctctgttttttattagtttgtgtctgtcacgtatggaatttctcctgtacttttcgtaataattttagagaacgtagtatgataaacaacttgcaatctgcaggtgtgcactgacatgctacttgcacatcccaccaaaataaatattagccaagtagcccaaggtttacagtataacaatattaaactgtttagaatggtgctaagtttggaacctaggaaatgttatggtaccttttactaaaaataatagaaaatatttcacatatccgatttatccattttgtaatagatgcaggggccggattttatccattttgtaaaaaaacagactggctatatttatgacgtttcaaacaaatatagttaaatcatttttacagtatacactaaaattattgcatatgtaatttggtgacttgcaatgtacaaatatatactgattatttttctataaaaaatatggagtcatgaatatagctactcaaaaaaaataccattatcccaaaaacctcacaacaatcaaccatttaataatccggtcgaatacaaattgcagataattaatctgatgttgaattgcttggttgttcatcacaggtgtcaaagtgagaatcgactgcatgatcagcgtgaaatcggcgtccaaggaggagatcaagatcaccgccgagaaggtgaccaacaccttcggcgcgtaccagctcgacatcccggcgatcgacggcttcgagtgcgccacctccgccgccgccgccgccgactccttctgccgcgccgcgtcatcgacaacccctcgccgctctgcaacgtgccggcggtcaccaccaccgtcggccacatctcctcctcctcctccggccacgaccacgaccagcccaacgcctgcctctacaacctcaactccctctactaccgccccggcggcgccaagaacggcggccagtgcggcggcaccggcggcggaggcgacgtgccccccgccgcgctgaacacgtcgctgttctactgcccgccgtggccgtggccgccgatcccgttctgcacgccgcgcccgtggttcccgcccatcccgttcctcacgccgccgccgccgccgttcctcccgttcccgctcccgccgatcccgttcctcacgccgccgtcgccgccgccgccggcgttcccgttcccgctcccgccatggccgtgggcgccgccgccggcgttcccgttcccgcacctcccgccaatcttctcgccgccgtcaccgcccccgccgccgccaccggcgttcccgttcccgttcccgcagctgccgcctctcccgcacttcccaccgctgccatcattctacccatcgccacctccgcctccgccgccgccgccgccaccgccgccatcgttcccgtggccgttcccgccattggcgccgcttttcccgccatatccatctcctccaccgtcgatgtattctcgcaaagatccgagcacttggtcgtcgtcttccaaacagcagccatgagtaaaaaatacattttgcttgtgctggaaattgtattgtgtactatgtatatgagcttttttttatggattgtttagtgtaagagtgcatttggctatttgcactctgtatacaaatatttgtagattttaggtttaaaagaatgaagattaggttaatcctactttgtgactatgaaagggtaaaataatcgcggcttgtgctctctctgtcttcgactgtttggtagtgtggaaatttggcatacaggttaatatcaaacagtgagtctcaacttatgttttgaactttttgtggaaatatatattgtatatagaagttgttaatgatttccaacacaaaagatatccatggtttaccatgttttgaacttcagattgctcctgtggtatatttttgccattgtcaaagctgaatcttgggttgctgagtgcagagtacttggtgtgttctccccaattctggccttttttatttggcattgtgctctgattgaataaccaaggctgtaatattttttccaaacaattttacgacaacagtgacaatttaaacttcatgcatttgctttcacctatcgccagtcaccctacaggtaaagcagaggaaatggggaaaatataaagggaacggagattatctgtcctgaaattatttgttctttttcgtgtttcctgtcaaatttcctgttttaccctcgcaaaatacagaatttttatgtttattttttttagggggaggtcaattccgcagccaaactagacggttctttttctttataaaaaaatgtagaaatttcagctagtattttttttgcatttatatttgtaacctgacgaactgattttgaagtagaaaaataaaaaatttcatgtagaaaaccatatttcaacttgattgtgacttaaatttcaaatccaactgtttttccttgcaaaacaaaaaatctcagatatttgtaagagaaattttatggcccttgaaaaaaaaactaagaggtacaaaatcctacagtgtaaaatttggtacctgtgttactttctcattcattttgaaaatgccaacccaaaactttcgtagttgcaaattataatttggcagtggccttggtgtttatgatatattagagagaaataaggatccataatgcatctattattcatgagaaaaatacaaattcttaaacatttacttacactcatatattttagtatacagagtttcaacaaaaaaaatcatttgcaggaatggaaatcgtatagtataattatagagtaaatttcaaaaaactgcaactatagtaacaaaactatcagtttactacaatattagtgatctatttcagtttgctacaacaattgcgtgggaaattatcacaaaactacaacttttgtcatgtagcagcatatcacgtaaaacttacagttttatgataatttcccatgctattgttgcatcaaactgaaataggttactaatgttatagcaaactatcatagttatagttttctggaatttactcataattatatgctctcaagcttgcaatattaagtatgccataaagctgggttcccttaccggcatgtaagggttttaccgccaccaagacagcaaccatgcagttaccgtgcaagaccacacaagattcatcttcaaatctcttagggcttatttgtaacaaaggaaaagatgatttttgtaggattgaaattctatggaaatttttcctaagtgctcatttgaaacaaaggaatgggcacttgaaattcccacaaaatccctatggaatgacttgattcatagcaaatttggaggttttttaacatgagattggacctcatgagaaacttttcttggtctatctctccaaaaatcttgtacttttcttatggagcgtccaagcaacaagttttgcacaattcctgcattttagaattcctaaggatcaactagatatgccacctctatttctacatttttcatgttcctgtttttaaatttctttgttctaaagagccattggtcatggtaactgcactaacccaaagttacctcttggtaagccacggtaatcataatactattttttaaaagagttatttgcaaaaaaaggaaaccatataaaaaaccttagaaaaagttttaaacatttcagaaaaatattttgttgagtgagagagtgaatgagtgaaagagaagatatctctctgttgggtctaaatgggctttatgaatagtactcatgttggcctactcgagttccttttttttttctattttcatttccactttggtttggctcgaaaaaaaataaagttaacttagtatttttcacacaagtttttcaccatatatcactagaattgatgttccacttatagattttttcggtctttttcaaatttgcattcaatcaaattttaacaaatcataccggcggtttaccctaccaagcccccacagtaattatctttttgaggggaacccccgcagtaactgaataacctccagtattgtcaaccctcgtctaaagggctgtgtaatgctgctcttatatgttcggaaactctaaattgaagagtgactattactctttcatcaaggaagagtgactaagttctggtcttcaactgtattgagtattgcaatcccaagtgattacctgcaaagaaataactctttaattttactcgcaaaagggaactctttaatttatttgaaaatgataatttgtaccaacttattactgcattttttttctcggttccctttatattttccccatttcctctgctttacctgtagggtgactggtgataggtgaaagcaaatgcatgaagtttacattgtcactgttgtcgtaaaattgtttggaaaaaatattacagccttggttgttcaatcagagcacaatgccaaaccaaaaaggaactgagaaaacggggaaaagtctctgcactctgcaaccaagcgctttgagcctttgacagtggcaaccatacattactggagtatattctgaagttccaaacaagataaactatggatcttttttggtgttggaaaccatttaacaacttctatgtactatattttcacaaaaagttcaaaacacaagttgagcctcactgtttgatattaaactggatgccaaatttccacactgccaatgagtcaaaagacagagagcacaagctgcgataattttaccctttcatagttacaaagtaggattaacctaaatgggcttcatgagtagtgctcaggttggcctatttctatttccattttggtttagctcgaaaaaattaagttaactttagtaattcacacaagatttttttactagatagcactagaactgattttttacttatatatgttttttgatcttctttaaattttagtccaaacaaattttatcaaaccatataccaacggtttaccaaaccgaacacctgcagtaactgaccatgcagtaaccactgttattgtcaaccctggtcaaaagctctgcgcactgctgctcttatgctcggagactctacattgaaggaaatgctatccttctaaatgcaatatgtaaaattactctttcatcaaggaagggtgactagttctgatcttcaattgtattgtaaatttgtaagcctcggtgattacctgcaaataaagaagtctttaattttactcgcaaaaaggaactcaatagtttcattggaaaatgatatttcctgcaaaaaacttgactacatttttttatccccaaatttcattcgaatgctatatagcaatcccctttctcaaatcatgttcctgtaacttttctttgttctgcttcgatggtctctttaaataaccagtgagtctgtgagtgcacaagcagcagcgagcgacggcgagtgaagctcgttccccttttcttttttccttttctttttttttctttttttttctaccgagagatcagcgtaccgtcaatataggacagttactatcgatcatatttgagctaatttcttctttttctcacggttttgaacactaatattgttctgataaattgtctatatctagctagttaactctcaatatttttatataacattgaagaggtaatctcacctaactaaataaagaattaactacacccaaatttatacaaccaactaaacaaaaacatcttctaaaccgtatctctcatttatgcaactaaacaaaatctcatactaaccagacaaaatcaatacaaggaaacaaacaactttatatgtatctttttatctggagaactgctagaccacggtatcccgtgtaacgggatagattataatgagttaatgatgagtcgttgcccccaccaaccatgcgcatgtgtccccacgcgtctgtatctcttcctcccacacgtacgcatcgctctcccagacccttcacgtgtccattgcgctcccccacacatccatgcactcgcattgagtccccacacaacttttaggtatcagatctgatagttgatacctgaggtaccagatctggttggtacccgtatcagatctgatagttgatacctgaggtaccagatctggttggtacccgtatcagatccgatacttgatacctgaggttccagatctagttggtatccgtatcagatctaatacctatggtatcggatccggtacttgatacctgaggtaccagatccagttggtacccatatcttgaaaatgatacctgaggtatcagatttggttggtacctgtaacggatctggtaccataggtatcagatccgatacttgggatattagattcgatacttgaggtatcagacctggtacccatgttactatggttggtggtacctggtctggtatcggtacttgatatctgaggtaccagatcgggttgatacccaaggtatcagtctggtaccataggtatcagatccgatacttaggatattagattcagtatttggggtatcagacatgggctgttacccatggttctaaggttggtggtacctggtctggtatccacgaggtatcaagacctgtagttgcatattaggcttggtaacaacaaaaaaaatatatcaaagcctggtacccagaggtaccattttgtaccaaataagtcatcttcttcctctctccaacacactatatcctcatccacctgttgattccttagcatgaaatcgaagcaacagcaacaacaagaacaataaaaagagatgagattgtgagtagatgcaggcgacgaactactagaaaagccatatcctcatattcttccttcttcctgtggacatctaaccccatgcaggctctgccattgttgcactcatgttgaattgctggggacatcgccgatggccggctcagatggtgttacggtcgatgcggcgagaaaacggctcccggtggccagcggctagtggtcgtgggcgtagagagggggacagaggatggagggagtaacttgtgcgtggtgggtggtggacgacgctgcatagacgagtcaagaagataaggtgtagggcgttgatcattactctactccgttcaaacggtatgtagttctatagattttctgttttatctggaccaaactcagtcgagaactgggttaggccactacccgtgcaaccaaacacatccataatgaagtgtctggccactacccgtgcatgatacgtacattggcacttcctgtccaacaagaagtcaagaacagagttacagccgacacttctgcaaacaatccattttacacgcttgaggtgaaactacgtggtatttaccgtattttcttacgctaatttataatacatcgtgttaacttagcacttctgaatttgtttccaaatccgagactatccaagccaatatattctgtttctaagaattgtttgggtcgatcagaaactatctgatccgttttcacgcatactacttacctcatagagaccatatataaaaggcctctgcacaagtagctgtactacaatatactatactacaccgtggaataaacactcagctggagttccatttcagatagttttgtctctgaagttcctgcattattccaagcaatatcaatgggtcaagctaaaactaccatcaactatatgccgctaatttttgggtcatgcttatgacaaaaatgtcggcatgtcttcacttagaaaaggagcaaaagcgtaatgtttatgtactatagtactactaataatcatctatccaaagttgcattcatgaaattgttggagcagttcagatttcagccatgaatcgcgtgatttggtcttctcttgacaaatcaccaaactgattaataattaattaaccaatcttaacttagtcatcaacagcaaacatgtagggccatggtgtgggttatcctgtgcccccaaagctgcacaggtccggtgttaattaactggttttcaatcgatcgatcaggttcaggtcgcctacccagcaattagcatatttcggactccggaaagtgacgcgataaaagacgcatgcatatgcatgctgatatgaatatgcgaagcacgcacgcatggctcgtttgtccactgctgcaacttttgttctcgtggaaagaagggcggttcttgtcaattgttcgtcatgatcagaggctatgcatgcactaccagcattaggtacacgaaaatggagggagtagatagatgtaaaaaagaagtataggattgatagaatgttactcttctactgtactctactctctctgtaaaaaaaaaaaaaaaaaaaaaactcctgcatacttaggagtgggttttcttacggagggagtacatgtcattaggccgagtttagttccaaaaattttttttaaactttcaatttttctatctcatcaaaatttttctacacacacaaacttctaacttttccgttacatcgttccaatttcaaccaaactttcaattttggcgtgagctaagcacacccttagttattttccttttttgcaaagtttgcacaatgtgatcatacatgagaatgatatggagtactactatgagactccatataagtttctctctcaaaaaaaaaagactccatatgttagtaggtattttccgactccgacatttttacatggttctttcaaagtagagatccgcgattccatttgtcccttcaatcttgataataattgcagagttggtgtggtacgtgccctagttagtactgtacttgttgttcatctcgtcagaaattgccaatactttgttcggagtggtaaaacattagttgtgcaataaccagctcactccctgctgtgtatactactgatctgatgtttatagagactcactttgaggtctaactttgagattgttttcttttccttactttcccatcttcaccctttgtttttcgtgcgctcgtttttcaaaccgttaaacggtacattttttaaaaaaaattctatagaaattattttagaaaacatattaatttatttttaaattttttttagactattacttaattcattacacgctaatgggtaacaccgttttcggtgactaagaaagaggttcccaacctctccactaaaaggttcgttgatgaaaagtttcgggacataacagacgagactagatagtgctactcccagtttggagtatttttatggagtaactacataaagtttggtgttatctttagcaaccatattgttggtgtttgtgcagacaagtttagctttgccctaattgtgaggcgacagttgattaactttttgacaaatgaaagacaagtgagctgaccagattctcttgctggcttgcttctttgtccagcagtgcgaaaaaggtttgcttccactgctactaccatcacattaccaatcatcatatgctcagcttaacgtcatcccagattctacttacacactaaccgaggttaggctactggtacttcctcgattagtaataatactagtactaataggagtactaattaagattataaaatgaggaatacacgcaagcgtatcccagaagaatgcaaacttgcttctctgcaacaatggaatgtgtgtctgtgcaaaagatcttgagaagatcacttggcttcagagcgatcacttgttcaggcttcaggcttcagaggttcagagcaagcaggatacgtgccgctaggagtagcattcctataacttgcagggcaatggttgccaaactgctactgggagtagtagtagagctaaaagtttgctgatttgactgactgaagtgattgagagggattttgtgcatctttttctactgggagagataattgcacaaagccctatttttgactgagcaggcagtacctctttttctgtatttgggacagcttcaacaccatcagaatcttggggtttcgtatattttcgttcgtgctagattacccctgtcaccctccctccctcaaaaattgttgctgtgtatttatacagaaactatgttcaaataccaggttagcccccctttgattcaaaggaaattcataggattctataggatccattcccttgatttaaagggctatatttaaaaaattcctatagaaataaaatcatctaaaattcctataaatttcctttgaatcaaaaggagcctgagcctttatctctcctcaaattcctttgtttttcttgcggattaatcaaacggtctttcttatatttttcctatattttacatttgtattcatgtcagaatcctatattttttctattcctccgttttctaagataaagtaaatacaaccttcgaaagagaataacttgtatccttaaatctagacatgaggtatgctcagattcataattgaaagtttaatttattttacggaaggaacatagtaggcttcttattcaaaatcttgtggagatttaaccatctgctttttttttgtctcatactaagggcatgtttgggggagctttagattctgagaagcagctgtttggtagccagcttctaaaaatctggaaaagctctgaaacccagcttatccagcttctggcttcttagttcatttttcagaatctgtaactatagattctcagaagctgtggactatttagggcagcttctagcagaagccaaaagctgcagctgggagaagctcccccaaacaggacctaagatgtggctaattcgatcctaagggcattaccattgcaagctacaccaattgagtttctttgtaaaaagaaaacaattctacataggagaaaacactaataagacacatatcccacaggacagagtatccctaccaggctgacaaggaatgtttagtttcagcccatagaattttctatttcagtcctcataaaccctaaatttataaataaatccagaatttgttaaaaaaaacctaaaaacaaaaggcacaactacctttgaccaagtcatttccttatttttatctcttaccaccatccaccattcattcttatctatggcctagtacaggggaggttaagattccaagaatcagccggtgaaaatctggagaagctggaatatcagcttctggcttttttttttttgaaattagcttctggcttttaatttattttatggattctacaactacatcttctcaaaatctgagtgaaaatctgtattgtctaggggagcttttggcagctgtagcttctagaagaatcttcagctaccagaagctcccccaaatagaccctgctactcgttcactcattgtcacctatggccatcgatgaatcgcagcagctcctcctctgaccaacacctcttctccctgccagcgtcgctgtccctcagccggcgcccctctcctccttcctgactagcacgcctcctttcctagccgatgcccctcccgcttccgtgggcttgccggatttagaccaagcagagttcggaggagacggctcggtccagcaagctcggcaatgacaccagcaacaagctccccctaccaggtcaacggcagcaacaagcccaacggggagcagctcatcagctggtttcaagccaatgtcgttccctccccctcctcctgtccttcgcttgtcgcaacctttgctggcggcagttgctagtggggcgaagcggtggtggaagaagggtgacaaagatctaggcgcggggcttggagcagcggtggtggcgcagttcttggcagagggccacgagctccaccgacggtggccgacgactcctcgagctcccctatcccactccactggccgctctacccctcctcctctagagctaaggcggcgtagattgacctccagcaattctggatgatgagggaccatgtcgttattggattgtggggcaccgtgcgtcgcagcggagcactcatgccctaattgagtatcggaaaaccttgcatgggaacgaaagagcatggcatgaaaagaatctttgacatggcacctcgaatccataaagccatgttgctgcactgttatatttttttggaatataggatcacgttggaatggggaaattttagtttggaacaagtacgaattacccaacccccccccaccccccgccggaactatcacggtcaactgaattaccccccataaacccgaaaacaagacatcgttcaccctaaactttcaatacagtcaaattacccccttcgacccaatctagaatcacctacgtggcatgcacgtggcagtcccgtcagcattttatttataaaaaaatatgggacccacctgtcatgctcctcttccactctcttatctctctctatcactctctctcatctctctctctatcactctctctcttctctctctcttactcttcctctctctctcttgcgggttggcggcaggcggtgggcggcgccgcaggacacggaggcggcgacggtaggggacgcggaggcggcgacgatgcgggacacagaggagggagtggcgaactctgagagggagtgggagggaactccgtcgaactccctccgcgtctcgcgctgccgcccacggttggtttacggactgcaatcagctcggaccaccagcctgcgcgcgccgaccgcccgcctctccaccacagtctctgccgtgccgtgtgtgtcacctccgtgttcgccgtccacacccgcccaccgcctgtccctgcctccgtccatcaccgcactgagggggcagccgccttggcgtcctgcgccaccgcctcctccacatcccacggctcgacccaccacccgcgcgccgtgcatgcggaacacgtgccgctgctcggcccgcacgcgagagagaggaagagtgagtgaaagagagagagaagagaaaggaagagtgagagagaaaagagatggaagagggaagaggagtatgataggtgggttccactttttttataaataaaatgctgactggattgccacgcgcacgccacgtaggacaaaaccgctctggattgggtcgagggaggtaatttgtccggtattaaaagttcagggtgagcaatatctggtttttgggttaaggggtaattcggtcaaccgcgatagttcagggataattcgttcttttttcctttttgtctagaggaatataaagttgtacggtatttcacacgagaaaacagcattgcaactattttaggaagcattatcgagggtcgaagcggattttgtgaagaataatttcgtacctattaaaatgtaaaattaattcctgtaaattctctctaatctcctcctttatcccttcattttatggacaacagaataggcccttaagaagtgggagtttgtcggaacgtttataatttgatttattctgcgaggaggacttgttctcgtggtacagcctcaaattttctcaagcgcgaaactctcttttgatcctttgagttttttttttttctaagcaagcctgtttcaagttgcacaggtaatacctcaattcacgttccaaggtagttttgccactgctagaattattttggattaatggatccatgctattataaatttttaggattaggcatatgacattataattcatgtatttattacaatgccatagttttagagctcattacatatcctttcactacagttaaaaataaaattggaccaaatgacccacttctgccttcctacctacgttgaaaatttaaagaatatgtgcaaaaactaaagaaatataattcataagtttctaatacttcgtgcatcttagaacgtactagaatgatttagttttgttataagtcaaactattttatgtttgattaagtttataaaaaataacaactttaaaacacaaaatcaattcattaactccactatcgctctaaaaaatgaaactccattattgaatagtatatttttataatatatttgttctactccctttgtctcataataagtccagttgtgggtttcagtgtcaccgtccgtcttattttttattattattattattattattattattattattattattattattattattattattattattattattattattattattatcatcattattattattatataaaatatgaatagttctttatgcgtgacttaatttttaaaaatttatcataaattttttaaataagatggatgatcaaatattggaaaaaaaacgtatgactacacttaaaatgggacggtacttggaacgggaccaagggaagggagtacgttaaaatgttgccacttaaggaaaaaaaacaaaatacctttactccattctacgaaacgaagggccggagcaggaacctaggccctgtttaggacccacataaaaattgtacacctgtcacatcgaacgtttgaacacatgtataaatattaaataaagacttaaaaaactaattgcacagattgcgactaatttgcgagacgaatcttttaagcctaattgcttcatgatttgacaatgtagcgttacagtaaacatttgctaatgatggattaactaggcttaataaatttgtctcccgatttaacgagggattttataattagttttttattagtgtccgaatagcctatgcgacaccttatataatatccgatgtgacacgtcaaaattttataccactactccctccataaaaaaaaaagacaacctaggaggggtcaccctctagtacaatgaatctggtccagatttgttgtacaataaatctggtccaaattcgttgtactaggagggatcatatcttcttctagattatttatttttgggacggagggagtagatctaaacacccccaatcgtttgataccgcataggagtacactgactgcattatgttgtagccgacagacagatgaccacgccgccgtcggcgcatgcaaagagaaaccaccggacggaccgacggtggccggccagacaacacgacgaagcactggaaaggtaaagctacaaggaaagaaccggtactggagcagccgtggcctgtcacgtgtgggtgggtcccacctcccgacacggctctcgtcccatctccaaagcacaggtttgctagaatgatactatcctgtattttggttttgttaaattgctactctcaattaaatccatataaaaaatgtcataaaaacaaaaatatccttgactcctaccttcctctaacatgccggaggtgctttgcctgtggccaccgaactccatgaccgccgcctaggctcactggctctggcatgcgctccattgccaccagcttagagcaaccacaatgtataaaaaagatgaccttaagataatgattacacttgtaaagtaagctatatacattgtggaaagtagcattaacttagggtgcaccttatgcttaagatctaccacaagcaaaaagaaaatattttttttctctctcattcacttcatgaacaagagatgaaacaattatttttccattctatgtgggcccatcttgtggctaaattctaaccttagcattgtgggtatggctttaacaatggctcactattcatagggccaccttaaggttacactacaccacaaacattgaggatgcccttaacccaccatcacttaattccctccacccgccaaaccctagttgtgccgcctaatcaaagccgccgtcgttgtacatctatcgtcgtcctgtgaccctcttgtcctcggccctcttcagcagcccgcaggtcatggtggtctgtcgtcgcgccgatgcagaaggagtgaggaagatagaagagctaggcatgatgtactcatccgtgtccctcttcgacgaggtgcatttcaaattttcagttcactcatatgtcaaagggtattctagcatgtaactttttttttttgtgaatatcaatgttgaatagttctacattgattgtgaaagggtaaatgatctaagatataagttggggaacccctcacctcaatggctggcttttggggtgggaaatgccctttacgatcctacaattgatatcagagcctggctagtttaacatctctagcctgatggacccaggctagtttaacatctctagcctgatggacccagtgtgtgaaggcctgatggaccatgggtgcctgtggagcccatatacctgatggaccgtgggcggggcccgtatacggtaaaggggcgatgaagggctgagggacacattggcccgatgaacacagtgtgtgaaggcctgatggaccgtgggtgcctgcggggcccgtatacctgatgaaccgtgggtggggcccgtatacggtgaaggtgcggtgaagggctgagggattccaatgtgtgaaggaggagattgttgaatagtcctacattggttgtggaagggcaaatgacctaatatataagtgggggagcccctcacctcattggctcaatgtctagtttttggggtgagaaatgccctttacgatactacaatcaatttaacaaagccgaattttagcgtgtactacataatattttttgggaatatcaatttaacaaaatactccctccattccaaattaatctatatatttcataggtacaccaagaccaagaaaagctaataactctctctcatactatatttactatagcaacaaactcaatgcatgcaccatccccactattttctagccaatagcaaatcaaaatattgcatgtgggttataaatacatgtgtgcatggatgcatgcatcaatgtccatttagagcaagtttaatagtatagccaactactagctccaattcatctatagtcaatctaatagctcattcatacaatagttacatactccctccatctacttttgatagtcatatttcatcttggcacacagaccaaggataagtaattctacttatcatccatttaaacatgctattagttattcatcgtaaacaagcgattcattaatatttacatttctcaatgcccatgtagccaatcatgtgtgaaagaatagagagtcatgcattaaattcgagaaagtcattaagatgataggttgttggattgaaatatgcctatcaaaaataaaattttcagatttggaaatatgactatcaaaagtagatggagggagtactacactattaatacctggtcccacctgtcataaacacgctgcgtcttggagtccgtactatagctggctattaatctgtagcccgctgcccatctctctccttatttatctccttaaaatatatttgcatttggcttatagcctgctattgtccctgctcttactccaatacacaaataacgaatagacctaataaatgaatataaatatgtagatcatttagaaataaccttaaaaaaactatatgtagattaatttggaatggagggagtactatttggcatactacaagatagtattctcacaagtcagaagtcagaaaacccctgttgaatgatggcaaactagcaattttctcctcgatgaaagccatcggtagtggcccgtgctagctacacggaggaattaaactcggcctcgttccccgaggtcaaggcgtcacgcacgtactcagccgcggccgtccattccagctcctgccgcgcatcgatctccgtccagccccccaagtgtagtgtcaaccccgcccctgctgctgccttgcgcccagcgtactccttccgtttcggtccgtgtgctgcagcagcacagcctacccgtaggttgtacatctagccctgctgcccctgttacgcaccggatcctcctcctctaggctgtgtttagatccagtttggatccaaacttctgtagtttttcatcacatcaacctgtcatacacacacaaattttcagtcacatcatctctaatttcaaccaaaatccaaactttgcgtgaactaaacacagccctagtagtggtgtgtttaaagatcctcgggtaaagtttacattaggccgtgtttagttttaaagtttttcttcaaacttttaactttttcatcgtatcaaaactttcctacatagtagtaaactttcaacttttccgagtttagcttatgccgtgtttagttttaaagtttttcttcaaatttccaacttttccatcacatcaaaacttttctacacatatagtagtaaacttttaacttttccgtcacatcgtttcaatttcaaccaaacttccaattttggcgtgaactaaacacagccttaccgcatcggatattatatagagtaccttatggtgtattcagcactaacaaaaaaacctattcattaaacaacgagataaatttattaagcctaattaatccgttattagtatatgtttactgtagcaccacattgtcaaagatttgtatcgcaaagtagtcgtaatctgtgcaattagttatttctttagcctatatttaatacttcatgcatacatatgttcaaacgttcgatgtgatggagtgtaaaattttggggtgtactggcctagtctcagcatgcacatacacacaagtcatccgggagaagaaaaaaaaagacacaaggcagcaagagagatcagagatgtgcaagtcgcatgtagttgtatactactagtactagactgtcactgtagagatggagatcgaggagctcaaccagtagagggatggccgttgtcactgttcaccacattccggaacgggactcccgcgacatgccactccggcgagatcgctaccctgcgcccacaattcggggctttcatttttcctaggccgtccgatccgatcgtgcctactctctccctctcctctgttgaccgcccacttgctgtcacccgggccccccccccccccccccccgttttccgttgaggagtgcaccattctagtactgccactactgtacacatcactgttactacctcctcgctccaaagtggtagtgttcccggtgttcaatggcgttcacatgcttcaatgcgccggctgatttggcaagttcacgaacgccttcatccgcattcactacctctgcccagggcccccccatcacacgaatgaaatttcgctctccttggattggattttgcatcgatccttcctgcattccttccttcgcctggccatctccttcaattcaattcaattcatatgccagtgtctgaactcacatctcaattctcacaccattcttctacacagagctagttggagcttggaggaagaggaaccccgtaacagtaaatgccagtacacgtgtaaacccaacgccagggcccctacaccaaccaccaacaatcctagtagcagcagcatcatgaaccatccctacaatacgaggctactgctgctactactactccgcccttcacatcccaagaaaagagggcaccggcatcacatcgcatcacataaacactcccttctccaattaatgccacacgcaggcaaaggcacaaagccccatcgcgtcgcgtccatcgcatatctgtcaacaacacagacttcatgcagaggaccacggtcttttgcacaaaacaccacccccacccctacctttgcctccgccgtatacatgcacgccaccaccagattgccagcatcagcatcgcagcggcatgattcacccatcaaccacacacgacacgagccacacggtgtggggaggcagcaatggttgccattgcccttttgccaagatggcattccgttccacatgacatggaactgggacctcctcctcactgcctcacagggctcagcacaggggccaaaccacatgcaaaagcttgagccaaaaggagaaagcaagcaagcatgcatgctttgttgctgcaacgaacagtgtagcaaacctgcaatcgtagcagaagcaacaagacgaagggcgaaggttgaaggacatgtctacagttgttaacttgacccgggcctgagacgagccagagggggggagagaaagagaagattccattttagcctcaaaagtgcaattaattccacttccgacgagctgtcacccatgcatgcaccgattgtacttacacgtgacctgattcattcccggttttgctacaaccaaccaccacctcaaagcacagtaccacgagagggaagcacaaccaaagagtgacaaaaataaacttgttccatccgcgccaaaaccacccgagagatttgagtaaaacagggttaattacactttggtctgcctgacaggcaacttaacaacaacattaagctgcatgcaagaagcaggaactactgctaacgctatactgcaggtctagtagtagtataatgagggtttcatacatgttgggaggagtacgcactgcgtgaggcgtagcaaatggtgagctgttgttctgtgagtgatactgacatggggtcaaaaaaaaagaaaagaacaaaaaaactagtaaggcaagagatgtcactagtactactgtttctctttcgtttcttttgttttgtctactttttccttgcggcgattgacggcggctatggggcggcggggtcgacgacgcaggttgcgacggagacggagagcttgtaggggaaggagttggtgtactcgaaggagacggtctcgccggcgaggagcgggcggccgtcgttgaggaggcagtcgtcgtggccgagccggcggaacacgcgcgggtccaccaggctcaccgagctgaaccacccgcaccgcacgtggatccccgcgatggcgcactcctcgtcgccgccgccgccgccggcgcaccggttcatcacgtccaccgtgtacgccggcaccccgctcggcagcggcgtcgccctcccctggtagatcgcgatgtcgtccgcccccgcgcacccgtcgtccacccggcgcgtccgtactccgtctcctcctcctccgccgccgctgccggagacgaaaccgacgccgacgacgtccgcgcctgcaaaaagggtgaaagcaagcgggccccaccggtcagtcactgcatgcatgcggcgacgaaaaactgagagcaccgcagacacgggcccacatgtcatgctccgatacgacagaatggaatgtgagggcgacggaatcatggcgcgccaaagggatcgtctcgtctccgaggacaaaacaggaggcgtctccgtggaccccacatatcaggctcccccccctctggcccccacggcctgcgtcagaggcttgtcggagaaagcgccggccgcgtgggccaagcagcagccgtccgatcggtcaatcggacggcgagataagcatcgccgagggaatcggggataggaagcttgcttttaccttgcgggcggaggagcttgcggggggagaggacggcgggaggcgtcgccggggccggagaaaccgccgcgggaaccggggcggcgagcggcggcggcggcatcaacggcgagagacctgcacaaaaaaacgcccgcacgattagacccccgccacacggcgacagacacgtgggaccaacccggagtgggccccaccccgtcagcgacacacaaaagcccaaaaacttcaccccacgcgacaaatccacgacgcggcggcggcagtagcacacagtgggagaacagcgatacgaacagagcgaaatcaaccaaccaaccaaaaaaaaaacatttcgaatccatgggaatggatggatgggtgggggtgggtgggttggtggtgggcccaccgcgctgcgcctctccttgttcgtatcccaatcttggaaaggaaggcgcaggtcgacgtggaggcatgaacacgatgaacagtagcagtacaatgcaaattccagaaaccgcacggatggagggagagagagagagatctcgtccgtaattattaatgatgctcctagtgatgcaaaactaatggtgcaaatccattgcacccgtgcggtatttcgagaattttattcatacaaaaatttttagggagaatgatctcatcgaaacggagccaaaacgcagagagatttgacgaggaaaggagtgcgatttttttttcagaaatatatgtgcagacaaaaaaaactggcgaatcatgtgtgggagaatcaagcagcagcgcacaggatgaagcggggtggttttggaatggtgcgtcacctgtgtcgtcgttggaggatgcggcggcggcgagggcgacgtcggagcggagcatggcgagcagcaccaccgcccacgccgcggccgcgaacgccggcggcggcggcgtactggacgccgaggagaccctcatcgcgcggaaacccgtgcgcacgaacgcctgaaacaaaaaactccggggggtcacgagacagatctgccacctccatggctccatctgcaacgaaaatactacacagaaaaggatgcgacgaactagagcatcggcggagaaaccaaaaaggcccgcagaaagcttgcgagagagaggacacgcagcggcgccgcctcgggccacgcgcccccttcccccgctcctccgcctccgcccaaaccgacgcggacaccatccctcccacccaccggagcacgcgtctccgggagggagacgagaccacactcgcacacctcggaaccctcgcccgcgtaggctcgagaaggagaaagaggaggaggaggtcggcgcctaccttctggtggatgacgaggcggaggcggcgacggaggccggcgacgagtggccggcgaggacgcggaggaggaggaggagtagtagtagggtttgggcgcggcgtcgctatccccctctcccctctcgcacgtgcgcgcgcgcggcggaagcgggcggcgaaacgaaacgaaaagaggcggtgtgaatggacccagaggcctacataggcggcgcggccggagcggatcgggaggaggcgtggcgtcgcgtgttgtggtcgagtcgaaccgggccggcgcggtggagagagagagggagagggaggaggggaccgacccgacagggaccagaaggaagtgatccggtctggcccggttctggtcaaggctgctgcacacagcctgcacagggagggagggagagagaggctgggtaccggtacatggcactgtgtagtgtggattggcctttggaaagtttggggatttttgggcaaactttttgttggtttgaattctgggtttcttttttgggggattgggtttttggtggccttctctgcctcctcctcctttcttcctcttgtgcttttggaagcagagagaatgttgaatcggtagaggagcgcagccatctctgggaggaaacaaaatagaaggaatattatgttagagtgctcgttggaggttaatttaccaccctcatgcttcacttgtcacaccaaattcagtaaatcaacagtccgacctgtagtatgataagtgaaatattacgcagttgagatgtaggctgtgtttaattcacgtcaaaattggaagtttggttgaaattggaacgatgtgacggaaaagttggaagtttgtgtgtgtaggatagttttgatgtgatgaaaaagttgaaaatttgaagaaaaactttggatctaaacacggccgtagtaaagggtgcatttatgggtgcacgcgtgtgaagaaagagactccggtagcgacaaatatcatgctaatcttgtagctgatgattaccgcgcacagttggcctcgtttgttgcttttgttccattcgtgtgtcttcattcctcccatcatgtaccactaacactaacgattgcatacgtggggctttttagaacacaaacaaaaaaaatgttggagtgccttttggaagcttaatactaacattgctaacttgtaatgctagccacctattaagcaaatcaaaagtttgaggctggactatatcgtaaagataaaaatcacatggaaatgcgataaaaccatgcattcatgggtgcatgcatgtgaagaaaaggaattaggaagtgacaaatatcgagtttatgactatggttgaactgttgtatccttgcaccacctgttgtaccctcatttgttaaatgcttggcatgcatcatcataggaaaccttgtccatgattatggattaaatggttccagacttatggaacaacacacgattcataagtacgacacaaatttttagattaatttggttgacgatcctaaccaataagatcgattatgggattacaccattcatttttgttcttagtttcttgaattaggttaagtctaatttaccacacgactattgtgaaaaatatgatttaccctcctaactataatttcagacatttgacaccctcaatctatttaatctagacgaattaccaagcacgcaaacaaatagttatataacatgtgaaaaacaaacgatcatatctacaatcactgtctaaaaaaccagcgtgatatttatcacttttaggttccttttctctatatacatgcactcacgaatgcacactttgtcatatttccatgtaatattgaccttctacactacaggtcagcctctaccttgatttgccaagaggttgctagagtgacgttagcaatgagcgataaacctccaaccataacttcaacatttttctacaatcttcaaacaaataaggtaatacggatgtgatcgttggcggtacgtacacgatcggtacagtgaagacacgtgggcatatttgagaggcggtgactagtgacttggttgttttggatgtcgatccaacggtttagggcctgatggcctgttccgctttagtgttaaaatgaaccattttaaaatttggtaatactaaaattttaataaattagcagtattacgaagtagtaaatgtgttactgtcaaaatttcttagtagtagtaatactacaattttcttcctgcattccacccaaagcatagacaaatcttgggcagaaattcagcgagtgattgtgtgtgtgtttgtttacaaggaggagcagtgtctgacgttaattagaagccatcatggtgccggccttcgctgcccctgcccctgcccacgtggaggaacggttcgggccaaagcgtgcatgcaacctgaaccaaagcttgccaaaaatgtggcaacgagagaatcctctcccacgaacgggtgcgtcgctggagacacaccgtcaataatagtagcagcgtgtttcatcggattttgcttaaactctgtggggattgtcttgatcagttggttggttagttcaaccaagttttattttagaggggcaaaatcagttggtttctctttgtgagtttgaagacgtgtgaattaatttggtctgcacgtgctgagatgttcagggtgcctgccatttggtctgcctcttgctagctccgagtgattggattttgcacgatgttgggaaggtgagggtggatttgaagtagtgcagccattttcacgaggaatatgtgggagtgcttttttggaggttaattcagtaaatcaagactcagacctatactcctatagtaacatatggaagatgggacaaagcgtgcatttattactgtatacatgtgaagaaaagaaatccagtagcgacaaatatcatgctgatcttaccgcactataaaaaacaatttttctgtacgagaccctcgttaggttacaacggaccataactgactacgtctgcaaaaatcgaccaccattttcgcatatggtttcttaagataacataagcacccgcacacaaaaatagtgtcttttgcagacttttggcgcgtgcggtaggactaaccgcacgcggaaacctgtttctgaccgcgtggaaaaatgtctattgtaatagtgtcgttggtgactaccgcgcacggttggtcttgtttgttgcgtttattccattcgtatctcttcattcctctcaccatgcaccactaacaatcgcacctgtacatagaataaaaagaaatgttggagtgtcttatggaggcttaacactaaaattactaacttgtcacgttagccacctgtcaagaaaaatcaaaagtaaaggctggaccactggtggagaaaccctttgtagtcccggttcgtaaccctctttagtcccggtttccaaaccgggagtaccaatccgggactaaagatcgctatctttagtcccgggtgaaataaccgggagtaaagatcgatctttagtcccggttggtaacaccaaccgggactaaagatcgagctgaccttttttttttttttgcatgcccctgttgctgcatggtttatatatatatatatatatatatatatatatatatatatatatatataaaccatgcatatatatgtttcaatacatatatatgcatacatatatatatatgtatatatatatatattatattatattatatgtatatacatgcataatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaacgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaatgggagtatattattttctatggtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccaccttttcgattggtgcgactcttagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatattcttttctggacttcgaggcttgaattgtctcttgacttctgatgcaacgtaagcgtcaagctcctcttgcgtgcaatcgtaccccgggtccttgttcttggcggcgtcaactttcgccttctttgttgcccttgtgtgggcaagcggtggagctgggggggcccttgactttgaaggtgccggaagaggagcttgcgggggagtaggtgtaggagcacgaggaggagtcggtgcaggatcctgaggaggagtcgatgctggagcctgcggtggagacggtgctggcggagcatgaggaggagacggtgcaggatcctgaggaggagatggcagagccggaggagatggtacacgagacgccgcttgtcgcccagggaggatgatgtaccgcctgcgccatagaataatggcatggcatgtgtctcgtagatgcgtctcaccgtctcctccagggtaatccagctcgaggtcctcgtacgcgccttcgaccaactcaacttcgaccttggagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgctgagtgatgtcatcaacgggacaggtcgattcgtcctgtgtttgcatggcgtccatgctctgcgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgagttcgtcctggatgctctggagtctgcagggcgagtgtcagctcgtccctatctctgtctggtcggaacgtgccctgagaggaggcttccactgcatctgttagtcgtcgcgcagcctcttgtatctgatagccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcacctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacatgctaagtctaattacaaatcgtgatataagctaagtctaggtgacgtatattatacaaccctagctagtaaataattatatactaagtctaattacaaataaaataatcttatattaaaactcaaataatattacatgctaagactaaaatagtcatgtatatgctaagtgtttcgtgcgtatatgctaagtctaattaagactacaatagtcaattgctacttgtcgcaccaattccgtagtcaataattacatactaagtctaattacaaataaagtaatcttatattaaaactcaaataatattacatgctaagactaaaatagtcatgtatgctaagtgtttcgtgcgtatatgctaagtctaattaagactacaatagtcaattgctacttgtcgcaccaattccgtagtcaataattacataccaagtctaattacaaataaagtaatattatattaaaactcaaataatattacatgctaagactaaaatagtaatgtatgctaagtgtttcgtgcgtatatgctaagtctaattaagactacaatagtcaattgctaggagtcgcaccaattccgtagtcaataatgtcatactaagtctaatttgcaataaaataatcttatattaaaactcaaataatattagaacactacacaatcttatatgataagtctaattgcaggtctaataatcttaattaattgcattacaaatataacaatcatttatattattacgtcacttgcctgctcgaattccttctagggctagctcttccactcaggcttgacggacgactccgacaacacgtcttttctgcaagatacaaaaaaatgtattaggataaatgcgaagtaacatatatatatatatatatatatatatatatatatatatatatatatatatatacatatatacatatatatacatatatatacatatatatacatatatatatatattgcatttcacgttaacgttcgtcctcgttcgttcgctcgttcacgttccctagctcgttcacgttcgttcgctcgttctcattcacgttcgttcgattgttctcattcacgttcgttccctcgttctcgcttgcttcgttcgatcgttctcgttctcgctctcgttcgttcgatagttctcgttctcgttcacgttgtcgcggcaacgtacgttgacgtgttcgttctcgctctcgttcgttcgatcgttctcgttctcgttcgttaacggcggtgtg

SEQ ID NO: 29490 - DNA, 1414 bp, Oryza sativa
aagggagatctggcggcggcggctttcacctcagagatgcggcggcagcggaggaggcggaggcggcggcgaggacgacgagctcgagacgacggcgagatacggcggcgtcggcgcggggatttgccctaggcagtggcggcgaaggagagaggccgagagagatcgatcggccgaaaacgtttaagtgttggtgaagaagacgagggcgcaccgggaatatatatacccctggatctttactcccggttgttctcaacaaccgggagtaaatatcttttcccgctatttcgaaattctttttaaacccggttagggttaagaaccgggactaaagattatagcactgcatatgattttcgcttacatatgtgtttataaaatagaagttaatgcattaacattatgtaaagtacaaagattaatgacaattacttcgaaaaattatttttggctgtaataaattaagtggataaatcgtaataagcaaatataattaataaaaattccaataatcatatatacttagcatatatatgaatgatattattatattggtaaaaactctaattaagatatgtatgtacatactgcatgatttaaaattaataaaaattgtaatcatcatatgtacttagcgtaggaattatattaaattaaatgctaaaaactctaattaacatatgtaaatgccacatgcatgattttaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgat

SEQ ID NO: 29491 - DNA, 12003 bp, Oryza sativa
atttcggaatccatggtttgatttgcgcggatttggaggaggaattcgcacgggagggagagaaggccgtgcgggaggaggaagaaggcgacggcgccctggcgcgtgggccccaccggtcaggcggcggcgtcagcgcgcgcacggcgcggacgtgcgggaggggagcggctcgggggctggggcggcttgggccgagcggccggcccaagaggagaggaggggaggcggcatgggccgagcaggccgggagggaagaggggggggaaaaggcagcccgagagagagagggaggagggagtgggccgagagggggagaggcccaagaggaggagggagagaaggagagggagagaaagagagggaggactttgggccaaatttggcccaaaagaaagaagaggattatttttagatttttctttttaataaactttgacaattgttgttgttgtttaataaatatttccggtgctctgaaaattcaagtaaaatttgagggctcattttagaccaaggagaatttaacaaaaattctccgggccacattcgaatttttcttgcacgtattttagtgtttgccgatttcttttcgaattttaattaattctattattccttttagcgaatgaatttttaattttgggatgaatttatcaggacgtgacaaatccaccctccttacaagaatctcgtccccgagattcgaggaggctagcaagaagataggttgggcggtcttctcttattgtctgacttcttccgctccgtcttctataacaaacttgcctaacaaaacttcttcactctggactgcttggctcgatctcctgttgcagatggaatcttctcttcacctgacttgtccctggttgaacctttagctgacttcgactgggttgcggcacttgaagatggggcttcagttccagaactttgcatagttcatatctttggagtcaacctcatacaagttacccacttcatgtcatgcgtcgagatcagctcgtcattactaagataccatgcttgtcatcatttagcattcaaagtattcctttacacattcagccctgacgtattctttttagatttctcttatcaatcacctttcgacctacttctttgcctggtaataaacatctttttcgatatcttctatcagtcatcttttgacctctggagaaacttctcttgtttgtcttcatccgtttccacatcttctggtgcatagtgagccaaacgatagaactcgtgccggtactctgtgacggtcaaatctccttgcttcaggtagcgaaactctcgttttcttagtgtgatcattcctgcgggaacatgtgatctcctgaatacagaggaaaactcgttccaggtgatggtatgtccttctggccgtgatgcctcgtagctatcccaccactctgaagccggtccaaccaactgatgagttgcgaagccaacccgctcctggtcggtgcactgaatcacccctagcttcttctcgactgtgcgcaaccaatcattggcttccataggatcgacggccatggcaaaggttggaggccccgttttgagaaattctgataacttgcactgttgctggactgtaggtacttgaacgttggttgcccctgctgggttgttccgattctgtaatagttgaaaggcggttgccaacatgttggtttggttaaccacaacttggattagctctggtgaggtttcgttgatgcttctctcattcccattggcttgggttcttgagtcatcggatccatcattcccatagcctttgttaccaatgttatccatctgtcacaaggtagaggttgagaggggaagcatacaaggaaagaatagaccagagctagggacaggaccttaaaggaactaactctttttgttgatgtgttgtttgtttcatttattctgcaagttgattaagcaaacaacctagcatggttacatcaccacccaccgatgcaaaccacgcgctacacacacaagcaaggaaacacacgacaaacgaaacactagagggtggcttaggttctgcgacgggttctccaagatcttcactcctgcttcacagctggcttcactgcttccttcgcttcgctggcggatcctgcagtcttccggagcttcggcaaacaactgacgacatcttcttcttcgcaaagctgaccatctagtacttagttgaaatccgaagaaagaaaagagtaaaccttttgcaaatagcattaggggaaggagaaaaagaggaactttcgcaaataattttatttataaaatatgtccttaggttttatccatttggcttatcctacagtcgagatggctctgataccagcttgtcgcgaccgggaaaattgccttttcccgaacgctagtgtattaatccccgtcccaggaaaagccggggtacaccacacaaacatgatataaaagacacatctttattatatcgataatatttacattattacaaaggcacttaaggcctgacaatcaaaaataaacggcagcggactagcgggcctacggctccatcttcacaggcgctcaactggggtataagccaggactccacctaagacatcttctccaaagcttctcttactgaagggggaaaagattgagcaagaatgagtacaaccacagtactcagcaagccacaccggcagatgcatgattaatgcaagggggtacaaggggataatagtaggggttaggttttgcagtaaacagcatttaaaagtcacttagttgcccaaagccattttgtaaagacgatcctagagctacacagtattattaaacaaggccgtgaaccctcacgaacctgccttaacccaaggcctacgatgatttggaccgaactggcaacccgacctgggttccagctcgtcccaagccaacccaggccaaccattccatattttagttgtggagcaaattttaagaattaaaacactgacttgggtacattgctaggcttgcccatatccgagggctcggctattcgaatagatttactctgatcagaggtgtacatctttacccacaagacacatctttactccgcattccatggccttggaacccgtcgtaaagatgtgacatagtttccaacccatcctagccttagacaagagtaccgacccaatcctacctacggccgggatacccgggacaggcaggcagaactgagcccctagcattgggcaccaaccctccgccgtacgacatctcgactaccgggccgcagctcgtgtagccttcatttgccctggagaatgtccatcgacgcccgacttcatccatctccaatccgtgtacttttgtttatgactagactgagccacaaactaagccttacccattagacatgtggaagtacggtagtgctttgcaacagaggcccgagctttagtccttatagtggccggggtgctacttcccacaactggcatgcacccaaaccccaccgaaaacaggttttaggggttttgaaagaggaagagaggtgtttgtccaattccaacataagccaaccattccaaagtgtccaaatgatatgagaattcccaaagtctaaagttataaaaccacctaatgttgcctaattaatcagcgaagcatctacctaaattcatactagtggaaccatgaatagagtacccactagttgaggttttgtttaatctagggtgaacaaggtaataataataacaataacaataataatatggtcataacaaaggtaaataagcatggctaaataaaacagtggtaacgcgggaatttaaataaagcgataatgcaataatttaaatcaacataattttataaaatgggattcaatatgctcaaggatgatgtgacttgccttgctcagaaagaacggccttccgaacctttggcgacgaccacgaaccacgcttcgggaacctccggaacgacgaaagctacgcgaagcacacaagcaaagctacaagcctataaagaagcaataacaatacataaaaacaaagcacagggttctttaggttataacaaacattaggagacttgaacgggtcgattcagagttcgtatgaccgagatatgatcatccgaagtttaatgctgttatatggagatttgcggattattataattaagctttgcaattataaaacatgtgtaagcgctggcctggaaaagacaggaaggctgcgccgttgacatgcggaccccacatgtcaacctaaaggaccgcggtagaccgagtacacagaggcggtccacggtcgacggaagcggatcccgtgtgtcaaccgaggcgagtggccgacaaacggactccactagacaccacacggtcactacccgcacacgtgaacgaccaccgacaccggtacacgggtaccggggccgacaaccgcacaacgggcacgggcgacaccgaaaggacgaggacagggcagcgagggagagggaaccttaccaccacgcgacgaggcgtgggaacgacaacgacgaacgggcgcggcggagacagacgggcacaacggagacgaacggcgaggggacggcttcggcggcgatccttggacgaaggcgagacgcggccggcacgaggcttgacgacgcggagccgaggacaaagacgaggacggggctgcagcggctcgcttgacgaacgcggacgacggacgagaacggctcgacggagggacgaacgccacgacgaccggaaacgacgagaggacgacgacggcgacgaccggggccggcgaggaggcgacgaggacagccggcagcggctgcacggggacgaggatgacgtggaacacgccgctgcgatgacgatgacggaggcggcgccgcgagacgacgagccgggcgagagggaacggtgaagacgacgacgggcaccggcggtgttcggtcggaggggaggcgaggccgaggacgacgtcgcagctgcgatgccgaagatgatgggggtgtggccgaccggtgcacggcgaggagggacgggcggccgaacaactccggcgaggcggacggagaggttcgcggcgacgttccggcgaaaccgagggcaggccggggtggagggcgatgcggcgtcgccgagggaggagacggcgacgtcggccgacgctctggcgcggcgaccggggcagccggaggagatgtcgacgaggaggaaggtgaggccggcgcgggcgacggtgttccggcgatgttcgggcgaggaggaggtgatgccggggatgagagcggcgtcgtggagccgaggaaggtggtggcgacgtcggccggcgctccggggacgcggcagaggcggccggaggcgaaatcgtggcggcaacaccactggacgccggcgaggacgcgtctccggtgctttacccgcgaaacggagggctgaccgagggagagggggcagctgcgaggccgagggagaagacggcgcggccgggcggcgctcgggcgaggagaggaaggcggctggaggtggccggcgcgaaggaaggaggagggcgacggcgggaacgtagttccgggggtctcctcgcgaaacggagggcaggccggcgtggaggaggtggcggcgacgctggaggaggcgatggcgcggccggccggcgcacgggcgaggcggcacaggcggctggaggtcgccggcggtgtgggagagagagggcgacggcggggatggggctagagaccacggggaggctcgggatggggttaaaacgagagaacgcacggagggggttgcattttataggatgggggagggagccgggcacgggagagggcggaacggcgacgggaatggcggccggcggcaatggagggcggccgaggaagacgcgggcgttcccggcgattgggggcgccattcaagggggaaattagggggaattgaagaggagtcaatggggattaaaaccccccaattaatttcggaatccatggtttgatttgcgcggatttggaggaggaattcgcacgggagggagagaaggccgtgcgggaggaggaagaaggcgacggcgccctggcgcgtgggccccaccggtcaggcggcggcgtcagcgcgcgcacgcgcgcggcacgtgcgggaggggagcggctcgggggctggggcggcttgggccgagcggccggcccaagaggagaggaggggaggcggcatgggccgagcaggccgggagggaagagggggggggaaaaggcagcccgagagagagagggaggagggagtgggccgagagggggagaggcccaagaggaggagggagagaaggagagggagagaaagagagggaggactttgggccaaatttggcccaaaagaaagaagaggattatttttagatttttctttttaataaactttgacaattgttgttgttgtttaataaatatttccggtgctctgaaaattcaagtaaaatttgagggctcattttagaccaaggagaatttaacaaaaattctccgggccacattcgaatttttcttgcacgtattttagtgtttgccgatttcttttcgaattttaattaattctattattccttttagcgaatgaatttttaattttgggatgaatttatcaggacgtgacaggcaagaggcctaagccagatccagaggccactacctctgagccgtggggactccggtttgcgcgagccagcgactaccctctacctgccccgggatcctgcggatggctggaggattagactgacggactccttgcagcttcgatctcgtatcagatggtttttggatagtatgcgagacacccccttcccttacctagattgacgagtagtttgatgattggtttgatgtatcgtttggatgaaccttatttggactgcgtatgtatgcagtcaattgcatcatgatttatgtaccatttgtgaaactctgtgatgttatctatgatatctattgttgttgtgttgtaaatgagtttattccaccatgcttgcgaaacaaagtcatatcgacacaactcccttaatgggataaagccataggagctagttagaaaattaggatgcttactccatcaacctacacagatggcaagccgacgtcgggcaacaaccagcaatgacgaaactcagacacccgacttaaacactctggccggaattatggccacccaaactcaacttctgcaagctatcgcgagcaaccaaggcaaccgcggagggtcaagctttggagagtttatgaggaccaagccgcccacgttcgctacggccgatgagcccatggaagcagaagactggctacgcatcatagaaaagaaactgactctagtcagggtacgcgaagccgacaaggtgatcttcgcagtgaaccagctggaaggacccgctggtgattggtgggatacctacaaggaggcccgagaagacggtgctggagaacccacctgggaggagttcactgcagcgtttcgcgagaatttcgtacctactgcagtgatgcgcatgaagaagaacgagtttagaagactgcggcaagggaatacaacggtgcaggagtatctaaacaagttcactcagttggctcgctacgcaattggagacctggcggatgaagaagaaaagatcgacaagttcatagaagggctgaatgatgaattgcgtggacctatgatcgggcaggatcacgagagtttccagagcctgatcaacaaggtcgtcaggctagagaacgatcaaaggacggtggaacacaaccgcaagaggaggcttgctatgagtcgcccacctcagacaatgcctcagcgacttaagggagccactccgtccggatggaagccccctgtcatggtgaccaaccgtcccgctgcacttagcaacttcaacaggccagttgcacttcagaaccgcacccctacaccaactttggctgcccctggggccaagaagaatgtggactgcttcaactgtgggaaatacgggcactacgctaacaactgccctcatccacgcaaaacccctgtccgaactggcgcgaacgcaatgactgttcgcggcactactacccctgctgtcgggcgaggcctattcaagactccgcaaccgaacaggaccaccactggatttgggcgcgggcaagtgaaccatgttcgagctgaagaggcccaggaagatcaaggcgtactgatgggtatgttttcactcaactccactccaattaaagttctcttcgattcaggagcattgcattcatttatatctttgaaagcaagtcaacaacacaatttaaccagagttaaattaagacaaccaatgttagtacattcgcctgggggtgagatagcagtggatacagcttgcattgacgtacccatccgccttagggatgtggtatttccctccaatcttatggtgctaataccccaaactcttgatgtcattttgggtatggattggttagcaaagcatagaggagtaattgactgtagacgtagagaagttaccctgaccacaccctggggatcggatatgagagcaaccatggatcaagatcctaggctaaccgaacgtgccggaggtatatttaccatgctacccctaaagggaatgccagtagtgcagcgatttcctgatgtgttcccagaagatttacctggaatgccaccagatcgtgacatagagttcattattgacctgatacccggaactgcccccatatccaagagaccatatcggatgccggtcaatgagttagaagaacttaaaaagcaaattagggagttgcaagagaagggatttgtacgccccagttcgtcaccttggggagccccagtgttatttgttaaaaagaaagacggtagcatgagaatgtgtgtagactaccgatcactgaacgaagtgactatcaaaaataagtatcccctaccacggattgatgacctcttcgaccaacttaagggagctaaggtgttttcaaagatagaccttcgatcaggataccaccaactgaagattaggaccgaggatatccccaaaaccgcgttttcaacacgctatgggttgtatgaattcacagtaatgtcgtttggtctaaccaatgccccagcatacttcatgaatcttatgaacaaagtattcatggattacttggataagtttgtggtggtattcattgatgacattctaatctactccaaagatgaggaagaacatgcggaacacttaagattggttctccagaaactccgaaagcacaagttatacgcaaaattcagcaagtgcgaattttggttgaaggaagtcgcttttctgggtcacgtaatctcagccggtggagtagcagtggaccctgctaaagtggaggctgtcacggaatggaaagcacccaaatcggtgactgaaatccggagttttctaggcttggctggatactaccgaaggttcattgaagggttctctaagatagcccgaccaatgacacaattactcaagaaggaaaagaagtttgcatggtcggaacagtgtcaaggaagctttgagcagctcaaagaaaagctgacctcagcacctattttagttcttcccgacatcaggaaagactttgttgtatattgtgatgcgtcgaggcaaggactaggaggtgtactgatgcaggagggaaaagtggtggcctatgcgtcgcgacaattgcgaccacatgaggaaaactaccctacccatgacctagaactcgcagctgtggttcatgcactaaagatttggagacattatctgattggaaaccattgcgatatctacactgaccacaagagtctaaagtatatcttcacccagtcagatctcaacttgaggcaaaggcgatggttagaattaatcaaggactatgatttagaggttcattatcacccaggcaaagcaaacgtcgtagccgacgctctgagtcgtaagagccattgcaatcatctgagaacggaagggatggtccctgagcttagggaggaaatggcgcagctgaacctacatatagtaccccatggacagataaacaccctggatattcaacctcttttgagaacccaaatagaagaagcccagaaggacaatgaggaagtccgagaggtgaaggaacgcttagctgccggacgtgcaaaggaattttcaaccgacgaaaaagatgttctatggtataaaaagagaatttacgtacccgaacagggtggactgaggggattaattttaaaggaagctcacgaatcggcatattcattgcaccccggaagtacgaagatgtaccaagatctgaaggaaggatactggtggcccaacatgaagagagatgtggccgaatacgtagcactctgcgacgtatgccagaaggtgaaggctgaacaccagaggccggcaggtttgttgcaacctctcaggattcccgaatggaaatgggatgagataggtatggatttcattgttggattgcccaagaccgcaacaggatatgattccatttgggtaatcgtggatcgactcaccaagacggcgagattcattcccgttaagacaaattatagcagtgcaaaactcgccgagttgtatatgaccaggatagtgtgtcttcatggtatacctaagaagattatatctgatcgaggcacacagtttacctcacatttctgggagaaagtccatgaagccctgggaagttacctcgcatttagcaccgcttatcatccacagacagatggccagacggagagaaccaaccaggtcctggaggacatgctgagggcttgtgctctggattttagcaaggactgggagaggtgtttgccctacgccgaattctcttacaacaacagctttcaagcaagcctaaagatgtcacccaatgaggcattgtttggtcgacgatgtcgtaccccgctaatgtggtccgagactggagaacgggcggtatttggacctgacattattcaagaagccgaagaaaaggttcgcttgatccgtgatcgtctaaaagtagcacaatcacgacaaaagagttacgccgacactcgaagaagaaacctggaatttaaggaaggagattacgtttatctaaaggtttctccgatgaggggaacaaaaaggtttaaggttaaaggaaaactggcaccaagatatgtggggccattccagatcatcgccaggcgaggagaagtcgcatatcagttacagctaccagaatatatcgccgatgtgcacccagtcttccatgtgtcccaattaaagaaatgcttacgagtgccggaagaacaagccccgctggaagagattcacattagcaatgatctcacatatccagaacacccgatccggatattggatgaagcagaaaagaggactaggagcaaagtgtggcgtatgtacaaggtacaatggagtaatcacactgaggacgaagccacctgggaaggcgaagaattcttgaggacggagtacccgcatctattcggcaactggtaagaaaatctcgggacgagatttatttaaggggggtaggtttgtaacaccctgaaaattcgaccaacgaaatcaaaactctaaaaatgcggactttcaaaaactttttaaaccaattgcatcatgccgactttattcgcctgtttcattggattttgatgtcggagtctaattaatcgcgaataatgaataactagctaggaacaaaccataaaataaaatctagttgactaaataaataattaaaatataaattaaaataaaggttaggtgggattgaaataaataaaataatatcgcaaccatattagcaataattaaattttagtacgatggaataaccctaattaaaataaattatataaaaataaaatatgagtaatattaatctagggagaattcattagttaagattacatgaatattgagtaaaatgcatatatgtaaaattaggaatcgtggaatcaaatttatatggaaaata

SEQ ID NO: 29492 - DNA, 3359 bp, Oryza sativa
gcaagcttcctttgcttcctccactcaaatctagagcctatcttgtgagattgagagattagattagagtataggagtgttttggagatggcttaaagattatgtttgtttgagcactttggataccttgtgggctgtcacttgggcttattactcttggagatcttctcctagacggttaggtgtcgcccgtgagcttccaaagatcttgtgaatgtcccgggaaagtttgtgaaggttttcctcacctccacaaggaaacgaggtaagtgagtaaagattcttgtgctgagttttcagaggttgtcctaggtagagcaacttgcacttgtggtcttttctagaaggaattgtgagttggatcttggcggtcactcaattctagaaaatgacctagaagtgttgagttgaaggctgtggacttcttctgggatctttgcataagtgaggcaaggggttaatcgagacccggctctttgagcacttcaatggagagtaggacccgtgtgatccgaacttcggaaaaaaatcgcctttgtctctcttgtgcatgatctatgtttgaatctgctggtatcttgtgatttacatcttgtgcaaccttgtgcctgattgtctatagctaggacctgttttgcttccccaaattttgattttctctattgcccggaagttcctggctcaagaactccgaaagttccgggctgctcatctctgccaggaagttccggtgtttttcaccaggaggttccgggcactgttaatcttaaccgctgcgattgttgagaaaatttcaggaaagcctattcacccccccccccccgctctaggctacatctctgcgcgttcagattgaggggtttcgatccttatctcctcatttttccccttctcaagaattagagcaaaatcgcgtcgtatctatcttggaattgagccctatagcaaaccctagagttcacctcagagtccgtttcgcctaaaaaaatcgcgtctacatgcagatgatgataacggacgaaaatagtgctggaatccttatgtattttttaattaggtacatatattaaactagttttaatgaaactaatttgatacttcttatctttttataaacttaattagatttttcaataaatgttaaatgaattatcatatacaagggcagggtggctatactctgttttttttttttttttgcataagtaaacctgaaaagcaccacaaattatggccttttgttccccgaatccatcctaaatgtattggcatcaggaatgaatcaaaaatgatttggactaacctatttttttcaatccaaaaaggatgagtttttatttaacgtgtcacatatttattgccgtaaagacacgaattttatttgaggcattattttattccttttgaaacttatgatcaatcataaaaaatgtttgaaattgctttgaaccttgtgtatatttcttacgagctctctaaaaaatctaaatatgttttttcacccttcctctaataagaagcatttaggtaattttttttctctgctaattgctcctttggtaggatttaagatatttttggacagagcaagtaatatcccttgtttgactttcgttcaaaacgacgtgcatgtttccacgacccaagatagtaatatatatattctctccttttcaaatttaggacgatgttaacttttactccctctatcctaaactataagcatttttagcatagagataagtcaaacattgtcaactttgaatatttatttgttaaaaaatctaagaatatcaatcatgtcaaattgatgttactagaattatcattaaacaaactatcataactatcatagaatggactccctccgtttcataatgtaagtgattgtagcattttgcatattcatattgatgttaagtaatctagacatatatatctatctagattcattaacatcaacatgaatatgggaaatgctagaatgacttacattgtgaaacggaggaagtaactctttttatttaaaacatattacttttatctatattgttggtcaaattaatatatcggagaccgtgtcagagtctaaaaatgcttatattttgggacggagggagtatatataatatgctttgatagagtaaatttcaaaatccccatgttttatgatcaaaattatataaaaccacatatattatgacttgtgaaacataacccaatgtattatggttctaaagttttataaaacatatattatgatttatgcatgttgagtacaaatttacttaaaataataaaacatatagtgtatataaaaattttaattattaagttcttaactaatgttgatagtttatctcttctgtactttgaaaaattgtttcaaatatgctataattaataaagattttaataaaggtgtgattttacgaaacatatatatatatatatatatatatatatatatatatatatatatacaccaaaatatcaatatcaatagttatgtgccacgcgtcataatatctgtatttttttttacaattttgaccataatgaggttctctaaaatttactctaatatataatgttttttcattccacttattcaacatattttagtgaaatcatataagtcatgcgtaaatgcctttaatgaaaatttttttaaaaaaataaaataagatgaatagtaaaatattacgtccaaaattcatacaatacaaaaacaggggcagtatttcacaaatgctttacaaagatttaataagcacacgaagatcagttctcaagcggccatctgtttccttgagttggtcgtcttctccgctggcacgaggtacttgtggaatatcctctccttgagctcggcgacatgggcagtttcacgctataggggcaggcgccggtgacccgcctccatggcagccgcaagagccgcctccgtccaatgcgcacgacgaccgaggcgctcgatgagggacaccacacgtcacggcggtgtgtggtgtcatttaaattgggaacttagcccctcaaacaactcaatgtgaaattcgctctcatgaagatttcaacatatgaccttgaggtgctattcgattagatcactacaaaccactaaactacatgtactttcgtataaattaccgagcatattgtattttggatatgatattgataccattagtaaagcactgacaaaatataggagccttgttgtttcactaattcatatgcttatccgattcgattataagcagaagcataagcactataagatcctgcagaaaggactagcttaatttgaaattacgatattataattatatgcattcacaactattagcacattc

SEQ ID NO: 29493 - DNA, 23678 bp, Oryza sativa
atgggacgggtcatacctacttccactccgcctgttacagaagcgacgtgggggcacggccgcccgttcaatcggatgtgaccggcaacaggccggtcacagactggttacatccgattgacgtgggtcagctaggcggcaccgcacatctgcccttaccgcataaatgcggtgagggacagttgaggcgctgcgcattgatggctgttcagcctcggcccccttcctgctcgctccccccgccacatggtagctgggcgagggcctcgggacaaggcagcgggagagcccgaggggcacgacatggcaccccgaggccccccggccgcttttgtgactcgcgaggcgcgggagtagggctaggctgtagagccacgcggctggatggaaaggtaactttcccccacttcgcatacccccaggcccatctccgacagtagcccctggcaccatattggacactgacctcctgaggtcggtctgatgtggtgcctcacgacttcccaagctggggttgtgggcccgacagggaatctaaggaaatgtcgccgagtggccaggttggcatattaaccacggcagcagtttgccgccactgaccacgctgatgatggggatgtttaaggcgtgaaaatcggggggtcggtcaggccacgcctcgattctcttgcccgctactcatgcggcggtagtggtgacggttcactcaggttgtgtccgtgaccgttgtgcgccctactccgagtgtgccgctgataggcgcactaaatgcagggcgtggattcaatgggcgacgtgatgagttgacgcgggaaacgaagagacaaccgtgggcgcgagaatcgtgggggcaaccgtgagggcgtgaaacgaggaggtgagcgtgggtgaggcgaggataaaaggatacggaggcaaggatgttgtctccttcctttcgccaactgcccactcgtcttctcgctccttaagccctaacattctcaccacttcacactattccgcgcgccaagccctccgccgcttctccgccggccatcatggctcaagacgctggcgacacggtgctcccggcatcacgcattatggcggatagacaccttagcctcccccgcaagatcatgccggaaggcgccgtcgtgagggcgggggagttgcggccgcggccgctgtatccggagcgatccgtgcacctcttgtccttcgctatggcggggttgattccgccgttctccggattcttccatgaggttttggatttctatgaaatccatgccttgcatctcgcacccaacgccgtgatgacgctggccatcttcgcgcatctgtgcgagatgttcatcggggtgcggctgacgatgcggctgttccagtctttcttcatcccacagctgctgcaaggtgcggtggtggggggatgttacttccagccccggccaggcacggcggggcaatacatcgagagtcatctccgcaagaaatgggaggactggaagaaggactggttctacaccgtgttgccggaccacccgcgacttcggcttcctgccggtcctcccgaaagatccgccgtatggctggcggtttcgtaactgggcgaagagtacgacgcggtgtgggatcgccttaggggcctgcgaagcctgggcctcacaggggcgatggtctttggtgactatttccgccgccgcatcgcacctctccaggatcgatcccgtggcgcgtgggagtacactggtcccaacaaccccatgcgcacgcatgtgggtgagcgctgggactgggaggaggaggacgcgaagatggtgattcggcgggtactgggcttggactccgccgagcaaacactgattccagacgggatcctttccctatggtgcgaccgcgaccgggagagcatcctggccgtgtcggttgttggcaccggcaggagcaggtccagccgggacggcaccggtggtagcgctgccgatgttgctggcggtggcgcgacagcaggcgggagtcggacaagcggacccggcgggggtgggagctctaggtctcccggcccaaaccgcggacccggggacgactcggccagcgacccgaaagggaagcggaagatgtccgaatctcgaccgccctctcccccgcgtggagggggcgccgagcgcgtggatcgtccgctagcgggccacaagagccctgccgggaccgaggccggacggaagaagaaacggctccggaagataggacaaatggagccgtgtcgggggagcttcattgagcccccgaagtggactttcaaccgccctccccgcaggtacgatcgccggcacccacctcggtgcttttatccagcttggtctcttgttccctccttttctttttatttgttaacgcgatctgggttctcttgtagcgagattccttcccagggggtcacgcggtccgacccttcgcgggggaccaaatccgaatgatcggagcggcccaggcttggccgatccaaggccgcggggccttcacagcccctcggcagggcccacgggccgcataccgggtccggccccgagcgaaccccagccgggactcgtcccgccgcgggcgatagcggcggtgacgtccctcctgggggcgactccgagaccagggttcatgcggagcgccacccgggatcggggggcgaaggaggtcgtggctcggatgccgaggccggaggcggccttgagctcgaggtcaaggccgaaatcgggggcgggcccgagccggaggccgagtccgaaattgggggcgggcccaagcctgaggccgaggccgaatctacccgaggacccgaggcggggggcgagagggacggccgctcccccttgcacttggggcgccctcaaggctggtcgtgtagaaggggggccgagagcatcccccagtctcgcgggggatccagcggcactccgtcgtcccgggggcgggccgcaactttttcttctccgactccggcaagtatggagccgctcctgcaggtgctcgctgccgccgattccaccgttcgggaggggctcaacgcccaagttcaagccctggcggaagagcgagcggccctggaggctgcatgggcacagctcgcgtgcgagttgacgaggggcgtcgcgccgtggacgacatggtgagggtgggacgcaaaatgcgccaagcccaactagccaaaatccaggcgcgcgaggagtcgctggactccgtcatgcgagaggtggaggaagagcggcaggcggcgctgattgcctcgagcgtcctggacgaagcactgggtgacatcgccttcagtacgaggcccatgccgaggatctggcgaagaggatcaaggacgcccgcggtatcctcgacgcagctgctgcccaagagcagcgggtatcggaggccgatgcctcgctgcgggctcggacagcggcgctcgaggccgaacgcagggccttggatgagcgtgtccgctccacgcaggagttcgagaccacgattcgccggcgaatcgaggtcctcgatcagagccagcgtgagcaaaacgcgcgtggccaggagcaggcgcagcgagcccaggagctgtagaggcggactcaggcgctggaggagcgagcgcgtctgctcgatctgcgggagtccaccttggccgcccacgagagaacagcagcggaggtggaggcctcccttcaccttcgtgaagaggccgcagctgagcgtgaccggatcaccctcgccgcgaaagcttcagtggaccgccacgcagaggagctacggctctgggaagaggcgtgccgagaacgggacgttgtactcgccgagcgcgaagctgaggtgaaccgccatgaggtggcctcgcgccggctgggcgagcagctcgcaaaacgcgaggaggctgttgccgggcgcgatgctcggcatctggagagtgctcgcgccgagcgcgcggcgatagcggcgagggcttctgagctggaggcccgtgagaaggacctggcggcgggcgggcagcccggcggcgcggagttggggagccagcttgccatggctcagagcactctcgccgatatagagcgcttggtgcaagatcaggccagggagattgcggccctccgcctcaccaacgggatcggacccgggaagctctccgacgccgtcgaccggctggagcgcgcggggcgccgagtcggcatttccgtgcaccgggatagtaagcttccgcccacacgccggcagtcgcactccggctggacgggctggcggcggatctggagaggctggagaaggaggtcggcgagactgtgaaatcgtcgtcggctttcttggcgcgggacgcggtggaactggtcctcgcgagccaccaagcgcgtgaccccgacttcgtcccatggcgcgcactcgaggattttcctccagggaccgaggcaagggctcgggagcaagtccgggaggcggccgacgcgatcgtctctaacttcgaggggtcggccccccggttcaccttcgggcttgcctcggacaaggagagcgggagcggggacgatgatgacgacttcggcggcgaggactgggacgacgtctgtcacgcccagaaatttaacccaaatttccggactattttgtgtattaaatccctgtccaggacaagccagggtacacaaaacgacaagtaatatacagttccaaacataaataaagcgtaaatacttacagaagaggcacttagtcctcacaccgaaagaaaatgacaacagcgggaaaaggcgatcctagcggggcttcagctccactcacaggcaaaacttaactggggtctgaaccttggtcttctaacttcgtcttcagctcagaagcactacacttctgaaaaaaggggaataatagcaaggctgagtacaaccaccatactcagcaagccacaccaatgatgcagacgtgcaacgggattcaagaatggcttgtggctatttgtataaaggcggttgtaaaacattttattgagcaaaacagtaaaactattgagtaattaaggtactattaaatctccactgatcaacgctataccacgttgaacaggcccaaccaacccacctgaactacagtgcattgggtcgatttattaggggtgagactaatcacggtgaatctggtcgaccgaccataaccgcgggcacggctattcgaatagttttactctgatcagaggtgtacaactgtacccacaagacatagccccacgacacgtttccgtgcgctgacatgccaccacgacatactggaaagaggtcgtgataggacccttctcataactccctctaaccaagcacaccacacctcagatttcacccccactcctcgcaaggcagcgggcagtcccctctcgtgcctaggtgaatccggaagccgcataggccgtcgcagggcccatccaaattccatcacacccacccttgcctggatgcgtcggctagaggaaagctacactacaagcccagctgttgcccacgctggcttgtggtaagcacgataaattcttccagggtttcccgtgaaccggttcttaattgccatgggcacgactagcaaaaccatgcacccacagcccaccatgaagtcacattttagttgggtaattacgaccatgaagcatggccagatgtctcgagcatgcagctcattctgacactaaaaaggtctaatactataattatcccatcaaccgggctagtggtaattaagcatggctaagcatatagttctagctaggtcacataagtaacatgagctagttgatttattacccaaggttgacaaaggacagatatcaagtaaatatggcacaagcaagcagataggtaatacccggatcccatgtaattagcaagacatgcaattttatttgtaaacgataaaacatttgtaaattaggatcaaaattctcaaggggaatgtgtgacttgccttgcttcttcactttgatcttctgaactcttttcctcgcgactacgaacttccgaaacaacggaaactacaccttggcacgcaaaacgaggaaaaactctaataaaaaccaaggaaacagtacataaaaagtaaacaaacatgtagagctcaattttagatgaattttgcaagttgaatggctcaatttggagttcgaatgaattagatatgatttttagaagctttgagccatttaatcaatttctataattaaaccgaattattgagcaattattaattattttctgaagggataagctcatcgctgacatcagcaaagagccggcgccgacgggcgggcccaatgagtcagcgggccaaaggatttggtccatcgtggacttggtccacggtagtggtgcgcagcagagaggcgggttggctcgccggccaacccgactgggtagcggcggcgcacgaccggacggccaccggcgccaacactggcggtgcaaggaacggcggcgcacagcacaggaggcggcggggaaggaagagggatgatcaccagagggcacgacggcgagatgaccacgaggaggcggtcggcgacggaagcgatggcggtggtcggcacgggatgaggcgggaacggcattccggcgactcccgaccacgccggaggcacggccgagggccggcgggatctggcgaacggggaggatgggttagctgcagggaaaggggcacgaggagactcccggcggcgtgaatcaccggccggaagcaagaaaagcggcgggtgctcaccggtgtgcgatggaggtggagttccgacgggattcgggcgacggggagcagtggccgaggacctcctcgtccttgcggagccgagggaggcgacggcgtggattggcgacgaccaaagcagcaggacgacgcggttggagtcggcaaatggagttggtggctcaggttggtggtggcagcggcgtttcggcggcggtttggggaggggaagtggtagccgggcttgcccttgagacggcgaagccggtggaggttgtcgcgtggcacaccggtggctaggacggcggcgatgtgcggctggaggcggtacaggtggcggtagcttggcaccacgatgggaatggtgctgcgggggtggagggggcgaacggagtggatgccggggtgcggcacgatgcggcggagcttttggctgcagcggcgcagcgcggcattggctagagtggcggtggcgggcggctggaggcgttggaaggggcggcggctcggtttcatggtggagatggagtttcgacgatggaatggggaaacggagtggaggctgaggcacggcgaggcacggcgaagctggcggtgcaagcggagtggcgcggcggtggctagtgcggcggctagaggcggctggagctcgccggagagcggcggcgcgtgggctcggcgcggggagagcaagggagggcgcggcggcttgggaaaaatggaggaaacggatgaggggaagacgggagggaaggcgggatcgagcccgagagaggtggaaaccggccggcgacgtggagctcgacgtgggggtggtggcagcggttcggtgccgattccgtggggagagtgggggaagaggaggtggggatcgagtccacgcgctcacgggacggggtggggcgcgggaggcgcggcgtcgtggggcggaaccagcggccatggcagtttcagccggccggatggaggtagggggagaagctgacgagtgggccctgcggtcctacttgtcggccggagtgagagagaggaggctgaggaggacgtgaagcggacttttacaaggggaaaggggaacaggccgacggcccaagaatggagggggaaggccggcctggccggggaaggagggggaagggattgggctgagcccaaggaaggaggggagggattttatttgtttttcatttaatttaattggtttaaatgaactttgtattattataattactccttgagctccgaaaatttgctgaaaaatccggagagtattttagggcaaagagaatattacaaaatatttccggccaatgatttttaaaggaaatttttaatttcctctataatttcacttgattaaattgatttaacttttatttaatttctagaaaatgcattattaattgatttttattcccgaacaaaaatcggggcattacaacgtcgttagcggcaccggcctcgggggcccgagcactccgtgattacccgcgctttcaatttcccattgttgtgtgcctgtagcagacacttcttgtatttaggccatcgtgtcttcctgtcttgttctgcaattaaaacttccttttcgcactttttacccctttgctttttccattgaatgcctgcggcatagaaagaggaaaaaacaagagcaaaagtatataattaatctgcctgtgatcgaaatgccgcttttaccccatcctccccccccccctcgggcttgttctagcgaaaaggcaaacccgcgctcggtccgtggtacctaagtggtgaaaggcaaaaccgacgccctgaggaagccgcccagcgggacttgccagaccggggctacgacgacaaggggtcggggacggccgagtgtaggcccttccgagcccccagggttcggcgcaacccggggcgcggcccgcgtttgtgctccctttgggcggttttcaggtcgccccacggcacttagggttcagagtaagcgcgaactatcctttgaaccaggacaagccaaaggaaagagagagaaaaggggggcataacgggcttcacactaagtagaaaaattcattgcttgtaaagggaaaaggatacacagtggtagcccccgaccaagcccgcacaaaccgaggggttgtgcgggggttggcccgagctcctagaaagcaaaaaatctcgacgctatggatagaagcgacggaggtgttcgatattccaggggttaggcaactcggtgccgtcctccctggttagtcgaatagagcctagccggggaacaccgatcaatttgtatggcccttcccacattggcgagagcttgctcagcccagacgcgattggacgcggcgtaggacgagatcgccaacttgcagtgactgggcccggacgaggcgctgatggtagcgccacaggctttgttggtagcacgcggcacgcagggccacacgccttctccattcttcaagataaacgagatcgtcgcggcgaagatcatcctggttggcctcattgtacagcgcgacgcgaggcgatcccagggaaagctccgagggtaggaccgcttcggcgccatacactaggaaaaatggtgtttcccccgtggcacgacttggagtggtccgatttgcccacaacacggtgggcaactcctcgagcctcgaatccccgtgtttctttaggacgttgtacatcttggtcttaaggcctttgaggatttcggcgttggctcgctcgacttggccgttgctcttagggtgggcgggtgaggcaaagcacaatttgatgcccatgtcgttgcaatagtcgccgaacagctcactggtgaactgggtgccgttatctgtaatgatgcggttgggcactccgaatcgtgacgtgatgcccctgatgaacttgagggcggaatgcttgttgatcttgacgatcgggtaagcttcgggccacttggtgaacttgtcgatggcgacgtacaaggtgttgatacccgcctcgagcagccttgaatggtccaaggatgtctagcccctagaccacaaaaggccaagagagcgggatgacctgcaaggcttgggccggctggtggatttgcttggcgggatgatctgggttgcccttgctcgggggccccgggggggtctcgagtcatgtcgggatcataggccttaggaccactcgccaaagcctcccttcctcccacgggggcctcgggctccgggcctttgggagacgtagggccatcgcgagttaaaggggcctccggttcgccctcttcgcactcgactactagggcggtactcaccacatggggggttgcggccaagtagagtagcaacggttcctccggccccggggctaccaagatgggggggaggtgaggtaagctttcaactggttgagagcttgctcagcttcctccgtccacacaaacggcctagagcgcttgaggagcttgaataggggtagcgccctctctcccagcctcgatatgaatcgacttagggcggccatgcatccagtgacgcactgcacatccctaagtttgtaggggggcccatcctctctatcgcgtgtattttctcgggatttgcttctatgcctcggaaggagactagaaaaccgagaagtttgcccgccggcacaccgaacacacttatcgggattcagtttcacgcgtgtggacctaagactatcgaaagtctcagccaaatcctgcagcaacgtgtcctagtggcgcgtctttaccaccaggtcatcgacatacgcctctacattgcgccctatttgattactcaaaataatacgagtcatgcgctgaaaagtaggtcctgaattttttaacccaaaaggcatagttgtataacaaaaggtgcccacaggagtaatgaaggcagttttttccttatcttccctagccatgcgaatctagtgatacccagagtaggcatctagaaaacacaaaaggtcacaccccgcagtggagtcgactatctgatctatgtgtggtagatggaagggatctttagggcatgccttgttgaggtccgtgtagtcgatgcacatccggagcttgccgttggccttcggggcgaccaccaggttcgccagccactccggatggataacctcgcggatgaagtcagcctccaggagccacgccacttcctctcggatgaaggcctgtcgctccagggcttgacgccgcactttttgccggacggcaaagcggtgctcgatcacctccttgaggaccctgggcatatctgacagcttccatgcgaagacgtcagaatttgcccgaaggaaggagacaagcgcgccttcctatttggcgcccaggtttccgccaattttggcggtcttggacacatcatcgccaagggggatctccttgacgggcacctcatcagccgaggtgaggcgcttcttggaggcgggacgcggaggcctccggggcctgcggctccgtggccaccgccaggttgtcggcgcattgctccgcgcaggtgagggcaactttgacatcgccaaagacggtgatgggaccagcagggccctgcatcttcatctggaggtaggcatagtgggtggcggccatgaacttcaccaacgtgggtctgcccaggaccgcgttgtagggcagattgaggtccgccacatcgaagtcgtttcgctcggtgcggaagttggtggagtcgccgaaggtcatcgggagctcgacgtggccaagaggccacgtatgtcccggagtcacgccgatgatcggcagcgacggctggagcttcatccccggggccttgagtgcgtcgaaggcggctggggagatgatgctcaggctggctctccattcaaccaggacacgcttcatcctgacgttgtgaatggtcggggagaccacaagggccaacttccctcctcgagcgagcactgtcggatggtcgctctggtcaaaggtgagcttcacctccgaccagcgcgccttccgagccgcctcgtgcgtgggaacagcggccaaaagctctcgcctcatggccttgaagccccggcgagaggtgtgagcgcacgccccccccccccccccccgtcgagcgtggcgacggttccctgaggtatctggaaatccagatcctcactgtcaccgccatcatcggcgggggccttgttcttggcctcttctcgccggttaccggttgaggtggcgggggctttgccctcccgtcgaccctgccgcttctcctcatcggcctttcggaatcgctcagccaaattcttgaccgagcggcagtcggcgagactgtgccgataagtgttgtgcaccgagcaccacttgtctgccgaccggccctcgccggatggagcagtggagatcgtcttgtcgccggtgtcctttcccttgcacggggcccgtgcgggcccatctgccgcaaggacatggccctcgtcatcggagcgggccggtttccttttgcctctcctatctcgccacttagagtggggggcagactcgggggcagccgtggccgccgcaccggtgccgggagagttccaggcccacgcctcctccttccgagccaccttgtccgccagctcaaaaagctcggcggtggtcttgggctccttggaggcgatcttctctagcatgcagttatgctgcacgccattccgaaacgcatacacgaccgcgtgggccggaatgcaccgaatagtgttgcggacctaacaaaagcgttgtatgtacgagcggagggactcgtcgtccttccgccgtatagcgtgcaggtccgcctcttctcccggacggggatatgtgccctggaagttcgtaacgaactgctggcacagatcctcccaggagtggatggagtcggggggctgggtcatcaaccagccacgcgcctgatccttcagggccatggggaagtaattcgccatgacccgatagtcaccccctgccaccacaataatcgtggtgtagatctggaggaactcggagggattgatgctgccatcatacttctccgtgaggttggggcgaaacttcaggggccacaggacattctggagactcaccacgaaggccttacaacccgtccctccaggggagagcgtgggggagggccgcctcgtgaggaggaacgtggcactccagatgaggaggcgcctttccccatgcgggcagctcagcgctcgtccctgcgtcgctcgatgttgatccgagcgtcctgctccccgtagagaccgtcatgacgcctccggcttcctgaggcccctgacgatgttggcgccgtggaccgccttgaggcggtggccgagcgacgggccctcctccttgccgacgaggagagggtaacaggggtacgcgacgtaccggtggcggcaggtcggtcgccagcagccaactgccgctgggcagaggtgaccaagttggccaagtcgtctagccagcgctgaacaggggtctctggctccgagtttacggggggatgccacagaagggcacccgccgcctgaagcgcgcctcggggcgaatcgtcgtcgccgtaagtgaggcggcgacgtgccccgacgcgtcgtggcctccccccgcccgggggcgaagagagggccgaaccacccgaacgggtggtatcctccctccgcgagggttcgcggcggggaggagttggggagtcgcggcggcggtgacgagggccgcggctcccactagaatactcactcccggacggggtgggggtaaacgccaccgcctcctccacctccaggatctcgaccatggtcgtcaagggcccagggaaacttggggcggaagaaaacgacttcacttcagagcgcgcgaccttccccctacctggcgcgccagctgtcgagggaaggccctcgatagcgggaggtcgtgagacccccctttcgtgagttcggccgggggaagaggctcgcctcttagaaatcgcgtatccgcccctaaggctactagctagcttgcacagaatcggattatacaggttcgggccgctgtggagcataataccctactcctgtgtttgagattatggttaagagttacaagggttccttaactccggagagctttctccccttcttctcctagagttcaggttttctgagagtcgtccctttgctcggtgggcaaggtcctccttttatagttcaaggggataccacatgcaccgcctctacctatccttccctgggagggggacccaccttaccttgaccgggccacgatccgtgccttcgctcggaagctaagcagcagcctgtccttgagtgggacccagcgccacccctcgcctgacacaggggacagccctgtcattccctcataaatgagtgaagacttgtggtgttccttctctcatggagggaaccccgaatgacaccatgataggacgggtcatacctacttccactccgcctgttacagaggtgacgtgggggcacggccacccgttcaatcggatgtgaccggcaacaggccggtcacagactggttacatccgattgacgtggatcagctaggcggcaccgcacgtctgcccttaccgcattaaatgcggtgagggacagttggggcgctgcgcattgatggttgttcagcctgggcccccttcctgctcgctccccccgccatatggcagctgggcgagggcctcggggcgaggcagcgggagagcctgaggggcacgacgtggcaccccgaggccccccggccacttctgtgactcgcgaggcgtgggagtagggccaggctgtagagccacgcggctggatagaaaggtaactttccctcacttcgcatacctctgggcccatacctccgacagatatagttgtagatttcaaatacgcgctgcatttcaagtttgtagtcacattgcagtggtttaaaatttcacatttcatctaaaatagaaataaaataatttatgtaaatattattgacgtaatcaaatattcagatccaaagatctaaagttatgctgatccggccttatatgtactgaacacaacatacccatgcattcgagcctccatgggtacggtccagcaacgatgtcagggaccacaggaatagcggtggcgatggtgacatgcttcggaggggcacgtacggcgatggtgatgacaacgagcttttagatgtgatgaacacaacaatagttgcctcgtcttcattgatggtaacagggaagataagcgacgcagacatcaccaccacaacatgagcgcgccaacatgtagacctacaacggagatatgtatttttgattttataccatgtagatcatttgtcttatttaaaagatgtataaattaaaaataaataaaacgtacataagtgcctttagtcatagaatagattaaaagatatagttttcgaataagataaatggtcaaacgtacatctattatatctatctattatatactaaaatcaattaaactttctacaaacactcctaggttgccatgtggtatcctataaacgctctcgagtcaccatgtgacactctaataaaatagtaaaaatctgaccattaattttcatttaaattgatgggcccattaatttttatcgttagatttatttcacgtggaaaaaaaatctccgtccggagtccggatgtcagccttcatgcgcacgtacgtacaatccccgcaaggctccaaccaccgttcctctcttttttctataatccccataacaattaaagttaaatactttcttatgggcctaaaaagcccatcaacatattatatctagccaactcttcatatatactctcctaataaaattcaacatcatacaaatatttgtaaatacatttccagattcgttgttcttaaatatgtcatatcatattctaatttgagtttttatggaacggagggaatatatagcactcttaaattagaggaaatcttaaaaaaaataaaacattcgacaatcgatttacattattttaggttattagatcgatctttttcaacaaaaaaacatcccaaatcttcctccgcgctcccatgcggcgtcaaaacatattaaccatcttataaatgtttctaaaccacccagggacacactaggggtctctcttaagttaaaaaaatcgtacaaaattatgtgaggaaaagcaaaacatccgaccattagtttcgcttaaacatccaacacattattttaggttgttagatcaatctttttttatgaaaaaacaccctctccctctctctctctccccgtgcggtgtgtatcgttccttttctcttatttttatgtttatttatgataattaaaattaaaattatctttatggagaaaaaaccacaaatgaaccctccacatataaggtctagccaggtatcccactgtccctattcttctctttctcctcttagaactaatagaaacaatataaataaaaataattataacttttcaaatcatatattcaacttatgatctatttgaactattatatttttagtgaaatcatatattcatattgactatatttaaatgccaacataaaaagtacattccggacccacatccaccttgaggccaacactaaatataaaatatattaaaattcgtcattgaaaatcggaatatcgcaccttaatttttaataaagctggtatacccattagttatatcctgatagacacctaacaactttctatcaacttaattattttttctcaacatgtatatgggggctatttgcctatacaatttgatcttggagctttttatcaataaatgattgacttaggagataaataaataatctttaggtggtcatagcatctaaattatatatatgatcaatgaagtcactaataaattagagaaaaactttaaatgatattgtttttagtcataatgtgtagcccatctagcgttaattttttatagacaacataatgaaaataaaaacatgctcggttgaacatcatattgatcgtacaagcaagtgggttgcaacaaagaatcttatcagtgaaacaatgatgaggtggccttaccaatataatgagtcactttcatataggaattaaaaatcatgttcatttatttctttttgtagaacttgctacaatacgttgtaaatttctaacatttagtgtagaacaatctagaaatgtgtatttattacatgacctctattttaatattcttactctactgaagtgagataatttagaagagaaaactttaccccatatcaggttgtaggctcaacccacttatgttttcaacccaaattgcagagatcaaataatttcaaaagatgcttcatagaatagaattctccaaatttctttaaaaaatggacatgaaaacaaataaaatttatctattttttttataaaaaattggttttaaaacccattctaaatagaaatattcaaacttttagcagcgctaatggaatgaaaatatgtaaaacttcaaatagcataaaaaaaattagacattttgagcaaatgtttgggggtaagatatctctgtaggaagtcaaaattcccaaaatttactcataggaactacacatattgtttcgacataatattttctcataaattaagaagtgtacgttcacaagtaattttagtttagaatttatgcgctgtaaaggtaatcagaagaaaattataaccagcattcaaaacacattaaataagttcaattcttatttagatatagtaaaagaatattttaaaacaaagtcacacacacatggacattcataataaaattttacgtacattaaataaggtgcacgcgcatgtgcgcgggctaccttcctagttatatatatactaaaagtccattaaactttctacaaacgctcctaagcctccacgtgacatcctataaacactcctaagtcgccatgtggcactgtaatttatagaaatttataaaaattctctagccattgatcttcattaaattaggtggacccaatatttaccaccattaaatttattaaaaaagattgcctaacccccaaaccgggtccaccttgagcctgtacgtattaccatatgtataggtatgttttttttaagatagtacttatgtacgtacttccaccccttcttccctcaatttcttcatatttttgcacacatttattcttctattatcatactttttagaaaaaaaaaaacttttgtgctgaacaattccgcaactatacatctaaaaatcataccacaaatttttaacctaccattgacaataaagtttaactggcctacttatagataaaattatggtctacgcttatcttgaggagcgcgactatatcacgggacccatgaataaggcattagagaaaactccttagtaactatagtcggcttcacccgatcgttacaggagcattcgtatataagtttaattttgttttatcctattaattggtagaagtggtgtttttaaatatttacatataaatttggacatctacgagacatgggcacttgggtatgatgtggagattaactttttatggtattaatgatgtatttggttttttgtctgcaattccatctattaaaaagacactcatgtttcaagacaatgaaaataagttatggtgaatgctgaatttatatataaccggaataaagtgatttttgattggatatgatagccattctgattatttagtacataccaaaatctatggtctataagagtctatttcttatagtgaatagccattccggtgagatattgcttcttttaacattgtttttatagacaataaataaattggccgcgcatctagcgcgggcatccgtcctagttaagagaaacagagtaactacgttacaacggctctacaaaacattcaatgagcacagtaagatcagctctcaagcggtcatcagcttccctgaggagttggtcgtcttctttcctgccacgggctacctgtggaatgtcctccagcgccgaaatctccgtgagctcggcgacctcggcagcttcgcgctgcagcagcagccgccggtgacgcgccttcatcgcctccatggccaccgcgagagccgcctccgccccctgcgcacgggcgaggcgctccacgagggacaccaccgcgccgacgtcggcctcctcggcgacggcgccggacagcagcagcagccgccgctgcgttcgacggacgacggcctcctcctccccgagccgcttccccgccgcgtcgatgccggcggcgaggtcgcggatcgggccctcgacagcgaggcgctgggacgcggcgcggcgcagccgctcctcgtgccccgcccgcctcgaccgcgccgcgtcgcgcgccagcgccgccatcggcgcgctcccctcggagtagagcgcctccaggtcgtcgagcgccgccgtgacggccgcggggaagctggcggcgacgacgccgcgggggcgtcgccggagcaggaggcggatgcggccggtgtcgctggcggtgtcgcgggatagcagctgctctatgacaaggcggatgtacgccgccgcctgtggttggtcggcggcggcggcggccggagaagaagggaggtgatcttgcgtagctgcagccatgggttcttctacaggtttcgattggtgtgtgtgcgtcgccatggatggatcatggatggcgagctatatggcgcgtggaaactgtttgatcgagtccgattagcagtcggagaagaacgagggactgatcggatgagaactgaacattccgattaagcaccggaatcggacttcctaatggagcagataattttctggttcgaagcagggtttccgaaatttttggaatttcagtacttctttccctaattattttttgaaagtttgacgaattttgaatgaatttgaataaattttaaacaaattcacaaaaactgaaaaaagataatcggaaactttcgtgtgaaatatgtgcttgccggtgggggcgaaattaccgaagtttcagaatttcgttccggaattgtaatctcaggttcaaagctatcgacggttccgagaactagtacaatagaatataaaaaaatattgatttcattactaaaccactgagacgaaatatagatttgcattgcacgaagtgcctcaatggacatactctgtttttacatgtaagcaacaaagagtaggtcctgaaaatctatgaaaaatatgtagtgcaaaccacgtatacactaaaaatctgaaaacggtcgttagatctaaaaatagacatatgagttttatccacgtcaaccaaagtaatgctgggagtaaaatttttactctagttgacgtggacaaatctcatgcgttcatttttagatacagcgatagtttttagtttccactacatatttttcctaggtataaatgcagttcatccgtataagcaatccatatatgttgtttatataggcggacttggtgacggcgagtcaccatgagcccaacgctggatgaagtgattcttattatgaaactataggtgaatgacatagacaatgtactttttatgtgaaaaaacataacaaagaaaaccatagctaggcatgcatcgaatagtgatcatcactgttgatgcgttccttacaaatatacaaatatagacgatatataacaatatgccatcgcaccctactcatcatatagatttgtagttctagtgaaaaactacacccgctatctaaaaatataactaccttaagataatatagctatattttaatatggagatagtaattcaaatatgttgcatactaaaatcccaattacatatctaacaattttaactaattttcaacattacctatctgcgatcctcctagatattccatcaaccttgcatgttctttacaatctagatagcctttaatagtaaagcttttctcaaaaccaaaaatatagaatcaggattatgaccatgaaaagaaaaaaataaacagaccaacgaatggacacatatatgattttcgcaactttaatatgaatatttataaagataattgtattcaaagtttgacttacatgtctgacatgttcaaaacgccatgcatgtttctgtgaaccaagggaagtaaaatacatactcaatctaattttaaatttacgacgttatttatttttatatgtggcattcgaccatgagtgttatgtatatatatatagagggacgctccggtgctttttactgaaagtattatacttcaagtagaaataatctaaaccgtttattttaaatggtagattagtaatgtactgatataaactgggggtaattttggcaccagttgttttgtccgtctatgggctgtgcagactctgggcctgtgcggactcgtgtggaccaactaatgacgtgggcccaggtgtgtatgtgattaagaaagaacgtacgtccgatcagaaaagaacgtgtcagattaggctatgctatagcgtcaagaaaactggattaaagtttttaaacacaataaaattcggtttcaatttcagaccaaatttatcatgatttcatctggatggtctggatcgggttgacaacggaaaaaaggaaaaatatttacgtctgcaattcattcggttagtccagagtccagacaggcttaccaacaaaaacacatggtttttcatagtgcacacatagattagagcagtactagtattttagataaaatatgttacttccaaaattcattcgggactattcgggccgggtcgataacaaaagcacgtggtttttttgtcgtgaacacatagattagaggagaactactattttatcacaaaatatgtgggactcgagaaacacccaacggtattctagctagctccgcaagatggtgggttaggcctaactttgaagcctcacccattctatttatttgatattatgtcctttgctaatatttgtgtttttcatatgtggggctcagtcaaaatcgttttaaccgaatttatctgaaattcaaatgggactgtccgtcttaatcataaacaactcgattaaagtttttgaaataatttaacatccaaaatcgtttctatttttagatgaattttatccaaatttcaaacgagactgtctggaccgggcctaaatccaaatttcaatcgaaacactccaatccaactatgatagatacagggcaacggaagaataaaccggtatgtttttttatagggacttcacaattgcaataacaagtagtatacattcagccaaaaaagctatgatatacacagatcgacactttcagaaccacaaacttctcttttcaatattttgcgacgccataaccttgttagcatgacgggttttaactgcaccaaagataatataagatgctgatttataggtgaacaaagcgagaacatataacagtgaatattcagaagtcatggaatagacatgtagagtttttctttgtcttgccactcttctatatattctctgtccgagaagaatgtgcctcactctaccttgttctgcagaagttatgacatatcgatcacacattgtgctgaaaatatcatcacaagctgaaaaagtttttctttgtattgcctcactctgccttgttctgcagaaattatgacatattaatcacacacattgtgctgaaaaatatcatcaaattgataaaaacaactgacactacgccagatcctcacacctctgacgggatacctgtgacaggcaaacgaattggtcagtagtgaccgttacctttgacgggttatacgggatgccgtcaccggtgaggcatctggccgcggcccgtcacaggtatccgctcacctgtgacgggccgaaaggaaaacccgtcagaggtataccagtgacgagtttttcttccaacccgtcactggtatcccctcacctgtgacgggccgatacattagaagccgtcagaggtgatgggccgccacctgtgacggctttcatttgtggcccgtcacaggtgagcggataccagtgacgggccattgaatagaagcccgtcaaaggtatgagcaatacctttgacgggctttttttatctaacccgtttgaggtgtgttggctctataaatacccccaaactgccaactgctttccatcccgaccattgtactgttcacaaatcggttgggagggcaaggggggcgattttttgctaaaatttaaggtaaaaaacacattattctccattcattctcaacatatcgatcatcatttatttttcttcgtatgttgttgatttcagatggatcgtagatggatgtactatgcgcatcgttcgtctaccgagtatagagagggggtcactgaatttgtcacatttgcggataatgacagaaaaagtaggatgagcatgcacatgttgtgcccatgtagggactgtaagaatgaacagatgatcgaagacaaggatgaagtgcatgctcatttgataatgaatggattcatgaagaaatatacctgctggaccaagcatggagagcaagaggcgcctgatgtcgcagctgaagaagtgttagatcaggatgtagagaacaccgccgcagctcgagaaggcatgttcgtaccttctcctttaggtggagagaccatagatttggacactcaatgtctatctacaatgttgcatgacattgaagacgcagaggacaacgacagagattatgagaagtttagtaagttggtggaagattgccagatgccgttgtatgatgaatgcaagtcgaagcacagcaagttgtcatgcgtgttggaactcatgaagcttaaggctagtaatggctggtcggacaagagttttacagaactccttgagctgttaaaggatctgttgccagaggggaacaatttacctcagacgacatatgaagcgaagcaagtattatgtccgttgggcctggaggtcagaagaat

SEQ ID NO: 29494 - DNA, 8729 bp, Oryza sativa
gggagagacacaacttcttccatcgatgacaattctttgctgaggctgtcggtgcagagaatggttggtgctgaaggtattattgctatgatttattgcagagtcaggtgcagcaggaggagcattggtgctgtggatgatatcgtcgatgttgctgttggagctaactagctgatgagacaatcgtagggttgttcgttggatttctgcggtcttggtcaacaacacactgagttggcaatccttgggcacatggtttgtaccttcgcacagaaaacatgtgaccttgcgggtgggacattcacctggtggatggtcttccccacaatgagggcagagtgtgagacacatgctagcaatgtgtccaatttctccacaacggttgcatgcttttgattccatctcttcctcaccgagatgtcggggagactcatcttcataatccgaggagacttgatctgacccttcactatcatatactctgccaccatggcttaggaggtgctgggtcaactgtcgtgcacctcggaaggtatttcctctttgacgtctaggaatagttatccctgctggaggccattcggtgctggtaatagtcatcttacgtacttcttcttcagttcgcatcggcgcttttctcttctgattcttactcttcttgcctttggcttgcttagtgtgtgaccccacgtggtacgaaaggctagaaagaaagcaattcccgggattcaatggattctcttcattgggctctctgctttgcacactaggctgcaagcttgacttggtgcgaggaggctggcttagcgatgtctgccctgctaaaccaaaggaaggggcttctttagcatatacccatggacaattcagggcatagtgtccttgttctctacaatcatgacaaaaggggacatgctcttctggcatgggaagctcattggcctgggtggcaaatgctcgatcaaacacatacttattttggtcttgacttccaaccaatggtagctgtgaactaagccgcatacttggaatggaccaagggtgtgccctggttaactctcttgaggccagtggtggattgagttgaaaactggagttacttgaggcatacccgctgacattctttcctttttctctgttaaacatctgttacagggattgaggtgagagagaaaacaagccaggaaagaatagaccagaactagagacaggaccttaaaggaactaactcttcttgctgatgtgttgtttgtttcacttattctgcaagttgattaagcaaacaacctagcatggtcacatcacagcccaccgatgcaaaccacacactacacacacaagcaaggaaacacacgacaaacgaaacactagagggtggcttaggttctgcgacgagttcccaagatcttcactccttcacagctggcttcactgcttcctccacttcgctagcggaccctgcggtcttccggaccttcggcgaacaattggcgacatcttcttcttcgcaaaactaaccaactagtactagttgaaatctgaagaaggaagaagggagtaaaccttttgcaaatagcacaggggaaaggaggaaaaagggactttcggaaatagttttatgtataaaatatgtccttaggttttatccacttggcttatcctacagtcgagatggctctgataccagcttgtcgcgaccgagaaaattgcattttcccgaacgctagtgtattaatccccgtcccaggaaaagccggggtacaccatacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacttcttctccaaagcttctcttactgaagggggaaaagattgagcaagaatgagtacaaccacagtactcagcgagccacaccggcagatgcatgattaatgcaagggggtacaaggggtaataatatataggggttaagttttgcagaaaacagcatttaaaagtcacttagttgcccaaagccattttaaaaagacgatcctagagttacacagtattattaatcagggtcgtgaacccgcacgagcctgccttaacccaaggcctacgatgattcagaccgaactggcaacccgaccctgggtcccagctcgtcccaagccaacccaggccaaccattccacattttagttgttgagcaaattttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacccccgggacaggcaggcaggattgagccccctagcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgagcttaatccttatagtggccggggtgctacttcccacaactagcatgcacccaaaccccaccgaaaaacaggttttaggggctttgaaagaggaagagaggggtatgtccaattccacaataagccaaccattccatagtatccaagtgatatgagaattccccaagtctaaagttataaaaccacctaatgttgcctaattaaacagcgaagcatctacctaaattcatactagtggaaccatgaatagagtgtccactagttggggttttgtttattctagggtgaacaaggtaataataacaatagcaataataataaggtcataacaaaggtaaataggcatggctaaataaaacagtgataacgcaggaatttaaataaagcgataatgcattaatttaaatcaaaataattttataaactgggattcaatatgctcaaggatgatgtgacttgccttgctcgctttcccaaacgtcggcttcaacttccacgaagagcggatcttccgaagctgcagcgtctacacgaccaacggaaaagaaaaggcttttactctactaaactccatataacaagcagaaacaaagcacaaaaatgggttcttggcttcttaaggaaaaattagagacttgaacggtccaattccgagttcaaatggccaagttatggccatttgaagtttatatgctctttaaatggatatttacgaatttctttatttaaattttaatttaaaatcggatttattgcgtcagccgaggggaggggcgcgcggaccgggtccacgggagtggggcccacgcggcagcctctcggtccacgatggaccgggtgcacgcggcttacgccggccggcgccgtgggtcccacgcgtcagccgcacccgagggcgcgggcggctgacggccgggccccacatggcagccgcggggcgcgcccgaaggcggcctcgccggcacagccgacgggaggcggcgcgcccgcgccccgatggtcgccgccggcgaccaccggcgcggcggagcggcgcccgagagaggggagggaagggggaaacgaaatgggcggtccacggctcaccccgggtcgacggcgacgacgggaacggcgaccggagcggaggaaggcggcggcgcggctcgggttgacgaggacggcggcgttccggcggtcggcgggcgaaacggaagggtggacgaggtcggcgaggacgcggcgaagccgaaggaggcgacgccgaggcgggaggcggtccggggtgacgatggcggtggaccggagctcggcggcgacggcggagagagagagagcgacgtcgcgagctgaaatccggcgaggaggaagggcggcgagaggcggaaccggacggaggaggtgcggggagggtttaaatagtgccggggcgagagagggtggccggggaagggaggaaaccagcgcgggaggtcggccgccatcaatggcgccggcgagattaggggagcggtttccaaccgaattcgagggacagagggtgggaaaaatggggggaaagagagagggaaacacggggagtgatttccccctctttattgcgcgcggggacggcgggaggcggcgggattcgcggcggcggcggcgctagggcacgggcgaggcggtgggagcggcgggaggatagggatgacaggtgggccccacccgtcagcgagggtggcgggcgggcccgcccgtcagcggcgcgcgcgtggggagaggccgagtgggccgcggggaggaggagagagagggagggagatgggccgagccggcccaagagggggaagggggggggggaaaaagactttttagagcttttctttttataaaaccattttaactttgtttatttcttaataattattatttgtgctctaaaaattccactaaaatttgagggctccttttagaccaaggagaatttaacaaaaattctccgggccacatttgaatttttcttgtacgtattttagtgtttgccaatttcttttcgaattttaattaattctattattccttttagagaatgatttttatttcgggatgaatttatcaggacgtgacagttgtttgggatctgtgtgacttgccttgctggccttggaactcttcaaactcttctccggcgaaaacggactctccggaaacgacggaatctaagcagaaaagagcaaaaacaccaaaacaacacataaacaagcatgaacagtacatgtggatatttttaacatgtagatctcgattttagaaaaatttagagacttgaaccaactaaatccgagctaagatgaattagttatgaatttttgaagatttaatcggattaaaacacttatattgattttaattgaattatgacgcaataatgaattatttttgaaaaggaaaagaggatttattgcgtcagcggatagggtttgcggtggaccgggcgcacggcggcggctcacgggaacgaacggccgagattgatccatccaaaacggacggccgagatcgatcggtccacgaccggctcacgggagagggcgacgatgacgtcggcggtgacgtcaccaccggcggcgacggctcggcggctcgacagctcggacggcgcacgctcgccggcgaacggctgcactacggcacgaacggagggcaccaacgggtagagggcgacgcggcgaactcaccggcgaccagaagagcggcggaagatcaacggacggcgacggcggcgaggttgaaacggcggcggtcttcgagtcgacggcggcgacggtgctccggtgatcttcggcgacggcgaaggggcggacgaggacggcggcgacttggcgaccacgacggcggtcttcccgagcgacgacgacggctggaacggcggcggcgcacggctggagcggcggcggcgacggcggcgctaggttacacggcgctagggcgctacggacgacgagaggcgaaggcgaaggtggcgacgggtagaggagacaccggggagccttttaaaggggctaggaggcagcggcgaaggcccacggcggccggcgacgagaaggaaagatcggggtttgaaggaaagagaccgatccgattcgaactcgaatcaaacacattccaaaccgatttagccgatgtttccaaaggagaaaaggtagaggagatcccgaagattgtttcccctcaatcaatttcaccggaaacggaaaggaacggccggatttggaaaggaacggcggcggcgcgaaactagggtttcgggcggcggcggccggaggtcgacgacgaccctgacaggtgggccccacctgtcagcgggcggacgcgcgcgcgcggcggactgggccggactgggccgaggagagagagaaaggttttgggccgactttcggcccaaagccaaaagagactttttaaaacctttttcaatttaaattattcatgaaatgaaattccatttattaaaaatacttccttagctcaaataaatcccagaaaaatctaggaattatagaattaagcaaagtatttaatgaaattttatctggccccattttatattggaatttattaattaaaattagatcttctcttctaggcttttttaaaaataaattctaataattccaattaaacaacaatttataaattttgaattttcagggtgtgacatatgttgataggtctactttgactttggattcgctttacacaaaactcaaaacacatgagatgaatattctttctcgaagagttgattctaagtctagtgcttaggtttcttcctcgacttctttggatgttggtgcctcttcatcgaagtcttttattcttgctttaattaatggcatatccgatgaacaactcgaataattcgaggaggatttggttttggttactaacaagttttctcgagctatgaataatgttaggtacaggaaaagaggtggtccaaattgttgctttgaatgtggttctcttgatcaccttcgtttgcattgtccaaagcttggaagaggcaagatggaagataatggtggagagaagaccaatgacaacaagccgaagagcacattcaaagggaagaagaagaaggagactctcaagaaggcttttgatcaagtctatgctgcttttgagccactaagtgatgtagatggtgaaagtgaagatgaagataagggaaagaacatttccggtgtttgcttcatggcacgtggtgaatcggattcggagtgtgaagacaatgaggtacgttcttttgagaaagctattcttattttaagtgcaaaaaataagaagtgtgagaagatgtatagaaaacaggagtttattattgaatctcttaattctgaagttgctagattaaaatatcttattcccaatgattgtgattgcaaaagttgtgaggttttaatgaatgaaatttcaaaaattagagatgtcaatgctgcacatgatttgaaaaatagatcttctctagatcttggatttgccttgcgcacacacactttggatgagttgtttttgactaaaaagttgttgcaaaaatatcaaattgcttttcgtgctagtttgatgtttaacataatttgagccaaaaagttaaaataaccacatgatgttttggattgctcaacatgtacattaaacaagatgaaactaaaagatgctttaggtcgtgttgagtcaatggaagatgttgtgaaaactaatgaagtgatttcttgctccaaatatcgtaaaagcaaaggtgtcatggtaaattgtgaaaattgtgctaatttggaaaaagaggtttcttatttgaaaaattctttgcaaagattttctgatggtaagaaacaacttaacatgattttggatcaatctaaagtgactagttacaatagggtgttggttttgatgttcatgactatttcaccaaaaatcaaccaaatgttttgagtgtgactgaacatggtgaaattttgacaaaaccaagtgctaagaaaatagtttttaagtctgctagaattttgccttctctttctgctacactaaaagaaaaaaaacaaatctttcaaaaccatcttcttttaaagaaaagtacacttgttcttttttgtggtaaagatggacatcttgttggttagattagctcgtaaacagaaaaaaggagagataaattgcttttgcaaaatcaaagtggcaaaaatctggttttccctcgaggaaaccggtcagaccgcagtgggtcccgcggtcagaccggctactgagcggcggtcagaccggtggtacagaagcggttagaccggcccccggtaagaccggctactgtactacggtcaaaccggcctcggagaaatttttctgaaaattctcaaactgtttttgcacgtggatatatgcctattggatctactggtcgtgtgtcctagattcctaaatttgtattatctaaccccagtcctgaggcttcaacatcttcatgtgtgtaggctttggtggcgaggaaggagaacgtgtggatcgtggattccggttgttcgcggcacatgaccggtgataaaaattggttctcctccctcaaacaggcatccaagactgaatcgattatctttggtgatgcttctactagtgcagttctcgctacaggtttgctcaaggtaaatgacagattgaattgaaaaacgtagctttagttgaggatttaaagtacaatttgctttcagttttacaaattgttgatgaaaattttgaggttcattttaagaaaactgaaagtaaagtatttgattcttgtggtgattctgtactgaatatttctcgctatggaagagtgtttaaagctgattttcgaaatcctgtttcacctgtgataacatgtttggtcgctaagtttgataaggatgtgatgttttggcatcgtagacttggacatgtttgttttgatcatc

SEQ ID NO: 29495 - DNA, 2073 bp, Oryza sativa
ggtttgtatcttcgattggatcttgaatttcctggttctttgaaaataattcgaagtgataatggtggtgaatttaaaaatgctttatttgaacaattttgcaacggaagaggtcttgaacatgaattttcttctcgtgttccgcaacaaatggtgttgttgaaagaaagaattctgttttggttgagatggctagaacgatgttggatgagtatcacactcctagaaaattttgggctgaggcggttaacactgcatgctatatttcaaatcgggttttcttgaggtcaaaacttggaaaagcttcttatgagctttcacatttgcgtgattttggttgcaaatgttttgtcttcaaatatggaaatttggataagtttgaggcacgctctactaatggaatgtttcttggttaccccgcacattcacgtggctatcgtgtacttgttttggaaactaacaaaattattgagactcgtgaagtttcttttgatgaggctagtccaggtattagagccaaaattgcaggtacaatgtcacaggttcagagggaggatggtcgtatttttgaagacgagagcgatgacgatgacgacgaggtcggctcggccggtcaaaccgggcgccaggctggtcagaccgccggcacactattggtatttcttaacgacattattagaaatatatttcacagcaatgtcgcataaatactcttggtatattatggttacagagttcatccgcaagcgcacggatataacattttagcattgcacccgagagtattccaagggtatcgtatttattttatcccgtgggaagatcgtgtagagagaacttgactaataatttatatgttacttgtgataatcatattctaaacatgggttaagataaaccaagcgtagaatgacacacaagcatttgctactcattcccataatatatgatgtaagccaagtggaaagaaaagagagagagataatctattcctatacttctagtatacatagtatacatatattctagttaactgatatactagctaataccctctatccgatgccctcctggtacttcgagaagccacccctgactgccgagttccttacgacagcccgtcatgaccatacaaccggggctaaaacggaggaataccctccccaggaaattaacttaggactatatacaggcgcggaggaatacccgtactgagctgtcaccatcagcggcccacctatcatccgcagcatataaccccaaataatgatatcccgtaatctagacaccctgtctaaactaccagatactactctaatatcatcgtcatgacatagagtaattgcatatgcaaacattatacccgcaccaaagcatctcccagataagctagcagcatattcagtataacatgaacataatgtaaagtaggcattcgtatactcgaaaaatatttcaataccataaatgtatatagaagagtattctaataaaagtacaaagcttacaaaagaggaaaggaaagctactagagccatacccgaactcttccgaagacttccggactcctgatttctactatattcctattccaccagctagatactactaaactaaacttgagagagtatgagaaagcttgcttgaggtgtgtgagtgaagtgagaaagtgaagtccttatatagaggtagttatgacggttgtggaaggggaattgtccgaagtgccctccaaccatcattgggatgcaatcctggacgtccacgccgaaccctgcatccaacggcgccatgatgggttcggccgaaccatgggctgggccatcccggcccatcttcggctggcggcctcctctattgcttcactttgtagacttgtgaattttggcccaatttatcgtgtcaattccaaattcctggcccattcatgcataagtctgattctcaacatcattcgattgatttatcgtctgtgttgatgtcgattctcctccactttatggttactccccgcaaaaggttagtataccaaatactagtggaatattattattgtaacatttatatgcattg

SEQ ID NO: 29496 - DNA, 2637 bp, Oryza sativa
  unsure (1)..(2637): unsure at all n locations
agttgaaccaccttctagacataatattattggaaacaagtgggttttcaaaaataaacaaaacgaggatggattgattgtgataaataaagctagacttgttgctcaaggatttacgcaggtggagggtttggattttgatgaaacttttgctcctgttacttgaattgaggcaattagacttttgctggcttttgctgcttcaaaaggttttaaattgtatcaaatggatgtaaaaagtacttttctaaatggttttatacaggaggaagtttatgtcaagcaaccaccaggttttgaaaatcttgattttcccaaccatgtttttaaattgtctaaagctttgtatggcttgaaacaagcacgtagagcatggtatgataggcttaagaactttttgcttgtgaaagattttacaatgggaaaggttgacaaaacactttttgttcttaagcatggtgataatcaactgttcgtttagatttatgtnatgatatcatctttggttgtcaactcacgctttggttgtggagtttgctgagactatgggtagtgaatttgagatgagcatgatgggtgagtttcattccttttgggattgcaaattaagaaaacacctcaaggtacatttgtgcatcgaacgaagtacacgaaagatcttttgagacggttcaagatggagaattgcaagccaatatcaacaccaactggttctacagctgtgttggatcctaatgaagatggtgaagctgctgatcagaaggagtacagaagtatgattggatctttgtttatacatatgatattttcttgtgtatgctagcaataatatgaaggtttatttgtctctagcatagcttgtatgtattctagtctttttaggaggcttagatattgcttttaaaggagatgatgcatgacacttaaattctatatttgaattaagaaaatatgcaatattgatgctagcatatggtttgatttataaatgctttatatatatatgctttattgaattgttattcctcaaatagctttgtaattgctcattgtgtaagataaaaatatttatgagtgagaaaaaaatgaataacgaatccttggaaacagtcttgacgacaaggacgtattcgatatgagcaaaaataatgggtgccgaatccttggaaacagtcttgacgacaaggacgtacccggaaaaaattgagaaaaaaaatatgagcaaaaaggctaaagtaaaataaaagataaaaattctcttggttgttttgtgctaaagctaatttgagaaatagtgataaatgcaataggtctatatgtttagtgtttatttttcaacctatgtgcttgttaagatgttgcattataaatcttatgaaatcatgaattttgattgttgatttgaacttaattgtaaaatctttgattcatgattatactttaatgcatgcttgctatattatagatgggttcatcttctttttattgcaactcatgacttgatatgctatatgtatgctaagctcttgaacattgacgaacataattcttatgcttgatgaaatcattgtcaaaagggggagaagcaaatgagagtttttgggagaagagaagaatttttgttggagagttgtttgagaagagcatgttttttggttcaaggggaatttctttcttttcaaaagtgagagaagttttctttcggattttgagcacgatgtgtacatttgtacgaagtgtgctttttaccactttttgtttttatttttccaaacaccaaaacatttttgatgggtttgccaatgtgttcatgaataaggagattgtaaaataaaagtgtttttaattgttattttgtgatgaacaattggcattggagattattggttttgatatttggaatttattttcgaagtggttttggagatgattggattttacaggtgatctacaggaactgctgtctgtgatttggtccggtcagaccgggctgtgtgtgccggtcagaccagcggtgatcgagcggtcagaccggccaacccgtggtctgaccggccgactctgtgttagtttcggtttcgggttatttatttggatatccatgattgtttcatatttatggcttctagatggatattatatgtatgtaatactgttgtttgctaacaatgagtcaagttggggatagcttggtcttgaaatatggtttctttgtttgattcatatgtaggtgacttgatgtctcgggagagtattgccggtgatggatcgggagtcggcttggggataagacgatgtccgtgacggtcagatatcatgtgggatacttaggctagagttcaatgcacgtggttggtgaatattcgatatgtcatacaatggaggtattgtgtgcgtatgggatgcggagtcgaatttggaaggagtccaaatttggtatgattggagtttgtaaagtttgtttcttgtacgggaaggtttcctatgtggattaggacttctagtatgagtttggtttgtggctttaggctgcctacctcatgtataaatagtgagggagcgtgaggcttcccggtatcgcttttgagagcattgagttaataggttagttaggggtttcgagtttagtcgagattt

SEQ ID NO: 29497 - DNA, 16581 bp, Oryza sativa
ctgggcacaggagcaagcaataacaggaagcgattgttgggagagcgaggtgtgtggtggtggagaaaggggcagatttgtacttcctgagctttttctctctccatttctttgggatataataaaataatgccacgagtgtactatagctaattaccggttttttttcagtagatacgcgttcttatggtgtcccacaactaattatacttttttggatgtcgtgtagcaaattttgccttttttagtggagaggggataagggccactgataaccgtaaaacatacaccgctacaaatacaaaatacattccttatcaaccacaacgaaaatataaatcttaagagcccctttgaatcaaaggaattacgaaggaattttacaggattgaaatcctataggaattcctatgtagccctttgattcaaaggattgaagttttctaaatccaacaaaattcctatggaatggctcatagtatataggttttggaggaaacttagcaagaggtccaacctcttggaaaaaaaaatcctttgagtctatctctttcatccgattcctgtgtttattatgtggtccaatcaaacgatcattcctatgtttttcctgtgttttacaatcctctattatacgcttacattcctgtcagaatcctatgccttttctattcttccgttttttcattctacgattcaaaggtgccctaagatgatttagggctcctttgaaacaaaggaaaaacggagtatgtgagttcctatggattcattcattgtagcagcctttgatttgtaggaattggtcataggaaaaccgaaggaaatattcattcgtcgctgattcaatgggagaaacacaggagtctgagctcatttttcacttgctttacgtaggatcgaagcaatcaagctcctaatgactttcttcactacagaagaacaagcaatgaatggtaatttgttttagctgcaatatatttattagaaatggaaaatggtcccaagttcttaagcaaatattcctatgtttttcctatactccattcaaacacatattcctatacatttcctatggctttacaatcctcttttttttttttgagaggacaatcctctattttacatgtgaatttctatcctattcctatgtttttcttattcctgtattttttcaatccaatgtttcaaaggggcccttaaagaatttcatcgtagtttattttctaaaattgacttttaaactgctgatatcacaaatataaagtttttattttataaattatttttaattgtttctttattttttctacagcatacctaaacaaccagagccgtagcttccattgtgtcagacgaacatggaacctaggcacaaatgtaatgcaccgggatgtcattttgtaatttctgcagttttcccgggagaatcatactagacaaaaatctacagatgctattatcatgtaggttatgcacgcaactttattactggagtagttagtagtttataaaggttaactccacatgttctcaaacgcggtctacctgcggaccagaattagcttgcatatattgtttttcttcggattaaaaacaatggaacaaatggtagaagtttttgatcttataggatctaaagatagcattgcagaccatagtaacatactaattataattacaatcaggatcctagctagatcatccaattcatcatcagaaatactgctagactgagacaatatttgaataatggataatgactcaagagatacaaagcagatatgcttcagctaatctaaaatctccaccatgtctggttaagtgcgaaatatagaaattagttggaggacttgggttttggtgcttctacttcttccgagagctcaagtgaaacggggcagtgatcacttccataaaatcctgcaaaaatggacgtcaatgaattgtaccatgacattaaacagcatattggcattaccatttactagggggaaacaaggaaatttgttcgattcattgcttgtagagaagatcatggaagttaccatgtaatagcttcaaggtgctggtgtttattactggcaggcatgcataaaatttcagttacaggtcaaatgtttatcactgaaccaagagcaaaagaggattccaaagggagcttctaaacttgcagattttttctattgtctgccatatctcctacagtctatttgcctacaacatggaactcaccaacacaaaattacagaaaaggtctactctacccccagaactagcatcaaagcgcaaggtgcaattactaccactactgcgacaaccagctctgtcctgttcacctgggttcatgtaactaattttcatggggttgaggtacctgtcgtattccatttgcactttaaattccaaaaaaccagtgtagtgtgctcacaagtcacaacatgggtcacaagttccgacaacatgcaatttgtattgtagtaatagtccagcatgtatttgcagttcgatgtctaatacagtaaaacaacattttagctaatcaggctcgacaagttatgttcctcaaaaaaagaaacaaaatgcataatattagttgcaaccagctgaagttaagcaagctgatgggataatataacatatgcgccaatctattttcaggaacaagattttcaaaatgatttggagtaaacaaaatttatgcaccacattaacaatgtacctcaacctttattaccatgtttgagagcatgacaccacactacatggcactgagctgtgacatgctagtaagtcccctccatggttgtctaatgcggcagctcagatggtgccaagtgatgtggcaacataccgtgccttggagttatgatggcagagtataacagctctcactaaatcactagtttcctaggataggagattaggagttacttacgaaatacttaggaagtactaagagatacagtatcagtatgttaagaacgtagagatagtagtgtgagagctgtgttgcctcccactattcagaccctttttgccctatccatggatcaacacttgggtctattcttagaacaaatttcattctggtctatttgaacaaagttttttaaaagggccaaatgtaaaaatgacgcttttatatacttgcgtatcacaatggaaagcatgataagcaatgttttaaccccataccttctagctctattccacgaccatgaatgtcacatgaaactatttggtccttcagtttttctgaaacaaggaaatagtcaattcgcattctcttccctcggtacctgtaggcatttttaaatcagttagtcttcatgggattccagttgtaatgaatcaaaagttagcccattagctaagatattaactagaaaagatttaacgaagatcatatttatcatcttgtgtaaggatcaagtttagattaccagagaaaaaaaaaagagaatcagctgacacaattttaactggaagtaggataacttttagataattttcacagttcaggtcatagtgcaaactaaactttctagaagaacatttatatatctgccaaacatacaggattatctttaagcctgtaagcccatttgaattgataaattgtaaactcaaactgttcagataaagaatatttgttcaagataacctttggtaaaatgcataccaatgaaggaatgtaataagatgacatatcaatgtcagatatggacatgctttgataatgcagcaataaaatctacgaaacaaacgaagactagcataataattgaaatctttcttacttgccaattggatgtccagaccaagaaaagccacaatccatgtccttctctttgtgcagatatctgtaagcatctaccagctttcctctgtaaattcaaataattactccatgaggtattaaaaaatttcaagcctagaagtatgtcttgttgcaatgaactaaggggatcctagatccaagcattgcttccttggtgcatgacatacctgtcatgtgcacaaagatacggaagaagatatttgccattatggccgtatgttatacatgcaactaattccttgatcaagtcacagatagcttcttactgtaagctgctggtgacatgatccactgggggcatcactgcgaacatggcttgaattttccttaacttattttctttcctccatgtcgaaggaaccgtatgccatgtgaggctttatttgcttcatattaagttcacagaatattgttagaaaagggttcacattatgctgcctgaactggttcctagtggttttcagcttaaataaggataggaaaaaagttgtcaactccaaaatcagttgaaaactcattccttaaccaaggtgtggtgagcacgtttgttaaagggagagataatgaatgttaatcatataccccaaataagtcctgtccagtttactttctgaacgtttagggcaacttttacatggttttggagttagaggacaagtttaaatctaaggtaagagctgaagatatttttttttcaaaagattataacttgagggtgacaatcttgcttgattacccagttacacatggcgaaataataagaggttggcatgttcctacccatacccaccagtaatttagtcagtgggccaaatgatacatgatctgtaaactgcaaaggcatattggggatatgatctgtaaacagaacaggcatactggcatagatgacctctacccatgcaggcagtagtaaaaaaagtctcaaggcttatgagcaattcaaacttggatcgctccatgcttgatttgagcatggccagccaaggtttgtacagcataacaagctctgagcttgaatagctcagcgtggcttgataattcgagtagtccacaattgtcaaggcctatagcaggtccctggcccccaaacatcaatgaacttcaaccttcccataatcccatctcataaaaattatcacatgttctgaagtcacagtatgtgcaacattgtgaccccatcggcaggttgagcatacatgtaagtgtgagcccatgaggccataatgcagagctgccaacgctgcaataagcctctctcatagccagatcttaagggatggcttaggtaggatgaggatgtgaataaaactatcactgaagattctctaaagttagctcaaggtgagtgtgagacatattcaacgagagcatgaaccatatctgtgatgactactagctagtagccaatatattatatatttttgactcaaatccataatggttgccagtgcactgtaaactacattacagatttaaatccattttaacaagatgggttggatcagaacatatcatcttttatggtctaaaacgttataaaaatgaaattaattcatgtagtgctaatatgtttttgacatcaagtttcaaaagatagtataagaaaagttgccaatgtagaaatgtatcagctttcacgtactgggacaatatattgccgaagcgccgcctctctgacagggtgaatcctggctgtccacaatcctgcagagtaggatgcaagagatttaattgcatcaaaaggctcaatagtgatccaataggacttctattttgtaacaggcagtatgccagctggtacaatagcacgtgaaaggcacatttaaatatatatcacattctcaagagcctaggcatatcagtattctaatggttgcctaggtaggctaggcagcgacctttttagaacagtgatgattcaagtaaaacatactactataatattgtggcactgatagaggacagaaacggattccttcacatgcattgatgttcttgtaactgaaatttgcatattcccagcccttcccaatattgaattggttgaagtggctccagccccacttgctggcgctggcagacgtgtgctcctctcgtgaggttgagcatgcctggtcgcgcagcgtgttcaggggtttttcttgacttaattgaatgccactggtcatcttaacccgctgctcgagtattcccattctgaccccctgaagtcctagtagaaccaaaacaaccactaataaaagaaagtctgcctctgagttggagaatgaagtgctagaaaagaaaaagaacgatttacaggttttcaataatgggagtgcacccaatgttcttaggaatagtagggatgtgctaataggatataacagctaacgcaggctgacactatcttttttagtcaactaaatgcacagtttacgagatgggacaattacattaaggaacaaccctaacatgcaactagaaatgaaaagcacaaactgtttaaggatcatttcaatgtggtgactacatacagttcctgagttgtaaaaagccatgaaaagtaataaatcactcctagtcacttgtaaatagaagacttgaatcagtagagtaatgttacctctttatttggagggatgtatccattgagtttagcactgctaaaaaaatcaggatggctaacatcgatttcttcatgactgaaatatttcaaatacaagcaaagtattagagctaaggctggtttatggaaggtgtcaagtagtggattattactattcatggtgtagcaaatatgagttccttagcaagtccatataaaatttgacagcttactcactttgagatctaatggaaatttcagtacatgaccagttccaaaaaaattctatatcaacaattacctgaagtccatctcctaaacatggaattttggtaaacctaatgaaaagtaaatccatagttttcacacattgtcggaccagtggattttacgagacattttaactattttatagatgatgtgagctaaatatactagacttcaataaaataattatatttcctgtggttgcattggaatttctaacatgttgcactgaaatcacaacatgtcaggactatcctgtggttgcattggaaaatataaaaatatattccatgccactaagtttgctcttgttcaactaatcttgaaatcatgatagcagacaggagtgcaggactgcagggtaacataattgcaatttgtaaataaaagaagaatataatatgaattattcgtcctgcactgattcaagcttcagaatacaaaaatacatatcacagctcattatatgtattttatggatataatatgctcaaatcagccttgacagaaaagaaaagaaaaactgttatcagttctgttgcctactagcttttttgtcaaaagtgtaaagattttgtcatgtatcggttttctgttacagtatgcctgaatcaaatctaaaaaatagtatgaagatgtagctatatgtccaaggaaaacaagataatcagtaactagtactacctgttataaataatattattaattacctgacattcaagtctccacaccagattaagggtttgtctacctgttgaacaaactccaacattcttttatcccatttccgtcttctttgaaatgaattttcctcttctttccatccattgtttggagcataagtgttcagcaagaggaacgattcgaattctgcaataataacacgcccatctggttcatgcttggaagctgaaaacaatacaaaagtggattcctaagaaagagtagcaatatgcgagaaagtaatgatgaaaccaaatgttaattcaaagttgcagtgcaacaagtttgttgacctggaactttctttttcattaaagttttgatgtgcattttcttccctgaacagtagttgggagcagccatactaaaacaatactacctccttcatttttgacttattttctagtcaaacatttttaagtttaaccaactttataaaaaaatatagcaatattttcaacacaaaacaaacatattatcaaaatatattcaatgtaatatttgatgaaactaatttcatgttgtagatgttgctaaatttttctataaacatggtcaaacataaagaagtttgactaggaaaaaaatcaaagcgacttataatatgaagcggagggagcatataggaacataataatataaattatactgagagtatgtacacaaatatccaacatatcaggaagaacaactcagaagttctagaacaatctagcagctgatgtggttatcaacaaaagaaaaacattctcaagcgtcacaacacttaagctaatcaggaataaaagccaccacggtaagtaaataattcatcatcttgggcaactctatattagtcaagagaaatcgtttccatctatgcttgttggtgaaatcttatgtgccgtatgatttgtagggtagatgaagagagacacactaacgttagaatgagactgatatggtcaccatggtgtgcatattaaagtagatcttgtattgagttattcacaccagagcaaagcacatggacactacaaaacacaccgataacgggagattgcctatgaaaggaaaatatgaagtcatgcatgcaactctgaacatacatgttctatccaagttgaatgacactttctttggttcaaacttcttctttataatcatagctgtgcctgcatatttggagtctgaaagagaccaccagacacgatagtctttaaaaggtggactcgacaaagcacgcagcactacctgcatggcatcgagatgtgatcttagaacaatttcttggagcacaacaaatgcaatatactaaacagtcatgaagggaccaaaaaaaagactgtagcttgccattcttgaaaatatcagtcagtatacatagaaacttggttgcttgcgaagtgtactacattcattacacatatatcaaatcttctagttttacaggggtcaatcttggaaaagatagcatcgcatgaagatacgaatcaagtttagaattcttaatttgatcttgatctgcctagtattatgaaaagcacgacaaatctaatattaacttctgcataaaagtcacagaaaatttcattaatcttttaatgcttgtattacctgcttttcatctcgtgatgagcttgtgtcatctttcagttgaccaggattttttggtgcccctttggaaccagctgctggcatccgcacttcctaacaaagaagtttagatactatcctagtaagacatttatgacatgtatacttaaaatgaagttgtaagtactgataaaaaaatcagacaaaagcaaaatagttgtgaccagctggatacaaaagaataagcaggcaactgaacattataaggacaaagaatgaaacattatgaggtttggaaagacaaaaagacgtcctcatgtcctatgtacttgagcgtcaagcccctgaggtagattccaaaaggatgtgcctaatataaatccaataaaactataggatatattgggatcacaagcataagagaaataagttgcaatgtgactaaagaagaggcagtgtgattaaagaagaggagctgccgaactggttcccatgaaacagtagaatagtatgtgaacctcaattttgttgtggttaacaccttatacagtgggcatagtggtaccaaagaaaagctcaatcattcaatatatcacgagttttcccatatcatgaattgaagatttaacttgaagagaacacttcacataccatatggtctacagtttgtcacagtccttgcctagatggagtacttgtgctagcatcacaagtggctaacaaaaaaaaaaaaaaactgggctatgaacactgacaacgagttcctagcaactccactcgcaagcaatgacacaactatcttcaaattgcatgtgaatacaacgcaatgcaagctctgtgaacatctggaaggacagaaccctgggaggaaaaacctcaatctctattaagatcgcacctcccttgtttaatctcccatgggtgaataacgaaaacgtacgctcccaacgtgctcgacgaaacgcccgtgagcgaccgcaaatctggcatatgccacattgctgcacaatcgcctaaaacccactcccatatccccacatccgcacagcactgcagattaaaccctagagggagcaaaagccggataaaaagaagaggcaaaagatcgcgcccaaaaccgaaaacccccgcccccgcgccgctcacctggacgcagatgacgtcggggtcgacgcgggagacgaactggcagaaggccggccagtcgctcttcatccggaggagcaggctgttggcgttccacgtcacgaacctccgcggttcctcctcgcggggagcgggaggagaatccccctccccgacggcgcaggcggccgcggcgggggcgtcgccgccgagggagtcggagtcggaggcggaggcggcggcggcggcggcgggcctcttcttcgccggggagccatccttgggcacgggctggaagaagcgcttcatcgcaacagctgccggcggcggccgctcctcgcgtcgcgtctttctgcgtgcggggctgcgccggcgtcgtacggggattagcgaaaacgttagtccgcccaggcccgttaggccgcgtagttaaaagctcacgtaatgggccgagtctgtccaacctcgtcaagttcttgggctttctttttttctttttcaaaaggaaataagttcaccggacgtccctcaactttacgtttagtttaactagcatccctaagccgcaataccagaaatcttcgccctccatctttgctaaaccgttcaagtgagttccttaacagtatggatggtgttttggatgatgtggcattcttgtcagttaagataaattaagagcctgtttggtagagctagttgggtctggagtgaagttgtggagttgcctaaactcagctccacatctctagttcattgtccatctccactatatcatctctttcgggatttctggagctgagtaggccagccaaacactttcagaggtacctcccattggagctggagtttggagctaggagttaggagttggagccctaccaaacaggcactttgtgagagagatccacttagttccactcctattttaggtggaggtaaaactgtttggttgagctgaagctggagctgtgctaaacagggcctaaaacacacatgtggggcccacgtgcaagtggattttcacctctcgcccctctcttcaccacctctctcctatcttcctcaggacctcgccgctggggtgatggcccacggccagagagctcatccacgggaggcggcaatggcggtgggaggtcggtgccaagggtgctccaggcggcctggtttgctcgttcttgccatctttcatattgtgattgagcttgtttttacccgatctacttgcatgcttaattaatatagttgatgaccttatatcttgcttagataccttgtttgtcaccttttgattcatatacattttgtttgtttgagctacaagttcatagctagtgttttattccattatccgccgaaccttttggttgagacagaaacttccaatcccctaccggaaattccgatttgaaccggaagttctcatcattctaatatgctataaagttgtgataatttttagaaacgactattcacccccctctaggcgacatcaaggtcctttcacccatgtttatagaaacaaatcctgaccagccaccaacattcttggtcttgaataggtgagtgcacttggtcttcaaactgatggggttggccgatgtagtgatgtctagccctgtgatcatgattatatccaagagcagtcatcggcctatggttgaacaagaaagcgtttaaggtgtctgaccaaaataggctgcagctgataacattggttcatctttcttcttatcggctagagatagagaaaggcattgagatattcctatttcttcccagtgactctgcttgcttgtagctactctgttataccactcaacccatttatcggcttgggatggccatgatctaaaggtcgtagacaaatgggctaggtttggattggtctacctaaaagggattctatttgtttctgagttgatgaatatagtgggatctgtatctccaattgggcccatgaaaaagtgatttgattctttcagacttgggactgctacctagggcgctaaatgctacagattgcaagagagggagattgaattgcaagaagacgcaagaattggaaagagtttgagctgatggggcttacctctggaaactctgcagttggcgggcttgacgagctcggggaggatgccattgaagttgcattgggaatcgccactgagagcgcatgtgcggtcaccggagaacgtgggaatcgccggagagatggggaaagtgattttgcttaggtggtgaaaacggaagtggatggcgtggaaattttaagcggtggttactatttaaaagcgcgcggttaacggccaatggcggataaacacttggggggcatgtgttaatgaccaaatttggtaatgcatggatcgtatttggaggtaaagacgaagcagatttggaggggattgtggtgacggttgaaaacatattacacatcggctggagaccgtatcggctaacactagtcggatagggatagccgatacagccgatatcgacaagatgggttacaaagtcattgtcggatttgattgaagggctacaggagtattgccaggcaaggattatgttcaaagaatggcaattgtatctattaattaggatattttagtagtttccttatagatatctttggtaagagtgtgcctaagtgacttgtttgtctgttagagctataatagaagtttgagtcgtgtccatatggaaattgttggtatttcttaacgacattactataaatataattcacagtaatggcgcagaaatacttttggtatattatggttacagagttcatccgcaagcgtacggataaatcattgtagcatttcacccgagagtattccaagggtatcttatttattttatcccgtgggaagatcatgtagagagaacttgactaataatttatatattacttgtgataatcatagtctacgcaggggttaagataatccaagggtagagtgacacacaagcattaagctactcgttctcatactaaattatctaagctaaatggtaagaaaaagaggaagataatctattcctatacttctagtatacatagtatacatacattctagttatttgatatactagctaataccctctatccgatgccctcctggtacttcgagaagccacccctgactgccgagttccttacgacagcatgtcatgaccatacaagcggggctaaaaacggaggagtaccctccctagggaattaacttaggacaatatacacgcgcggaggaatatccgtactgagctgtcaccattagcagcccacctctcatccgcagcatataaccccaaataatgatatcccttaatctagacaccacatctaaactaccaaatactactctaatatcatcgtcatgacatagagtaactgcatatgcaaatattatacccacaccaaagcatctcccagataagctagcagcatattcagtataacataaacataatgtaaagttggtattcatatactcggaaagtattttaataccacaaatgtataaagaagagtattctaataatagtacaaagcttacaaaagaggaaaggaaagctactagagccatacctgaactcctccgaagacttctggactcctggtttctactctattcctattccactagcttgagaatactaaactaacttgagagaatatgagaaagctcttgcttgaggtgtgtgagtgaagtgaagtgaggaggtccttttataggcaggtaatgacggttgtgacggttggaatggtcggtaataccctccgaccgtcattggggatcaatcccaaccatccagaagaagccctgcatccaacggcggcgagggaggttcggccaaaccccctggttcggccgaaccaggggccggcccaaccagcccaagttttggctggcggcctcctccgttgctccacttcgtagatgtggacccccgtttttataacagggatcaatcgtgtaaacagtaccatttccctggatcaagtagtctggtacacacgagttcatagctgaaataccaaatgcacacacacgagagtctagtgcgaattattacaacataagcccgcaggcattgtcttaaatcatcggaccgggcggtccggaatacatcccaaaagcagaaatagataaggcagcggaaataaggcagcggcacgccattgccacaggcaacgaccgtactaagacctactgagcgccatcgtcttcatcaccctcctggtaataggcatagggatcctccgaagcttcatctcccgcttctgattaagtttatatttgcaagggtgagtaccaaccgtactcagcaagccaccacatcaacaatgcatatgataggggtatttcaaaggatggctagggttcttttgcgcaaagcaaattttgtaattcttttcacaagcctaagacctagcattgactgatcaaattttagtaccagtgtttgtatttgaacaacgacggttctgtccaccatccattgtgatcccaaggatagcttcccgccattgagtcgtcatggttttctgaggacgcccaccttcccccttctcaggaagtggctccaacagcataaaaattcatcatgcaataacccatcccacactagataagaatttagagtctagccaagtgtaatacatgtcccggtgctcaataaccgcgagcacggctattcgaatagatttggtttactcacactgcagtggatgtacactttacccacattctgcgactgcccaacacatgagccttgtctcaacacatgagacgcgtcacggcaaagcttttcgataaccttgcattggcagtacccgctccatgaacttttcatcctcatgtactctaggcgtacacagtttctagcagtgagaggagttctggcgcacccggggagggaaaattcacacacatgtattaagttataattatgttcaactcatcacatggcagtcctaacaatggcgacaccattgtagagcccctgccttacacatcgagaaaccactatgcatggatactgcctccgctcggctatttactccgctaggtctatccccattcgagaagtgtggttgtacggggtcgtttcatgcttaacttcatggctcggtccttaattgaccggggacggtactagcctttcccggataccacccaaattcaccgtctgccccggtctaaaacaagtgtttagttttctttcctattttcacaaatcatgtcatcattatcatggcaatgtggcgctcatgtctccacatgccgcatctcaattaccttcccaaaggtaattgcccaagcatataatatttgacaaatatgagtatgcaatattctagtgtagcatttctaagcaagcatcataatcgactagggactcttacgtaatcatggttacaaggatttaaaggtgaacgataatcaaggcatggcataatcataaataggatgttcatcatcgcatgcaatcttatttgtaaacaaaaattaatttcgcaattgggatcaacgtgatcaaagaatagtgatgacttgccttgctcaaggtcttgcgggtcttggccttcactcggatccgcggcttcctcgggctctacaagtgcgtgcaaagaatcgatttgaattccattagaattcaaataaaatccaataaaaatcgaattgaaaaacgagcgcgagaggcgaatcctatatcaactatattattcgcgaagtgggattattcttcctcctaagatattttgtgattcgaaattacgtcttaagacttcatctaattatttagttctcaattccatctaaattactaccgcgaattgatcatttatagagattattaaaataatctataataatctataggaattcatctaattgtttagttcttaaatacatctatgattatagtattactttgcaaatactagattttagttaaccccataattaaattctaatattttaaatatcctaaatctccccctaatttttcctatttattttcccccctttttcctttctttcttttctcttcgttttttccttttcctttcttttctctcctcttttttctttttcctttcttttctcttctcttttttctttttcctttcttttctctccctcttctctccctcccggctcctttctccctctctctctcggctcccttgcccacccgggcggcggcggcggtggacgcgagggggggggggggcggcggcttaccgacggcggcgcaaggcgacggcgatgcccggcgcggcaacgagggcggcggtgcggcggcacaaaggcggcggcgcgacggcacggggacggcgacgcggtggagaggaaaagagaggaggaagaggggtgtggagtggggaataatggagaggggtgggggattttatagggaataggggaaaggg

SEQ ID NO: 29498 - DNA, 15499 bp, Oryza sativa
ggcgcggcagcagcgacgcgacaggcgacggcgtcggcgcggcggcagtggcacggggctcgggacggcgtgcgcgcggggcagggggagggttagggctagagaacgcgatcgagcacttagagcgcaatgaatagtgccattttctatttaacccgatttaagcctatttatttatttaaatttgattctataaacctaaattttgtataaatgaagttcactcggtatttgtgttattccaaccaatggatccatccttgactaattttacccatattttatttttatataattttcttgaatttaattagggttaattcttattccatcacatttaaatttaattgttacaaatatggtcgtaataatattttacttatttctatcctcaccaaatcttattttaaattgaactttaattatttactttgtcaatttacttttagggtttattcctaattaattattcattattcgtgatttatgaactccgaagtcaaaataaaataaaatagtgaaacaaaatcggcatgatgcaatttatttaaaaagtttttgaaggcctatatttttggagtttagatttttgtcggtctaatttttagggtgttatagtagacttgtgaattttggcccaattcatcgtgttaattctgagtttttatcccattcatgcataagtctgattctcgacatcgtccgattgatttaacgtctgagttgatgtcgattctcctccattttatgcttattctctacaaaaggttagtaaacctaatactagtggaatattattattctaacatatatatgcattgtaagcatcactagttctcctctattttggtaatattgatgggcgaaactgatcgataacgaccgtcaacagacatattatctattttgggtataaatatgtacccgacaccctctaaataattaacaccatttcaatacactttcggcacatcgccaaacctttctattattttatttcaatgagttcttgctttcgagttgggctgcatcgacttcgatctccgacaagaggtaaagcttgttatgggggcttgcgttctcgggatcagtggttacatctttatgacactataatcttgtttatgtaattcgtcgagttataatatatattgactaatcaaagttgatattttaatccagtccttatcggccgatctctgtttagggttctatcgacattgactagaatagttcgtcggcttagattatgcaatgtatctaccatcttggagaggctttcattggcttgtttacctaaatcataagtttctctttatacttagtgctgcatcagttaagtttgatcaactaagtcgtatctagaaacctaatatttagcttgcttcatgattgctaatagatatagtatcggagttgcagctgatcttacatgatatatctattttgttttacttaacaagttatatctgccctttatattaggctctcaatagatttaaatatattaagtttgtcatcgatctagttaggttaatctaacgtcaaattgatacttatttaacatatttacttcaaagtgatatcctagtatagagttatatcggagctatagccgatatacttctaaatttgcctatcggctatgacatgagcttgtataatttatagcttgatataactttagatataaatgatttatactgtctcggcggctgtccaatctatcccaatcatttcgtttaaagttatattgattcatagattatatagtgctgatttctccaaccgatagagtaagtttagttactttctttatcatatcccttatagccaatccgactaacattgcatcgcctaggtcacagacgatatgtcatcggctctacgaccgataggctatcgtttatggatttaactttctatctttatttactttctttatcatataccttacggccaatccgactaacattgcattggctaggtcacagacgatatgtcatcggctctacgaccgatcggctatcgtttatggatttaactctctatctttatttctcgttggttgtaggatcaaaccaactaacatgccctgaaccctgaaggcaagctttggacctgcactagaataaagcaaatctcttatatcagtgtgtgtttttttaattaacaaaagcgcgagatcgtgcggtgtcgtgcgatgggtacacgataccgcggtctcgcacgacaagggtatgagagaccgtgtgaccttgcacggtaagtatgcgagaccgcatgagtcgcgagattaatggatcaatcagcatcatcaagaattaattaattaactattatttatttaattagcattattagcaattaattaatcacttattaagaatttaagattgttaattaccaacttgccgtcattgctatcgcactctgatctcgtgatttcattgcgatttcgcactgccaaacggcgataacggtctattgatttcgcactgccaaaccgcgatgacggtctattcgtgtaaatctgttcgaatctcgtatattttttaagaaaaaaaacttcaacaatatattttcaaattcttttggtatgcttatagggttctcttttaaatcaaaccgaagagaaacgaaatagctaacttacttttaaccatactgctaaacctttgtttcagcgcagcgtgtacttctataacgtctataaaagctgctgatatcatagattgggaaattttgaagagtagtcgatcttatccaaatttttttcaataatggaatgaaatattacagcctttcactagtacagaaagccctattggtgtcggttgggaaatggcaataggtgccgttttcccgtccggcacctattgctggtaccggcaactaatggtaaaatagaaccggtacctttttgtctgcacgagaaaaaaaaaactctggctcaaatcaagccgaaggcctccacatccagaacaatatccccacattcagaatcaaaccgtgatcccctccacatccttagatccagaacaatatccctacatccaaaatcaaaatccaaagaacacatcaataacaacaacaatttctacatccatttaattataatgctcatctgatccaaatccccatgttctcggtacacatatgaataagagaacttgagagaaattaaacaaagagaacaagaacgggataaaaagaacacactcgaaccacagcggcattgaggatgatgcggcggtgacggggcccttgggttgcctccttcttccccttgagcgtcgctaggatggcggttgtggacgacttgcacgtgaggggagggcgcggtcgctgccgccttcgtcgggcagccactggccgcgggagaccgacgccgccctcccgccgaatctggaggagggagggcgcggcaaccgccagcctcgcgagcccgccgccaccgccgggcagctaccactagagagaggggagggagagacgcgaggcgacagaggggagggagagagacgcgagagcgagagagcgtgggagtagataaggacaagacgtgggtgggagtagataaggaggcgtggcgctcggctcatcggttcgggtcgttattataggtgtcggttctttaaaaaacgaataccttagtattggtaccggtttttactaatgaaccgacacctatagtttcttaaaggtactggttcttatttttttgagcgtgtggaggtaggaaaaggcctataggtgcggttttaaaggaaccggcacctataaggccgatccctatgagtgtttttgtagtagggtttgctcaacgagttacagccaattattataaggctcacacaaaagcaaaccagagtaacaaaaccaaaagcaaataaaactaataaaaccaaacaaggtaaacatcccagaactagtgaattctattggtgaatctccacccaaagttggcaaagaagacgcaagtttaggacacgcctctcttatttgcttgatatgatcatgcctttgtaattgagataattcccggagccaatatgttaccctgaaaagaacctgcaaatatgatttttaaggtgatctatccaaatccatttcatttctattaagccatagagcacaacatatagcggaagctccaacaaaaataagatccttgatatttttattaactcccacgaaccaattaccaaacacatgtgatatattatgtggagggtacaattcaaaggagaattgtatagataaactagtttttttttaaaaaaatattatgtttgtgcatacaaagcattctacacatttcatccatacacatacattactcaggctggacaaagcagctagcggatgatcaaatagtataggattgaattatcaccgttctcgaaagtgctttgttggtaaattagaaagggtggttctgagcttcaaatccttcgatggagcggtggacgctccaattcagattgctcctgtggcgtcatatcaccaaatatattgagaccccaggtataagacttgccagacttgttgaactcaatgattttgtgcgctctgtccttgaaatacacgaagcgccgaaccatgtcatcacgatcgcgctctatgtcatggaagctgcaccaccgctggtacagcgcccaaacggcttcctctgactcgaggtccttctcgtcgtaagcgaagcaggtggctggatcatctatcggtaaaataacaaggcgttatttaagttcaaagcaggtggttgtttcgtctatcggtaaataacaaggggtaactaacaaggcgttaattaagtttcggttggatgataatgccatgtactctttgactccttccatccgaaaatacagggaattctctgtttgtcacaagtgaaactaagtttgactgaatttatagaaaagaataacaatagattcattatgaaatactccctccgtttcgttttatttgacgccgttgactttttatcacatgtttgaccgttcgtcttattcaaaaatttttgtgaaatatgtaaaactatacgtatgcataaaagtatatttaacaacgaatcaaatgataggaaaagaattaataattatttaatttttttgaataagacgagcggtcaaacatgtgctaagtcaacggtgtcaaataaaacgaaacggagggagtactaagtaatagtgcatgtgcaacgcacattaggaaataaaatcaaaccaaatatgttggacgtatgttgcagcctaatttgttttttaatatttagtatagtatttacttggacttaatgtaaaaggcaaagtgaaaataataattgacataaatttatatcacacaattaaaactactaaccaccatcaacaacaacaacaaatactaatactgctgttaggaacgtcccaacatggaaaaggaacacaacagtaatgaccaaagatgatttgcgggaaaaaaacaaatatttacatatgattttaactacacatggatccattccctcaatgaatgtttagaaaatgaaaaggaaccagttaagattgagtgtattctcgtgtacggttgtaccggttggatcagtgtataatttgagataacaagatcacatatttacattgaaggaaaaagattgcactgagcttaggtttacatagaagattacatactactcagatcctgccatggcctgcatcatactacctggacatatatgtgtcgagattcgtagcaaggattgaactttttttttttgggacggaggggtagttattattaccacgtcaataaacaatcacaatccagtatatagggtcaacaagacaacaagagtgtgaaccttactttgtggtgagtaaactttttatggtacaactctgaacaaacataattgtacatatatattttttttatggtaacagagacccacatcacaagttcgcaatagtactgaggctaaaattttcaaagttacttctctgatgtggtagatgttaatattttctctaagaaatttgatcagcttagaatttgctaagaaatttgatcagcttagaatttgacttagcacaatcccaggattacttatatgttaggacagagcaagtacaaataaagatagtgcagggatagagtgtgtgtgctttagtgcgttcgctagctcagatcaagggccattgttccacttgtccgtgtgactcatgtaatggggttagctaggccatgtacacaataaggctgcaaatgaaataaactgaatttcttcactgagtttcttcttcagtgtgtttttcttgttcccttttccttctctgtttcctataccaaaattctccttctccccaaaatagaacaagatatcaataatactgctaataattcaccccaaattacaacgagttatccataatactgctactagtcaccagctcgggtcataacaattactacctccatattttaatgtatgacgctgttgactttttgtctaacatttgaccattcgtcttatttaaaaaatttatgtaattattatttattttattgtgacttgattcatcatcaaatattctttaagcatgacataaatatttttatattttcacaaaaattttgaataaaacgaatggttaaacgttagtcaaaaagtcaacgatgtcatacattaaaatacgaaaagagtacgagcaatcggtctctcacgagttcgggtcataacagataatcatcatgacgacagtatccttgaagtggaggcaaaataaaaaaaaaaaatggcggtcgattaggttacctggagcttcagggtcaaagcaatcgggggagaggtcggcgggtccgggggagtggtcgccggggatcatcgcgatgccgcgccggaggatgacgagtgggcccgacggggcgtgtggcagctgaggccgcgtccaggcggcggcggtgcaggtggtgtcgccggcgtagccacaccgaggagcaaagcggcccatgtacgaagccacatgacgggcggcggcggccatggcaggttgatcggatgtgaggaggtccggtactcgattccgatctagggtttcaactttgcaattcgttggactaattatccttgcttgtgttttcagttgagtatgtccctgtggcaatgacacgtttagcaagtccttggagcgtgatgacccacaaccaataatcttcttgatcaaaactcaacgaatggttcaatgattcaatcagacattagtcaatttgttgatctcaataaaagaatataaggttattatcgacaatgaaagacaccgccgacaaaatatccggtggcatcggtttagtgattttatcattttcagaaaaaataacaagctcaaaattattattttttgaatacactcacccttatgaatagacacacaacttactcctataaacatctacgaaggacttagtcggtatatcataaaattaatgaagtcaccacggccacgggcgcctcactgtcgacgtatacatcgtctaccactgagagaataattagcctaaatacaaaactcggattaaattgacctaacagaagtgatgaaagtgcattgtaaaataccaaaaatttgtatactgacatattagggtttaacggatattgagtggcaaataagggaatttcaatatatatattcccctgattttttttagaaacacaatataaacgcaaacgctcacactctcacccctaagaacatatacacgcacattctacctttataaacaccttggaaaaactgagccaatacatcttgaggttaacgaagtcaccatagacacatcgttatcgatggatatatatatatcgtctaacactaaaagaataattagctgtaaatttgatcacccgtgtcaagtctgagacttaaatttcaggtgaacaaaggttctaccatgagaaacttagctagttgagctacgctcacttcatcccctgattatttttgttaatcaaccgcttaaaattttgtaaagttcactatggtcacaattttgaggcagatgtgaaatattaaagtcttattacaatagattaaaaccattcaatattacgtagataatatatgcaaaagattgaaacagatctcttaactttttgcagccggcagaggggagaagaggaaatgcccttcggcgtggaagggatgttgaccgagtgccacaccatggatgagttctagtatctcatcgaacaggccatggtgtgtggcaagctcgtggtcatcgagttcggtgcatcctggtgtgaaccttcacgcaggatcgctccagttttcgctgagtacgccaaggagttcgctggagtagttttcctgaagttcgatatcgatgagctggaggaaattgcagactcgtatgatgtcaacggagtagtacccaccttcaccttcgtcaaggctgggcagaagattgacatgatccaaggagccaggtgtgacatcccggctcaggacttaataggattaatagaatactcataccaacaagttacaacttcttttccggaagccgcttctgggtgcgcacgagtgaggacaaagtgtgcagaaaagacttgtgttgctctgtgagagcattctatatcctaagaaaactgccagatatagagagggcctggcggtcaccgggaaattcttcccgggtgcgcacgagtgaggacaaagtgtgctatgagggcagtctatatcctaggaaagctgccagatgtagagagggcccggcctcggagagtgtggggcgttacagatggtatcagagctgacccttgcagcgttacagatggtatcagtgccgacccttgcagctatacgtatatatgaatatgtacgcgggcatacggtgcacacgggatgatccacgatgtggtcgtatggcatgacgtatgtgcgccgaaaattgtctgtatatacgtggtgctaataggagacgttcccggcctgggttgaccgacgaggacgtcggtgtcttaagggggagagaatgtgacatcccggctcagggcttaaagaggattaatagaatactcataccaacaagttgcaacttcttttccggaagccgatctcgaaagaactctaaggttacttcctgggttcataagaactttcttaattcttcccgggtgctagtctgtgtcctattaaagctgccagatgtaacagggcccggcctcgagtgtggggcgtcacaccaggtctctccgttcgaagattcaaatgcacactgcttctccttacttcctgggttcataagaactttcttactgtctttgcgcgatgaagtggaacagctagtagttgttattttgcggtcgggaccttaacatgtaattaagaaaccccactacagtgctctttactagtggtaaaaagtaatctaaaccattgatataatttaatcgaatggtttaaaatctacttgtactgtcaccccagtttgtggtaggagaaacatgaagggacattattattaaaaaatagttacagaggggtataattatcatttagcagtgactaaaccttctaatcataatattagtaaattattgatttacccttaattaaggtaaggggtgttaccgtgttaggcactagacactacttaaaaaatcctcatagggaccggcttatttaaaaccggtacatattgatcttttctcaccttccgcgggataaaaaataaagaaccgacacctttgaacaattataggtgccagttctaaagaaaaactggcaccaatacaattggtattgatttttttaaaaagaaccgacacatataatatattataggtgccgattaattaaaaaccgacacctacaaattaagccgagctggtggggcccaccatgagagataaggccagcggctagacacctcgatccatccagaaatattctagatcgctctatcgctctctctcggtcgttcgctcccctctctctttccctcccctctcgtggcgcctgcccgggaggtagcggcgcagcggcggcgtcctcctttccgccagatccagtgggagggaaactgctcctcttttgaaacgaagaaagctgatgtctttgtaagcagacacggctatgaagcatcaggcaatttctgaaataggaatgtgggtgaaattctacagtaactgataaaatgagtggcagatatgtagtcaaatacagttgagaggtgctgcacagtatcaatttatctacatagtcttcataaagatgtcctctgttgatatgtcactgctcaattgataacagtcctgaaaaaacgcatctagtactgttctgccacattgagaagtaactttgaatcttgctctccatcatgatcctacatgtggttttctgcacgcagtgctccacaggttgcagctgctcaaggcagttgctgctacactcggaggggagaccatcttccaccacgaggcataccaacgcgatacatgttcaatggcatgaacctagactccacaatatatataactgtgtcatcaactcgtcaaccaatctttctgatgcggacatcactccttcggatacacacaacaatcctccaccggtcattcaagaaccgataacaagagctcgcgtgcgacaattgaatttagaggtaagctcgttcctatgttcttctttgtatgaatttgagaatagattgctacctaatgattatattgtgattaggaacaatggagaggacaaagagacacttggagaaggacttagagttatggaggatcatcaaggacgtccaagtcaaggtggagggccaaagcaagccaactttgagtgcaattcggagtccagaaccagtctacactaaaacgggcgtccaggtcgcatacgtgctcggattggggcgttctttatatggatggaagctaagaagataacctttccaatggttctggtcccacgtccaaattctttccgagtcaacgggaatcgaccgaacaagttgacgtctacaatctgtgccagtgctgcgtcaccgtatttaggcctttgggctgtgtatcgtattggaacctattagggttgtgtcaagggttggttgcatgaccctaaactctatatatcagtacccgccgtcaccagtggcgaatccaggatagaaaaagagggtaggcttgatctccaagtattaagttactacctctgtccctaacaaattttggctatgaatttggacacatgattgtccagatttatagctaaaattgcttatattttggagtagtaaattgcagtacttacggtagttattcaacacatacatgatacatgattgaatagaaaagaaagaaataaagaaaaataccttgccaatacgaagtaattgattactacatcagtcatatgagaataacaaacacctatatgcatatactccgtaaacatagtataactgctgctctgctagtgctagcggctactgtggtgctgctccgcgcgccgccatggcgcctactgacggcttcgcgcagccgctccgcctgcagcctgccggcttccgcgcctgcggccgcctttgtttgctcttactcgccaccagacagctagctacggcgctgcagctcgaggcctcgagctcttgcgacttgcgtcggcgtcggctgctccagccgccaccagttgccagcgacagctcccaccctaaacacccccaaccctatccccacctgacctgtgtgagtgtgaagtgtgggaagtgggccactggactgggccattactatcgaattgggacaacctgttagaataattgggctaggcccaatttataataattaaatctcaaagacccataataaatgttgaggataataataccacctcagaatttaagcgagaaatatctcaacctaaatagggagttattagaggctccctgttgaccagttgaggtgggggtcggaatgccacgcgcgcgcgcgccgggccgtgggcgaggcgtggcgtggctggcggcgtgcgtcacgtcacaatccttttgcagccactaacccacgttcccacgattccctccacaaccgcgcttccacgttctttctcctgatagtcacgacgcaatccttttgcagccactaacccacgttctcacgattccctccgcaacagcgcgtccacgttctttctcctgatagataaggaggccgcgagtccgatccgacttcttagcttttttcccggtgttagtttctccttctccgcgcctgagttgctctcgcttccccgcttctgatctcttgcgcgcacgagagattggaagaagcagtggctccgaaaccacacctttgcctgagatctgcaccgggtaggcgggagatcaggtttttggggagtgcctcctgcacgactgctcatcgccatgtctggagttgctgctgccgccgctaccggcggaggtggtacgccgccgccgacaggagctggtgcgccgccgccgacaggagctggtgcgccaggaggaggtgccgtgaacgactacaacaacggaggcaattctgcctcaccatccagcggagggccattctcggggtataatcttctcctcctgctactgctgttagcgctattcctgttcccattgttagcgctatactgtgtgcgctatgttcttgttcctattctacgtgatgcctctagcatgttatcgcgttactggtatgttcctgtttctgacattcatgatgcgcatagtatgctactggttatgttaagattaccctacactgcttatgccatgatcattgtttcaatttcttggattaaaatatgccgaataatgactatatttccaacaatccaaaaacctgataggtcattttcggtagttggctttgctgctgcactgaaaccacatgcttttgatggttcaaactataagagatggaaagcacgtgcactattgtggttgacagcgatgcagtgcttctatgtttcacggggcaaacgaagtgaaccacctctttctcctgaggaagaggctaagttcgaggcttcggattgcctgttccgtggagcattgatcagtgtactcgctgacaacatagtggacgtgtacatgcacatgccttctgggaaggacatgtgggatgcacttgaggccaagttcggagtttctgacgccggcagtgagctgtatatcatggagcagttctatgactacaagatggtcgatgaccgttctgtagtagaacaagctcatgagattcagatgctggctaaggaacttgagaacaacaactgtgagttgccggacaagtttgtggcgggtggcattattgccaaactaccaccttcttggtcggactttgccacttctctaaagcacaagagacaagagttcagtgttcctgatctcattggctctttgggtgttgaggagaaggcgagggcaaaggacgtccggggcaaaaaggttgagggaggttctagtgccaatatggtacagaagaagaaccctcatgcatcccacaacaacaagaaagtcaagcctgatgtcaaacccaaggctgcaaccaattttaagaagaaaggcaagggaaaggcaaagggagactgctttgtgtgtggcaagtctgggcattgggccaaggactgtcctgagcgcaaagacaggaagtctgccaacatgatcattagcgagggcggaggaacatcggggtacggtaaaatattacctacagttctctctgtttttcattcacctgattggtgggtggatactggtgctaatattcatgtatgtgctgacatttctctgttttcttcttatcaggtcgagagaggttcctccttgttgatgggaaacgggtcgcttgcggctgttcatggtgttggtacggtcgatctgaagtttacttcgggaaagaccgtgcagctgaagaacgtgcagcatgtcccttcaataaagaagaatctagttagcggctctctattgtgtagagaaggttttagacttgtgtttgagtccaataaatgtgtcgtatctaaatatgggacttttgttggtaaaggttatgacagcggaggcttgttccgcttttctttgaatgacatgtgtaataatcataatgctgtgaaccatattagcaagaatgatgagtctaatgtgtggcattcgcgactctgtcatgtgaatttcggttgtatgacgcgcttagctaacatgagtttaattccaaaattcactttggtcaaaggttccaagtgccatacttgtgttcaatcgaaacaacctcgcaagcctcacaaggcatctgaggcgaggaatttggcacctctagaacttgttcattccgatttgtgcgaaatgaacggcatgttgactaaagggggaaagaaatatttcatgacactgatagatgattgcactagattttgctatgtgtatctattgaaaacaaaggatgaggcattgcattactttaaaatctataaagctgaggtagaaaaccaacttgaaaggaaaatcaaacggttgaggtctgatagaggtggggagtatttttctaatgagtttgcatccttttgcgaagagtttggaattattcatgagatgacgcctccctattcaccccaatcaaatggggtggccgaaagaaagaaccgtattctaactgagatggtgaatgccatgttagacactgcggggctttccaaggaatggtggggtgaggcagttttgactgcgtgtcatgtcctgaataaaattccaatgaagcataaggaagtaacaccattcgaggaatgggaaaggaagaaattaaatctctcatacctacgaacatggggctgtttggccaaggtaaatgtacctatagtcaaaaagcggaaacttggaccaaaaactgttgattgtgtgtttcttggttatgctatccacagtgtgggttatagattcttaatagtaaactttggagtacccgacatgcatgctgctacaatttttgagtccagagatgctacattctttgagaatgaatttcttatgaaatatacacctagcacttctagtaaagaaactgtcatgctccatgagcactttgcaccgatagaacacaatgatgaaacgcctgaggaaaatcctgaggaggacaacattgtagatactcgcaagagtaagagacaaagggttgcaaaatcctttggagatgactacattgtatacctcgtggatgacaccccaagaaccatagaagaggcatattcatctcctgacgctgactactggaaggaagcagtacgcagtgaaattgactcgattatatctaatggtacttgggaagtcgttgagcgtccatatgggtgcaagcctgtaggatgcaaatgggttttcaagaaaaagcttaggcctgatggtacaatcgaaaagtacaaggcaaggcttgtggccaagggttatacccaaaaggaaggcgaggatttcttcgacacatatt

SEQ ID NO: 29499 - DNA, 1087 bp, Oryza sativa
tggctagcgcaacgaggcctgacatctcatttgctgtaagcaagctgagctggtttgtctcaaatccgggagatgatcattggcaggctctggaaagagtaatgcgctatctaaagggcactatgagctatggaattcactataccgggtatccaaaagtactagaagggtatagtgactcaaactggatatctgatgctgatgagataaaagccacaagtggatatgtgttcacacttggaggtggcgctgtttcctggaagtcttgcaagcagaccatcttaacgaggtcaacaatggaagcagaacttacagcactagatactgcgacagttgaggccgagtggcttcgtgaactcctgatggatttgccggtggttgaaaaaccagtgccagctatcctaatgaactgcgataatcaaacagtgattattaaagtgaacagttcaaaggacaacatgaagtcatctagacacatcaagagaagactgaaatctgtcagaaagcagaaaaactccggagtgatagcattggactatgtccaaacggctagaaatctggcagaccagtttaccaaggggctaccacgtaatgtgatagacagtgcatcgagggaaatgggcttgatacccacctaaggttgcataatagtggaaacctgtccattgtgatcggagatcccgtgaatttggatggtgaaacaaactattgtgtgactgagagaagagacccttgaaaagggctcatttccatgatgtgcttctcttctttcctgcatggtaggatggcttatgtcttaatgtgatccgagtggcttttccaagcagagatgttgacctgcagaacatctcagaaggaacacacctatatgagtttgactgctagtcacagtctatgaggtttgggcaatctctagatactcatgaaaggcctggagtttgacttatatgctccaaacagaggggatgcgaacggcagcccagtaccattcaaggttctgagtgaaacctgatcacacaaaacttacaattcaaggcatagtccattgttcagttgtggtctgatgtacctcatttcctacgtggaa

SEQ ID NO: 29500 - DNA, 9556 bp, Oryza sativa
gacggcgacggcgatgacacgcggcgacgggcggcgacgtgacggcggcgcggggctcgaggcgatggaacggcagcgcggggctcggggcggccacgcgcggggcagagtgggaggggggttagggctagtgacctcaatcgaacacctttggggcaatgaacagtgacttttcctatttttccaacttggttgtttttcctattcaaatcttgtcccaatatttctaatttttgctcaaatcaagtttacacaatatttgtgttgctctaacctagattatcactacccatattttatttttatttttatttttaatttattcgaatttaattagggttaattcttattccatcgcacctaaatttaattgttaccaatatggccgcgataatattttatttatttccaacctcacctaatctatattttaattagttattttgccaatttaattttagtgtttattcctaattaattattccttattcgcgatcggtaaactttgaaaccaaattccaataaaataggcaaataaaatcagcatgatgcaatttattaaaaagtttttgaaggcccatatttttagagttttgattttcgttggttgaattttcaggatgttacaaacctaccccccttaaataaatctcgttccgagatttcttaccggtcttcgaacagatgcgggtattctgtcttcaagaattcttcactttcccaagtggctttatcctcagtgtgattactcaattgtaccttgtacatatgccacactttggccctagtcctcttttctacttcatccagtatccgaactggatgctctgggtacgtgagatcattgctaatatgaatttcctccaacggagcttgctcctccggcactcgcaagcacttctttaattgggacacatggaagactggatgcacatcggcgatgttttctggtagctgtagctgatatgcaacttctcctcgtctagccgtgatttgaaagggtcccacatatcttggcgctagttttcctttgaccttaaaccttttcgttcccctcatcggagaaacctttagataaacataatctccttctttaaattccaggtttcttcttcaggtgtcggcgtaactcttctgtcgtgattgagccacttttagacggtctcgaatcaggcgaaccttctcttcggcctctttgataatgtcgggtccaaataccgcacgttcacctgtctcggaccacattagtggagttcgacatcgttgaccaaacaatgcctcattgggtgacatctttaggcttgcttgaaagctgttgttgtaggagaattcggcgtagggcaaacatctctcccattctttgctaaaatccaatgcacaagctctcagcatgtcttccaggacctggtttgtcctttccgtttggccatccatctgcggatgataagctgtgctaaaagcaagataacttcctagggcttcatgtactttttcccagaaatgcgaggtaaactgtgtgcctcgatcagatataatccttttaggcacaccatgaagacacactatcctggtcatgtacaactcggcgagtttagcactattatagtttgtcttgacgggaatgaatcttgccgtcttggtgagtcgatccacaatcacccagatggaatcataccctgttgtggtcttgggcaacccaactatgaaatccatacctatctcatcccatttccattcgggaatcctaaggggttgcaacaaacctgccggcctctggtgctcagccttcaccatctggcatacgtcgcagagcgctacgtattcggtcacatctctcttcatgttgggccaccagtaaccctccttcagatcctggtacattttggtacttccggggtgtaatgaatatgccgattcgtgagcctcctttaggattaatcctctcagtccaccctgttcgggtacatagatcctctttttgtaccatagaacacctttttcatcggttgaaaattcctttgcacatcctgcagctaggcgtcccttcacctctcggatttcctcgttgtccttctgggcttcttctatttgggttctcaaaagaggttgaacgtccagggtgtttatctatccatgaggtactatatgtaggtttagttgagccatctcctccttaagctcaggaaccatcccttccgtcctcagatgatggcaatggctcttccgactcaaagcatcggccacaacgtttgccttgccggggtgatagtgaacctctagatcgtagtccttgattaattccagccatcgccttagcctcaagttgagatctgactgggtgaaaatatacttcagactcttgtggtcagtgtagatatcgcaatggtttccaatcagatagtgtctccaaatctttagcgcatgaaccacagctgcgagttctaggtcatgggtggggtagttttcctcgtgtggtcgcaattgtcgtgacgcataggccacaacctttctgtcctgcatcagtactcctcctagtccttgccttgatgcatcacaatatataacaaagtctttcctgatgtcgggaagaactagaataggcgccgaggtcagcttttctttgagctgctcaaagctttcctgacactgttctgaccacacaaacttcttttccttcttgagtagttgtgtcatcggtcgggctatcttaaagaacccctcaatgaaccttcggtagtatccggccaagcctagaaaactccgaatttcagtcacagacttgggtgctttccatttcgtaacagcctccactttagcaggatccactgctactccaccggctgaatcacgtggcctagaaaagcaacttcttcaaccagaactcacatttgctaaattttgcatataacttatgctttcgaagtttctcgagtaccaatcgcaagtgctccacatgctcttcctcatccttggagtagattaaaatatcatcgatgaatactaccacaaatttgtccaagtaatccatgaacactttgttcataagattcataaagtatgccggggcgttggttaatccaaatgacattactgtgaactcatacaatccatagcgcgttgagaacgtggtcttgggtatatccccggtcctaattttcagttggtgatatcctgatcggaggtcgatcttagagaacaccttacctcctttaagttgatcgaagagatcatcaatccgtggtagtggatacttattcttgatagttacttcgttcagtgaacggtagtctacacacatcctaatgcaaccatctttcttcttaacgaatagcactggggctccccaaggtgacgaactggggcgtacaaatcctttttcttgcaactctctgatttgcttcttaagttcctccaactcattgactggcatccgatatggtctcttggatatgggagcagttccgggtatcaggtcaataataaactctatgtcacgatctggtggcatcccaggtaaatcctctggaaacacatcaggaaatcgttgcactacaggcattcctttcatgggtagcatggtgaatatgcctccggcatgttcggccagtctaggatcttgatccatagttgttctcatatccgatccccaggggtggtcaaggtaacttttctacgcctacagtcgattacccctctgttctttgttaaccaatccatacccaatatgacatccagggtctgaggtatcaaaaccataaggttggagggaaacacaacatccctaaggcgaatatgtacgtctatgcaagcatgactcacagttatctcgccctcaggtgagtgtaatatcataggctttctaagtcccactagggttaagttgtgcttttgactagccttcagagatatgaatgaatgcgatgcaccagaatcgaagagaactttaaccggggtagaattgatagaaaacatacccattagtatgccctgatcttcctgggcctcttcagctcggacatggttcacttgtccgcgcccaaatctggtagcggtcctgttagtttgcggagtcttgaatagacctcgtccggcaatagggatagtagtcccacgaacagtcattgcattagcgctagtacggacaggagttttgcgtggatgagggcagttgttggcgtagtgcccatactcctcgcaattgaagcagtccacattcttcttggctccaggggcagccagagttggtgtaggggtgcggttctgaattgcaaccggcctgttgaaattgctaggtgcggcggggcggttggtcgccacaatagggggtttccacccagacgaagtggctcccttgagtcgctgaggcactccctgaggtgggcgattcatagcaagcctcctcttgcggttgtgctctacagtcctttggtcattctccagcctaacgactttgttgatcaggctctggaagctctcatggtcttgcccaatcataggtccacgcaattcatcattcagcccttctatgaacttgtcgatcttttcctcttcatttgcaaggtctccaattgcatagcgggccagctgagtgaaccggttcagatattcctgcaccgttgtgttcccttgtcgcagccttctgaactcgttcttcttcatacgcattaccgcagcaggcacgaagttctcgcgaaatgctgcagtgaactcttcccaagtgggttctccagcatcctcttcccgagcttccttgtaagtatcccaccaatcaccagcgggtccctccagttggtttactgcgaagatcactttgtcggcttcgcgcacccggataagggtcagtttcttctctatgatacgtagccaatcttctgcctccataggctcgtctgtcgtagtgaacgtgggtggcttggtgctcataaactctccaaagcttgatccttcgtggttgccttgattgtttgcaatggcttgcagaagttgggtttgagtggccataactccggccagggtggttaggtcaggtgtctgggtttcatcattgctggttgacgcccgacgtcggcttgccatctgtgtaggtcgattgagtaagtatcctaatctcctaactggctcttatggttttatctctttaagggaattgtcttgatgtgaactttgttttgcaagcatggtggaataaactcatttacaacacaacagcaataatatcataaataacatcacagagttccacaaatagtacataaatcgtgatgcaatcgactgcacacatacgcagtccaaataaggttcatccaaaagatacattgaactaatcatcaaactactcgtcgatctaggtaagggggggtgtctcgcatgctatccaaaaaccatatgaagcgagatcgaagctgcaaatagtcctccagtctagtcatccaaccatccgcaggatcctggggcaggtagagggtggttgctggcacgggcaaacctgagtccccacggcttggaggtagtggcctctggatctggcttgggcttcttgcccggggatcgggtgctcttgcgggcaatgctgagggtgtgagggcctccgatgaaggtgatgcggggaacaggggtctcatcctctgaaggatcagtgatgtctggctcgatctctggctcggtgtcggtcccctctgtctcggagtcgacctggatcggagtctccatactggaacccagctgtggtgacggggtagggaccagtggggtgtgcacaatctctggtgcaggtggctgtgtcactgtcgtgtccactaggtagggtgctgacttagtagctagcatgccaatctctcccagaagagtgtggaatgcgggtggatatggcggggtgaggaagaagtagcggtcacgccctactgctgtggaagtagaagctcctggggtgctgaccgtggctgctcgaagctgctcctccagctggctgacgtgctcctgactctctctcagctgctcctcaagtgtattcatcatcccgcggcgattgttgtactgatgagataactgctggaactggtcgccgtggacctggagctgtgccttcagtgagtctatctcactgccccaagcctggtgcacctcccctagctgaagctgttgcactgtgaggtcagtcacctcggtctccaactctcccacaggcctctgctagtcgtcgatctctaacagagcctcctcgtagaagtcgtctactgcctcagcccatcgtgacagtcgagtcactatcgggttgtagcagcaaggtgtgtcctgaactgtgcagacggagttactctcctctcgaaacgggtggtgagcaaactcagtactcgccaactcagctcggtggatagagctaagtcggagaaaggcctcccgggctgcatcctacatcgcggtctctggtaagtcacgacggtggcatgtcggaaagctatagtctgactctgaaggaactcgtgtgtgaacctcgactcgggcctcccaaacggatccacactgtctcactcggtagatcggaaatctggggtaccgtagacgcctcatcaaccgatgcagctcaatgacgtatccctctgagcggggtacgcccatcatccaggtagcgggtgaatcctgatctgccatctaagtttaagaaaaacccaaagtcagctgagagtaaaacttgttttgtgaagaaaatagttaagagtaagatgaaaatcgtatagagttttgtgaacatagcatttttatttttgaaagtattactaaatgggaatttctcccttggccaacttagaaaagggggtggggcgccttttggtcttttcctacagtcgtatggctctgataccagctctgtagacccccgtttttataacaggaatcaatcgtgtaaacagtaccatttccttggatcaagtagtctggtacacacgagttcatagccgagataccaaacgcacatacacgagagtctagtgcaaattattacaacataagcccgcaggcgtagtcttaaatcatcggaccgagcggtccggaatacatcccaaaagcagaaatagataaggcagcggaattaaggcagcggcatgccattgccataggcaatgaccgtaactaagacctattgagcgtcatcgtcttcatcaccctcctggtaataggcatagggatcctccgaagcttcatctccggcctctgattaagtttatatttgcaagggtgagtaccaaccgtactcagcaagccaccacatcaacaatgcacatgataggggtatttcaaaggatggctatggttcttttgcgcaaagcaagttttctaattcttttcacaagcctaagacctagcattgactgatcaaattttagtaccagtgtttatatttaaacaacgatggttctgtccaccatccattgtgatcccaaggatagcttcccgccattgagtcgtcatggttttctgaggacgtccaccttcccccttctcaggaagtggctccaacagcataaaattcatcatgcaataacccttcccacacaagttaagaatttagagtctagccaagtgtaatacatgtcccggtgctcaataaccgcgagcacggctattcgaatagattcgttttactcacactgcagtggatgtacactttacccacactccgcgactgcccaacacatgagcctcgtcccaacacatgagacgtatcacggcaaagcttttcgataacctcacattgacagtacccgctccatgaacttttcatcctcatgcactctaggcgtacacagtttctagtagtgagaggagttctggcgtatccgggaagggaagactcacacacatgcattaagttataattatgtttaaattaacacatggtagtcctaccaatggcaacaccactgtagagcccttgccttacgcatcaagaaaccactatgcatggatactgccttcgctcagctatttactccgctaggtctatccccatgcgagaagtgtgattgtatggggtcgtttcatgcttaacttcatggctcggtctttaattgaccggggacggtactagcctttcccagataccacccaatcttaccgtcggtgccagtctaaaacaagtgtttaatttcatttctattttcacaattcatgtcatcatatcatggcaatgtggcgctcatgtttccacatgccgcatctcaattaccttcccaaaggtaattgcccaagcatatagtatttgataagatatgagcatgcatgaatctaaaatagcatttctaagcaagtgtcatagttgactagggactcgtacgtatctctggttacaaagatttaaaggtgaacaataatcaaggcatggcatattttacaagtgggatgttcatcattgcatgcaatcttatttgtaaacaaaataaattttgcaatcgcgatcaatatgctcaaagaatagtgatgacttgccttgctcaatgtcttgcgggtcttgaccttcgctcggattcgcaactccctcgggctctacaagtacgtgcgaagaattgatttgaattccattagaattcaaataaaatccaataaagaccaaattgaaaaacgagcgcgagtggcgaattctatatcaactatattattcgcgaagtaggactattcctcaacctaagatattttgtgtctcctaagtaaattcctaagaattcaacatatttatttagcgcttaaataaatctaatttcttaccgcaaattaattactcatagagattaccaaaatataatttaattttgcaattttacgactataattaatctatacttaaatcattaattattttaaattttctatttttattaacctccctatcctatttctcttttttttctttctttttctctcctctcattctttttctttctttttctctcctctctttttccttccctttttattttctttcttcctcctctcccttccggcttctccctttctctctctctcggctttttgcccaccagggcggcggcggcaatggacgcgagggggggggggggggaagatggctcaccggcggcggcggcgcaaggcggcaacgctcggcaccacacctggcgcggcgcggcggcttcgaggcgacggcgcggcgcacgaaggcggcggcgcggcggcacgacggcggcggcgcgtggagaaggaggagaggggggggaaatggtgaggatgggtgtggggtggagaaggggaggggccgagttctataagggcgcgggggaggggtgggcggcctcatggcgacgcgacaggcggtgcgcggtgtggctggcggcgatggcgacgggcgggcggcgcggcgcggggctcggcgcgacggcgacggcgatgcaacgatgacgggcgagcggcgcggcagggtgcggggcgcgaggcggctactcgacgggcgagcggcgcgcggggcgcgtggcgcgaggcggcgactcgacgggcgagcggcgataggacggccgacggctacggcgcggcagcggcggcacggggc

SEQ ID NO: 29501 - DNA, 10223 bp, Oryza sativa
gccatcctttggtatccttgtgcacttgcatatttgctgtgtggcttgttgagtatgtcatatgctcattcttgtaacaatcaatcaacctcagttgaagacaagttgcgaaggagaagacgtttggcttataccccagttgagctgcctgtgggagtggagccggagcttcgctagattttattttccgctgcagttttcttcttggtgaggactaagtgcctcttaagtaagtacttatcgttttagttaatttgatgaatctgtatattaaattgtcagtttgtgtacctcggctgattcctggacgaggattttatgcacaaataagtttggaaattacttgtgaatttccgagcgtgacaaccgagcagtccggaatacatcccacagcagaaatagataaagcagcggcatgccattgccacaggcaacgaccgtaactaagacctattgagcgccatcgtctgcatcaccctcctggtaataggcatagggatcctccgaagcttcatctccggcctctgattaagtttatatttgcaagggtgagtaccaaccgtactcagcaagccaccacatcaacaatgcacatgataggggtatttcaaaggatggctatggttcttttgcgcaaagcaagttttctaattcttttcacaagcctaagacctagcattgactgatcaaattttagtactagtgtttatatttaaacaacgatggttctgtccatcatccattgtgatcccaaggatagcttcccgccattgagtcgtcatagttttctgagaacgtccaccttcccccttctcaggaagtggctccaacagcataaaattcatcatgcaataacccttcccacacaagttaagaatttagagtctagccaagtataatacatgtcccggtgctcaataaccgcgagcacggctaatcgaatagatttgttttactcacactgcagtggatgtacactttacccacactccgcgactgcccaacacatgagcctcgtcccaacacatgagacgtatcacggcaaagcttttcgataacctcgcattggcagtacccgctccatgaacttttcatcctcatgcactctaggtgtacacagtttctagcagtgagaggagttctggcgcaccgggaagggaagactcacacacatgcattaagttataattatgtttaaattatcacatggcagtcctaccaatggtgacaccactgtagagcccctgccttacacatcaagaaaccactatgcatggatactgcctccgctcagctatttactctgctaggtctatccccatacgagaagtgtggttgtacggggtcgtttcatgcttaactttatggctcggtcctcaattgaccggggacggtactagcctttcccagataccacccaatcttaccgtcggccccagtctaaaacaagtgtttaatttcatttctattttcacaattcatgtcatcatatcatggcaatgtggcgctcatgtttccacatgccgcatctcaattaccttcccaaaggtaattgcccaagcatatagtatttgataaaatatgagcatgcatgaatctaaaatagcatttctaagcaattgtcatagttgactaggggctcgtacgtatctatggttacaaagatttaaaggtgaacaataatcaaggcatggcatatttcacaagtgggatgttcatcattgcatgcaatcttatttgtaaacaaaataaattttgcaatcgggatcgacatgctcaaagaatagtgatgacttgccttgctcaaagtcttgcgggtcttgaccttcgctcggatccgcaactccctcgggctctacaagtacgtgcgaagaattgatttgaattccattagaattcaaataaaatccaataaagaccaaattgaaaaacgagcgcgagaggcgaattctatatcaactatattattcgtgaaataggactattcctcaacctatgatattttgtgtctcctaagtaaattcctaagaattcaacgtatttatttagcgcttaaataaatctaatttcttacctaaaattaattactcatagagattaccaaaatataatttaattttgcaattttacgactataattaatctatacttaaataattaattattttaaattttctatttttattaacctccctatcctatttctcttttttatttctttctttttctctcctctctttctttttctttctttttctctcctctctttttccttccccttttcttttctttcttcctcctctccctaccggcttctccctttctctctctctcggctttttgcccacccgggcggcggcggcattggacgcgaggggggggggggaaagacggctcaccggcggcggcggcgcaaggcggcaacgctcggcaccacacctggcgcggcgcggtggcttcgaggcgacggcgcggcgcatgaaggcggcggcgcggcggcacgacggcggcggcgcatggagaaggaggagaagggggaaaatggagaggatgggtgtggggtggagaaggggaggggccgggttttataagggcgtgggggaggggcgggcggcctcatggcgacgcgacaggcggcgcgcggtgcggctggcggcgatggcgacgggcgggcggcgcggcgcggggctcggcgcgacggcgacggcgatgcgacgacgacgcggcgcggcatcagcgcggggcgcgaggcggcgacgcgacgggcgagcggcgacggggcgtggggcgcgaggcggcgacgcgacgggcgagcggcgacgggacggccgacggcgacggcgcgacatcggcggcacggggcgcgagatgacgcgacggcgacggcgacgggcggcgatgatgacggcacgcggcgacgcgacggcggcgcggggctcgaggcgatggaacggcggcatggcggcgcggggctcggggcggccacgcgcggggcagagggggggggttagggctagtgacctcaagcgaacacctatggggcaatgaacagtgacttttcctatttttccaatttggttgtttttcctattcaaatcttgtcctaatatttctaatttttgcacaaatcaagtttacacaatatttgtgttgctctaacttagattatcactacccatattttatttttatttttatatttaatttattcgaatttaattagggttaattcttattccatcgcacctaaattcaattgttaccaatatggtcgcgataatattttatttatttccaaactcacctaatctttattttaattagttattttgccaatttaattttagtgtttattcctaattaattattccttattcgcgatcggtaaactttgaaaccaaattccaataaaataggcaaataaaatcggcatgatgcaatttattaaaaagtttttgaaggcccatatttctagtgttacaatcgggtggtgtgaacttattcctttgttatggtctgtttgcattgattactctattccttgataccttgggttattataatttgactagttgagctttatatatttgttcagctagatgttagacataattacttagccatgcttagaaacattagcacacaattgggataactaatgtttcactattacttaatgatggatatttaatgatagctcacgatgatcaatcgtgattggttaattaattaatgtgccaactaaaacttgataatggtgtgttgtgagcacatggttttgatggtcgtgctcatgacaattaaggaccggttcacgagtttcggttgtgaaacattaaccgtgccaaccacaagccagaatgggcaacagctggacactttgtataacaaggctcattgcggagcaccagactgagaagtggcggagataagcccacgggggtcgctggggagtccatgcctctggtttttgagggggtgactacaatccaggaacggtgcactgctttgggttaagttatgcgaggggtcttgtcacaactacacaaatggtgacatgttcagcatgggcacatgatgatatggtgacatattgtggagatgtgtcttgtgggtacagtagtacacctctggccagagtaaaactattcgaatagccgtgcccgcggttatgggcgggtcgaacaatgtctttcgtgattagtcccacactactcattaataataatgtggtaattgatggtaattaatttagctcctagtttggaatggtacattcctggtttggagatagatctgtgcagccgggtatggttgttcaggatggttgggcctgtgcagcatgggtgtgctgttcagtgttgattaatattgatgattaattactctattgttttacaattctcaaatgtttgctaaatgctgcttttgcaaatgagccctgtattatgccattctttggtatccttgtgcacttgcatatttgctgtgtggcttgctgagtatgtcatatgctcaccttgcaataatcaatcaaacctcagttgaagacaagttgcgaaggagaagacgtttggcttatacccagttgagctacctatgggagtggagctggagcttcgctagattttattttccgctgcagttttcttcatggtgaggactaagtgcctcttaagtaagtatttatcgttttagttaatttgatgaatctgtatattaaattgtcagtttgtgtaccttagctgatttctggacgaggattttatgcacaaatgtcacatcctgatttttgtttcaggatttataaattatttaataaattattattagaatttatattaaatgttcattaatttacaagtgaagttaaatgtgggaaataaaatttcctaaatataaagcatggatggatttaattttgattaaattctccatgattaattacactctctgaaattttctcagatgtttcggagctcaattcttaacttttaatcatacaaagagcatttcagtaattacccacatattaaattaatcattaaatggtctgtttttaatattgttaaatactttgggtctccaagtatgttcaagatttttcttggaattatttgagcataggaattatttttaacaattcaaagatcatttcattgattaatttaattggaaaagtaataataatcctcttcctagtcttgggccctttccagcccatctccctcttttgtctgcacggccgtgcagcccaagtcggcccagccgagcttcccccttctctttctttctttgctttgttttcagccagcccaagacgaaaagtctaatttgcctccctccacactgtttatcttctacctctagcagccgaactgagaccgatttggctcggtttttctcctccaaatctgacctttccccttgtgtttttctaaaattagttgaggggaaatattcctcttatcctcctctatctttatccccaaaaatcggagctaatcgttgagtatcttatccgaatcgaactcgttttcgagtttatctccaaaaccgagtttttgatttcccggatcgatttcttgcgggaggagtccgatctcttcaatccaaggctataaataggaccccctagtcctcctctttcgtttgccccctctcccgtggtctcccgtgcctcgtagcgccgccgccacgtgctccaccccgccgtagtcgccggccgagctccatccgcgtcgcgccgccgcctccgccgtcgccgccggtctccgtcaccaccgttaggtgcgcgggagggtggagaagcccggccgctatctccccgaagccgccgaccaccgcagccccgtcgccgccgtcgaccgaagccgcgccgccgctagacctcgtcgccggccgtcgtcgttcgtcgtttggttcgagggtgggtaccgttgggttcgtctcgtcgtcctctacgtgttcttgtcctccaaagtcgcagccgaccatccaatctccggcgaggtcgccatcttggttcggccattgatgaggtgacgtcatcatcgtttttttctttttcctgtttttctaatagattaaatcttcggaaattcataactaaatcatcgtaactcggttttgagtggttcaagttgctaaattcatctaaaatcaggatctacatgtttgtttactttatatgtactgtttatttggtttttattagtcttattcttcgttttgcgtgttagtttgtcgtttccgtcgttgcgaaggttcgtgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaacctattcctttgttatggccaatttgcattgattactttattccttgataccttgggttattataacttgactagttgagctttatatattggttcagctagatattagatatgattgcttagccatgcttagaaacattagcacactattgggataacttatgactcattgtttaatgatggtttaatcgtagctcacgatggttaatcgtgttatgataattaattgataactaaaacttgacaatggtgggttgtgagcacatggttttgaaggtcgtgctcatgacaattaaggaccggttcacgagctactgttatgaaacattaaccgtaccaaccacaagccagcatgggcaacggctttaccttctgtatagcatgattcattgcggggcaccagactgagaagcggcgagaagtccgtgggggtcgctggggagtccatgcctctagttatatttatagagggggtgattatgatccaggaatggtgcactgtggtgagttgtgttgtgcaaagggtattgtcacagcctctattcgggtactttccagtatcgcgacgcatggtagacatgatgaggaggctgtgtcttgtgggtacagtggtacacctctggctagagtaaaactattcgaatagccgtgcccgcggttatgggcgggttgagcaatgtttttcgtgattagtctcacacctctcacaataattatggatgttatatctggtaataatttgcttagctcctggtttggagttagatctgtacagccgggtatggttgttcaggatggttgggcctgtgcagcatgggtgtgctgttcagtgttgattaaaatttctgattaattactccactgttttactcctcttaaatgttttgctaaatgctgcttttgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagccggagcttcgctagaccgtaattccgttgcagttttcttttcttttgaaagtatgtaacactattattgatgattctgtatattaaattgtcagtttgtgtacctcggctgattcctggacgaggattttatgcacaaataagttcggaaattactagtgaatttctgagcgtgacaacaaactagttcggaaattactagtaaatttctgggcgtgacactaactttgccctttcaaattatctctaatcttttgcagtggaggaggctcttcaaacctaacgatgagatcaagctagaagctatgacagaagaaataaaggtgatgacaggcctacggcatccgagattaggtgtgggttagttggttagcgttagctgttggtgtgttggctttagaggttgttgtcaagtgtttgttcagcttttggtctgctcctaagctccttgctgtggttaagcttactagtcttgttttgctcttgtatggttcgctggcatccccagctgttaaaagacaccgccgatgtggctttcaagtaaaagccaggtctctgaccttttctctaaaaattagcgagacgtagagccgccatgccgaagaagttgcgcacgatggttgtgccggtgtcggagccgatggaatccgcgctgatgagctccaacatcatggagccgaagccgatttccgttgggagttcgtcgtgacagaggcaagcatggataacagcatggagctgaagcccattcccactgcgtgctagccgttggtgaagagagaggggagagaaggcagaggaaggtgatatggcacttacatgtgggccggccccatatgttctttttaacttttttttccgatgactaagatgccacgtcatccaaaacaaatatccatactgccaagggacctcacttgaacggttttgtaaagttttattttttttttggggggaggtgaagatttatggtattgcagttttgggatgttaattaaactcgacataaagatgagggacggcaagtggacttattcattttcaaaaatagacaagcttctgggcttcgccgcaatataaattattttctgggctctcaagtttgaacattgagcgtccgatccaccccttcattatcattgcatttagggatggcaggcacgacgggcacgggtagtgactacccatgctcgtgcccgcgggcatgcccgttactacatgacgtggaaggaacattgtctatgcccatcgcccgcgggcgccatgtgctcgcgggcatatccgtttacccatcacaggcttacagttcaatccttcaaccacaaatctctacaagcagagagatattatcacagtttaaagatagggtacagttgtaccaagttctacaatacaagcattacaagtttatcaatcctagacggtggcatttatactaatttgactgagagcccacatgtcagttggtttttgcgggtaaacgggcgaagcgggcatgggtcactacccatgctcgtgcccgtatgtcacaccctgaagttctcctcccaggcctaaaatttaatttataaacgaccccccaagaaaatgcaggtgcaaatcaagagaaaaccctaagaaagtaatgcaaataataatcggatttgacatgtggaatttttcttgagttctacatgtcgaaattcattaacaggatttttagtggaattttcagagctctagaaataattttaaccaattaaaattgagcaagcaatattttaattccagggaaaatcctttttccttcttctttttctttttcctccctttttttttcctccttttttcgaatgggccgccggcccattctctccttcctccccctcctccctgctgggccggccgcaggccgaggcccagccaggccggccgcctccctcctctccccggggtcgccgacaggtggggcccacctatcgggcccttccccaacctccggccactcgcccacgtcgcccatccgccgccgaaaccgccgcaccccgcctcctccggccacgtcggccacgcccgtgcgtgcgccgcgcctcccgcacccactccccctctctctctcgccgggccctcaaccgagatggccgggattcaaatttgaatcccgccgctctctctctctctcccccaccttcaacctcccacgtcgccggtgaaatcgggagcgccttggccacatccgtctctcccgagcccctataaagcatgcccgcactcccctccacatattttctttttccaccgctctctcccgtgccctccattgctcccgcgccgtgcgcccatccgccgccgctctcccgctactccggccgcctctagccgccgctacacttgccgccgcaccgcgccgtcggcgccgttgggttcgcgcggccgaggtccaccccgttcacccctcctccgtcgaggttcgtcgccggagccctcaccccctcgcactctggtgagcaccatctctaccgccgccttcggccatggtttccgcccgccgtggaccacccctctccctctaatctctctcttttcctttcttagggcatctcggagctcgtccgcccgccgacgtcgtccttcccgtggctcatcgtcgacggtcgccgccgtcccattcagtgaggactcccacccctttcctttaattcccccgatcccccgtgcgtcgcc

SEQ ID NO: 29502 - DNA, 1675 bp, Oryza sativa
ctttgtacaacacaactcaccacagtgcaccattcctggatcataatcccccccttataaaacaaggcatggactccccagcgacccccgtgggcttatctccgccacttctcagtttggtgctccgcaatgaatcatgctatacaaaaggtaaagccgttgcccacgctggcttgtggttggcacgattaatgtttcacaatagtagctcgcgaaccggtccttaattgtcatgagcacgactctcaaaaccatgtgctcacaacccaccattatcaagttttagttggcaagtaattaattaaccaatcacgattgaccatcgtgaactatcattaagccatcattaaataatgagtcataagttatcccaatagtgtgctaatgtttctaagcatggctaagcaattatatctaatatctagttgaaccaatatatataaagctcaactagtccaattataatcacccaaggtatcaaggaataaagtaatcaatgaaaacaggccataacaaaggaataggttcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcacgaaccttcgcaacaacggaaacgacaagctatcacgcaaaacgaggaaaaagactaataaaaaccaattaaacaatacataaaaaataaacaaacatgtagatcataattttagatgaattatgagacttgaacggcctcattctgacttcaaatgaatttattacgaattttacaagattaaatctatttaaagcccatttaaaaagaattaaataaatttaattcaatttatggacaattttaatatgtagatctttattttatataatttttgcaacttgaaccacattaaactgagttcaaatgaattagttatgaatttttaaagattaaatcggattaaaacacttatatggattttaattgaattatgacgcaataatgaattatttttgaaaaggaaaaggaggattattgcgtcagcggctagggtttgcggtggaccgggtgcacgacgacagttcacgggaacggacggccaagatcaaccctatccaaaacggacggccgagatcgatcgggtccacggcggctcacgggagacggcgacgatgacgtcagcgatgacgtcaccaccggcggcggcggctcgagcggctcggcagctcggacggcgcacgctcgccggcgaacgacggcacggcgaactcaccggtgaccaaaggagcggcggaagaccaacggacggcgacggcgatgtggtcaaagcggcggagaagatcgggtcgacggcggcgacggtgctccagcggtgtccggcggcggcgaaggggcggacgaggacggcgacgacttggcgatcccgacggcgaccacgatgacgaccttcccgagcgacggcgacagctgaaacggcagcggcacacggctggagtggcggcgacgacggcggcgcaaaagctcacgaggctagggcgctacacacgacggcgggcgaaggcaagagaggcggcgggtagaggagacaccgggggtccttttaaa

SEQ ID NO: 29503 - DNA, 998 bp, Oryza sativa
tgttcaaacaaaggaaaaaaaaatgattatcttgttctagaatattagagggttaggtagtgtagctagaggtggacaactgaaagagctgatcaaagaaaagagggtgtacattatctgtttacaagaaactaagaaagaggtgttcttagatagagagttgaattccttccaaggagggaggtcttttgtgtggtgctgaaagcatccagggggacttctggtggcattcttgtaggtgtgaattctgagatgtttgaggttatctctactcatgccggagcttatttcctatgttgtgttttgaaaaataagaaagatgactatctctaggaaatcataggtgtgtgtggtcctgtggacaatcacttgaagggtgggtttttagatgagttgaaatggcatattcagggtaatgattacccctttatattaggtggagactttaagttgtatagatttgcttgggaaaaatccaatgctaatgttgactctaggaatatgttgttgtttaactcttttattgctgatttagatttgagagagacttttaggaatggacctaagtatacttggactaataagcaagagtgccctgctcaggaagtcctagatagagttctaatgaatgatagttgggatattaagttcccctctgctctgctctcttccctccctagagtaggttctgaccatactcctcttcttcttgacactgatgaggaaagggaaagaagctgtagttactttaagttcgagtcagcctggcttgctgaaaatgggtttaaggagatggtttgtcataagatgttagaaagagatagttcctatattttagagttctggactagaaagcaatcagagatgagaaaatttttgacaggttgggtgtcgcgaccgagaaaattgcattttcccgaacgctagtgtattaatccccgtcccaggaaaagccggggtacaccatacaaacatgatataaaagacacatctttatt

SEQ ID NO: 29504 - DNA, 13288 bp, Oryza sativa
ggaacgaagctagggttcacgggagagagagagagaggagaccgggcgggaggaaggagacgaccggcctggcgcgtgggccccacgcggtcgggcgcgcggtcagcgcacgcgcgggtgcgtgcgcgggaggggagcggctcaggcaggggcgcggcgtgggccgggcggccggcccaggaggagaggaggggaggggtggcccggggagagagggaggaggagggagtgggccggggaaggagggagggaaggagagggagagaaaaagagggaggagagagggacttcgggctgggcttggcccaaaggaggaagaggatttatttttaggtttttctttttaataaactttgataattgtttttgttgcttaataattatttccggtgttctgaaaattcaagtaaaatttgagggctcattttagaccaaggagaatttaacaaaaattctccgggccacatttgaatttttcttgtacgtattttagtgtttgccaatttcttttcgaattttaattaattctattattccttttggaaaatgatttttatttcgggatgaatttatcaggacgtgacaaatccaccccccttacaagaatctcatccccgagattcgaggaggctagcatgaagataggttgggcggtattctcttcttgtctgacttcttccgtcgcgtcttttataacaaacttgcctagcaaaacttctccactctaggctgcttggctcgatcccttgttgtagatggaatcttctcttcacctgacttgtccctggttgaacctttagctgacttcgactgggttgcggcacttgaagatggggcttcagttccagaacttcgcatagttcatatctttggagtcaacctcatacaagttacccacttcatgtcatgcgtcgagatcagctcgtcattactaggataccatgcttgtcatcatgagaataccatgcttgtcatttacttctaacttgccaccaactgcctcatattagctttcctgctctccgggtgctagctacttctgctattcgatgcaagggtcggtaactttgcctttgaattatgtttctaaaaagaaccaacttatcccacttgacatgctttgacgtctccccaaatgactttactactggacctgttatggtatgatcgttatcctaccaaatctgaagcttcgttgttagatgtgattttaatctgacctctgtagactatcttcgaacatatcacttggttcataactgggaatagctcccacgaacaagcaactcggattcactttctttatgtttagtttactttccactattctcttcatgttgtcatcatttagcattcaacgtattcctttacaccttcgaccttgatgagttccttcccattggatcatctcccaagacatggcattgcctggtaaccggtgcctgcacttttcactccgtgtagcatctgataccgagttgaagatttcactccttgccttcatagaaacacttttacctaggtcatcttgcttactcacagatttatttttttttctctcaatgacaaggtgactgttgcagggcgattactgtcaggagtcttccttgtgtgatgcagagcatgtttctgattatcctttatcaatcacctttcggcctacgtctttcctgctagagaacatcttggccaacctcttttatcaatcatctttcggcctatctctaacaggtggtactctttaatgtgggttgcggacacttctggtggcgatggggtcctttggtctgctgcctttcagtgaaaccttgaagtgttttcgccaaaagctatactgactgtcattgcctttgatccgaaaaagacacgtgtgaaactcttagtccaaacaaatgtctctttggttaatcgcttgattttcttttccatcatcaggttggttattaactcgaggttagaacatagttcctctgaaatgagaccctaggtctcctttgacagtaaacaattatacacataatcccatatcagcatcttctgaaagagtcctcatagaacttgtttttattacacatttctcccatattacatgaatacgaggcactaccttaaacaaaaagggaaggtgcttaacatcggtacattgtatcctcaacatgaatcatccataaacatagtaaactcactgtttatagacatgaatatatttatttattacatgattgctgcaaactttcgattacacaatgataagtagcgaattgaaaaccacaaacgtggctgctcattttgattctggagagatatagctggcattgttctagtaactgcatcatccttgattggttctgtgatgatgtgataggactgcatattgctatcattcacgggagaaacttccttctgattgctgtttgaagcagataacggtcttctgcttggtatcgccctcctgaggttgattgcccttcgctcagcctagagtaggtcggggagagaaacaacttcttccatcgacgacaattctttgctgaggccgtaggtgcagagaatggttggtgctgaaggtattattgttatgatttattgcagagtcaggtgcagcaggaggagcattggtgctgtggatgatatcgtcgatgttgctgttggagctgactagctgatgagacaatcgtagggttgttcgttggatttctgcggtcttggtcaacaacacactgagttggcaatccgtgggcacatggtttgtaccttcgcacagaaaacatgtgaccttgtgggtgggacattcacctggcggatggtcttcttcaccatgagggcaaagtgtgagacacctgctagcaatgtgtccaattttctccacaacgggtgcatgcctttgattccatctcttcctcgccgagatgtcggggagactcttcttcatcatccgaggagacttgatctgacccttcactatcagatactctgccaccatggcttaggaggtgctgggtcaactatcgtgcacctcggaaggtatttcctctttgacgtctaggaataggtatccctgctggaggccattcggtgttggtaatagtcatcttacgtacttcttcttcagttcgcatcggcgcttttctcttctgattcttactcttcttgcctttggcttgcttagtacgtgaccccacgtggtacgaaaggctaggaggaaagcatttcccgggattccatggattctctccattgggctctctactttgcacactaggctgcaagcttgacttggtgtgaggaggctggtttagcgatgtctgccctgctaaaccaaaggaaggggcttctttggcatatacccatggacaattcagggcatagtgtccttgttctctacaatcgtgacaaaaggggacatcctcttctggcattggaagctcattgacctgggtggcaaatgctcgatcaaacacatagtgattttggtcttgacttccatccaatggtagctgcgaactaagcagcatgcttggaatggaccaagggtgtgccctggttaactctcttgaggccagtggtggattgagttgaaaacttgagttacttgaggcatacccgctgacattctttcctttttctctgttaaacatctgttacagggattgaggtgagagaggaaacaagccaggaaagaatagaccagaactagagacaggaccttaaaggaactaactcttcttgctgatgtgttgtttgtttcacttattctgcaagttgattaagcaaacaacctagcatggttacatcacaccccactgatgcaaaccaagcgctacacacacaagcaaggaaacacacaactaacgactctaccctagagggtggcttaggttctgcgacgggttctccaagatcttcactccttcacagctggcttcactgcttcctccacttcgctagcggatcctacagtcttctggagcttcggcaaacaactgacgatgtcttcttcttcactgacctgaccatccagtactagttgaaatccgaagaaggaagaagggagtaaacattttgaaaatagcattagggaaaggaggaaaaggaactttcgcaaatagtttcatttataaaatatgtccttaggttttatccacttggcttatcctacagtcgagacggctctgataccatcttgtcgcgaccgagaaaattgcattttcccgaacgctagtgtattaatccccgtcccaggaaaagccggggtacaccatacaaacatgatataaaatacacatctttattatatcgataatatttacattattacaaaggcacttaaggcctgacaatcaaaaataaacagcagcggattagcgggcctatggctccatcttcacaggcgctcaactggggtgtaagccaagactccacctaagacatcttctccaaagcttctcttactgaaggggggagaaagatagagcaagaatgagtacaaccacagtactcagcaagccacaccggcggatgcacgattaatgcaagggggtacaaggggtaatgatataggggttaagttttgcagaaaacggcatttaaaaatcacttagttgcccaaagccattttaaaaagacgatcctagagctacacagtattattaatcaaggtcgtgaacccgcacgaacctgccttaacccaaggcctacgatgattcagaccgaactggcaacccgaccctgggtcccagctcgtcccaagccaacccaggccaaccattccacattttagctgttaagcaaattttaagaattaaaacactaacttgggtgcattgctcggcttgcccataaccgagggtgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacctccgggacaggtaggcaggattgagcccctagcagcaggacaccagccctgtaccatgacatctcgactaccgggccacatctcgtgtagccttcatttgtcctagagatgtccatcgacccccgacttcgtccatctccatccgtgtagttttgtttataaccagactgagccacaaactaagccttacccactagacatgtggaagtacggtagtgctttgcaacagaggcccgagcttaatccttatagtacccgaggtacgactagcaaaacccaaccacgcacctcgagcccagcctaaaaccattttgggggttttgaatagagggggaggtgtgtgtccaattccaacaaaagccaaccattccaaagtatccaagtgatatgaatattcccaaagtctaaagttataaaaccacctaatgttgcctaattaatcagcgaagcatctacctaaattcatactagtggaaccatgaataaagtacccactagttggggttttgtttaatctagggtgaacaaggtaataatatcaataacaataatattaagttcataacaaaggtaaataggcatggccaaataaaacagtgataacgcgggattttaaataaagcgataatgcaataatttaaatcaaaataattttataaactgggattcaatatgttcaaggatgatgtgacttgccttgctccgggagaacggccttccgaaccttcggcgacgaccacgaaccacgcttcgggaacctccggaacgacgaaagctacgcgaagcacacaagcaaagctacaagcctataaagaagcaataacaatacataaaaagaaagcacacggttctttaggttataacaaacattaggagacttgaacgggtcgattcagagttcgtatgaccaagatatgatcatccgaagtttaatgctgttacatggagatttgcggattattgtaattaggttttgcaactataaaacatgtggaagcgctagcctggaaaagacaggaaggctgcgttgttgacatgcggaccccacatgtcaacctaaaggaccacggtagaccgagtacacagagacggtccacgggtcgacggaagcggaccccatgtgtcaaccgaggcgagtggccaacaaacggactccactagacaccacacgggctgcacatgtggaaaccatgctgctactgagcggacacactaacacggacaccacacggtcaccacccgcacacgtgaacgactaccgacacggtacacgggtaccggggtcgacaaccgcacaacgggtacggggcgacaccgaaaggacgagggcggggcagcgagaggagagaccttaccaccacgcgacgaggcgtgagaacgacaacgacgaacgggcgcggcggagacggacggcgagggaacgacttcggcggcgatccttgaacgaaggcgagacacggccggcacgaggcttgacgacgcggaggcgaggacgaagacgacgacggctacagcgaccttgacgaaacaccgaggacggacgagaacggcttgacagagggacgaacgccacgacggccgggaacgacgggaggacgacgacgacgacgaccgggaccggcgaggagacgacgagggcagccggcagcggctgcacggaggcgaggacggcgtggaacacgccgcagcgatgcccacgacggaggcggcgccgcgagacgacgaaccgggcgaggatgaacggtgaagacgacgacggataccggcggtgttcggccgaaggggaagcgatgccgaggacgacgtcgcggctgcgatgccgaagatggtggaggtgtggccgaccggtgcacgggcgaggagggacgggcggccgaacaactccggcgaggcggatggagaggttcgcggcgatgtgcggcggcttccgggcgaaaccgaggggtggacgaggtggagggctacgtcaccgtgccgagggagggacggcagcgccggctgatgcacgggcgcggcggaagggggctgccggaggagacgtcgacgaggaggaaggagaggccggcgcgggcgacggcgttccggcgaaattcgggcgacgccgtggcctggccgggaaagaggacggcactccggtgccgggagaggtggtggcgacgtcggccggcgcacaggggacgcggcagaggcgggcggaggcggaatcgtggcggcaacaccacggttgccggcggggaggcacttccggaggtctccgcggaaaacagagggtaggccggcgaagaggaggcggctgcgatgctggaggaggcgacggcgcgaccggacggcgctccggcgaggagggagaggcggctggaggcggccggaggcacgggagagagaggaggactgcggggagaggtgatacgaccacggggagactcgggatgaggttaaaacgatagaacggaggatggggattccattttatgggatgggggatggagccggccacgggaggagcgggaacggcggcaggaaacacggccggcggcaatagaaggcggccgggaatggcgcggccgttcccggcgattgggggcgccattcaaggggaaattaagggggaaagagagatgagggaaaggggattaattccccccaattaattttggaatccaacgcttaaatcgcgcggattcaagggaggaacgaagctagggttcacgggagagagagagagaggagaccgggcgggaggaaggagacgaccggcctggcgcgtgggccccacgcggtcgggcgcgcggtcagcgcacgcgcggcgtgcgtgcgcgggaggggagcggctcaggcaggggcgcggcgtgggccgggcggccggcccaggaggagaggaggggaggggtggcccggggagagagggaggaggagggagtgggccggggaaggagggagggaaggagagggagagaaaaagagggaggagagagggacttcgggctgggcttggcccaaaggaggaagaggatttatttttaggtttttctttttaataaactttgataattgtttttgttgcttaataattatttccggtgttctgaaaattcaagtaaaatttgagggctcattttagaccaaggagaatttaacaaaaattctccgggccacatttgaatttttcttgtacgtattttagtgtttgccaatttcttttcgaattttaattaattctattattccttttggaaaatgatttttatttcgggatgaatttatcaggacgtgacattggggaatcaatatcctgaatgagaaaagaagggaaaagaaaactcttcagggaaaattggaggagctagataggaaagctttagaagatgacttatcccctgaagaatggaattagagatatgaggtggaaagggatctagaacacacttataagatggaagagttgtactagcataaaagatgtggagaacaatggatcttggagggggataggaacactgagttttttcatagggttgctaatggcaggaaaagaaagtgctcaataatctctttgatggatggagatacagagctgactagtaaagaagatataaaaaaaatcatattgtctcttattacaaaacccttttttagagctgatgttttaactatacccacttggctcgagatatctggagtggcggtctgaacctttctgctgacaacaaagagagtttgattagacccttcaagattgaggagttagataaggcgcttcaggaggcaaaattgaacactgctcctagtccagatggttttagcatccttttttgcagagcttttggcctcaagtgagaaatgatttgtttgagatgttgcttatgtttcataatgaggagttagatctcaagagactgaactttggggtgatttctttgattcccaaaaacaattagcccacagacattagacaatacaggcccatctgtgtgctgaatgattgcttcaaatttctcagtaaagtggtgaataacagactctcagaggtagctaatgatgtgatttctcctacccaaacaaccttcattcctaggagattcattcttgagggctgtgtgacaatccatgaggtgttacatgaaatgaggactaaaaatagagaagggattattttaaaaattgattttgaaaaagcatatgatagggtcaaatgggagttcttgatagaggttatggaaagaaaaggtttccctcccaaatggattaattggattaagtcttgtgtgataggggccgggggagggtctgcattacattaatggggataggactgagttttttagaacctttagaggccttaggcaaggggatcccctttctcctctccttttcaatctggtcaatgatgctttagctgcaatgttggataatgctaagagaaatggagttattagtggcttggttcttgagattgttcaaggggattacccatttacaatatggtgatgatactgctcttttcattgctaatgatgtctctcagattactgccacaaagtttatcctttattgctttgaagagatggctggtctaaaaattaattaccacaagagtgaggttttcactatagggttagaggaatctgatactattggagcttctcaaatgcttaattgtcctataggtcactttcctatgaaatacttgggcttgccaattagccctgagaaggttttaaatcctgattttgatttcttaggtcagaaactagagaagagattgggaaattggggacctggtagtctttctcatgctgggagagctgtgcagattaatgcttgtatgtcctctattccttcttatgctatggggttctatcttcttcctgaaggggtgcatcagaggtttgacaagataagagggaggtattactgggctggtaacaaattgaaaggtaaatatcacatggtcaaatgggaagacatggcttttcctaaggactttggggggcttggttttactgaaacaaggaggatgaatgcagctctgctggccaagtggattattaagttggaatccaatgatcagagtttatgccttcaggtgctgaggggaaagtatatgtaggaaggtggtatgtttcagtgtaaatctgggaatggttctcaattttgaaagggtttgttgaatattagaaagtgagtgcagcttggtgctgaatgggttttgggatgtgggaatcatatctatttctaggaggatttctggttacacaattgtcccttgtgagttatgtatccaaatattttcaaaatttgtaatcaacagaaggtgctggttgcacaggtcattcagagaggtgtggagtgtctcactttaggaggtcctttggccctatagaaagtgtagaatgggacaacctgaaaaatgacatagagaatgtgaatttgagtaatgagcctgacaagccgatttggggtttagcctctaacagaagattctctaccagatcactatatagagctttaacttttagaggtattagagaggtgaactcagagttgtgggctgccccctgcccaatgaaaatcaagcacttcctctggcttgctctaaaagatagaattcaatctgcagagaacctgaaaaagaggggttaggagggttttgaattctgtcaactttgtgggcaaattgagactactagtcatattctttttaactgtggcatggctaggatggtttggtgcatttgtagagatgctttgggatggggttccatccctcgaaattttgatgagttctttctattatgccaatgtgactgtaacccatcttctatgcatctgtttatgagtttgcttgcggctgtttcctggaatctttggctaactagaaacaatatggttttcagagataagatcttgtactccccactaactgtcacagcctgatttttcgttttaggatttataaattatttaataaattattaatagaatttatattaaatgttctttaatttacaagtgaagttaaatgtgggaaataaaattttctaaatataaagcatggatggatttaatttttaaattctccatgattaattatactctctgaaattttctcagatttttcggagctcaattcctaaatgatacaaaggacagttcagtaattagttaatcaataatcattaatgatttaattataattatgttaagtgcttttcttgtttaaaaatccttaaattacaaattgttgtttaattggaattagtagaaatgatcttaaaagcttaaaagaaaagatctaattttaatttgttaaattctaagataaaagtgggctagataaaatttcattaaatactttacttgattctatagttcctaaatttttctgggatttatttgagccaaggaagtatttttaataaatggaattgcatttcatgaataatttaaattgaaaaaggttttaaaatctccctttttgttttgggccgaaagtcggcccaaaagccctctctctctccccggcccaagttagcccaccagccgagccgccgctcgcgcgcgcgctctcgctcgctgacaggtggggcccacctgtcaggaccttcttcctcctcgcgccgtcgcccggccgagctctagccgagccgcgccgccgtctccttccaaatttggtcgcacctttcctgctccggccaaatcatttgaggggaaataatccccttgatctcctctatcttttcctctatagaaacttcggataaaatcgtttggaaaccgatggatttgagctcgattcggattcgtctctctcctctaaccctaacctttccatcgccgtcgccggtcgctatgggcctccgtcgccgcctcctagcccctataaaagcatccccgggacctcctccgtccgccgccaccctcgccttagcccgccgccgtctgtagcgccgcctccgcgtgagatcttgcgccgccgtcgccgccgtttgtccagccgtgcgtcgccgtcgctccggtcgtcgtcgtcgctcgggaaggccgccgtcgtgatcgccaagtcgtcgccgtcctcgtccacccctccgtttccaccgaggatcgccggagcatcgccgtcgtcgtcaagccgatcgtcgccgccgcttcatcctcgtcgccgtcgtcgtccggttgtcgtccgccgccgttcgtttctcggtaaggttcgccgcgtcgcccactacccgttggtgtcctccgtttgcgccgctgcgccgtcgttcgccggcgagcatgcaaggctgagccgccgccggtgatgacgtcaccgctgacgtcatcgacgccgtccgccgtagaccacggtagaccgagttgatctcggccgtccgttttggataggatagatctcggccgcccgttccgtagaccatcgccgtgcactcggtccaccgtgagccgagcccactgacgcaataattcccttttccgtttcaaaaataattctttattgcgtcataattcaattaaaatccatataaatgttttaatccggtttaatctttaaaaattcataactaattcatattagctcggttttagttggttcaagtctctaaagttgtataaaataaagatctacatattaaaattatccataaattgaattaaatttatttaatcctttttaaataggctttaattagattaaatcttgtaaaattcgtaattatttcatatgaagtcagaatgagcccgttcaagtctcataattcatctaaaatcatgatctacacatttgtttactttatatgtattgtttatttggagtttcttagtctttttccttgttttgcgttttagcttgtcgtttccgtcgtttcgaaggttcgcgagtgcgccggaagtattcaagaagattaattgaagacccgttattgcaaggcaagtcacacagatcccaaacacagttcctttgagcatgctgatcctatatttaaattctctatttatttcaactgtgcatttattttttaatgtcatcgggctctgtagacccccgtttttataacaggaatcaatcgtgtaaacagtaccatttccctggatcaagtagtctggtacacacgagttcatagccgagataccaaatgcacatacacgagagtctagtgcgaattattacaacataagtctgcaggcgtagtcttaaatcatcagaccgatgtcacatcctgattttttcgttttaggatttataaattatttaat

SEQ ID NO: 29505 - DNA, 4586 bp, Oryza sativa
taatgatagttcacgatggtcaatcgtgattggttaattaattacttgccaactaaaacttgataatagtgggttgtgagcacatggttttgagagtcgtgcttatgacaattaaggaccggttcgcgagctactattgtgaaacattaatcgtgccaaccacaagccagcgtgggcaacggctttaccttttgtataacatgattcattgcggagcaccagactgagaagtggcggagataagcccacgggggtcacttgggagtccatgccttgttttataaaggggtgattatgatccaggaatggtgcactgtggtgagttgtgttgtgcagagggtattgtcacagcctctattcgggtactttccagtatcgcgacgtatggtagacatgatgttgaggctgtgtcttgtgggtacagtggtacacctctggccagagtaaaaactattcgaatagccgtgcccgcggttatgggcgagttgagcaatgtttttcgtgattagtctcacacctctcacaataattatggatgttataactggtaataatttgcttagctcctggtttggagttagatctgtacagccgggtatggttgttcaggatggttgggcctgtgcagcatgggtgtgctgttcagtgttgattaaaatttctgattaattactccactgttttacttctcttaaatgttttgttaaatgctgcttttgcaaatgagcctatattatgccatcctttggtatccttgtgcacttgcatatttgctgtgtggcttgttgagtatgtcatatgctcattcttgtaataatcaatcaacctcagttgaagacaagttgcgaaggagaagacgtttggcttataccccagttgagctgcctgtgggagtggagccggagctgcgctagattttattttccgctgcagttttcttcttggtgaggactaagtgcctcttaagtaagtacttatcgttttagttaatttgatgaatctgtatattaaattgtcagtttgtgtacctcggctgattcctggacgaggattttatgcacaaataagtttggaaattacttgtgaatttccgggcgtgacaagttggtatcagagccatctcgactgtaggataagccaaatggtcaaaccttaaggactaattttccgaaaacatgatttgtgaaagtttctcctttcttccttatctagaattctttgcaaattgtttcattgtctacttccctctctctttcaacttgagtagttctgaaactagttgttgaaacttgaagacgccaatgtggtctacttatggaggttaagtcaagtggatcgatgaataagaaggtgatggtcgatctgaagtgcccagatgtcaagatggaatgaagtttggatcctaccttagaacctatgccgccaatctatccttgaagaatagttagtagggaagagcgtttgttgtttgctttgtttgtaggtatggttgcattcccatcattggagtagttcattgatgagtgtgtaactatactaggttgcttgcttaatcaacttgaacaatataatggtctacgcacaccagatcagtggtaacctggttaaggtcttgtctttagtgtaacctctctccttctatcttctctaatatgcaatagatggtgaacactcgcgccagtggaagtggaaacaataacaatgaagggaacccaactcttgctcaagtcctggctcaacagactcagttaatgaacatgatgatacagcagatgcagaaccagctcaaccaagggaacaacaatgctccaccgccgcagaacaagttaactgattttcttcgtgtaaggccacctaccttttctagcactaccaacccagtagaagcaggtgattggctacacgctgttgagaagaagttggaactgctccagtgtacggatcaggagaaagttgttttcgcttcacatcagttgcaaggacctgcatcagaatggtgggatcatttccggatgaacagagcagaaggacaaccaatcacttgggaagagtttactgaaggattcaagaagacacacatacctgtaggagttgttgctttgaagaagcgtgagtttagggccttgaagcaaaaggatcataccgtggcagagtatcttcatgaattcaatggcacgttatgctccagaagatgtgcgtactgacgaggaaaggcaggagaagttcttggaaggcttaaaggatgaactgtcagttacgttaatctcccatgactatgttgattttcagcagctggttgacaaagcaattcgacttgaagacaagaagaacaggatggataaccgtaaaaggaaaatgattgtattccaggaggcacaaggtagtagccagaggcagcgtatcaagccactccaaattggtgaatcttcttccgctggtcaaggacagtcgcaacagttgaatatcgctggtgagatcaaatcagagactaatgaaagcaatgaagttaacatcgagcaaataaatcagccgatgccagttcagcaggatcagtctcgggagaataacagtagtagaagggagcagcaggtatgtttcaactgttacaagccaggccactttgcaagagagtgtccgaagccgaagcatcagcagccgcaaggtcaggtcaacaacattgtcgtcacaggagccaatgcagtaccagttgtgtcttcaagagttgcatcttcaagtgttacagctcagccactagtttcaaagcggcagtagttttctataaagccttagaataattatcggagttatggaataagatagactgcagtttacctatgcctttttctttctagccgttccgaatctcgggacgagattctttgtaaggggggtagatctgtcacatcctgattttttcgttttaggatttataaattatttaataaattattaatagaatttatattaaatgttctttaatttacaagaaaagttaaatgtgggaaataaaatttcctaaatataaagcatggatggatttaatttttattaaattctccatgattaagtcaactctctgaaattttctcggatttttcggagctcaattcctaaatgatacaaagaacagttcagtaattatttgatcattaatgatctaattatttttgttaagagcttttcttgtttaaaaatccttaaattataaattgttgtttaaaaggaattgttagaaatgattttaaaagcctaaaagagaagatctaattttaatttgttaaatctcaatataaaattgggctagataaaattttgttaaatactttgcttaattctataattcctagatttttctgggatttatttgagctaaggaagtatttttaataaatggaattgtatttcatgaataatttaaattgaaaaaggtttttaaaagtctcttttggctttgggccgaaagtcagcccaagtcggcccagtccgccgagccgccgctctcctctctctctcagccgctgacaggtgggtcccacttgtcagggtcgtcgtcctcctcgcgccgccgccgccgcctgaaaccctagcgcgagccgccgccgtctccttccaaattcggccgatcctttacttctccggccgaatctttagaggggaaatgatccttgagatctcctcttccttttctcttttggaatcatcggctaaaatcgtttggaaattcgtggattcgagttcgattcggatcagcctctttcctccgaatccccgatctttccatcccaccgccggtcgccgtgggccttcgccgtcgccttccaacccctttaaaaggacccccggtgtctcctctacccgccgcctctctcgccttcgcctaccgtcgtgtgtagcaccctagcctcgtgagcttttgcgccgccgtcgtcgccgctgctccagccgtgtgccgccgccgtttcagctatcgccgtcgctcgggaaggtcgtcatcgtggtcgccgtcgggatcgccaagtcgtcgccgtcctcgtccgcccctttgccgccgccggagaccgctggagcaccgtcgccgccgtcgacccgatcttctccgccgctttgacctcgtcgccgtcgccgtccgttggtcttccgccgctcctttggtcaccggtgagttcgtcgtgccgtccgcttcgtcccggtgccttccgttcacgccgtcgcgccgtcgttcgccggcgagcgtgcgccgtccgagctgccgagccgcccgagccgccgccgccggtggtgacgtcatcgctgacgtcatcgtcgctgtctcccgtgagccgccgtggacccgatcgatctcggccgtccgttttggatagggttgatctcggccgtccgttcccgtgaaccgtcgtcgtgcacccggtccaccgcaaaccctagccgctgacgcaataatcctccttttccttttcaaaaataattcattattgcgtcataattcaattaaaatccatataagtgttttaatccgatttaatctttaaaaattcataactaattcatttgaactcagtttaatgtggtttgatgaactacttgca

SEQ ID NO: 29506 - DNA, 10650 bp, Oryza sativa
cggttatgggcggtcaaccagattcaccgtgattagtctcaccctagtgtaatcttttgaaattggatagtttaggtggatggttgggcctgtcgcaacgtgggttagcgttgggcagtggatagttgatattaattaattattacaacggtttaatctttcaacttctgtttataaatgctcgctttatgcaaatgaaccgctctagctcttctttgataattccctgcatcatacccctattccggtatgacttgctgagtacagtgggtagtactcagtcttgctctacttttcccaacccagagttcgagtttgggtcagataaaggtttctctgaggagtaggcttcgtccgtgccgtcgaggatgcctgtggagtggtgttcccgctgcagtttagtcaaggcttagctcctgttgtctttcttttcttccgctgcatttatgtaagacttttatgatgtttgtaagacgtggatctgaatgtcaacattgtcgtttgtgtactgtcacatcctgatttttgtttcaggatttataaattatttaataaattattaatagaatttatattaaatgatctttaatttacaagggaagttaaatgtgggaaataaaatttcctaaatataaagcatggatggatttaatttttattaaattctccatgattaagtcaactctctgaaattttctcggatttttcagagctcaattcctaaatgatacaaagaacagttcagtaattatttgatcattaatgatctaattataattgttaagagcttttctggtttaaaaatccttaaattataaattgttgtttaaaaggaattattagaaatgattttaaaagcctaaaagagaagatctaattttaatttgctaaatctcaatataaaattgggctagataaaattttattaaatactttgcttaattctataattcctagatttttctgggatttatttgagctaaggaagtatttttaataaatggaattgcatttcatgaataatttaaattgaaaaaggtttttaaaagtcttattttggctttgggccgaaagtcggcccaaaacccctctctctttctctctccctccccggcccagtcggcccagtcagcccgcgctccttccttttctctctcggtgtcgctgacaggtgggtcccacctgtcaggttcgtcttcctcgcgccgtcgccgccgcccgaaaccctagcgcaagccgccgccgtctccttccaaattcggccgcgcctttccttctccggccgaattgattgagggcaattgatccttgagatctcctcttccttttctcttttggaaacatcggctaattttctttggaaaccggtggatttgagttggattcggattcatctctctcctctaaccccgacctttccttctcgtcgccggcagccgtgggccttcactgccgcctccttgcccctttaaaaggacccccggtgtctccgctacccgccgcctctctcgccttcgcccgccgtcgtgtgtagcgccctagcctcgtgagcttttgcgccgccgtcgccgccgttcgtccagccgtgcgccgccgtcgctacggtcgtcgtcgtcactcgggaaggccaccgtcgggatcgccaagtcgtcgccgtccccgtccgccgcttcgccgtcgccgaagatcgccggagcaccgtcgccgccgtcgacccgatctccgccgccgcttcttcctcgtcgccgtcgccgtccgttgttcctccgccgcttctttggtcaccggtaagttcgccgcgccgcgctctacgtcctggtgccctccgttctcgttgtcgcgccgtcgttcgccggcgagcttgcgctcccgagccgccgccggtgctgacgtcatcgttgccgttccccgtgagccggtcgtggacccgtttgatctcggccgtccgttttggatagggttgatctcggccgtccgttcccgtgaaccgtcgtcgtgcacccggtccaccgcaaaccctagccgctgacgcaataatcctcttttccttttcaaaaataattcattattgcgtcataattcaattaaaatccatataagtgttttaatccgatttaatctttaaaaattcataactaattcatttgaactcagtttaatgtggttcaagttgcaaaaattatataaaataaagatctacatattaaaattgtccataaattgaattaaatttatttaattctttttaaatgggctttaattagatttaattttgtaaaattcataataaattcatttgaagtcagaatgaggccgttcaagtctcataattcatctaaaattatgatctacatgtttgtttactttttatgtattatttctttggtttttattagtctttttcttcgttttgcgtgatagttagtcgtttccgtcgttgcgaaggttcgcgagtgcgccggaagtattcaagaagattaattgaagaccgattattgcaaggcaagtcacacagatcctaaacacaatcctttgagcatgttgatcctatgtttaaattctctatttatttcaactgtgcatttattttcgaatgtcattgggtggaattaacctattctttgttatggcccttttgttcttgattactttattccttgataccttgggatattataacttgactagttgagctttatatattggttcagctagatattagctatgattgcttagccatgcttagaaacattagcacactattgggataacttatgactcattatttaatgatggcttaatgatagttcacgatggtcaatcgtgattggttaattaattacttgccaactaaaacttgataatggtgggttgtgagcacatggttttgagagtcgtgctcatgacaattaaggaccggttcgcgagctactattgtgaaacattaatcgtgccaaccacaagccagcgtgggcaacggctttaccttttgtatagcatgattcattgcggagcaccagactgagaagtggcggagataagcccacgggggtcgctggggagtccatgccttgttttataagggggtgattatgatccaggaatggtgcactgtggtgagttgtgttgtacaaagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatggacgagttgagcaatgtttttcgtgattagtctcacacctctcacaataattatggatgttataactggtaataatttgcttagctccggtttggaatggataattcctggtttggagattagatctgtacagccgggtatggttgtttcagaatggttgggcctgagcagcataggcatgttgttcagtgttgattaaaatttttgattaattactccactgttttacttctcttaaatgttttgttaaatgctgcttttgcaaatgagcctatattatgccatcctttggtatccttgtgcacttgcatatttgctgtgtggcttgttgagtatgtcatatgctcattcttgcaataatcaatcaacctcagttgaagacaagttgcgaaggagaagacgtttggctcataccccagttgagctgcctgtgggagtggagccggagcttcgctagattttattttccgctgcagttttcttcttggtgaggacttagtgcctcttaagtaagtacttatcgttttagttaatttgatgaatctgtatattaaattgtcagtttgtgtacctcggctgattcctggacgaggattttatgcacaaataagtttggaaatcacttgtgaatttccgggcgtgacatgtaccccggctggtcctggacggggaatttaatgcacattctgcttgaaattctattcgggaatttctgggcgtgacaagttggtattagagccgaccttgaccgtaggacaagccaaatggaaaaacctaaaagccctctgaatccttttcattgcatatgttcttggcaattggatttgttccgggaaaattgggatccgttcttgtggttcaagggaaaaatcttggtcgctcgtttaagtgagatttgtcaaaacgagtcaatctagagttttagtaaaactcttgagatttattcgttagtcagttgggatttgatgggtgaaatgcattaggtcctagctcaggaacatgggttgcaaggtatttcagctcttattgttattattagtatgtatctaatttccccattattttatcgttatgtgagtctgtcttatttattcgcactcatgcaaaatgatctatgcataaaatttcgctcttattcgattctcttatttgagtcttttattgctttatttaaatttggatttgagcatgcattgatcctactcctttgtcttctctagatggccggacacccacccaaccaccgcggagaaggcatgattgattttgtggcagagttggcacgcatgacgctggtggtgggctaccccaacgcgccagagtagacgacggttccaccgctcagtggcgagcttcctcaccgtgttcgcttggaggtccatggctacgtgggtacctgcctagctaacatggtggttgaggcgtccggaggcacagcagatcacgcctgtcaggaggcagcatacctgatgatggccagactacgggagcgccacaactacatcttccatgacatggcataccgttttcaccctcgtcgagccagtggtgatgatgtcagcaccttccgtccgacaaccggccagaacgacaccacctttggtcacatgtgtgctgtgatgagtggattggataggatgcactcggacctgcacaaggcgaccaaggccttgaacgatgggaagctcatgaggatcgtcgctctgatggacgagatagcgcgcctgaagagggagaatgctcagttaaagggtcttcccgcgccaggaggagtccggatccgcaccacaccccgcaagacgacgacggcacccgtgcgcatccagcttgcgcccaggaacccacctccatcagcagctcccgcagcacctccagttccgcccgcagttcctgcagctccagctccagctcccgcgtccgctctctccttcgctccagcatcagccgccaggggtccagccagtggcaacggaggttggttgtctgctactcccagtggcagccgcgatctcagcagcagcagctccagtggctcagagtcgggcagcggcgagacttatctgccaggctccaggagtcgctcagagggacctggtgacgagcaggaggacgccttcgactccaccgaccgcaggagccgttccgagcattaggctcgttttccattagttaatcgactgtctagcttctgcttgttagtttgtgtgtttaggttgcttgcttggggtcagtcgacggtcgatatcatgtgcctatgatatggctgtcttaataaggattttcgcttgttttttttaagtgttttaattcagatcagaacaattgcagtttaaattcctttgtaataaagcttagtttctgagcttctgtttttcttcttttccccgtctgcttctccctccagatggtctacaccaggaatggtagccgcgcaacaggcgagggcagcaacggcgaagagcgcactgatggggcgcatccccacagcgattccggcaatggtccgccaccacttcccgagaatccgacgctagtccaagtaatggcacatcagacccagatgatggcagccatgatgcagcaccagcaccagcagatgcaccagcggatgctgcagcacgccgaacagcagcatcaacagtttggtccccctccccctcagtccaagttgccagagtttctacgtgtcaggccacccaccttctccagcaccaccaaccctatggaggcgaatgactggctccatgccatagagaagaagctgaatctcctgcaatgcaatgatcaggagaaggttgctttcgccacacaccagcttcaaggtcccgcgtcagcttggtgggacaatcacatggccacccgcccaccaggtactgaagtcacttgggtagagttctgccgtagcttcaggaaggcgcaggtgccagatggggttgtggcacaaaagaagagggaattccgggcactccatcagggcaacaggactgtgacagagtacctccacgagttcaatcgcctcgcgcgatatgcaccagaggatgtccgcaccgacgccgagaagcaggaaaagttcatggcgggtctggatgacgagctgaccaaccaactgatatctggggactacgctgacgttgagaggctggttgacaaggcaatccgtcaggaggatcaacgcaacaagatggacaggaagaggaaagccgcacagttcagggcacctcagggaagtcaccagaggccgcgcttcgctcccaggcagcagggtggacctaccaccatgatcgttcgtcagcaccgcccgttcaaccctagcaactttccccagggcgccagtggcagtcagaaccaccatggaggtcagtccaaccgcggtgcagctccacgcccaccaatggcaccggcacagtcaggcccgcccgcgcaagccaagaaggagactggagcaaaaccagggtcctgcttcaactgtggtgagcttggccacttcgctgacaaatgcccgaagcctaggcgtgccgggccaaggtttatccaggctcgtgtcaaccacgcatctgcggaggaggcacaagcagcaccagaggttgtactgggtacgttttctattaactcaatccctgcaacagtactttttgattctggtgcaacgcattcgttcatttcaaagaagtttgttgggatgcatgggttaataagagaggaacttagcacaccgatgcgggttcataccccagggaatagctccacttcggttcaattcagcccttctataacaatagaaattcaaagatcaccatttctagccaacctcattcttctcgaatccaaagacctagatgtcattcttgggatggattggctgaccaagtttaagggggtcatcgattgtgcgaatcgcacagtcaccttgaccaacgagaagggagaaaccgtggtgtacaaatcactagtctcaccaaagcaaggggtctctttgaatcagattgaagcagaaatcccagtggacaccgtggagaagaatttgaggaaattggaagatatacccatagtctgcgagtatccggaagtgttcctcgaagacctcactaccatgccacccaagagagagattgattccggattgacttggcaccgggaaccgccccaatttacaagagaccgtacagaatggcggccaacgaattagccgaggtcaagaagcaggttgatgagcagctgcagaaagggtacattcgaccaagtacttcaccttggggtgctccggtcatttttgtagagaaaaaggataagacgaagaggatgtgcgttgattatcgcgcactcaacgaggtcaccatcaagaacaaatatcctttgccgcgaatcgatgatttgtttgatcaactgaaaggagctaaagtgttttctaagatagacctgcgatcaggctaccaccagttgagaattcgggaggaggatattccgaagacggccttcaccactcggtacgggctatatgagtgcacggttatgtcgttcggacttaccaacgcacccgcattcttcatgaatctgatgaacaaagtgttaatggaatttctggacaagtttgttgtggtgttcatcgacgacattcttatctattcaacgtccgaagaagaacatgaacaacatctccgtctagtactcgagaagttaaaggagcaccagctatacgccaagttcagcaagtgtgacttctggttgacggaagtcaaatttctgggccatgtcattacagctcagggtgtggcagttgatccatcaaacgtggagtcagttaccaaatggaccccgccgaagaccgtgtcgcagattcgaagttttcttggacttgcaggttattaccgccgattcatcgaaaacttctccagaatcgcccgacccatgactcagttgcttaagaaagatgagaagtttaaatggacaactgagtgcgataagagttttgaggagctcaaaaagaaattagtatccgcaccagttttgattctgcccgaccagatgaaagacttccaagtctattgcgatgcatcccgtcacggacttggatgtgtcctaatgcaagagggcatagtggttgcgtatgcctcgcggcagttacgtccacacgaagggaattatccaactcatgacctggaattggcagcagtggttcatgctttgaagatctggaggcactatctgattggcaaccgctgcgaagtatatacggaccataagagtctgaaatacatcttcacccaaccggacctaaatctccgacaacgaagatggttggaactaatcaaagactatgacatgagtattcactaccacccgggtaaagccaatgtggtggcagacgcattaagccggaaaagttactgcactgccctatgcatcgagggcatgtgtgaggaattgtggcaggagtttgagcatctcaacgtgggaattgttgaacacgggtttgtagccgctctggaggcacggcctacgctcgtggatcaagtcagagcagctcaagtaaatgattctgaaatagcagagctgaaaaagaacatgagggtcggaaaagcccgggatttccacgaagatgagcatggcacaatctggttgggagaaagattgtgtgtacctgacgacaaggaactgaaggatctgatactcaccgaggctcatcagacccagtactccattcatccaggcagcactaaaatgtatcaagacctcaaagaaaagttttggtgggtcagcatgaggagagaaatagctgaattcgtcgcactctgcgatgtttgccaacgagtgaaggcagagcaccaaagaccagcaggtttactccaacctcttcaaatcctggaatggaaatgggaggagattgggatggactttataacgggactgccccggacatcgtcgggtcacgactcgatctgggtagtcgtggatcgactcactaaggttgctcacttcataccagtacataccacgtatacgggcaaaaggttggcggagctttacctttcgagaatcatgtgcctacatggagtacccaaaaagattgtatctgaccgagggagtcagttcacctcaaaattctggcagaagctgcaggaagaattggggacccgtttaaatttcagcacggcctatcacccgcaaactgatggtcagaccgagcgagtcaatcaaatcttggaagatatgttgagagcttgcgctctcgattttggtggagcttgggacaaaagcttgccatatgcggaattctcgtacaacaacagctaccaggccagtctacagatggcaccgtttgaagctttatacggccggaagtgccgcacacctctcttctgggatcagacaggcgagcgtcaactgttcgggacagaggtattagcggaagcagaagagaaagtcagaatcatcagggaaaggttgaggattgcccagtctcgacagaagagctacgcggataaccgccgaagggagctcacttttgaggcaggagattacgtgtatcttcgtgtcactccgctccggggagtacaccgttttcagacgaaaggcaagttggcaccacgcttcgtgggaccatacaaaatcttggaacgaaggggagaagttgcttatcagttagaacttccatccaatatgatcggtatccatgacgtgttccacgtgtcccaattaaagaagtgcttaagggtacctgaagaacaggctgattcgaaacacattgatatccaggaggacctaacatacgtggagaagccgattcgtatacttgataccagcgaaagaagaaccagaaacaaggtcaacaggttttgccgagttcagtggagtcatcattcagaagaggaagcaacctgggaaagggaggatgagttgaaagccgcccatccgcacctcttcaccagctcctccgaatctcggggccgagattccgtttaaggggggtaggtttgtcacaccccgaagttctcctcccaggcctaaaatttaatttataaacgaccccccaagaaaatgcaggtgcaaatcaagagaaaaccctaagaaagtaatgcaaataataatcggatttgacatgtggaatttttcttgagttctacatgtcgaaattcattaacaggatttttagtggaattttcagagctctagaaataattttaaccaattaaaattgagcaagcaatattttaattccagggaaaatcctttttccttcttctttttctttttcctccctttttttttcctccttttttcgaatgggccgccggcccattctctccttcctccccctcctccctgctgggccggcccgcagccgaggcccagccaggccgggcgcctccctcctct

SEQ ID NO: 29507 - DNA, 13050 bp, Oryza sativa
acgaaatcgggagcgcctcggccacatccgtctctcccgagcccctataaagcatgcccgcactcccctccaccttttttctttttccaccgctctctcccgtgccctccattgctcccgcgccgtgcgcccatccgccgccgcctctcccgctactccggccgcctctacacttgccgccgcaccgcgccgtcggcgccgttgggttcgcgcggccgaggtccaccccgttcacccctcctccgtcgaggttcgtcgccggagccctcaccccctcgcactctggtgagcaccatctctaccgccgccttcggccatggtttccgcccgccgtggaccacccctctccctctaatctctctcttttcctttcttagggcatctcggagctcgtccgcccgccgacgtcgtcctcccgtggctcatcgtcgacggtcgccgccgtcccattcggtgaggactcccacccctttcctttccttcccccgatcccccgtgcgtcgccgtcgcccgcgctcgccgtcgccttcggtcgctgccgccatccgttgccgccgtttccgcgtcgttttgcgccgtcgccccgccgccggatgcgccgccggcaacgcattcgcgcgcgcgccgtcgccgcggccggtcggccggccttgagccaagccgagccgggtgccgccgccccttttctttccccccgccgctgaccagtgggccccgcgtgccggcgcccttcctctctctcccgagccgctgactggtgggccccgcatgtcagcgccgcttccccgtgctgatgtcagccctggaaaatattgcgcaataaattatttaagaatttttgttatagtaataaacacagtgaatcttctaaaattcataactaattcatccgagctccgtttaagcccattcaagtctcagtaaatcaagaataatgtgtagaatccattaaaaatggttttgttccctgtttcagtagtcttatagcctgtttgcattgtttgctttgtatgtcgctagattccgactcctccgacgctccggtgtacttcgaaatagtcgctgaggttcctccagcagcagagcaaggcaagtcatgcttgtcacttgaacatgttgatcctatattgcaaatgctctattgttttctttcaaatattgcattgttttataatattactatgggatggttacctattgttacagctatgctttttggataccatgctcctttgttagcttggggttacaacatgattagagtttggactaggaattgcttagccatgcttagttcaactagttcacaatggggaaaatcctattaatgtttagactgttggttctaatggttttgttggattagtgccaccgctttggtgttggttaattaaaataaatcacatggtgggctgtgggtgcatggttttgctggtcgcacccatggcagttaaggaccggttcgcgggatgccctgaaagaacttatcgtacttaccacaagccagcgtgggcaacggctgggcttgtagtgtagctctcatctagtcgacgcatccaggcaagggtgggcgtgatggagcggggcgggccctgcgacggcctctgtcgtttccggattcacctaggcacgagaggggactgcccgttgcccgctggggacgggggtgaaacctgaggtgtggtgtgcttggctagagggggttatgcgaagggtcctgtcacggcctctttccgatatgtcgtggtggcatgtcggcgtacggaaacgtatcgtggggctgtgtcttgtgggtacagttgtacacctctgatcagagtaaaactattcgaatagccgtgcccgcggttatgggcggtcaaccagattcaccgtgattagtctcaccctagtgtaatcttttgaaattggatagtttaggtggatggttgggcctgtcgcaacgtgggttagcgttgggcagtggatagttgatattaattaattattacaacggtttaatctttcaacttctgtttataaatgctcgctttatgcaaatgaactgctctagctcttctttgataattccctgcatcatacccctattccggtatgacttgctgagtacagtgggtagtactcagtcttgctctacttttcccaaccccagagttcgagttcgggtcagatgaaggtttctctgaggagtaggcttcgtgcgtgccgtcgaggatgcctgtggagtggtgttcccgctgcagtttagtcaaggcttagctcctgttgtctttcttttcttccgttgcatttatgtaagacttttatgatgtttgtaagacatggatctgaatgtcaacattgtcgtttgtgtaccccggctggtcctggacggggaatttaatgcacattctgcttgaaattctattcgggaatttctaggcgtgacaccgtatgcccgttgggtacaggttttgacctaataaaaaacccatgggtactaaatggagaataaacctaattctattagggtttttacccatgggtaaataggcaaacatgtcaaattgccatccctaattgcattggctacaatgcgtagggcaatttggtggatacctggctacaaacctcacccgagcagcccttatccagatgagcgacaagtggttgaggaagggatcctatggtgcgactgcacggctccaattgcgtgaagagacggacagctagccgcatgcacgatctccacgcgtggaagcgcggctcggctccgctttgctcgttgctggggatgcggactacgcggctagaagcagaagcgacgcatgtcatcaccgcgtctgtttagggtgcttaagattacgggaagtagttggttggtggtcaatttctgagaatgtgaaaaagctaagtttcccagcgtttgattaatttctagtttattttctatattaaataactacagttttttagaatcaaagctatattatttaggggaccttttaattatgagagaaactatatcagctagaagcttcccgaacagactcatttattgccgctttgctcatacttgaccttcgtgcgccagattgccgccaaatcatcgacaaccacagctgccatggcagggaaatcgagggacgcagtagctgccatgcatggcaggaggaggctaggagaaggacctagcctctacagcctctatgcctagttctttgattgtcatgtatattcatcaatttcatttgatttatcgttcatgatgcgtgctgtgacggaggtagtataaccaatataagtctacctttacttaaataaagtaatctattagctacgttttaatgaaaaatatttttcattactataataaatccataaagtcattgatagcatacaagaaaaattgttagtaaaattttggaaactgatatgctagatattttaaaaaaatcacacatagtacaaatagatataaaccaactccattattatgacacattttttttaataattttagtatggagtttatatgttgcaagggtaatcagaagaaaatcataactaatgtccaaactacttcgttattaaccaatacatgtttacaaggagtaaaaaaatacttcaacaatataatatcatccttaacattcataataaaaatgaaagctacattaaacaaggtgcccttcctagttaactatataagtgccatatatatactagacaaagacgataaaagaagtcattatcaacggaggaagtaaggagaagctgtgtgccttcgaattttggctcggagcaactccttgttagcaccaggaatcttgtcaatcttctccccatccttgacgaagaaaaatgttggcactatcccttcgatgtcataccagtccgtaacactctccagctcatcgctgtcgacattgaccttaatgaaaaccgcaccagcgaactccttcgcatactcggtgaaagctggcgcgatgtagcgtgaagcagggcaccgggaagtagtgaactggatgactacgagcttgtgggattgcttggcttggctcatgtggagggcgaactgctccattgtgtggggcacaatcaccgtcccttccgcaccggtgggcatgtcttcttcgatacttatctctgtagtagtgtatgttttgtgttggtgtgcaattatggttaagacatgagttagtaccatgggatatatattatacacgtttgcgctaaaatgcacccaagatgcgcaatacctaaaacacacacctcacgtagtaaattctttactgaaagttatgctgtcctcaaacacctcgtaaatattttactaataggctcagtatgggtatttggcgataattcatatctcagtaaacaaattactagcactgggtgtgttttaacaaatgtcttgacttgtgcaatatataaaggatactatagtgcatacacctttcgttctttgatccaagtgttagggccaacattctacggttcttaaggaggtaagactaggaaccacaccttctaggtacccgagaaaatataggacctcccattaattccttaagtagatgaactgtaactgtaaaatgacaagaaacaaaattacctctactctgaagacgtgaagaggattccggtagcatacaaaacctgattcagggtcacaacaataacatttaacttccattaaaattggtttcaaacaatcatcaagtcaggttgaagatgcatagaaggtaaagatagaagccacggcagagaaagaaagaagctcaataatccttgtaagttgtaacctgggaatagaatgaaaaatccatacccgtgatcatcttgttgtgccaaatcttcatccaagtctctcccttcagcaccaaagatccaatccacccattgtatatcaaccataagagtgctcggcgtcggatgcttgcgaattgcagtcctcaaggcagactccacttcagttttgtttgattcatcatcatcagtgcccccaattcttgcagagatctctgcaagggcgaccaagtgttccaaccctgtctccttagagtcatactgcttgaactcgttggcattgaaccttagatttaatctttgcacactcggcattgctccttccacaaaagtcatgcatggtgctgtacagacaaacatgaagtacttgagagacccgaacccctcattcgcagcgacgattctttgcgcaggcgctgttcgaacaagcagcgaaagagcagtgagagatcccagtcctttgagagtgtcaaggtcatcctgggaaatttgcatgactgcaatgtttaaaatgcggagattgttgagctttccagtccatttggggatgctggtgaagatgtacctgtgacagtgagggagcagatcaagtagtacaagacgaaggtgcaacaaacactgtgtatgaacaatatccaataggacagcagttgctcttgcatctgcttccagtgtctgcaagtgttgtagtccttggatcttctctggaagtttaactgtgatattacctgttatcttcagatatctcagttgtaacagttcagaaatgcttgtgaggtcatagcttgttttctcttgatcagcccaaaaacaaacaatcagaactcgaagaagcctataatctgcaatggaaggcatacacttgacttgtccgaaaaatgccatcgatcgaacttgtgagagtctcaaacctgctagtggtgttgtatcatgtgcattgctgaagtgaagcgagagtcggcgaaccttgtcagcatgtcttactgtcgtctgagaatgatccaatgtaatgctgaaattctcctctattgacttacacctgatgaaatttaataccatgtggtgcactacacatgacaatacctcatttttgcagttaacatctactggttggaccaggcccctaccaacaagttcatcaaaatagttccctgcaacttcttccatgactttattttctatggaattgatgaaaccttcagccatccattgcctcaccaagttggccttcctaattatgtagtcctctttgtagatgctaaggtataacagacatgctttcaaacaatgaggaagattattgtaaataaggttgagtacttgcctcatcccctgcaaagtaggatttttcttcaaattggaagtagtcaatgatttttgtatgtgattccattgctgcattccatctaacagctggcttttaaaatgtctggctgttatagttattgctagtggcaagccaccacatttttttatcatgtcatgagaaacttcagtaagatgtccaggaaattcatttccttggccaacaactccactgaaaaacaattgacttgagacatcatcacccagtggatcaatcttaataatgtgctctgagttatatccacagcatgccaaagctacaggttcaatttctgttgttattagtattctactgcaactattattatcaggcaaaccacggctaacaatatcccacattgatgaagcccataaatcttcaattatgatgaagtacctgcagaacatttagtacttcgtaaacattaaacttctaatgtacgaaaaaataaatcatatttaaaaagctatacgtgggatagcatgctgaatttaaaaagttgagtgcaatttcattttatcaactttgcaaacatggtgaagacatgttctatatcttgtaaatttcagaaattaaatttaaccacatatctaagagcaagtttaatagtatagccgactactagctccaaatcatctagagccaaatagccaattcatacaatagttgcttactatactattaatacttggtcctacctgtcatacacacattacgtcttagagtccgtgctgcagctggctacagatctgtaggctgctgctcttctctctcttcctatatctctttaaaatatgtttatagctagcttataacctgctattgtacctgttcttagacatggaaaaagacacgtactcctaagcaaatactctctcttgtttttaatgtttgatgtcaaacttttggacatatatatgttagatcatccatcttattaaaaatataattatcatttttttaaatttattttatcattaaaagtaatttaagcatatattatatttttcatatttgtaaaaaatttgaataaaataaatggccaaacatatatacaaaatcaacattgtcagacattaaaacaagaggcagcagttaaattgcaccatttttatcactgtttcgttttagttatattttaaattttgtttatgtacaaatacgattgagtttagtctaattcttttttgaccgaacaagggaggcccttacgactattttttattaagtaaaaaaaagttcttgtaacaactgagaaaatgaaaagaaaataaattacaacttactgctataagttaacatgccattgtggtagtttagtctaaaaaattataacaagggtatgaagcatgtactttcatttacatttagtaattaaaaatacaaacaactttgtagttgttctactagtagtagaaataatgtactagtagtttagtcgcctaaaaaaaataacaagggtatgaaacatatactttcatttacatttaataattaaaaatacaaacaactttgtagttcttctactagtagtagaaataatgtaaacactttacctttattttttcatgcaatagaccatatctatttatattaacaactcaattgctgttagtagaatgaggtgggtataataattgtttagattaccagtataattcatggctcgatcgaatcgtatctactaatagagggcactataaaagtaatttaaaatattattggcattgtcgagtaaattaaattcatatgtatagttactaacttaattactatatgaaggataaaaaaggggaaatttgagaaaatagtttgtaaattcatgaaaaaaatactagagatagatgtagacatgaattaccttttatcttgcaaatgcgtccggatagtttcaaggagtcgatcaacctcccaaacatccgaagactgatgctgatgttgtggccgcagctgtgacagcatgtcggtgaggatcttcgtcatgtcaggcttccggggcgtccgcacgaaagcccggcagtcgaacggcgcatccaaccgccggccatgcagacgatagaattctgtggccagcgtcgtcttgccaacacctccggatccaacaatggaagccaccttgagcttcggctcgccgtcggccagccaccggacgagcttttgcatcgaaatatccctaccaacgagctggccgtgcacagcagcgtcgtccatcccgaacgtcagcgacagaaaccggcggcgttcgttgccggcggagtcctcgcgatcgtcgtcgtcgacttcttctctcggcctcgagctcgaggtgcgcctgccaagatggtagctctcctggcggcgaatggcctccttcacgcgggcgctgaacagggtgacctcgtcggcgatccaccgccgccggttaagctcccctcgaagccgggcgatcatgctgctgatcatcttcttggcaccagcagtgctactgccatcgccgccgccgcggtggtggaggagctgggtcgttagctcgtcgaggaagtcgtcgacgtcgtaggagagctcgcgaacctccttagcccagcacgccgccgtcgagtctggcggtggcgcggtgtctgacggcggctccacgaggaggtagtagtcatctagcaggtgtcggagatcgcctctgaggaggaggatcttcttcctctcccccttccgcagcgacgacggttgcgcaggcggcggcggctccggcggctgcagcagcagcgagtcgagcttgctcgtcagggaccgcatgatgacaccctgcgatgcactgaccgccggcgccatggatggagacctctgcagctcgccggcgctagctgaagatcagatcagagctagtgatcgagattatgcctcgttagttgctgatttgacagcatggatcgcccaagagtacaagaaattaactcttgaaacttaatcctatctagtaagaaatcatgcagagaggctgcgctgcaaatgtagctctgccatagccttcaaaggttgatgtggaaagaagtaggcaatccctcgtctctttcgtcatagggagatactccatccaaatccaaatgtattaagcatatttcattgttttgattatttttttccaaatgagatgagcttattcatatagtctccatgcatccgagccttaaatgaagagagtctcttttcgttttactgtgtatgattaaattgttgaccgaaacttgagctgccatgcattctccaacccttttgcatgcatatgaaaaagtttgttacatgggagtacaaatcgaatgagttaattttttttcttggtctcgatgataaaataaatatgcttacgatctttgcatggaccgagtagctaattaatggaataacttttcctactttggaactatgacgacttggttctcgcttgagagtaacgttgtacgatggtaactatataattagatgttaggttaggccaaactccaaagaggataaagttggaagaaaattctacagaggagagcccattggggattaaaaaagaaagcataactaagggcatttgccctggaagcaactcttgattgtagccttttggataaaagcatgccactgagttgagagtactaatcctacagtacttatcttcatagtagtagctttgggttagcaacacttccattaatgccctctcccttgttcccatggtcaccgatggtgctgtctccctcgtcatcaccggcctatgttgttaattcttggctgccactacctctcgagtagatgccatctactcgagaggtagtggtaaccaggatcaaggtgctaactaccacattgaattcaggcacaaattcacagtttgaccattttgtagctgttatagaggtagtcttctttgctacgatgtctcaatagcattagagttacgtctcgggaacaatgtcttccttacaataacggcatcaacattttccatccccgacacttgaggtgccactatctctttctctgtatggaccacaccctctcttcatgcggaattggcgacttgcaaaatgtcctccgaatccaaagctacacgagataccccttcccctatggtgggatccaagcctacacaaaaatgtattattgtgagttctctaaaggagatgggggtttgtgcgccatgggagaggggaggggggacgggttagctttgacaggtgggcctggcgactttttaatatttcctgtacttagtgttttggccatattgattccatgcaggctgtatgctgcctatgatttctacatagcatgtgagataagtggttactcattcctatttcttgtcccgtgttttataaacctttcgaaattgttacaatatctcccaccagccttatccacgcggtatgggtataacataaagtcaagaaaaaatttctcttttttaaaaaaactgtagcactggctaccaaaactcagccaaatttatgaattttctttctattctttcaaaattctaatttgaaatttaaattctcaaaaaaaagataaaacacaaaaaaattgctgaaagaagtgaaaattcaaaagtggtatttcgcaacctgctagctatgtgctgacaagttagcaatcattctttcatcgctttagcaaagacgatcatccattggcctgtaatgtgacgataatatatactccctccgtcccataatataagggattttttgaccactcgtcttattcaatttttttttgaaattattatttattttatttgtgacttactttattatctacagtactttaagcacaaatttttgttttttatatttgcaaaaaaaaattgaataagacgagtggtcaaacgttacaaagcaaaaactcaaaatccattgtattatgggacggagggagtagcagctagtggatgctaacaaggaaagtagcaagatgcggatacccttgataaaactggtataatagaatactacaaaggttgatgtaacctgcgaacctgcttttaattgcaggcaatgagtcagtcaagcactatgaaaggtcttcttaaaaaaaaaaccactatatggaaggatgcctgtgaagattatggatacatgatacccacattatctatatatgtatccaactgctaatagaaggtgtgctatatttgtacataacttggttgctagggtttccttgccggttaaggcaggaccgtacacttcgattgggtttatctcttgtaatactaaagggaacttaggccgaatccgactgggtttcatacttgtaacctctgcccctaacctatataaggagagccagtaacaccctcgaaggacaacatacaacataagtcaccacaacaagatcgtcagatcaatacaacacccgacggattcaatccctcaacaggagtagggtattacttctcattaaaaggatctgaacctgtctaaacctttgactccacatccatccacttttggacttcgtaccactatgcaggatcaggtcatttctgacagccctaaaccctcacctctgacgggttcaaccttggtcaaagataagtggtcactgatgacgttgagtcacctgtgacgggtaaaggcccgtcagaggtaagagtcacctctaatggtccccaactaaaacccatcacagatgagggtcacctctgactggtcccaacaaaaacctatcatagatgagagtcacctctgatgggtatatattttaacatgtcactgaccgtaattacgatccatcactggtgtgaaaaatgggaaaaaaaagtaataccgtcctcctaggttaccatcacattcatttggacggtcatagatcgcatctggcattcacaaataaaataaatcatcaaaattcctcttgttcccatggcattcatcccaacaaaaccacatgaatgtcaatcaccagaatcaccacatgaattggaatcatcgatcatagtagcaagaatgtgaacaacatgaacaacacaagacaaagtatttgggtgaaagaggactggcaggcaatggatctgaacgcctccacctgccatcatgttcgttgtgcttgtccctgagacaacgcagattggagcttgggcgcggaggagacaacaaaacaatgggcgacacatgtggatggaggtggcggcgacccgagctcgatggtgaaggagacgaaaagacggcagtcggtgcatgtggatggaggcagcggcgaccggacccccatgtctcccattcgcctgcctccccatctctgcctccgccctgagccaccgcatccacgcccacacccccggatgcctccccatttccggccccctctgcccgagccgagccgccggctccccatctcagacctgcgttgccgtggttgctgcctccacctccacgccgttgcctctgcctgcctccccatcttcggccccctctgcccgccgcctccccgtcttagatccgtgttatcgccgtccccgcctccgcctgccttcccatcttcatccccctttgccttgagccgagccgtcgttccccgtctcagatatgctccgccgccacctccagccgcacgtcgtcgcctcccgcctgccttcccatctccagcctctttcacccgagccaccgcctgcccatctcagatctgcgctgccgccgcctccacccccacgccatagcctccgcctacctccctatctccctctccccctccctagtgctgtagcctcagccccaactcccgctcacccgttggcgttgcctccatccccgctgactcactggggtcacctccgcctccaccaacgcgcacccgccggtgagagggaggggagagaggggaggtcaagagacgggatggtttgagtgggaaagagagattgagagagaggggggcaaaaaaat

SEQ ID NO: 29508 - DNA, 786 bp, Oryza sativa
aaacctgcgaaaaatacatgacatttgtaggcggcgatcaacaccacctacaagaaatcattttcacatacgacatctcaattttcataggcgcaacaaccacccgcctacgaaaatattcttcgcaaacaacaaaaaaaaaacaatccgcccaccacccccatctgccaccggcgtcgcttgctgtggccgacaccaccaccatcgcccctctgctggatctgggagggagggaggaggggagccgcaccgctgcctccggttagatctgggagggagggagggaggggggaagagagaggggaggggtcgtgccgcctcttccgctgccggcgccctcctcctccacctgctgaggccgccgccaccgtccttccccttcggccgaatctaggagggagggaggggaggggaggggaggggacgtgccacctctgccactgccagcaccctcctccctttgccggatctgggagggagggaggaaggggaggggtcgggccgtctgcgcctctgctggctcccaccccccctccgctggatctaggaggaggggaggggtcgcgccgcctcctccattgctgtctatggctgccacccgtggggggtctccgccactgcaagtgccctcgctcctccgtcaaatctaggagggagggagggagggaggggaggggccacgccgcctcctccgctactgtctgtggccgtcacccgggaggagccacgccggcacctgctgggaggaaggagtgaagggggagagggggatggagggggaggtct

SEQ ID NO: 29509 - DNA, 2263 bp, Oryza sativa
  unsure (1)..(2263): unsure at all n locations
gcagtagcagaaacatggaggaacattactttttaaaaaaaggtgcggaggtgtcatgcccagaaattcgctaactcgaatttcaagtagaatgtgtattaaaatccctgtccaggaccagccagagtacacaaatgacaatttaataaacagatccacgtcttacaaaaacaataaaataaatcttacaaacgcaacggaaaaaacaaataaattagacttaatcttcacgaccaaaagcatagcttcctccataaaccacaagcaatcctcgacgttcggaacaagctcaatcctcgaagaactcaccatctaaaccaatctctgcctcggggggggggataaagcaagactatgtaccaatcaccgtactcaacaagtcataccagcaggaaggtatgatgcaagatattctcaaaggaatggctcattggatatttgcaataaaagcagcatttataaatcatattttaaataagtaaaacaatatatataattaagtagtattaaatcatcactgtcgaacgctaaagccacattgtgacaggcccaaccaaatcacctgaactacaccagttttacaagtcatattattatagtgagactaatcacggtgagctagttgaccgcctaataaccgcgggcacggctattcgaatagttttccacaagactcattccacacatgttaccatgcctcgaagtactgccacgatactgcaaagggggaaatcatgacaaaacccttcatataaccctccctaatcgaacatacccacctcaggtttcaccccctccttgtgccaagtcgtgcagtcccctctcatgcctaggtaaatccggaaacaacaaagattaatatccaggcccgaactacaccattgcctctacccttgccatggtatgtcagctaggttaagttatactctagatttagcctaaagcccatgctggttatcatcatataattaaggactaaattataatgaatcccattgtgaactagttgatctaagcatggctaagcattcctaaacatatcatctagtcaattataacccaagttatcaatagcataagatattcaacaggccgagtatgataggcatccatcccacacgacattctaaaacaatgcaatttaatagaaagcaggggattttataaaataggctcaacatgatcaatcctgtatgtatgacttgccttgctcttgtgctgatgaaacctcggcaaccacttcgaaataaactggatcaccgaaactgacagaatctaaacgacaaacaaagcatacaagaaatacaagcaataaggctaccgaaacagcaaaagaatccaattttaatggattctatacattttaacgagttcactgcacttgaatgggttaaaacacttgaatgggttaaaacagagctcagattatttagttatgaattttacaatatgagctgcgttattacaaataaccgaaaaaccttaatcatttattacgtattattgcccaaagataaatagatcaatggaaatatatctccggtaagcaagcctcacgaattagcgactccacaagccaatactttgtgacccgggaccatccaaacggtcaaccgaaccggcgaatggaaccagcggctcaaaacgactataaactaaagaacgactgaacgaactaatactttgacaacactacacgcgaacgaacggttagcggcttaacgaacggctgtggcaaaggcggcaactaagcactattagcggcaacgactcggtacagcaaacgataggccggtaggtatgggcagcgagaaaaccacaacgacgacgcgggaccgcggcagcggcacggctaggtggtggcggctcggctcggctcaggggcggcagcgacggctgcagcagcggctcggcgcgtggcaggggcaaggcgacggcggcgcggttgggcggctgcggctcagcagtgactagggcaacggcgcgcatggcagtggctacacacgacacggcgacacacgaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 29510 - DNA, 9133 bp, Oryza sativa
tttaattatctaagctaagcaaaggtaatttcctatctgttgctaagggcaccgacccctgctggtctgccagcgtggttccggctatagctctatgatgtatccaacgtggaggattactaggatgggattcagggctgtcaccacctgccgcctacctctgacaaatccgtgggatacacaacaaacaaaggtaatctctaacctagacaccatgtctaagttattaattactactctaatacttgcgcaggaacttccttctctatccggagtcctagtactagagcacttagtataaatactaaacaacgaacctgcaaagatgtaaatcttacttaaacaaagtaattaaataacataagaaaggaacacgaatgcttactttatagaagtttccccgaacccggagcagagtgtaccaacagctccggtactcctccagaattcctcctaggaagttacactcgtcgaggtagaagtcggatgagcgccaaacttctaggcactcctccagagcttcccctcactctctaccttattctaatgtacaaaagatacaatagagcctcttgtaattcagcccaaagttgtgtgttggaaatgagagtgagctcctccttttataggcaggtatgacggttacagcctatgcgaaatgaccaaactaccccggaaccgccattaggatgcgatcagggccatccacgcaaaatttgacgatcaacgaccaccaaaacggttcggccgaactggagcttcggccgaacccgggacggctccgttcggcccgtttttcgtcgtggacactaattttgaggccctcagcccattggcatgatagttgggcccatttggagttgtttaattgacttatggggcctccaatccgtgtaaatgtgtcctgaatgcgcggaggtgcagtttgtcgcttgacggatgtgttttcttctcaaaatacctgcatacacatatttcaccaacactagtggaaatgattagtaataatgcctaccactacgttggataccatgttttatttcattatacgaaggtattgacggtcagatattatgatttaaggaccgtcaacaaccaccatgcagtaacactaataaaatatagttaaaatatagtcatgacggatctagttttgtagagttctttttttaaagcattacgatgcaaacggttcaaaaatataatagatggtgtgagagatatcattgtttaaagatgagaattcaaaagatatcacttgcacttacatttactggttcaaagtgggtggtaggtcatgtacctgtgtgtttggttgttaccacatgttttgcagtaacgctattaagaaattgcagtaacatgcactgttactgtaaaaattatagttgttactgcacacatacaataacgtcatgatggaatggtagtaactcacaataaaaagtagtaacaataatgaagtcgaagtcaggaggcaacccagcaaatggatcctcgagctcttcctctggctcatcgggctcggcttcaaaacccggaggggaaggagggatatcgatgtggtggtcctcattatatcgcgccttgaggtatttgacgtcgcgagccgttttcttcgccgaattccgcaatcggcggttattttttgcctccgcggagcaaagaccaaaaagactccacaaaatacggaataagggagacggctcacaatgagccacagaggaagggcgcttagaagtagaaggcggctgagtggaagaagaggggatgtccctagctgctgaggagcctacctaggaagagcggggggccttgacaaggcccaagtgaagctgggaatgagacacatcatgatgaaactgaagctgagtgacagtctcgatcatccacataatgtgaggaacatagaccaactccttcctgtactaaatggaggccatgcagatttcctcccacacaaagtgataaacatgaaagcgatgaggagggggatcgaacctgacaagcacggtcctggagaggtggttaatgctgctagcatcaccatccttaggcacaaaggaccggtgaaacatccggttcaagtaggcaaagtacggtttgagactgtcgaccttacccaacaccacattaggatcattaggaatgtaaagagggagtaaatcagcgttggcaggaattggaagattatgcagatcaggaaggttgagcaagtcatgcaaatcaaaaccccaaatctcagccaatcgcggataggagacagaaaaccaggatccttgggtcatccattgcatggcatgatatggatcaaagaaaacggtggcatagaattgagcgatgacttcgttgcaccaatcctgctgtaaagtcatgaaagagcgaattcccatgcactcacaattggcaatcacaaagttgagcaccggatcatcatgcgcctgcagctactcccagttgatccattgcatgggattggtgggatgagctttggacttgatcacagactcataaaagtcttgttgaaagagagtccaaaaccgcgaatccgtggcggtgcggcgaagggggcgcggatcctcatctcagcgaggagcaacaacttcagtcttccgcctccaatcatacacttggcgaatcaccgccggatccctctcgggggtatgaatgtgaagaggagcaatagggacattgggttggtgcggcggcgtttgcggttgacgagaggagccctcaccatcaccaccaccaccaagagcttgagtggaccgccgaggagggagagtgccgcctcgagccacccacgcatactgaggagccgcatcctctctcccggaccaatcactgtccgaatcatcatgagaggatggggtgggagagcggtccctttggcgcttggatttgcgggaagttcgcttgcggggaggcatccttcaaacaagatatagacaagggatcagtgaatggaagccaaagaagcaagaaccaagtaagtgaaggcaagaatcgtgcaaaaccgaggtgataggggtcggccagagattttcggatatatccgaaaacaattttccgaaccctatcatccggatgccgcacaaatccgccaacaaaaacttgggaaaatgaatctgcaggtcctagtgcactaggggaagaactccaccaaaggaaatcgcaagataagacttgaggaatcgaaggatttgattttagggtggatacctcaagaacgcgaagaacacttgaagaacgcggtgaagatcaacaatgtaggtcccaagtagtgccccaaatgcgctcccacgaggatggagaggaggggagccgcgggaggtcgtcggagaggaggtggtcaccggtggggagcggaggagggagtcaagcccgtggtgaaaaagagttgaaaggagggagaaaggagtccacggggtgaaatataaagaccccgatattttcagatatttccgaaaattttcggataagtccgaaaggatccagtaggttgcgcacgcttctgtagattttcggatatatccgaagattttttggaatgtccgaaaaatcctgggatagctttgaatgaagagcgacaggacaggagattttcggaatgtccgaaaatttttcggaaagtccgaaaattcctggaaaacagtttttcaaagggatttcgctgggaattttgaagaaacagttttgcaaactttctaaaggaattttgcaggggactagcaccgggaattttttttgtcaaaaacacttttcacaaggagttttgaaaggattaaaggaatggagggatggtcgagcactaaaggctccatttgaagttgcggctagcacacacaagcatacaaaacaatagccacaaatcaaatgatctatccgagggatcaaaagagagggaattaccatgagataagataattcaccctcgagagagggaatgtgtgaatctatttcaaattgtgttaggaacaaaattcattgaaaaatgagatccccatacacatagattcaagatctccacaaatatgactagtgtccatccatgagttgaatgtccattttgtcacaaagtggtatgcaaacctattctagcaaacaaacatgcatgcaatagatcaagccacattccgagaatccaagatatttagttcaattctcaactcacaaaacctagcttcatctaaaagcttggtaaagatatccgccaattgtttgtcggttctcacatgttggatgtctatgtcgtctcttgttgaatggtttctcaagaaatgatggcgaatatctatgtgtttggttcgggaatgttggacggggttattggctatcttaatggcgctctcattgtcacataggagtgtgattttggacacatttaggccatagtctctcaaggtttgcttcatccaaagaagttgaacacaacaactccccgccgaaatgtattccgcttcggcggtggatagggcgacagatttttgcttcttggaagaccaagaaacaagagacctacccaagaattggcaagtacccgatgtgcttttcctatccactttgcacccggcataatccgcatcggcatagccaatgagatcaaacctcgctcccttagtataccaaagaccagattaggtgtgtgcaccaaatatctaagaattctcttcacggccacaaggtaacactctttcggagcggcttgaaatctggcacacatgcacacactaagcataatatcgggcctagatgcacaaaggtaaaggagtgagccaatgatggaacggtataccttttggtcgacgtctttaccttgctcgttgaggtcgaggtggccatttgatggcatgggagtgtggattagcttggcattctccatcccaaatttcttgagcatgtccttcaaatactttgtttggcaaatgaaggttccttccttgagttgcttgatttgaaggccaaggaagaacttcaattcacctatcatggacatctcaaaacgtttggtcatcatcctactaaactcttcactaaaagacttgttagtacaaccaaatataatgtcatcgacatatatttggcacacaaaaatatcattatcatgtcttttagtaaaaagagttgaatcggctttcccgatttcaaagccgtttttcacaagaaaattttgaagacactcataccaagctctaggggcttgcttaagcccgtagagtgccttgtggagcttgtacacgtggttgggatacttcggattctcgaagcccggtggttgctccacgtataccaactcgttgataggcccggcccgttgaggaaggcttaaaaatgaggttagtagcaaaagcaagcaatatgcgaatcaactcaagtctagctaccggcgcaaaagtttcaccgaaatctaatccttcgatttgggtgaacccttgcgccactaaccttgccttgttccttattatgaccccggtctcgtcttgcttgttgcggaagatccacttcgttccaatcacattttgccgaggtcgctccatcaaagtccacacttcattctgggtgaaattgttcaactcctcttgctgcgccatcacccaatccggatgattaagagtttcttccacccttagaggctcaagagaagacaaaaacgagtaatgctcacaaaaatttgcaatacgagaacgagtggatactcccttgttgatggctcctaagatgttgtcggtggggtgatctctttggatactttggtggattcttgggtgagctagattgatcggtgagggtggcacttgctcgccatcttcaccttgatccacgtttgaagtagagggatcgtcggcttgggttgatgtagttggctccacttgtgtggaggaagaggccccttgttgtggctccctaggacgtacgtccccaagagccaacctcttgattgcttcactcgggtcctcctcttcacctaacacatgtgagtcaacttgctctacttgagagccattagtttcgtcaaatgtcacatcacgcgcgatctcaacaatgccggaggttttgttgaaaacggggtatgcgcattcatttgacccatacccaagcaagaacccctcatccactttaggggcaaacttagaggatctagccttcttattaagaatgtaacacttactaccgaaaacacgaaagtaagagacatttggtttgttactggtaagaagctcatagggagtcttcttaagaagatggtgaagatatagtcggttgatggcgtggcatgcggtgttgacggcttcggcccaaaagcggtccgatgtcttgtattcatccaacattgtcctcgccatctcgatgagagtcctattcttcctctcggctactccattttgttgaggtgagtatggggccgagaactcatgcttgatgccttcttcatcaaggaaactctatatgcacgtgttcttgaactccttgctgttgtcgcttcgaatgttcttgatcttgaggttgaactcgttttgtgctcttcttgcaaacttcttgaagatggcttgtgtctcactcttgtcatgcaagaagaacacccacgtgaagcgtgaaaagtcatcaacaataacaagaccatatttgttacctctaatgcttagataagcaattggcccaaagaggtccatgtgaagaagctccaatggtctcgtagtggtcatcacattcttgaccgggtgatgcgctccaatttgtttcccgacttgacacgcgctacacaccctatctttctcaaattgaacatttgttagtccaaggatgtgatcgtgctttagaagcttgtgaagattcttcataccaatatgggctagccttcgatgccaaagccaccccgtgttggatttcgccactaagcatgtctcatgtttggctttacttcaggaaaaatccacaaggtaaagctttcccttgagaacacccttaaagactaccgatgaatcatttcttctatagacggtcacatcaacatcggtaaaaagacaattctaacccatgaaacataattgagaaacagacaaaatattgtagtttaaagattttaccaagagaacgttggcaatagaaagatcattagagattgcaatcttacccaatcccataacctttccctttccatcgtccctgaagactatgttatcttgtgaagtgccatttggatcaagagttgaaaatattgattcttctccggtcatgtgattggtgcatctgctatcaattactcaacttcttccaccggagacatattcctacaagagatcaatttctagttttaggtacccatacttgcttgggtcctctcatgttagtaacaagtgccttaggcacccaaagcactctcttgatagaaatattcttgctccttgggcctacatacttagcaacaacacgaccactagcattcttcctaagaacataagatgcattaaaagaacaatgtgaagcataatcattaggaatgatacttttggccttaacaaagttgctaagaccttggggcctcttgatcatcacactcttgtccacctttccttttggtggaggaacatacccaagaccctcatggttgaagttgttcctttaatagcctaagtactcctttagggtcttactacccatatgacacttaagtaggccattgtgaaggagtcccataagcttctcattttgcttttgcaaagcactcaatgaaatagagttggtagtacaaccttgaatatcaacatctttgcatctcacacatggttcattacttgggacaattttggaacaagatggctcgctagggagagagacactattttttaaagtttcgaacttctcttcaagagagaggtaagctttgtccaagccatccactctctcttgaagttgagcgttcgccacctcaagattagcatgagactctttggtttgcttgtaaagccgtaccaaagcctcatttttctctctctccttagtaagctcactcttgagttcatgagaccgctctttctcacgaatgagcaaagcctcttgcctctcaagagtagcatattggttctcaattctcccaagcaactcactcaagtgtcatagggattccttagttatggatttgaacaattcgtcatccataacctcatcctcaacctcatcctcctcatcactaacaagatcaacattaaatgacttgagaggagaaggtaccttaggctcctttgccatgaggcaaatgggagcatcctcatcacttgagtagtcgaagagtctcggtggtgatgaaggcttgacagcgaacgtggcgactccttctttatcacttgagcttgactcagagtcggagccaaagatcataccaaggtgagcttggtcataatgttcctgcttgctatgcttgtgcttctccttcttctcacccttcttcttatcttccttgatgtgggaaccatccttgaggtgggggcaatccgcaatgaagtgcctgggctctttgcacacgtagcacactcttgtggagtgtcttccacttgacttgttgtagtgcttggaagaacctcccttgaagaggccgcttcgcctcatgaacttgccgaatttcttgacgaagagagtcatctctttatcatcgatctccgccttgctcttgctcttgcggttctcttcttcttcttcctttgccttcaatgccaagtcttccttcttgatgcttgcggttgagctttggttgatgtattggatgacatccttggactcttgcacgaacatgtcatgggcaaggatacgtccgagcaaatcatgaggtgtgagagtcttgtagtccggacgctcacgaatgatggtcaccaaggtagagttccttggagtgattgcccgaaccatcttcttgaccacaacctcatcggtattgtccttggagccaagtcccttgatctcattgatgatcttgctcaaccggtcatacatgttgcttgggctctcaccatccaacatcacaaacctctcaaattgccccttgaggatctccaccttggactcatgaacactatccgtgccttcatacatgttccgaagcgtgtcccaaatcactttggcactctcaatgccatccaca

SEQ ID NO: 29511 - DNA, 2504 bp, Oryza sativa
agttaacccctacgtgaggatccctctcctctctcaaaccaccctttagtaaccctgtattcctctggtagttcaagctgcaccacacggctaggtggagtagaacccttctggtgtctacccattctcttctggtgtctacccattctctgtattgacatctccttggtggttcctgtgagaaacgaatagatgtaaagcgaacaaagttagaaaatattgtgagaaaataaggattcatgataatcaaaatattcttaccatgaaattgtcgtcaagaatatttggacaaacaaagaaccttcaacccaaagtcgtaggctttatggaacgaagaacctgacaacgatcactgcatctgcatcttgtacgggcttcccatggagcgagtgccgtagttagcacccgccagttgcactgttgttcacgacattgtcgttcgtaagccgcttgtaacacacctaagatgacatgcgcatacatacatctcagatgcaacaaatgcacaatgtaatgttcatgtggtatttctgaacaccagttagaaaacatgtatgcttggtaaccactgacactgtccagtaatccttccaattttcccttataaacgtgcactctccagggacacccatctttttccttaacacacctaacttcatattgcgaccagttgaacttggcaacccaaaactctctatgtagtgacactgcaaaatgctttaccgcctccttcatatcttctgctctagtataaatcgcttcctgaataacctcattttctttgtgggatccacgcttcttaagttttgaatccaattcctttttagcgtggatgtgaacaattaatcttgaggctacaataaaatctttgtattgcttcgagtatttgttgtccgctaaccttttgcaggaaataaaaagacaatcaaggaggagtgtacaataacttcgaacacttatatcacgctccttatctatgagaaaagatatgcatagggaaccaagtagaacaaatgcaaaacttgttgtattcttgcattcggttcaaaccttggtaagacatatctggtaagaatctcatacaccatgtgcatcctcatctcatgtctccatcctgccagggtatccagcatatccattgttgccataaaaaaagataaaaaaaggaaaagaaaaggaaaaaaataaaacaaaacaaaataaatgtggctccttggtcttccaaccaagtgagtcctttttccttcactcttgtttttgtttttttttgtgtccaataaagcctagcagatacaaagacaagtgtgggggggtgatcttgcacattaacggcataacaaaagcaagatcaccccagaagtgatgagccatgatgaaccacacatggaaaattgatgcagtcagacctaatgaggggtctgccaaacctcctgttcggctgaaccacctctaccatgaatcgtcctctgttttatacagagtgcaggtttgcacaaattttcctttggacatccattctatcttgagtttaatttgattatcagttctaaaatatcaaagataattaaactcaagctagggatggtacaattagagttcatgatctccctgaaaataacatgcatgcctattattcttagctcattacttgttgcttgtggtgatatatccaatagggaccctatgttatccagacaattgatgaatgagatatagtctgatgatagaaatcctgctcttcatgttgcacacttgggaattttataaaaagaaaaaaatatataacgatgctaaactcctcattgatatttttattcccactagagccataggttgatcagtcatgattagcttgctacatacgttgcttgtcattacattgagcgttgtcaagttttgtgaccctagtgaaatgtttttcgtactctcatggtcaagatcatatacactccacatacacgcacttatgcttgacttctacattggaagttagcatttctcatttaccattcatttcatccatagtccacaaaataaatactccatgtcgtttatgcctcttcctccaaagttctttaaaaaaaagtgagagagaggcatggctatgcaaaaagaaaggaaaaaagtgttcatacaagtgtggagcatgatgatgaaaaaaaatggaagaaaaagaaaaaaaagaaaaaaaatagccatgcactctcccaaatatgaaaagagaaaataaatggaggatgataaaaggagttatagtattttcttccacccacaaatttaccatagacatacacatgcgcattcttgaccagaaagtatgacttgtatttccatagatcctttatttgactttgcaatatatgtgatgcaagtaatgctctactcttttccataccccttgagctccacataagccttattagatggtaggaaaagaaaaggcccaatcatatgcctttgtgaggaatcataccctttgagagatcaagagaatccattaagga

SEQ ID NO: 29512 - DNA, 4152 bp, Oryza sativa
cgaccgtcaatattactaaaacaggagagaactagtgatgcttgcaatgcataaatatgttagaacaataatattccactattattaggtctactaacctttttgcagagaatgacaataaagtgaaggagaatcaacatcaacaccaacgataaatcaatcagacgatgtcgaggaccagacttatgtatgaatgggcaaagaactcagaattgacacgatgaattgggccaaaattcacaagtctgaggagtggagcaatagaggaggccaccagccgaaattgggctggattgggccagccccaggttcggccgaacctggtggttcggctgaaccaatcccggcgccgttgggtccaggttttggcttggacgtccaggattgcatcccaatgacggttggagggcacttcggacaattccccttccacaaccgtcatacctacctctatataaggagctcactctcttcacttcaacacacacctcaagcaagagctctctcattcctctcaagtttagtttagtagtatctagctggtggaatagaattagaataggaatcaggagtccggaagtcttcggaagagttcgggtatggctctagcagctttcctttcctcttttgtcagatttgtaattttattagaatactcttctatatacatttatggtattgaaatactttctgagtatacgagtacctactttacattatgttcttgttatactgaatatactgctagcttatctgggagatgctttggtgcgggtataatgtttgcttatgcaattactctatgtcatgatgatgatattagagtagtatctggtagtttagacgtggtgtctagattacgggatatcattatttggggttatatattgcggatgagaggtgggccgctgatggtgacaactcagtacgggtattcctccgcgcctatatatatcctaagttaattttctggggagggtattcctcagtatttagccctggttggatggtcatgacgggctgtcgtaaggaactcggcagtcaggggtggcttctcgaagtaccaggagggcatcgaatagagggtattagctagtatatcagttaactagaatgtatgtatactatgtatattagaagtattggaatagattctctttctcttttctttccacctagtttagattatttattatgaggatgagtagaaatgcttgtgtgtcactctacccatggattatcttaacccctgcttagactatgattatcacaagtaatatataatttattagttgagttctctctacatgattttcccacgggataaaataaatacgatacccttggaatactctcgggtgaaatgctacaatggtatatccgtgcgcttgcggatgaactctgtaaccataatataccagaagtatttctgcgccattactgggaattatatttctagtaatgtcgttaagaaataccaataagcatttcttataataaaataaaacatgatatccaacatagtggtaggtattattactaatcatttgcactagtgttggtgaaatatgcgtatgcaggtattttgagaagaaaacacatccgtcaagcgacaaactgcacctccgcgcattcaggacacatttacacggattggaggccccataagtcaattaaacaaatccaaatgggcccaactatcatgccaatgggctgagggcctcaaaattagtgtccacgatgaaaaacgggccgaacggagccatcccgggagttcggccgaaccgttttggtggccattgatcatcaaattttgcgtggacggccctgatcacatcctaatggcggttctggggtagtttggtcatttcgcataggctgtaatcgtcatacctgcctataaaaggaggagctcactctcatttccaacacacaactttgagctgaattacaagaggctctattgtatcttttatacattagaataaggtagagagtgaggggaagctctggaggagtgcccggaagtttggcgctcatccgacttctacctcaacgagtgtagcttcgtaggaggaattctggaggagtaccggagctgtcggtacactctgctccaggttcggagaacttcttctataaagtaagcattcgtgtttctttcttatgttatttaattactttgtctaagtaagatatatttgcatctttgtgggttcattgtttagtatttatactaagtgctctagtactaggactccggatagagaaggaagttcctgcgcaagtattagagtagtaattaataacttagacgtggtgtctaggttagagattacctttgtttgttgtgtatcccacagatttgtcagaggtagtcggtaggtggtgacagccctgaattctgtcccagaaatcctccacgttcggatgcatcatagagctatagccggaaccacgctggtagaccagcagaggtcggtgcccgaagcaacagataggaaattaccttcaacttagcttaggtaattaaaatacatagaaagttctctgtagcctgcctacctatagttgttgtccttggatcgtcttagccttaggtagattacacacgttccctgagttcgatatcctttaggggtcacccgaaggtgaagtgctacagcggtattccgtgggtttccggacttatctgtggttgtaagaaataccaacaaaaactttcctgtagggattagtccacagaagatatatatccaatgtccatgaacatattaactctgaaattcattagtcaaactaaactttatgtccaatttgattaaagtagactattttgacctaagcaccatgcttaatttaaaaagcctatagatgtcttgcacgaacacccaaaatagagcatatgcaaatagacaaaagaaacataaccatgtaggatcaagtctcattcaaatgaagataagtatgagtaaaaggaatggtgaaccttgtcttatctttcacatacctaagtgtacttgccgccagcatgatgtatattttgaaatctcgggggcagtggcatggtcacatatgattgtcgatttctcctccatctccatgcagattgtaccggaggaaggtgctttgaccatgcaaactcaggcaagtagtttagtcatgcacacacctcgggtgcaagaaccttgtgccttgaattcgtgatccgttggcacattgctgtagagacgtaggatacatctctttttggaaaatgtgcaagtaccaactagggtggagcatcaaacgcctaaaaaaaagaaagggggcaactcatctttcttgtatgcacgtaagtgctgcgggagcgagaagttgtgcatagctaggagtggataaaggctaagccaaggcggcacatgagctcgagagagcgactaggtgtagccaggcagcacgattgctactagcgaggtgtatagccatatttcaaagatacgcacataatgcggtctttgatccaaatatagctcgtcagctctcttgctcttttcttctcctcccattttttcttcttttcttctgtctctcttttctcctctttctttttttataatccttttttttctagcaagctagtactaacaccaacttcaaactaagatggccctagttgatggaactcgtcatgaaaagctcgtcgaccttcctccccccctgccccacacacacacacttggacttttgtgtcgcaagacatcaaaaaccaagtgtgtgatgtcggattctcctatagagtgtgttccaataccaatggtcaccaaagtgtacagttgatgtagctaccgtgttcttaagcatcgcatgaccctcgttcttaatctcaacctaaaatggttagcgaccaagaatacctgaaggtgcatattatcctaaaaactggttcttgcttttattagaaagaaaacttaccatagtaatctgggctatctcccggcagtgctttgtttatggtcacaagcttgaccatggggacatcgctctgcaagattagtgccacaaatacgagatttgcagtatttatgataaatataagcatctacaaccattcttctaaatatgttagaaatgaaaaccggaagatggttgtggtcctcgcaaagcgacgtg

SEQ ID NO: 29513 - DNA, 56793 bp, Oryza sativa
  unsure (1)..(56793): unsure at all n locations
actttcatcacacatggaactcaacagtgtgatgcactcaccgatgctcacgaccctactcaaccgccaaaaacgtaatgattttcatttaggttcgaacccattcaacatcaatgatccaatttatggagggtttttcataagatttgaatcctatggaaagattttgtatttgaccctttggaacaaattgaggcttttagaatggtgtgaaatatctttcgaatggctccccaaaactagggattttggagaaccccaacctgatggggtttttttttctgagtttaatatctcctcatttttattgtgtttttttctatggtttgtctatacgcggctatccctgtattcttgtgtttcgtagtcctccattttacacattatttcctatcaaagcgcaatgatttccctgcatataatttaccattgatgtgtttaaaaggagttcctgtatatcttgtactagctttaaatttattagctgcgcaagatagggttaacttattgaaaattgttactccaactattaaatccagaaaattagagtttagttgttattgcaatatctgtaatgttaggaaacagcttgagaaattgtatataaggtttaggttctatatagttcatcaccacgcaggtttttatggcatctaaccgccaggaagattaaatttccacatccacatattatcactatgattccttgttttttcgcacttccctatatgattttgacccatcatgaagtgttaaagcacaccaatgtgacaagccacgtgtttatctgtatgtaataagtgtgagagcatttgacgaaagttatatcatgacacgtgctacggagctaattaatcaagaaactacaataaagtttacgagtgtagcaaaataccaaacgcacgaaagctttaccgtagtttcttgattagctctgtagctcgtgtcatactgtcatgacacgattttttgtcaaacgtcttcacacttatcacatacagagaccaacgcatggcttgccacgctggtacataaattatgttgcaattaataagtggctcttattaaacggttataaaaacatgttcttttggacatgtctttcaagttgaattttcaatactatgtatttctactaaaatatttagattgcatgtataaatatcaaacaagttgatcatgtgttacagcaagtactttcataacatagtattattagttttttttaagtaatacaaatcaatatgtatttggtgggactgccaatgtccaaatgtgaacgaaggaactgtccctttgattttagctctggtaccacaattggtggaatagcccaccctagaatgggtgcagttaaccaaacgaaaagaaaagcaactagctagtatattatatatatatatatatatatatatatatatatctcagaatctaggtactacatggtatatatatttcatcaggacttccataaatataattaaaaccgatgcctgatgatcctttgaccatcaatgttattgtactagatctgtagtgaaatcaatacatttttgctaacaactagggctgacttcccttcttcccaacctggccaccctcttaatatttcttgtcttgttccattgtttatataatccccacacacaaccattcactagtcagctaggtctctgctcatgcatgcacagagttttttttaattaattaaactcccctagcatgtgtatgtacgtgcaagctgtgattaatctaggattaatgcatgcaaaccaaggtcttttggtgtacttgcaatcaagaggagggctaaattaatcaaaagcaattgtccccatcctaagccatgagagcccctttactagatgtatgtgcctattttttttttccttttttgatgctagatgtacggtgtaggtgcctgttttctttttcatttttgatgcaaaatgtaggtgcctcgtttgaccagacattatagtggtattgtccatatgcatgctaagctctatcagattttcagagctcaggtcagaaagaagtagaaggccagtgtaacagtgttatagcagctagcagcactgcggcagtatcacccaatcaattttctgtggccaatttggccattgctgccattatgaattgccaatctgtattgtatagcattgcatgggagagggaacaaattgctacaccgaattgcttgctgcccagcccggacatgtaacgaggcagtaataacttgtgcaccagccctgaatttatacacctgtttgtctgtacatagtagtacatactactagtacaaaatacaacgaataatgctacacgcaccatggcgctgctaaaattacccccggtaaacggtggccgacatatgagccccctggtcccatgtgtcggccgccgaacgtcggggaggcgtagcgatttgtgaatttggagggatgactgtttggtaagtacatggtgcaaaattgaatgcagaggcagatgggatgggatggaggtggcgcagctgtatagaggtagagaggagtatctaacaattgccaatggtaggggaccggagacctctgaacaatttagtcccttgttgttgtagttgttgttcctaggatcggtttggagttattgccacggccatccagttcaccaaaggcactgggaattgtcttgctttcctcctccattgtctccttgcaatttcaggcctctctgcaaattgcaagagatacagcctacatttaaccacaataatacacgctgttggtgagcatagaacatttaagtgcttttcatttcatcatgtgttgttggagtaatctaaaaggacaagcgaagattttttttttttggttcatcctggattgatctccaattctccattttctccttgcaatttgaggcctctctgcaaaactgcgaaagatacacctacatttacccacaacacatgctgttggtgagcaaagaacatttaagtgcttttcatttcaatcatgtgttgttggactaatccaaaaggacaagtgaagatgactttttggttcatcctggattggtctctcttttttttccctgttaggtattgcattgtggtcttagaccaggccggccaatgataggagaagaaacggagcagaatgagttcaagagcgatcctgatagatagcttgtgttgtgtgcactgctgcaattcaaagcagtgttgttttgtcatcttggacgcatattgcctcaaaagactagaaaaaacgtcagtagcaaagatttgcagatgctaccatatcgagaggacggcagatgatctcatcttgatcatatcatgcaatggtccaaaattccaggccagaaaaggagttcagatggtcggtcactgtggcactgcctggccatgaaactggagcaaacagctcgagaacgcagcccattaaattccaagaaagggttaaatatgaaaagttttgcccgtacaggacaaaaaatacatgcacacatgattcagtgacaccatgcatgaaattgctggtcttatgatctttccactccagttcatgcattcagtattcagtacatgggacacgctggtgatgatcatgagtcatgacaacaactcagtaggaatggttaacaataagaatggggcatggtatgtttaaagttcgacattatcagctcggcgtgtcaatacacccaggccacaaccaagaatcgacaaaatgtcttgtgtatgttaaactgagaaagctggtgttattttgtgacattacagccaagattggtcctgaacatgataacttgtttgaacctattaccacattgggacttggcaaacagctaccaaatgcaagcacatagggagatgaagttactgggctgctgtaccaactcgggtacattgtcaccaagctccaaaaatttgcatggattcctctactcaactggtttcgaggccaagatcttgcagacaggcatggtctcgtttttactcagtaacctcaacgacggatggacggggatgtcattcattgataccctatctccaatgtcaagatttgccaggtccacctcaatttttggagggatgtgctcagcagggcagagatacaccaagctggtccttattttctgcaaaaagccgcctgtttttttcaattgaattaaatagtcaggtcaagcatagaaagacaacaattcagcaattagacacaaattacttcaaagaatagcaaagcaagagttagataatccacataaagaggtaaacactgccacagatattgaaaatgtgacatgccatagtatatactgcatccgtcccaaaatataacctaggaccggatgggacatttcctagtattacgaatcttccggtcctaggttcttatattttgagatgaaggcagtacttcagtatgactagttatatatattatccacatgtttgtgtggtgccataggcacaaaatcatggtatctagttaaaagaaaatgacgaagcaaagagcagatgtcctagttccacatgtaaaggcagaatcacaccagcaaatcagatacatcacgattgtgtcttgagaaaactagactgagagagcaccaaatatgactaagtaaagcaggtagatgagttgtcactcccatctaaagtgcaacgtgtgcactcttatcaggcagtcattaaaatgtgtcactgctcagcgtgaaatcaaatagtacaattatgatcaagaatatattagcaactcttcagattggccatatgaaattgatatatgtatgtttcacatgaaaacaaatatcaaaatcttaaataaacaggtttcaggaatgtataatttatagcaaatggtatatgtcacattgcaaagactgcgaaatgaaaacgactccttttcgtgactggtagcagtaaagatcatgatttgccaggtgtacacgaaaacactggtaaagcctttaccaatatcataaaccccagaattagatgcataacatagcatagcaccataaccataactcagataccaacaaatatgtaaatgcaaggacaggggtacatgttaaattttgaactcctgtgccaaccacttgtcctcccttggctaagagtgactacttgtgctttctcacatgttctcttcagctaccgtcagtttggcgctaacttgattacctgaaaactactcaaacaatttagggcattcttggaagatcccccaactcccaagcataatcttaaacctgctacaagcttaagatatcatgctccacaaacgaggagcgccattgtaacagagtttttgaaagattaaactacattttgttgaagttttaaattccatttccatttttgtttttgagaggctagcttaggtggcccagaagagatgataagctcattgaagccggcattgaggccagtggaaattgaatgtcggaagttgtccccctcataaatcgacccggccttacaaatggtaagcatattcgggacctattgattgcgatttatcattgcagaagtaccaaagtcacggctcgttccttacacgaggacttcgatataaacaatgggaggtggcagaaaaggaccacaaacccagtcgatgcggtagtaaataatagagaagatgtgtgccacctgcccacttgcattaaacaaactaacttccagaatgcagcagacttggtgtacagatacttagaatgcgtataggatagtaatacatcataatggaaatttcgtactgttcatcatttattttgccaaatcatggagctatccagaattattaaggcaagagtcctatatcttaaataagaaaattgatgcccctctgcaaaacttaggccagcaatacagtacaaataatatttgccaatttcactggaaagggtaattaattttccacttgatagaattatattttttttttatagaacagttactaggaacgtgcattcgagacaaaataaatatcttaaaagaaatctacctacacacaacaccaagagtaatttggtccctacaagtccaacatcttaacagaacttcagattaggaaacaaaaagaaataaagtaaattgcaccatgttattcactaatctgaattgaggaattcacaatagaatgcacatcttcagacaataagaaagtcatttttttattctgttaaatagaggaatctgagctttgcctggtaatggagggctcaacaaagcccattaaactcctgatttggatattggctttcaaaaatgttagctacttttgtggtactaaaccttgatataagacaaatagatgtgggaatctcactgcttacgcttagaacctccaacaaacaagctattttccaagtgaccacttacacaaggtcagcaactcagcacatctgcttggcaaaaatcccatgtttgctaccactcaattatgggctcatgtgcaagagcacctcattatttttttgtccccatccaggctccaatatcaactttgagcacaatgtgcttacatgcatccaaccaatgcgcccatactacaaacttgccaatcccatgggttgacacgataagcaaaccatgccgacaaccaagggcaggcccaggcctcaggcctcctgggccatggcccgaggcctaggattcaatgttcatcatgatgtgcatttttcaccatgcgagacacacagaacaaggtataatgggtcggctcagttcttgggccaatcctgggtccagcactggcaacaactccgttcttcatttttcttcataaatatcgataagcaagctaacacatttttcaatctgtggtataacttttcatgtcactgttgagttctgacacaatttcaaacaaatgtgcatacatagactcgtagaataaagctattcaaattcgatagtttacatggaatcacaaaaaatagggtaacctggatctattgatccttagccgtggcatttgggtatctactatctggcctgtacttttcagcttattcactggattattgaaacagattatttgttccacgcttcaaaaaatatgttttctttaaaaaaaaactttcttcaactgcattgcttagagccttagaccgcttactttaaactatttgttaagtttatttcgtaaaatatttaaattatccctataatcaaggagataatccgtggcaataatccactcaatgatctaaataaaactgggcctagttacagaagggcagagttttgtgccaagtgttaagcatcatgcaatgcacatttctatgttgagattccataaaaacataagctatcatcttgtatatagcacagggattttgccaaataaaaagaaaacctatacctttcttcaacccagggcagacgtcctcccccttgaactctacaggcaagttcaccttcagcattgttccttcatctgcctccaccagcaccaagttcaatatatttcctgttgtttcgtctctatgcacctgcaaaacacaagagcatccacatcaaccacaatccattttatgcaagatagtgcagacccggtcctgacgcacaacatatctgaccaatttcttctagcactctcgcatatatagttgcgaaaccacaccagtggttcccccagctttctcaggataaaactgctcaagaacagtaaacaatcatataaaaagaaggattggttctctgcactcctaaactataaggactgctacgtatctgagcaatttctccaaagtaagcactacaaaatactaggaagtcgctaacactagtaacaaataacctaacagccagcaatttgccaggagaaactacactaataatgcgcatttcgtacacagggtgagcaaacgaatcgacacggccaacgccaactgagctgaaatacgaaaagatttcctcgatgcgcaagaacgaatgaacgagatattttttggtgggtggaaaggacaggaatggagaggggcgaagaccttgatagggaggacagtgccggagtgcacgacggcggtggatcgctcgccggcgcggacctggaggcggacgggggtggagaggaagtatggggactgcttcagaatctccccgagctgcttcctgtcggcggtgaggagcttccggtgggccaccccctccccggggccggcgccggcgagggcgagtagcacggccgggacgcggccgttgcggcgctcccgcgccgccgcgcgcgggccggccgtctcccgcggcaacgcctggatcgtgtggtggtacgacgccgaggccgcccgcctccacggcgccgtcgaagcgccgcggcggagcgcctctccgacggcggcggcggcggcgcggcggaggcaaagcgccatgtgtgggggtttagggggacgaagagagttgggcttggctgctggttgctacttgctgggccgtcttttgtatcctacagaaaatgggttgggaaatcttatcccaccttctaaaaggataacttttaatcttagccattcattcttcatatctcatttcatctcaaccctccactcatatctttgtcccaatcccatccctcctaacccattatctaaaccgagccttagggctttcttgatttgggaggctattttatcccattagacggcagacgcacacgcccacacaccactacacaacatataagaccattctcaacccaatgactagaattgtgtccatagtattaaataaactatcatctacgatgaaaaatgatgtggcaagtgaataaatgagaaaagagaaggaaaccatgtcttccacgagacttggtttctacccaacatccaagacatcatgtaagataagtagcattaaatttaagtatggagtagtggtgtttgcattggaagagtagtgtctagtactagtttcttgacgatgtggagtttatgaaaactatgtgcagtgtcttaggttggtaatggcctaacaccacactctcacatatccgtaaatgcccccccccctccaaccaacacatgtctagtggcatattcctgatttcactaaaattttattgaaaatttacgaatgtgtgcataatattagtggatgttaagatttgaaccatgtcactaatgaaaaaaattggaagtatcaaattggtactaaattgtttgggctaggctagtgctaaccttaatgaagccactgaaaaatttggcatttgccaaatttgtagctacaaaatcaaatgagcgacaataaatttggatgtgtcaattattaataggattaaaaatggtataaaactaaataaccgcttgaggagaattgttagatggaacgtgagtttgaggggtggattgttaagtaagatatttggatggtctacgtagaagttttaggagagattggaaagaggagtttaagagcaaacatccatcttttcaaaataatggcctacatatatttatctgatagtttaagatggactttccataagaatggcttgttctcggtgaggtctatgtacctagctttaattaataatggctatattgagagaaataaatgtatttggaagcttaagttgccacttaagattaaaattttcatgtggtacttgtttaaaaggggttgtgttaactaaggataatttggcaaggctgttggcgggtgttaaatgtcgattctataccgccaacatccgcataaagatagataataaaacatccaacatagtgataggtgcttaatctcatatattccacaagtgttggtgtatatttgtatgcagatgataaaccccggtgttgggaggaaaatcagactaaagtgaggagaattatgcatccatacaaggaggggttgtgaacttcatcaaaacatcagtgaatcaacccaaaactccgagaaatagacagaggagagcccaaggagtccaccgactgaaggccaggccaggagggcccagcccaggttcggccgaacccccccgatcaccgttgatcctggggtttggcgtggatgctctagatgctcttccaatgacggttgcggggcagttcggacatttccccttcgccaaccatcatacctacccctatataaggacatcatctcactcacttcaacacacacttccaagcttgagctaaactataagaggctctattttactatattgtatactagaataggaagagagtagagtagaaagagttggaagaattccggagttgtcggtaatcttctcctatttcttttattctgtttattactctgaattcaatataatatttttcttgagtaatttagatttatcttgtgagaattatctcttggttagttcgtaaatagcatacgggattattgttcactataatcaactaaaatatagtgattgatttggtgagttataaacattaaagtagatagtatttgcttagacgtggtgtttaggtaattgttatccagtaattgctgcgtgtcccacagtacgttgaggtgggtgtagaggtggtgacaaccctcgatatcactgaagtcctccctgtccgggtacgtagtagagcgacatctgggaacaacgggttgccagtgcctgaagtactgtgttaggattaaagttaagctttccctagacactgtttctcactagtaaatcctctctatcctggcctatcatttgcttggtgtccttggatgaaccggaggaagcgctgatcacacacgttcccttggattcgatacccttggaatactccataggggaagtgctacatcagtatatccgtgcgcttgcggattttatctgtaaccgtatcaaataccaacaagcatttctagcgtcgttgccggggaacggttactaatcatttccgaacccagttcatcctcgtatcctttttcatttttttattctaccttcacccctgctatcttagagaagtattcctgtcaactcttctcgaccatggagcaacctttgtttgagctgtctgctcctcggggtgaattctatgagccacctccttcatcggagcccatttatacaactggctatgaaattcgtcccgagctaattagtatggttagggaaaatcctttttctggccttgatctagaaaatccctaccatcatatgcgagactttgaacaagtctgctcatgccttaagattcgtggcatgagacaagaaactgtgcggtggaaattgttcccgttctctcttcaagagagagcaaagcaatggtacacctctaccgttggatatgtaaacggtagatgggaaaagcttcaagacagattctatcttgacttcttcccagttacccatattactgcccttcgagtagaaattctcagtttcaagcagatcgaaaatgaatcaattggtgcagcttggtccagattcactaatttagtgcagtccggaccaaccctgtccttacccgagtatgtgcttctccaacatttccatacggatttgggtaaggaatctgcattctatctggacataaccgctggaggatcgttcatacacaaaacaccgtcaggaggaaaaacgatcttggattgcattctagaaaatacttccttcatgacgcagtccaatgaacctcggccggaggcatccgtgtccaagatagaggagcctctaacgatcgagccacttgctaaaccatctacttctgctagctcgattgatgagaaggttcctgagcaccgtctgtcgagaatgaagaaattcagactccggattgtgccgcaattatgttcagggaaggttttgacgaagactacggcaataccctgaactattttagcaagaggaaaccacctgttccgttgtcacctcccgatcctatggaacttgggttcctgcgagaaactgtccaggagttgacatccataatgagagacgaatggctaagggaggcagagctttcatccgaagtaattcggataaataccgctcccgaatcattccttgccatctggaagggaacgatgtcggtattctctacagtccaactgtcggggccaacctcgtctctgagtcttttgcattcgcttatttaagtgataaggcagtgacctcgacaaacaaattcttcaagcatccgaatggaaatatgatcgaaggatttgggattgtgcaagatgtgcttgtctgctttgaagacagggaggcgatcttggatttccacgtctttgaagtccaagactttgatatcctaatcgggctgtccattgagaaacttctcatcaacacaccccgattaggtagcctcaaaataacactgggagagaatgaattctcaattctattttcgcgggcaaggatcaccttgaccgaccctctcccagaaattgagtcagcggaagaggttactgcagttcctcctcatgagtctcccgaggcccttctggaagatgatgtccccgacttcatcaaggaagaagcagatcccggtgagactctcgacctgccaatcatggaaccgtcacctcgacctccgcttgagcttaaacctctacctccaggcctacgatatgccttcctacacaatgacagagaagcccctatcataataagtgacaagatctctgaagacgagactcaacatcttctcaccgtgttagagaagcatcgttctgttcttggctactcgcttcaggaccttagggggattaatcccgcactttgcacccatcatattcctattgaccccgagagtactccctctagggaacctcaatgatggctcaataatgcaatgcgagaggttgtaaagaaagaggtcttgaaactcctgcatgctgggattatctatcccgtaccatacagtgagtgggttagcccagtccaggttgtgccgaagaagggaggaatgacggtcgttgcaaatgctcaaaatgaactaattccgcaacgaaccgtaaccggatggaggatgtgtatcgattacaggaaactcaacaaggctacaaaagaggatcatttcccgctacccttcattgatgaaatgttggaacggatggcaaatcattccttcttctgtttccttgatgggtattccggatatcatcaaattcccatccatccggaggaccagagtaagactacgttcacatgtccatatggcacctatgcgtatcgtaggatgtccttcggactgtgcaacgctcctgcatctttccaacggtgtatgatgtctattttctcggacatgatcgaagatatcatggaagtcttcatggatgacttctcagtttatggaaagactttcggtcattgtctgtagaatctagacaaagtcttacaacgatgccaagaaaatgacctagtgtttaattgggaaaagtgccattttatggtccgtgaagggatagttcttgggcatcgagtatccgaatgaggaatcgaagttgatcgtgctaaaatcgatgttatagatcaaattcgtcctcctgtgaatatcaaaggaatccgcagcttcttgggacatgccggcttttatagaaggttcatcaaggacttctctacaatcgccagacccctgaccaatctgctagccaaggatgcgccctttgagtctgatgacgcatgcctaaaatcttttgaagttctcaaaaaggcactcgtctccgctccaatcattcaacctcctgattggactttgtccttcgagattatgtgtgatgcaagcgatttcgctgttggtgcggtcttgggccaaaccaaggataaaaagcatcatgcaatttgttacgctagcaaaactctaaccggagcctagttgaattatgcaactactgaaaaagagctgctcgcggttgtttttgctatcgacaagtttagatcttacttagtaagagccaaggtgataatttatactgatcatgctgctttgaaatacccgctcactaagaaagatgctaaacctcgtctcttaagatggattttgctgctccaagaatttgacttagaaattaaagataaaaagggagtagaaaattctgtagcagatcatttgtccaggctgcagatcactaacatgccggaacaaccgatcaatgatttcttaagagatgatatgctgatgacggttcgcgactccaacccgtggtatgccaacatagtgaactacatggtattcaagtacataccaccagggaaaaatcaacgaaatctgaagtatgaaagtcgtcgtcacatatgggatgagccatacctatatcgggtctgctccgatggcctactacgaagatgtgtgccaactgaagaaggactgaagatcatagaacgatgccatgcctcaccttatggtggtcattacggtgtattccgcacccaggccaagatttggcaaagtggtttcttctggccaacaatgtacgaagactcaaaagaattcgtcagaagatgcaccagctgccagaggcaaggaggaatcactgctcgcgatgcaatgcccctcacatacaatttgcaagtcgagatattcgatgtttggggtatagacttcatgggacctttccctaagtctcgcaactgcgagtacattctggtggcagtcgactatgtctccaagtgggttaaggctatgccgtgcagcgctacggatgcgaggcatgccaagaagatgttcatagaaatcatcttccctaaatttgatacccccagaatggtcataagtgacggaggttctcacttcattgacaaaaccttccgagacctcctacgagaaatgggagccaaacacaatgtggccactccttaccatccacagaccagtggacaagcagaaacatcaaacaaacaaatcaagaatattctgcaaaagacggtcaataaaatgggaacaggatggaaggatagattgccggacgcattgtgtgcatactggatagcatacaagacacccattagaatgtccccatatcagatagtttacaggaagccatgccgactacccgtagaacttgagcacagagcatactgggccatcaggaattggaacatggattttgagggagctggagaatggagaaaaatgcagatcgctgaacttgaggaatggagagaaaaggcttaccacaacgcaaagatatacaaagaaagaacgaagcgctggcatgacaaaaggaaaaagatcaagaaattcaagccaggagacaaggtactaatgttcaactccagggttaagcttttcggccatggaaaactgcgcagcaaatgggaaggaccgtttgacgtcatcgacacctcttcgcacggggcaatcacactccgcgacgaattaggtaacatatttaaggtaaacggtcaacgcctaaagattttccttgagccaaatgaaactttagatgaagaagtggatgttattgaattaattgattatgaaccatgttgatctcatctattgcatgcttaaaaccctgtatagttgtcatttttgtgattaaaataggttttagtgggcctaggaaaaatttggtggcctgccggacccaccagggttcggccgatctagggcggcgcccgatcggccccaattttgaaccttagtctcccccgctcgtccctagtctgtttagatgcgcgtttggaggtagaacgttcggatcacaccagaacactccttcttcctcctttcctccacctttgcacactctcctctccaattcctcgaatttccactcatatccaccaatggctggcaaatccctaatcccattcatcggctcttcctccaattccacttacaacctcaccggagaactgacaccggcgaatcaattgatcccggtggaagaatacaccatggaaggggtaaatgcactatgggcgcagcccctcgcagcagtgccgggctcccctgcgaatctggagcccgtcggcgagctccctggttcggccgaaccttgcttaatgggcccccaataacctgcactatgttttgacccaattctaaatggttttcattgacttatggggcctccaatccgtgcaaacgtgtcctgaatgtgcagaggtgcattttgtcacatgacggatgtgttttctcctcaaattacctgcatacacatatttcaccaacactagtggaaatgattagtaataatccctaccactaagttggataccatgttttatttcattatatgcaagtattgactgtcaaaatattatgatttaaggaccgtcaacaatatgcatgtcgattgtctttagatttcaacacgcaatatgtataatttcattatcctcatcacaccttttgtagttgtgactggaactggagccagtatgttaccccctacatataagatttcattggggatttgtcaaaaatcatatcatatctactaagccataaagctcaacatatggcagatgcttttactagaatatgtttctttgttttcgagtcaatgcccacaagccgattcccaaaaaacggggaagtactatttaaaggtttcaaaccgaaagaaatatgaactgatgttcaaaggaatctagcaaaatggcactaaaaaataaatgatgtataatttcatttttcataaaaaagaacatctactatttgtcatttcaattccttcttgctaaattatccttagttaacattactcctttaaacaaatacctcataaaaatcttttttaagaggcatttttaatttttttttaaattttattcctttcaagatggctgttatttattagagctaagtacatagaacaatccaagaattgaccatttctgaaaattccatctaaataagtcacactcatcattcaactgaatatacacaatagagaccactaaattatgccaatttgccaagttctaacctaaccttacaaaactattctaagggaaacattttgaagagacggatatctctatgaaggaagtattttccaaccatttatcctcctcaaatcctacctttactttagaaaaattagttattttttttgtaacattgctataacaacaatatttttcaaagaaactcttaatgctattttcgctttcaatgtaacccctatcctagaatattgtagagagaagaagagaggccaatggacatgcaaaaccaacaaaggcatctaggatgggcaccgtaattagatgcaagaaatgcaaacaagttggtaagaacaaaacttcctgtgataggcaccatgcagctataggaggtagtaccaacacagccccacaggaagataacaacttggtgctattgaacactccacggagttttgtgcagagcaaaaaaaggaaggcaccaactactgctacaacaagttctgttagccaaacacacaacaacagttcaactaagcagaaggttagatgttttccaattgttcttactttaatttgcatttcccaattctgaacctatatgcttattcacactgtatgcataattttttcaggggcaacatgatcaaattgttaggatgaatgctaaggcaaaggttgcaacacagccaggtggttctgcaacagtcaacctgcaggcaattgtgccatattcctagggttgtacatcagcttcaattcagatcacatctaggaatgcatctgtttcagtctcagctcaagaaccagcaaagaagaaaacatctgctgggcctgctccatccaagaaggccaagactccaggatcaattctcatgctgccaccatgggaatctgacaaactttgaatcaatctatgtgtactgctaagtattgacatgccttagctaattatcctatttgtgatgtaatgtcgttcatgccatatgtcatgtaatggttagaatgctgctatgccagacttgtaaggctcatgtgtgctgctatgcctgactatttcttcttttgctgaaatatctatgaaatgcctaaattgatttggcttatgtcatattgagctgaaatttgctgagttttgttgatttggcctatgtcattgagctgaaatttgctaagttttgttcaactgaattggcacctgctatgttggtctgaaaatattgccttacaatgatgccagactaattggttcattctgcaatttgactacaattttatcatatgtggcctactacacaactgatttgctcaaatttgtatcaaactaatcatttccttattacctacccattttcataatattccattttagagttcaaataacacacatctttcaaactctaacctactattcgtatccttcaacacccctactatagcttccttctcaccaacagccttcctcgatgtggccaactcattcctagctaataccagctctgattgcgcaaatcttccttcttcaacagcagccggaaaatctcccttctccctcctcagcttccacacttcatcgcgcaaatcgttcagcacttctctaaggaaactgctcaacggaccatcaacccaagcaaaataatcgcaacctccactctgcaacagtgaaccaatttaaccctagaactcagctcaacaaaatcatggaccccttgaaccctagaacttagctcaaaaaactcacccttgcattcacacatttgaagtaccagcgcccgggattgtccgagatccgcgaaatccacctcaccgccttgttgccgcacttgcatgccaccgccggctcatactccaaagggccaacccgatacaggatgggggaagcagatgtgtgcctagaagacaccgacgagccctcactcctcgagctcgccattcaccgccactcatcgtgctagcagcttcaccaccgtcaaccgtgccgtcgccgtaaccccccgcgccgtaccgctctccgccgccgccacaacccactcacaacaacaatggagaacaaacgagcgacaaagataacactagaagagcccccgctatttattcccaactaccgtcgctgagtcagcgatgttgaccgagtcaagcggccacgtcagcgaaaaccgcccgcaaaacagccatgggagtcggtttgcccgggatttcaacgtttaggggtcaagatatctggttttgcggtttagggtcacgttttagattcggatcacttttgagggtcacgaagtgaacttattcctactagaaaatctatgtgcctattaacgcacccactatatagcatgtttatttgtttatcaatgtgcctattagtttattgaatatactttactttacaaaaattagttaatttttttgtaacattgctataacaacaatatttttcaaagaaactcttaatgctattttcgctttcaatgtaacccctatcctggaatattgtagttaattgtgttgttttgtttttaagaaaacatataaaacatgttcttctaattttcctaatgttcacacttctttactccatattttttttgttttctttacttttcctcttctgttttttcttttcttaatgaccaaactaataaatatgtttgacagattttctgtcagatccctaagatcgtctatagtatcactactaaatgatgggacccgtgagggtttctgtcacgatctttcgatgagaggcggaagatgacaacctggccacgagggcacttgtcctgcaagcaatcgaaaaacaagtagtaacaagtagaacaagcactgaattgctagatgaagatgatgtttcattattaaaaacacaatatggcggagttccgattgcaagcaggcaggcggtttagccaacacgcgtgttgcgagcaggtagcaagtagctaactctaataatcaaaaaccgattgttcttagcggcagctaagggtataagagagggggagaacgaccacagaggtgttagggtcgtgctctatataaactaggtgaaaccccgcgcattgctgcgggaatttagtataaagatatacatcgaaacattatgtgaattatgttggatgataatttaacaagtttgtgtttgaaaagctcttaaattataaaaactataaagatatagcatgtttgcatgatgtttaaatgtgatgattgttagtggatgatgatgtggcatcttgttaattagtggatgatgatgtgacatctttgcatgaagatatacattgaaacattatgtgaattatgttggatgataatttaacatgtttgtatttgaaaagctcttaaattataaaaactataaagatatagcatgtttgcatgatgtttaaatgtgatgattattaatggatgatgatgtgacatcttgttaattagtggatgatgatgtggcatcttgttagtggatgatgatgtggcatctttgcatgttaaacttaaggaattagtgggggataactttatagtaagataggatgagggggagaacgaccaatctagcttgatataactatatagggagatatgtctatataagtggcaaatataaataaaactttagtaaaggagcatgtatattaggtaagatcggctgaaaccccgatactatccttactaacaatcaagaagcaggctagagattatggttcgaaacacgacttagtacatcgaatgtattgatgcaacacttagtatgaaaagaaacatgatatctagacaatcaagccattgactgaatttttagggtggtagatgtctaagctaatctaatctagcaatacgatttagcagataccggcagaaaccctaaagcgagaagcagccaatagagctaaattgatatgctaagactagattagcggagacatataataaagatggtcacgatataaggactaaaatatctaaaacgacatagtagccccgatagcacaagccatcgagatgggttacctcttgcgaagcgaactcgtcgaaaagtaaaagcgaaaagggtggcgatgcgctgaagttgtattggattgtctcctgtattacaatgttatgaggttcatatttatacccgagtacaaacttagtccattatggacacgactcgaacctttctaaagataaaatacaaacaagactataactatcctaatcaatagatacaattaccttaattgagctctatctctgtttgggaattgtttgggaatgatggttatcttaatataggcccatgtcgaccccaagttatctctatcggctgtttgccatatcggccaaatcaagcctttgtccagtttttagccgatacgatactcagctgatgcacagtccgacttggagataaactcgaatccacaccaaatctgcctcgatctccttccttctctgaatctgatgcaaaattccagtgttaacacacatccatcatagaatctgaagaaccaatctttgaagccctcaattgattaattttctctaggatacacaatggcagcttccccaaaggacatgcaccttcttgtgctgacatcttcatcatcagtataagttgttgggaaagctgacaaagctaatgatggccttgtgtacatgttaatccacagctgcatgaaccaccaaggacctccataattgattactttatcttctaaatattgcaagcaacagagtgaagcattcgataaactgagccaagcagatatttccttagaggaatatgcttcttctaaaccaaaaattgagcaaagtgctgatagtttgcagttggcccataggttgaaccacataatacatctctttctaaccacatggccaggaatgcaacatgttcccttaaggaaacagatcatgtgccttgatattctgctatgtatcctttccaacctccatggatctgttttacacttaatgtccagtttgaaggggttgatggaagtcgtgacattcagacttgttagcatcttgacatgtaacaacgatggagtcatggggccttgccagaataagaaacaattgagtgtatttgaccagaagtaggccgcagcagatagcatcggctcattcttcttgacgtgtaataccccagaaatatccacaagcctaggatgccactaaagaaacctataaaagtgccaaaacaaagaaatttcggcaacacctctttatacacacacacaccatggtgccccatatgagtgtcatatatatatatatatatataggtatccactaacccaccgtggcagaaaatcaaatattgatttttcttattttgcaaaaatatgttcactgcgcggttttcgtggcgctatgttctgcatgcaaggccatttgaaagttctgcatgcaaggccgtttgatcagggaagtgttgaggttgttaccgggatatctatttaaaacggcggcgaggtaggtcagaagaggaggaatttgtgagcagaagcagatcagttctgcagaaatttgatggagcagaatcttttggggtagagggcagaaactcgtcggcgagttctgttgcttcgccttccgcggcgacagaaggcggaacctcgtcgacacatgatgtcgcatgcagaaggcggcagtagccgttggtgcgtcctcgccggcgagttcaggcgagcaccacaagccgacggtggaagaatgtggaaccgcgtcggcatctcggcgagtggtgacatgcagcagaagccggcggtggcgaaaggctgatccttgccaacgagttcttttgctcagcacaagcgggcggtgccggaggacggaggtctgttgaatggacacgaatgtgtgcagaactcatcaactgattggtacatatcgaagattcgaattggttgatgtgctctttataattttcctcttgtttgtgtgtttggttctgactgtgtgttgcgttatttggtcaggaatggttttgtgcaactgtgcattgcatggctactggtgacaggagtgaagtgatgaatcgctctctccagagatatgacatccatttccagaaatagtcacgcagcttgcaacatgaatttcagaagttgcggagcacccccggcgccgcagaagttgttccgatcgaacatgtaaccaaggagaacatttagccggttgtttaatgagcagatcatatggaataatggattgctttctgcatgatcgttgattagtcgtacgaactatctatactcttttatgatattttctatgagagaaacgcgactaatatttgagttgagttttctgtaacttctgcttgaaataaaaataagaagttttcctttgtttttttttgggctattttagcttattgtgttatccaaattctctgttgtcatctttgtccgctatgccccatcctttttttcgtagttgctgactgtcgtgtgaactaagagcagaatatgcctcgagtctgtggtgtagttttttgtcggacaaatccgtgaattggagcagtacaagttcttctgcttcttctgcggatgtagcagaacatggatcatagtttctgcttgtgtttgtatttgggtttagagatgtagcagatcatggcacagaactgggagcagaacatcacttctttttttggtttagagatggacatgcactgctttggagcatagcatgatctgctctctgatttctgaggagcagaacatgtggcagatttggtagtttctgtttgtgtttgtatttgggtttagagatgtagcagaacatggcgaacggcagaactgggagcagaacatgacttcttatcgtccagcgtgatcgtttctggtaaaaacataaacgagagccaccaccacctgatacattcgcacatgctgcaggactgccaatgcaaaatactccctccgtttcgttttatttgacgtttccgacatctttgtcaaaattaaggaagctgtgaaattacatatttgcccctgtgtcttctcctcatcggcgcaggaggaatccccaaaaatcgaccggcctccgacatgccgccgcggtgggcggcctcctctccgacctccgtgcccgtgtctcccaggtgcgggcgtgcacgccgccacccgccgggatcccctccctctcgtttttgccatcccatcccgccgggcctgcttgaccccgacgcctccttcctcgagctctcccaggtcggaaacgccggccgccgcgccaaccaccggggctcaccccaagacgccggcgaggccctcctgctccaagcaccgtgctcctgtgccttctcctcgtcaagccgcaacatcaagccgccgccgcggaaagaaagaggcggaaacgccggccgccgtgccagccgccggggctcacccccaagacgctgccgccacccatactcgtcggagccgtcgccgccacccctccttgccggagccgccggcagcaccattctcctgagccaccgaaaggtacttctttttttttagagtaaagtccatcaccggtccctaaacttgtaccgctgtgttatcccggtccctaaactcgcaaatcaaccattcaggtcctcaaacttgttcgactatgtcatccaggtctctaaacttgcagatcactcgtttagatccttcaacttgttcagttgtgtcaccacggtctccaaacttggatttgaatatcatctgggtcaaataggacggtctaaagactttatatttaaaaataattcataattttttcatgtgaaatctaatgaaaacaaactttatatcaaacttgtagccctcaacgcgatctacaactttgtagttgaattttttttattgtaagtcatttttttgtcccaaaatgtaattttaaaattataatttcaaaatctataaacatgcaacaatattttgggaccctatacagttttaattcaaaaacttttcaactacaaagttgtaggtcgcgtcgaggattacaattttgatataaagtttgtcttcattagagtttacatgaaaatgttatgaattattttttatataaagtttttagaccgtcctgtttagggaccggggtgacacaactgaacaagttggagaacctaaacgagtgatctgcaagtttagggaccgggatgacacagtcgaacaagtttgaggacctgaacagtcgatttgcgagtttatggactgggatgacacaacggtacaagtttagggaccggtaatggactttactcttttttttatgcagagttttctgtgctccgtggcttgctcattaatgccatctttgttcatttattcagtgtgtattatgaagttcataggactagtattatttggttgctgtttgttcatatgccttgcttcaaagtttcagagcttgtattttggactgtgttcttgtgatcaggaaggtacagaatgcggcaaatttgagttctctctgctatttggagttccctaaatccacctgctgtaacaatcctgagcatatgaaatcagcaatgttacactttatgctccctagcattgtttgttaaaacttagactgtaaagtcttctgaccaaatgcttgatgtgtattgatcacatattatcggtgtcttttctctacaggcaaggagagggagaatcagtgggagaagaatgatagaggaaaaataaacatgtgttcaagtctccttcatgtgtaatttattctaagattaatttattcttggattatacctaagtattctagcttaacatattgtgctactctacattgtactccctggtactcagtgaatgttgagctcagtgactacccaattttactcatgtgctgatcatttattcgttgccaaaattgtgcttcagattgctttttggtaattgaaattgctaatctgaaacactatccagattagcaattgctggtgctgttgttgatatgaacatgtcactgtctcttgttcactactgtctcttgttctgcatgattctccactgtctcttgttccatatactcctgcttgctgtgtgagctgggattcttgattcttgattccggatcggtgactactgatgcttatttctgaccttgttatatttggagaaaaaaagttggattgtgtaaaaaatcttagttcatttgcattcaacattcagtattccaatttgtaatttgtaactgacaatacagacagactacagatacagtatatgatttcttccaattgacattattcagccattcatattgccattattccaattgatattacagacacaattccaaattgtcttacttacacaatacaaaattttcaagctcacaggattctattgaaaactactccaaaatttctaccaaacaatttggcactacacaaatgctcaaataggcatgctcacatctcaaatttctaccaaaagttctgtgttaggtgaggtatcaccatctgtgtgttacatttagcaccaagagttccagattccattgtccaacattgtccaacgcattgacaacagcatccaggctctcccaaaaggcatcgttgaacacattttcagtctcaggacttgctctgttctgaagggaggttgggattattgtgacttcatagcactgaattgcagttgcagttatccaggtaacccaaaatgaactgcaatcagaaatcaagaacatgttcctggaaaaagaagagaaaaaatcgtctgaaaaggatttaggtgaagttgataatttgtcgacgaacaacaaacaaagaacagaaaccacaccagggcaccaggagcgtatgttctcctcctcgccggttgcgggcaaagacacatcggatgagctcgtgcatggcgtgccgcgagaatcgctgcaggagctcgcccttggcgccggcgtggtggacgacacggatgcacgtgttgacggcagtgcagacgtgctggttcccgagggcggtggcggcgggtgcgcgcaggcaggcgagcagcgactgcagcatccgcatcagcacggcctcctcggcggcggcatcagccccggcctcgaaccggcagctggcgacaggcccattcacgcagcgcggcgctcgtgagggacggacccatgagcgccatcacctcgtggagagcggccagcgacgccgaggtgaccgcggcgccggcgtcctcggagcggaccgcgtagaggaagggccgcagcacggcggcgggggagaagacgaggcggcgcagcgccttgagggaggagacgagcgggtggtccgccgcggcgtcgtcggctacggcgcgcgggtggcggaggctgcggcgcatgacggccagcacggcgctggcctcagcggatatcgcgcaggcgaggccggcatccctcgcggcggcggcggcggccggatttgaggaatcagggcgaggaggagggcaaagatggaaaccagcagtatgactgaactacagcgtcaaataaaaagaatgatttcggattgacttagcgacgtcaaataaaacgaaacggagggagtataaagaaaacgaattaggaatagaaacgatcaagaaaagaatccaaaggatggaaaataagcagcaaatcttagaactggaattctccatatgctagagctttcatcgttatctacaacacagccaccggtgaggctactaatctgagctcagttcagttatgaaccatccaaacgcagagaacgattttagatagataatgttctgctcttccttcatgatgggagaaatatcctgctttctcgctgtggataaacaaacataagtgcgaaaaaaccacccggatatatctcttgttagctcgtctccgatcaaatctcatatatacaacaaactagggaggctacgttcaatttttgaatctgctgtagaagataagttaaccaccgagaaaaataaaaacgggtgggagtattcaattcattagacccgttaacggtcattagcattatctagtgctagcgatcgaattgagggaggatagggagggagtagctactcctggtagtagtttctaattttcctactccctccgtttcaaaatgtttgacaccgttgactttttagcacatatttgaccgttcgtcttattcaaaaaaaattgtgaaatatgtaaaactatatgtgtacatgaaagtatatttaacaatgaatcaaatgatatgaaaagaataaataattacttaaatttttttaataagacgaatggtcaaacacgtactaaaaagtcaacggtgtcaaacatttcgaaacggagggagtatatatatagcccatttggggcaccatggtgtatgggctccaattctaatcaccgttagatttgatcctgatcaaactagttgatgtgggtatgatattaacgggtctgcccattagtagcttatgatatatggaatcagatatacttagatgaaaaggtaccggattcataggcgtaattaattatggatggtaatgatgtttaatcacatgcacacgattgagtatgtcatttatttccgtatatagtgtgaaaaggttataaatgaaacttttttatagtatttttttttaatgaaaggaaggtaaatatactcaggcaattcgtgtgaacgtatctgaaataataattttcttcgtgactttgggtacacgacatacgcatgtattccagagtataatcgtgtcaacatatctaaaacaaatcggttgtgtttggtgaacaaattaattttacgtgacatatattccaggaatcatgtacctatattttaggtacacccatgtgttttccaaaaaaaaaaatgtttgtttaaattctataccgtaccttatttcttttgctatatatgcacgtcgagtatgtgggaccatctccataatattatactggtatagagtatgtgtgacgcaccatgactcttattattgggtatataacccatttaaagacttgtgtatatatacttctcatcagggtatatacccaaatattttgtatatatccaattttacgtgtatgtatccaaatattgaacatatacccaaatattgaatatatatacccaaatattgggtacgtacccaatttgcacgtaaacatgtacatatacccaaatattgggtatgaaccaaaaaaaaatcccggagcatgaaaaataattctggaagtacacatacccaaatattgggtatgagaacacagaaataaataccgtagcatgaaaaataattttggaagtgcattagatcctaaaattcgaaccaaaatttgaaacagtatatatacccaaatattggatttggaaaaaaaaaatccttatccatgaacaaaaccaacgacgtattgggccgacgaacgagcttgcggacgaaaggcgcggacaaccagtggctgcggcaaagctcgcagacgaccagcggcggcaacgaagaagctcacggatatctggcagcgtaacagcttgacaacgaagattgtggaggcctggttgggaagaagaagctcgcggacgtacgatgtcaacgacaaatctcgcggacgacgatcagcagcctgcgacgaagaagctattgcatatccggtggtgcaatagcttcgcgacgaatgttgccgaggactagttgcaacgacgaaggtcacggtcgaacgtcgtcagcaacgatgctcgtggacaaccaacggttgcatcgaagaagattgtcgacgtccggcggtgtaacggcgtggagatatgaaattggagtgtgtaaaagatggaatgacatctctgcccgtatatatatatacactagaaatagaaaagtattaatagtatggatgaaaataaagcaattacatcgaaattagtgggtttgattatgtacatataatttggaaataaattgtgttcatgcaatcacgatcatattcatttggaaagttgacgcatgcaagcttatatggaaacagctagctgtgcgcgaaccatgcacgtatagtacaaatggaaagctggatcttaacccgctaatatatctataatatgctgttttgagtagcacggatcctaaagcagataaatggtggatacaattggagcccatacttcatggagcaccacataatttacctatatatgtgaaccaaggttcacttcaccttaaatctggaacgttggtgtgctttaagatgtgtgctacctaaatattcattgctctgtacttgtgaaggctttgctgtgtacttgctcttgacctcactttctaatcttccaactttacccctgagctaaattatagctctctttcatgctaaacacagttaatattacttttttttcttagtgttgttttaagttcttcatcccacggtgtgtaactgtgcatggtacattttttttttggaaataagtacccatacttttttctataactacataattaacatttacctaataaattgatcttttaccaaatgaaatttgtaaataatacctctgctaagatccaccgaaggaaggatattatggcagttggcaggagaaaatttgcagctatatcatttttgaataaaaatctaacgtgcatatataagataatatgaattataagattatgccacgtgtacattactccaataaagaggtccgggacaactcacatgatacttttgtggtgcattttaaattttatacacatttcaaattcacatgaaatgtcatacatattcgaaataatgacatatagctagatttacattaaatgatgtacctgtaatatagaaataatacatgtcaatttaccataataacattttacaaaaagaaagtttgatctatatatctacatacaaaaaaaattcaacatatctatatatctacatttacaagaacagtatatctccattcaccaaaaaatgacagttacaaaatgaaatgttgatttgttatatacacgggttgacattttttttgttaaacaaattgatgtatcgcaaaacattatgagaactcatgagaaatcaaaatcaccaaaagaaattatttgaggtgaaatgccgaaacataaacagatacttagccaattaagtgctaacaacggttattaatgatatgacttaatcaagtgatttgtaccttatagcactaccatgcgcatgggtcaacagagaattgtgagtgagtgatgagtcatcattgtccaatatgagtggagtactacttcaagtgcattttggtcttggcaattagatcatgtaccaacccctgctcacactataaggatacaaagctagatatgtacatcttacagtgattataatgtgtacacatgtcacacaaatgagtgaggtgcatatgaaccaaggttcatattttatatatatatatatatatatatatatatatatatatatatatatatatatatatatatatatatatatatatggcgccgtaggcgccacgtattagatggcgcctgacacaacacctccctaccctaccccacattcctcacatcccgcctacgccaaccatttatgagtcatttgataacttatgagaataccgcgtccaccccacacccaccactgcaccacattatctcacatcccacccgcgcccaactttcatgagtcatttgttaacttatgaccatgcccgcgcccacataacgccatgtgttattttttaactaaaaagcgggcatgcatgcgcaagtgagattaagaagccagttatttttcaactcatcagtacatggcacgtatcgacggtgtcacacgacttacctgtttttttggtttatattttaactcatgtggtgcgacaaggtgtgcgtgggggggcattcgtcgtgctcgttccggtgaggtattcgttaactccgtctgaacacacgcaactccattgcgtgttggcacgagggcagttttttttaactcgtttgcgcgtcactgcgcggtgggggcacatggcattggtcgttaaattgagttactttttaactcaagtgatcggcggtcattaaatgcatgcccgtattttttaaatttttttgtcagttacaggcagcgaatcttcagagattagtcacatcaaaaccgccgtagttatcgccgcccactcctcttccggacagttcttttctcttccccgttcttgagttcttagagatcgctcctcttctcgccgattcagttctgtggacccccgtttttataacaggaatcaatcgtgtaaacagtaccatttccctggatcaagtagtctggtacacacaagttcatagctgaaataccaaatacacatacatgagagtctagtgcgaattattacatcataagcccgcaggcatagtcttagatcatcggaccgagcggtccggaatacattccaaaagcagaagtggataaggtagcagagttaaggcagcggcacgacattgccacaggcaacaatcgtaactaagacctactgagcgccatcgtcttcatcaccctcctggtagtatgcgtagggatcctccgaagcttcatctccggcctctgattaagtttatatattgcaagggtgagtaccaaccgtactcagcaagccatcatagcaacaatacacatgataggggtattcaaaggatggctatggttctttgcgcaaagccagttttgtaattcttttcacaagcctaagacctagcattgactgatcaaattttagtaccagtgttcacatttaaacaacgacggttctgtccaccatccattgtgatcccaaggatagcttcccgctattgagtcgtcatggttttctgaggacgtccaccttcccgcctctcaggaagtggctccaacagcataaaaaacatcatgcaatatcccatcccacacaagttaagaatttagagtctagccaagtgtaatacacgtcccggtgctcaataaccgcgagcacggctatttgaatagatttggtttactcacactgcagtggatgtacactttacccgcactccgcgactgcccaacacatgagcctcgtcccaacacatgagacgcgtcacggcaaagcttttcgataacctcgcattggcagtacccgctccatgaacttaaatcctcatgcactctaggcgtccatgtttctagcagtgagaggagttctggcgctcccgggaaagagaagtctcacacacatattaaattatggtttaagttaagttctctctctcacacactcatggcagtcctatcaatggcgacaccgatgtagggcacgactctcggccctacctcaacagctgtcccactgtagagcacctgcctcactcaatgagaaaccactatgcatggatagtgcctccgctcggctatctaatccgctaggtctatacccattcgagaagtacggttgtacgggggtcgtttcatgcttaacttcatggctcggtccttaattgaccagggacggcactagcccttttcggataccactcaaatcctccatccgccccagtcgaaaacatttgtttagttttattttcctttcacaaatcatgtcatcaatatcatggcaatgtggcgctcatgtctccacatgccgcatctcaattaccttcccaaaggtaattgcccaagcatatagtatttgataaatatgtgtatgcgtaaatctagagtaacatttctaagtatttgtcatagttgactagggacttatacgtaaatcatggttacaaggatttaagggtaaacaataatcaaggcatggcataatggcgacgcgatggcggcgcacggggctcgggacgacggcgcggggcgcgaggcggcgaggggatgggtgcgcggcgacgggacgggcgacgcgacggcaacgggcgacgcgacagcgacggcggagcggggctcgaggcgacggcgacgcgtggcgacggtagagcggggctcgaggcgactaggggacaggcgcgcggtgacgggatggcgacggcgacagtgacagcgacggcgatgggacagcggcgcggcgcggcagcagcgagtgcgcggcagggcacggggcgcgaggcggtaggcacgcgacgcggcgacgggatggcggcgcggcgacaggcgacgcgacggcgacggtggcgcggggctcggggtggccaggcgcgtgcggcagaggaggggacaggactagggaacctcatcgaacacctatgcctgaatgaataatgttttttcctatttatccctatttcagcctatttcctatataaattttattctataaatcctaatttttgcataaatgaagtttacttaatatttgtgttattctaaccaatggattcaccctagattaatattacccatattttataatttatttgaatttttatattagggctaattcttattccgtcgcacttaaatttagttgatgcaaatatggttgcaataatatttcatttatttctatcctcaccaaatcattattttaaattatattctaattgtttattttgccaatttaattttagggtttattcctaattaattattctttattcgcgatctaagaactccgaaatcaaaatccaatgaaataggcgaataatatcggcatgatgcaatttatttaaaaagtttttgaaggcccataattttagggtttgatttcgttggtcgaattttcagggtgttacaaacctacccaccttaaataaatgagtaaattccctgtgtacccctgaaaactcactcaatccctttcatacccctaaaatttacccgaccccttctatacccctgaaatttcaatttgatcccttccatgcccctaccgttacattttccatcattttactgttacgtttggttgcaaatgtcttttttgcccttgatgctttaggtttaaatataagcttcaaaaataattgaaaattttgtttgagtgcacatcgtgtgcattttataaaactaatgagactaaataattagtgcagaaaattttgacataaattttgaaaataaaataaatgtaaaaaattaaaattcttatttgaaattttaataggacaatggatttttttatcaggagcattcataaaaatgttgtgaacattggtatacctatctttatatgaatgctcctcatttttatgatctttttttaaaaaaataaatacgtattttttttatttcattatctaaaaatatttttttgggataaataatgcatcgcacaacaaactcataactataatagtctcatgcgagaagcttttatatttttaataatgtaattcatgaatttctttgttcatccaagggtaaaatggtcatttttatagaaaatacacggtcaactaacgggaggggtatgcaagggatcaaaatcaaattttgggggtatataaggaagtaagcaaaattcaggggtatagaagggattaggaaaaatttcaggggtatataagggattttctctaaataaatctcgtcccgagatttcttaccggttttcgaatagatgcgggtattccgtcttcaagaattcttcgctttcccaagtggcttcatcctcagtgtgattactccattgtaccttgtacatacgccacactttggtcctagtcctcttttcagcttcatccaatatccggactgggtgttctggatacgtgagatcattgctaatattaatttcttccaacggagcttgttcctctggcactcgtaagcacttctttaactgagacacgtggaagactgggtgcacatcggcgatattttctggtagctgtaactgatatgcgacttctcctcgtctagccatgatttgaaaaggtcccacatatcttggtgttaatttccctttgaccttaagcctttttgtgcctctcatcggagaaaccttcagataaacataatctccttccttaaattctaggtttcttcttcgggtgtcagcgtaacttttttgtcgtgattgtgccacttttagacgttcacggatcaggcgaaccttttcttcggcctctttgataatgtcaggtccaaataccgcccgttctctagtctcggaccacatcagtggagtacgacatcgtcgaccaaacaatgcctcattgggcgacatctttaggcttgcttgaaaactgttgttgtaggagaattcggcgtagggcaaacatttctcccaatctttgctaaaatccaaggcacaagctctcaacatgtcctccaagacctgatttgttctctctgtctagccatctgtctgtggatgataagctgtgctaaaagcaaggtaacttcctagggcttcatgtactttctcccagaaatgcgaggtaaactgtgtgccttgatcggatataattctcttaggcacaccatgaagacacactatcctagtcatgtacaactcggcgagtttggcaccgctatagtctgtcttgacggggatgaatcttgccgtcnnnnnnnnnnnnnnnnnnnnnnnnnaaatggaatcataccctgttgcggtcttgggcaatccaacaataaaatccatacctatctcatcccatttccactcgggaatcctaaggggttgcagcaaacccgctggtcgctggtgctcagccttcaccttctggcatacgtcacagagtgctacgtattctgccacatctctcttcatgttgggccaccagtatccttccttcagatcctggtacattttcgtacttccggggtgcaatgaatatgctgattcgtgagcttcctttaggattaatcctttcagtccaccctgttcgggtacatagatcctctttttataccataagacatctttctcatcggtcgaaaattcctttgcaaaccctgcagctaggcgttccttcacctcttggatttcttcgttgtccttctgagcttcttctatttgggttctcaaaagaggttgaatatccagggtgtttatctgtccacggggtactatatgtaggtttagctgggctatttcctctttaagctcaggagccatcccttccattctcaaatgattgcaatggctcttacgactcaaagcgtcggccacaacgtttgctttgcctgggtgatagtgaacctctagatcatagtccttgattaattccaaccatcgcctttgcctcaagttgagatctgactgggtgaaaatatacttcagactcttgtggtcagtgtagatatcgcaatggtttccaatcaaatagtgtcttcaaatctttagtgcatgaaccacggctgctagctctaggtcatgggtagggtaattttcctcatgtggtcgcagttgtcgcgatgcataggccacaacctttccatcctgcatcagtactcctcctagtccttgccttgatgcatcacaatatataacaaagtctttcctattgtcgggaagaactagaataggcgcagaggtcaacttttctttgagctgttcaaagctttcctggcactgttctgaccacacaaacttcttttccttcttgagtagttgtgtcattggtcgggctatcttagagaatccttcaatgaacattcgatagtatcaggccaaacctagaaaactccgaatctcagtcacagatttgggtgccttccattccgtgacggcctcaactttagcaggatccactgccaatccaccggctgagattacctggcctagaaaagtgacttcttttaaccagaactcacatttactaaactttgcatataatttatgcttccgaagtttctcgagtaccaatcgcaagtgcttcacatgctcttcctcgtctttggagtagattaaaatatcatcgatgaatactaccacaaatttgtccaagtaatccgtgaacactttattcataagattcataaagtacaccggggcgttggttaaaccaaatgacattactgtgaactcatacaatccatagcgcgttgagaacgtggtcttgggtatatccccgatcctaatcttcaattggttatatcctgatcgaaggtcaatcttagagaacactttcgctcctttaagttgatcgaaaagatcatcaatccgtggtagtggatacttgttcttgatagttacttcgttcagtgagcggtagtctacacacattctcatgctaccattcttcttcttgacgaataacactggggctccccaaggtgacgaactgggacgtacaaatcccttctcttgcaactctctgatttgctttttaagttcctacaactcattgaccggcatctgatatggtctcttggatatgggggcagttccgggtatcaggtcaataatgaactctatgtcacgatctggtggcattccaggtaaatcttctgggaacacatcagggaatcgctgcactacgggcattcctttcaggggtagcatggtaaatatgcctccggcacgttcggttagtctaggatcttgatccatggttgctctcatatccgatccccagggtgtggccagggtaacttctctacgtctacagtcgattactcccctattctttgttaaccaatctatacccaatatgacatcaagggtctgaggcatcagcaccataaggttggagggaaacaccatatccctaaggcgaataggtacgtcaatacaagctgtatccacggttatttcacccccaggtgaatgcactaacattggttgccttaatttaactctggtcaaattgtgttgttggcttgctttcaaagatataaatgaatgcgatgctcctgaatcaaagagaagtttaactggaatggagttgatagaaaacatacccatcagtacgccctggtcttcctgggcctcttcagctcgaacgtggtgtcacgcccggaaattcactagtaatttccgaacttatttgtgcataaaatcctcgtccaggaatcagccgaggtacacaaactgacaatttaatatacaaatccatcataataataacgttacacacttacaaaagaaaagaaaacagcagcggaataacggtctagcgatggcttcagctccactcccacaggcagctcaactggggtataagccaaacgtcttctccttctggatcctttttcttcaactgaggttgattgattattgcaagaatgagcatatgacatactcaacaagccacacagcaaatatgcaagtgcacaaggataccaaaggatggcataatataggctcatttgcaaaagcagcatttagcaaaatatttaagagaagtaaaacagtggagtaattaatcagaaattttaatcaacactgaacaacacacccatgctgcacggcccaaccatcctgaacaaccatacccggctgtacagatctaactccaaaccaggagctaagcaaattattaccaggtataacatccataattattgtgagaggtgtgagactaatcacgaaaacattgctcaacccgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcacaacacaactcaccacagtgcaccattcgaaagtaaatgcacagttgaaataaatagagaatttaaatataggatcaacatgctcaaaggattgtgtttaagatctgtgtgacttgccttgcaataatcggtcttcaattaatcttctgaacactcccgacgcactcacgaaccttcgtaacgacggaaacgacaagctaacacgcaaaacgaagaaaaagactaataaaaaccaaataaacagtacatataaagtaaacaaacatgtagatctcgattttagatgaatttagcaacttgaaccactcaaaaccgagttacgatgatttagttatgaatttccgaagatttaatctattagaaaaacagtaaaaagaaaaacgatgatgacgtcatgatgacctcatcaatagccggaccaagatggcgacctcgccggagattggatggtcggctgcgactttggaggacatgtacacgtagaggacgacgagaggaacccaacggtactcaccctcgaaccaaacgacgaacgacgacggccggcgacgaggtctagcggcggcgcggcttcggtcgacggcggcgacggggctccggtgaccggtgacagcggggagagagcggccgagcttgcccacacctcggcgcaccttacggcggtgacggcgaccggcggcgacgacggaggcggcggcgcgacgcggatggagctcggccggcgacgacggcggggtggagcacgtggcggcggcgctacgaggcacgggagatcacgggagagggggcaaacgaaagaggaggactagggggtcctatatatagccatgggaggccgggatcgagcccacaacgacgggaaaaactcgggaaagtttagatcttcgccggaaaaaggaaaggttgaaccgcgaaattggaaaggatttccatataaacttttggggatttcttggggacaaggaagaggagattgagaggattccattcccgcaaccaattcggaaataagagcaacggagaggttggattttggaaggggatcggcggcaacaggcacggcatggctcggctctggctctggctctgtccagagctggaagatgaacagtagcgcagggaaggaaagtagacttcttgccgggcttttcttttcacagcctgattagaagagggagcaaaaccggactttggctgagagaagaagagaggatgcaggctcgggttgggccggcggaagagagaggaaggaaaggaatgggccgattcagcctaagacaagggaggagaattttattactttcccaattaaaataatcacttaaatgatctttgaattgttaaaaatacttccaatgcgcaaataatttcaagaaaaatcctgaaaatacttggacactcaaagtacttaacaaaattacaattagaccatttaatgattaatttaatatgtgggtaattactgaaatgctctttgtatgattaaaattaggaattgagctccgaaaaatccgagaatattccagagagtataattaactatggagaatttaataaaaaattaaatccatccatgctttatatttaggaaattttatttcccacatttaacttcacttgtaaattaatgaacatttaatataaattctaataatcatttattaaataatttataaatcctgaaacaaaaatcaggatgtgacaaatctacccccttacaaagaatctcgtcccgagattcggaacggctagaaagaaaagggcataggtaaactgcagtctaccttattattccataactcagataattattctaaggctttaaagaaaactactgctgctttgaaactggtggctgagctgtaacacttgaagacgcaactcttgaagacgcaactggcactgcattggctcctgtgacgacaatgttgttgacttgcggctgctgatgctttggcttcggacactctcttgcaaagtggcctggcttgtaacagttgaaacatacctgctgctcccttccactactgttattctcttgagtctgatcctgctgaactagcaccggctgattagcttgctcgatgttaactttattgctttcattagtctctgatttgatctcaccaccgatgttcaactgttgcgactgtccttgacctgcagaagaaggttcaccaatttggagtggcttgatacgctgcctctggctactaccttgtgcctcctggaatacagtcattttccttttacggttatctatcctgttcttcttgtcttcaagtcgaattgctttgtcaaccagctgctgaaaatcaacatagtcatgagagatcaatgtaactgacagttcatccttcaagccttccaagaacttctcctgcctttcctcgtcagtacgcacatcttctggagcataacgtgccagacgattgaactcatgaagatactctgccacggtacgatccttttgcttcagtgtcctgaactcacgcttcttcaaagcaacaactcctgcaggtatatgtgtcttattgaatccttttgtaaactcttcccaagtgattggttgtccttctgctctgttcatccggaaatgatcccaccattctgaagcaggtccttgcaactgatgtgaagcgaaaacaactttctcctgatccgtgcactggaggagttccaacttctcaacaacgtgcagccaatcacctgcttccactggcgcgagtgttcaccatctgttgcagattagagaagataggaggataagggttacactaaagacaagatcttaaccagtttaacactgatctgatgtgtgtagaccattatattgttcaagttgattaagcaagcaacctagtatagttacacgctcatcattgaaccccaccaatgacgggaatgcaaccatacctacacacaagcaagcaacaaacgttctaccctactaactattcttcaaggatagtttggcggcataggttctaaggtaggattcaaacttcattccatcttgaccacttggcacttcggtccttcctcgatccacttgactgacctccataagttgaccacatcaacatcttctagtttcaacaactagtttcagaactactcaagttgaaagcaggaggggagaggatgataaaatgatttatagagaattctagagaaggaagaaaggaaaattttcacaaatcatgttttcggaaaatttgtccttaaggttattttcacaaatcatgttttcggaaaatttgtccttaaggtttgaccatttggcttatcctacagtcgagatggctctgataccaacttgtaacgtcccgccttcccccaggccgggcccacttacatctgatagctttcataggtcatagactgccctcacagaccaacacatgtcttttctgcacactttgtcctcactcgtgtgcagcacgcttaaccctggagttctttggagattggcttccggaaaagaagttgcaacttgttgatatgagtattctattaatcctattaagccctagaccgggatgttacaccctcacccccttaagagagatcgactcccccgtcgatcaaccctaggccaggaacgtcctctcttggccacgtccatgtgtccagtgccagcgcatgtgccatgctgtgtaaccactcccggtctacaccagacgtgcgcaccatgcctgcgcaactgcgacacacgcgcccgtgaaaccgcgagagtcggctctgataccattttgtaacgtcccgccttcccccaggccgggcccacttacatctgatagctttcataggtcatagactgccctcacagaccaacacatgtctttatcctcactcgtgtgcacccgggaagaatttcccggtcggtcacccatcccaaattgctccaggccaagcacgcttaaccctggagttctttagagattggcttccagaaaagaagttgcaacttgttgatatgagtattctattaatcctattaagccctaggccgggatgttacacgtggttcacttgcccgcgtccaaatccggtagaggtcctgttagtctgcggagtcctgaataaacctcgtccagtagcaggggtagcagtcccgtgaatagccattgcgttagctccggtgcgaatgggtgtcttgtttggatgggggcacttgttggcgaaatgcccgtactctccacagttgaaacagcttcctggcctcactgatccagtagcggcctgatttggtgtaggagcttgggtctgagtggtaaccagcctgtggaagttgctaggtgcggtaggacgattggttgttaccaccgttggtctccatcctgatgaggtagttcctttaggacactggggtgcgacctgaggcgggcggttcatggcaagcctcctcttacgattgtgctccacaaccttccggtcgttttccagtctaacgaccttattgattaaactctggaaactatcgtggtcctgtccaatcatgggcccacgcaactcgtcgttcaggccttcgatgaacttgtcgatcttttcctcctcgtcggcaagatctccagttgcgtaacgcgccagttgagtgaaacggtttaggtactcttgtatagtggtatttccttgtcgtactctcctgaactcattcttcttcattcgcatcacagcggcaggcatgaagttgtcacggaaggctgtagtgaattcctcccagcttggttctccagcatcttcttctcgagcttctttgtaggtgtcccaccagtctccggctggtccttccagttggttcaccgcaaagatcactttatcggcttcacgtactcgaacaagggtcagcttcttctcaatgatccttaaccaatccttagcatccataggttcttcagctgtggcgaatgtgggtggcttagtcctcatgaattctccaaagcttgatcctccacggttgccttgattatttgcgatggcttgcagaagttgggtttgagtagccatgactccggccagggtgtttaggtcgggtgtttgagtttcttcattgctggttgacgcccgatgtcggcttgccatctgtgtaggccgatgaggtaagtatcctaatttcctaactagcccttatggttttatcccgttaagggagttgttttgatgtgaactttgttttgcaagcatggtggaataaactcattcataacccaacagtaataatatcataaataacatcacagagttccacagataatacataagtcatgatgcaatcgactgcacatatacgtagtccaaataaagtttatctaaaagatacatcgaactaatcatcaagctacccgtcaatctaggtagggggggtgtgtctcgcatgctatccaaaaaccatctgaagcgagatcgaagctgcaatagtcctccagtctagtcatccaaccatccgcaggatcctggggcaggtagagggtggttgctggctcgtgcaaacctgagtccccatggctcggaagtagtggcctctggatctggcttgggcttcttgcccgggggtcgtgtgctcttgcgagcagtgctgagggtgcgagggcctctgataaaggtgatgcggtggacaggagtctcgtcctctgaaggatcagtgatgtccggctctatctctggctcagtgtcggtcccctctgtctcggagtcaacctggatcggagtctccaaactggaacccagctgcggtgacgaagtagggatcagtggagtgtgcacaatctctggggcaggtggctgtgtcactgtcgggtccaccaggtaaggtgctgactcagtaactagcatatcaacctctcccaaaagagcgtggagcgctggtgggtatggcggagtaaggaagaagtagcggtcacgccctattgctgaggaagtagaagctcctgtggtgctgactatagctgctcgaagctgctcctcaagctggctgacgtgctcctgactctttctcagctgctcctcgagtgtatccatcatcccgcggcgatcattgtactgatcagatagctgctggaactggtcgccatggacctagagctctaccttcagtgagtctatctcactgccccaagcctggtgctcctcctctagctgaagctgctgcactgtgaggtcagtcacctcggtctccaactctcccaaacgcctctgctggtcgtcgatctctaatagcgcctcctcgtagaagtcgtctactgcctcagcccatcgggacagtcgagtcaccatcgggttgtagcagcaaggtgtatcctagactttgtagacatagttgctctcctcccgaaacggatggtaagcaaagtcggtacttgccaactcagctcggtgaatagagctacgtcggaggaaggcctcccgggctgcgtcctgcatcgcggtctctgtaagtcgcgacggtggcgtgtcggaaagctgtagtctgactctgaaggaactcgtgtatgaacctcaatccgagcctcccaaacgggtccacactgtctcactcggtagatcggaaatctggggtaccgtaggcgcctcatcaaccgatgtagctcaatgacatatccctctgagcggggtacgcccatctcccagatagtgagtgaatcctgatctcccatctaattttaagaaaaacccaaagtcagctaagagtaaaactcgttttgggaagaaaatagttaagagtaagatgaaaatcgtatatagttttgtaaacatagcgtctttatttttgaaaatattactaaatgggaatttctcccttggccaactaggaaaggggtggggcgccttttggtcttttcctacagttgtatggctctgataccagctctgtggacccccgtttttataacaggaatcaatcgtgtaaacagtaccatttccctggatcaagtagtctggtacacacgagttcatagctgaaataccaaatgcacatacacgagaatctagtgtgaattattacatcataagcccgcaggcatagtcttagatcatcggaccgagcggtccggaatacattccaaaagcagaagtggataaggcagcagagttaaggcagcggcacgccattgccacaggcaacgaccgtaactaagacctactgagcgccatcgtcttcatcaccctcctggtagtacgcgtagggatcctccgaagcttcatctccggcctctgattaagtttatatattgcaagggtgagtaccaaccgtactcagcaagccatcacagcaacaatgcacatgataggggtattcaaaggatggctatggttctttgcgcaaagccagtttcgtaattcttttcacaagcctaagacctagcattgattgatcaaactttagtaccagtgttcacatttaaacaacgatggttctgtccaccatccattgtgatcccaaggatagcttctcgccattgagtcgtcatggttttctgatgtcacgaccagaaataacccaacgggcgttccttacgtgcgtgcattattccttgtcccaggaggcaaggtacaccaaaagttgatacaattcagagtttaacaagcggaagcgtaattaatttattacatgggcagtgaagacccagcacacaagaagacaaacgaaaaacagcggaagactagggtgacgaccacaggcgcttgacggcaggcacgagctagacaccaaagccttcatcttccaggaactcctcttctgggtttgggaaaaattgagcaagactgagtacaaccaccgtactcaacaagacacacccacaagtgcagaataaatgcaagggagtacaagggagccataatatagggggttagggtttgcagtaaacagcattaaaagacacttagttgctcaaagctattttgtaaacacggtcctagagctatacaatattattaatcaaggccgtgaacccacacgaacctgccttaacccaaggcctacgatgattcagaccaaactggcaacccgaccctgggtcccagctcgtcccaagccaacccaggccaaccattccacattttagttgttaagccggttttaggaattaaaaacactaacttgggtacattgctcgacttgcccataaccgagggcgcggctattcgaataggttatactctgatcagaggtgtacatctttacccacaagacacatcatcctcacgtgtaaccacgtgccacataccaccatggtatacggacggaagacatgacatagtttccaacccatcctagccataaacaagagtaccgacccaaccccacctacggccgaaacccccgggacaggcaggcaggactgagcccctagcagcaggacaccggccctgtgccatgacatctcgactaccgggccgcagctcgtgtagccttcatttgccctagagatgtccatcgacccccgacttcgtccatctccatccgtgtacttttgtttataaccagactgagccacaaactaagccttacccactagacatatggaagtacggtagtgctttgcaacagaggcccgaagaccggtccttatatggccgaggtgctactatcaaaaccatgcaccctgagcccagcctaaaaccattttgagggttttgaatagagggggaggtgtgaatccaattccacaataatccatccattccatagtgtccaggtgatgagaatattcccaaagtctagagttgtaaaaccacctaatgttgcctaattaaccagcgaagcatctacctaaaatcatactagtggtaccatgagtagagtgtccactagttggggttttgtttattctagggtgaacaaggtaataataacaataacaataataaggtcataacaaaggtacataggcatggctagataaaacagtgataacgcgggaatttaaataaagcgataatgcaataatttaaatcaaaataattttataaactgggattcaatatgttcaaggatgatgtgacttgccttgctcgctttcccaaacgtcggcttcaacctccacaaagagcggatcttccgaagctgcagcgtctacacgaccaacggaaaagaaaaggcttttacgctaataaactccatataacaagcaggaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaaatttaatttaaaaagggtttattgcgtcagccgaggggagggggcgcgcggaccgggtccacgggagtagggcccacgtggcagcctcacggtccacggtggaccgggcgcacccgggctcgcaccggccggcgccgtgggccccacgcgtggtcgccggcgacggccataggcacggcggagcggcggccgagagaggggaagggaagggggaaaagaggcggcggtccacggctcaccctaggtcgacggcgacgatgaaaaaggcggccggagcggaggaaggcggcgcggctcgggtcgacggcgttccggcggtcggcgaccgaaacggagaggtggacgaggtcggcgaggatgcggtgaagccgaaggaggcggcaccgaggtgggaggtggtccggggcgacgacggcggcggaccggagctcggcggcaacggcggagagagagagcgacgtcgcgagctcgaattcggcgaggaggaagggtggcgagaggcggaaacggacggaggaggtgcggggagggtttaaatagggccggggcgagagagggcggccggagaaggaaggaaaccggtgcggcattctcgggctccatcaatggcgccagcgggattaggggaggggtttccaaacgaatccaagggagagagggagggaaaaatggggggaaagggagaggggatcacggggagtgattccccccactttattgcacgcggggacggcgggaggcggcgggatttgcggcggtggcggcgctagggcgcgggggaggcggcgggagcggcgggaggtcggggatgacgggtgggccccacccgtcagcaagggtggcgggcgggcccgcccgtcagcggcgcccgcgtggggagaggccgagtgggccgcggggagaggagagagagggggagggagatgggccgaattcggcccattagagagaaggagggattttagggtttttctttttataaaatcattttaactttgtttatttcttaataattattatttatgctctgaaaatttcactaaaatttatttacacattttaggcttttaggagatatacaaaaatcgtctaagccttaattgacttttagctttgcacattttaattgttggaggctttcacacggtttttaattattctaggcataatttagaggatgtattttagagtcgttttgggacgtgacatctgaggacgtccaccttcccgcctctcaggaagtggttccaacagcataaaaatcatcatgcaatatcccaacccacacaagttaagaatttagagtctagccaagtgtaatacacgtcccggtgctcaataaccgcgagcacggctattcgaatagatttggtttactcacactgcagtggatgtacactttacccgcactccgcaactgcccaacacatgagcctcgtcccaacgcatgagacgcgtcacggcaaagcttttcgataacctcgcattggcagtacccgctccatgaacttaaatcctcatgcactctaggcgtccatgtttctagcagtgagaggagttctggcgctcccgggaaagagaagtctcacacatatattaaattatggttcaagttaagttctctctctgacatactcatggcagtcctaccaatggcgacaccgatgtagggcacgactctcggctctacctcaacggctgtcccaccatagcgcacctgcctcactcaatgagaaaccactatgcatggatactgcctccgctcggctatctaatccgctaggtctatacccattcgagaagtacggttgtacgggggtcgtttcatgcttaacttcatggctcggtccttaattgaccagggacggcactagccctttccggatactacccaaatcctccatccgcccccgtcgaaaacatttgtttagttttattttcctttcacaaatcatgtcattaatatcatggcaatgtggcgctcatgtctccacatgccgcatctcaattaccttcccaaaggtaattgcccaagcatatagcatttgataaatatgtgtatgcataaatctagagtagcatttctaagcatttgtcatagttgactagggacttatacgtaaatcatggttacaaggatttaagggtaaacaataatcaaggcatggcataatcacaagtaggatgttcatcattgcatgcaattttattagtaaacaaaataattttgtaaatgggatcaacgtgttcaaagaatagtgatgacttgccttgctcgtagtcctgcgggtcttgaccctcgctcggatccgcaactccctcgggctctagaattacgtgcgaagaacgatttgaattcaattagaattcaaataaaatccaaataaacttcaaataacagtcgaacgcgaatcgatctttctatattgattacaaagtttgcaaaaccacgctattccaattttaaggtcatttaatcctaagtcattttgtgatttagaagtgtctccattaaaaattcaacgaagaatacaattcttagtaactaaatccgattatctccgcgagtgagttacttatagagattactgaaaataatctattttcatattaaactttgcaattctatgactataaataatctataattaatttctaattattctaaattttctaatcctccttaatctccatctaatttctatttatttatacttttttttattctatttctctcctcttctctttcttttcttttcctctctttctttctcttctttttctctcttttctttcttttctttttctctcctctttcttttctttttctctcttttctttcttttctttttctctcctcccccaggcttctttcttcccccctctctctcggctcatgctaccggggcggtgacggcggcggaacggggaagggcggcggcgacggcgaggcgacgctcggcgtggcacacggcgcggcgcggtggcactgagggcggcggcgcagcggcacgaaggcggcggcgcagtggcacgagagcgacggcgcggtggagagggaagaggagagaaggagggaaatggagtggggagaatggagaggggtggggtttttataggggagagggggaaagagagagaggaaagaggtggccggcttaatggcgacgcgacggcggcgcacggggctcgggacgatggcgacgcgcggcgacgcgacagcgcggggcgcgaggcggcgaggggatgggcgcacggcgacgggacgggcgacgcgacggcaacgggcgacgcgacggcgacggcggagcggggctcgaggcgacggcgacgcgcggcaacggcggagcggggctcgaggcgacgaggggacgggcgcgcggcgacggcgacagtgacaacgacggcgacaggacgacggtgcggcgcggcagcagcgagcgtgcggcaggcagcggggcgcgaggcggcaggcacgcgacgcggcgacgggatggcggcgctgcgacaggtgacgcgacggcgatggtggcgcggggctcggggtggcaggcgcgcgcggcagaggagggggcagggctagggaacctcatcgaacacctatgcctgaatgaatagtgtcttttcctatttatccctattttagcctatttcctatataaattttattctataaatcctgcataaatgaagtttactcaatatttgtgttattctaaccaatggattcaccctagattaatattacccatattttataatttatttgaatttttatattagggctaattcttattccgtcgcacttaaatttagttgatgcaaatatggttgcaataatatttcatttatttctatcctcaccaaatctttattttaaattatattctaattgtttattttgccaatttaattttagggtttattcctaattaattatttcttattcacgatctaagaactccgaaatcaaaatccaatgaaataggcgaataaaatcggcatgatgcaatttatttaaaaagtttttgaaggcccaaaattttagggtttgatttcgttggtcgaattttcagggtgttactagttctcggggatcgtcagcgccgtcgaagtttctcccaagtgattcccttcccacaatgttggccggcaggtaccagcaatatcaccctccacacattcctcttcctcatcccatatctttatcccccgccgcatgagtttgcctcctcacccccattgccgggctaaccttttttgttgttgatctagagccatgtccaatggagatgactgggaaaatgccggctagggtcaagcggattaggtttgccgattcgcaaaacgagtgcgaggtcgtcctgccccaaacacttgctagcggcggagcgtcttcgtcgagggaggtcggtgaagcagcacagagcaagccaaaaaggagacggcgtgctatgtcggccggcgagggcccatgaggcgacgaggtgagcaccacattacttttctttcccttataggttttttcctcatccctttttccaccaatactatcaggaactagattgtaatgtttgtttttggcattatagtgcaaccattggtcatgctcacatatcatgggttgcctacggggtcacttgtaaaaagtttactgggttggtgcggtttatcagacaattaaatgcatatgtcaaagcatactatagttgtccaaatcgttttagttaaaaaattgctgctatgtgtatagcctgacgcgttcagcgctctggtttgtcatttatgagctatattttgaccttgtacacctgcttggtgggtggagcccataatttattgagttaaaagtttattgtttttttggagtgggtatagtcagactggtgatcaaggtatagtttgattcgcacacacaccagttgcccaaatattatgtcagtaaaaacaattgctgctctgatatatcatgatcacctcatgtaactctgtatccttaagagctaccatttggtactgacaaccctcccacggttttgctgctcgtcatatctattcacttgttgtttactttcctctttttatgtttgcagccacctgagacaaagggtcataacctcacatgctgtagcgccgctctagcggcgcaggcttgtagagcgctattagccgtacaccatgagaaattggaggagattggacttgaagcggtagcgtgcatgtctcttgaaagccttgagcagccagacctaatacgatggctcatggacaggactaatcccgtgtcgcgcccggaaaaataccttctccagaacgctagtgtattaatccccgtcctaggaaaagccagggtacaccaaacaaacatgataaaaaaggcacatctttattatatcgataatatttacattattacaaaggcatttcaggcctgacaaacaaaaataaatagcagcggactagtgggcctacggctctatcttcataggcgctcaactggggtataagcgaggactccacccaggacttcttcttcagagcttctcttattgaaggggggggggaagatagagcaagaatgagtacaaccacagtactcagcaagtcacacaaggagatgcatgattaatgcaagggagtacaaggggtaataatataggggttaagttttgcagtaaacagcatttaaaagtcacttagttgcccaaagctattttataaagacgattctagagctacacaatgttattattcaaggccgtgaactcacacgaacctgtcttaacccaagacctacgatgattcagaccgaactggcaaccagacccaggtcccagctcgtcccaagccaacccaggccaaccattctacattttagttgttaagcaggttttaagaattaaaacactaacttgggtacattgctaggcttgcccataaccgagggcgcagctattcgaatagattatactctgatcagaggtgtacatctttacccacaagacacgtcttcctcacgtgtaaccacgtgccacataccaccacggcatacggacggaagacgtgacatagttcccaacccatcatagccataaacaagagtaccgacccaacctcgcctacggccggaacccccgagataggtaggcaggattgagcccctagcagcaaaacaccgaccctgtgccatgacatctagactaccgagccgcaactcgtgtagccttcatttgtcctagagatgtccatcgagtcccgacttcgtccatctccatccgtgtacctttgtttatgaccagactgagccacaaactacgccttacccactagacatgtggaagtacggtagtgctttgcaacagaggcccgagcttaatccttatagtagcctaggtacgactaacaaaacccaaccccgcacctcgagcctagcctaaaaccattttgggggttttgaatagagggggaggtgtgtgtccaattccaacataagctagccattccatattgtccaaatgatatgagaattcccaaagtctaaagttataaaaccacctaatgttgcctaattaatcagcaaagcatctacctagattcatactagtggaaccataaatagagtacccactagttggggttttgtctatcctagggtgaacaaggtaataataacaatagcaataataataaggtcataacaaaggtaaataggcatggctaaataaaaccgtgataacgcgggaatttaagtaaagcgataatgcattaatttaaatcaaaataattttataaactgggattcaatatgctcgaggatgatgtgacttgccttgctcagagacaatggccttccgaaccttcggcgatgaccgcgaaccacgcttcaagaacctccggaacgacagaagctacgcaaagcacacaagcaaagctacaaacctataaagaagcaataacaatacataaaaaggaagcacagggttctttaggttataacaaacattaagagacttgaacgggtcgatttggggttcgtatgaccaagatatgatcatctgaagtttaatgctattatatggagatttgcagattattataattaggctttgcaactataaaacatgcgtaggcgctagcctagaaaagacaggaaggctacgccgttaacatgcagaccccacatgtcaacctaaaggaccacggtagaccgagtacacagagactgtccacgagtcaatggaaacggaccccgtgtgtcaaccgaagcgagtggccgacaaacggactccactagacacgtggaaaccacgcggctaccgagcgggcacactaacacggtcaccacacgcacaagcgaacgactaccgacaccagtacacgggtaccggggtcgacaaccgcacaacgggtacggggcgacaccgaaaggacgaggatggtgcagcgaaggagagatccttaccaccacgcaacgaggtgtgagaacgacgacgacgaacgggcgcggcagagacggacgggaacgacggagacgaacggcgaggggacgacttcggcggcgatccttggacgaaggcgagacgcggccggtgcaacgcttgacgacgcggagctgaggacgaagacgaagaaggagctgcagcggctcactttacggacgcggacgatggacgagaacgacttgacggagggacgaacgccacgacgatgaggacgatgaccgggaccggcgagaaggcgacgagggcagccggcagcagctgcacggagacgaggacggcttggaacatgccgctgtgatgacgatgacggtggcggcgcagcgagacgacgagccgggcgaccgacgggaggtcgatgacgaggacgaacggtgacgatgacgacggacagcagagcggttcggatggaggggaggtgaggccgagggcaaccttgacgcgtccgttcccgatgattgggggcacaaatcaaggggggaatatgggggaaagagagaggaatcaatgggtattaattcccactaattaattttggaatccaatgatttaatcacacggatttgagggaggaaaggagctatgttttcgggagagagaagg

SEQ ID NO: 29514 - DNA, 15155 bp, Oryza sativa
agtgggccgggagggggagggaaagggagctgggccgaggggaaggcggggggagcggcccaagagagaggagggaaggaaaaagagagggaggagatggagactttggccacaggccgagggagagagagagggtggactttgggccagacttggcccaaaggaggaaggaggatttatttttagtttttctttttattgaactttattaattgttgttgttgcttaataaatacttccggtgctctgaaaattcaaataaaatttgagggctccttttagaccaagaagaatttaacaaaaattctccagaccacattcgaatttttcttgtacgtattttagtgtttgccaatttcttttctaattttaattaattctattattccatttagagaatgatttttattttgggatgaatttatcagcacgtgacatcccgacacaatgtgcatttcaatagatgatgacaggaagatacagatcacccctcgcaccgtgaggcttgtcctggggaccccgcttggtggaaatgacattgtactcccatcccacaaggttgtgcgaaccgttcaagaaagcatcaccgatgaactgggaattcataagaaggctaggttatcagcaaaacagttgatcgaggtgatcaagagccagaaagatgacccctaggccgttcgatatttcatcatggtacttaggtcaaagctcctagttccaactaccgatttttatgtgcccaagggcgatgtccgggtcgcctccgacctcgaccgagtcgctgctattgactggtccaagactgtgttccgggctttaagcgacagcattaggtgttggcgccaaaacccggcatcgtcaatagcttcttgtgtcgtattcctcgtggtaagccattccgttgacatttcctttattttatcaaatctttctttaccagcaaattgttgtttcaatgctaatcgccggtctgtttgctatttgtcaacttctttttctaactttgtgcctgcgtacatgggttaaatatctggacaacatactgccaccaagagacattgggcttgatttaaccttcaccccacgtatatagatgtttactaaggacatcgtggataagctcgttgctgctgatcaggaagcaagcagggacggcatgccgccttttggcaacctccccgtacgtgttgtcctccctcttatttttattgatatttttagctcaatagtatgcagtataactacattgtgtagtacaacatcatctaaaacacgagaacaagggccaccattctactattttgcatgtcttaatttgaaatattcgttgttctgtaaatgccaatgttccacacacacccatttatcgttgacaatctcgacagtactttttttttgttcgccgctaaccccatgatttgtccctcgcagctgcgaccgttggagagtacttgctacgccaacaagcctgccgacaggggaaaggggccgatggttgaagatatcagggcagcggcgtacaccttccccaatatgtctactattctcggtccacaccatccctatccgtgtacttttatttatgaccagactgagccacaaactaggccttacccacaagacatgtggaagtacggtagtgctttgcaacagaggcccgaagaccggtccttatagtggccgaggtgctgctatcaaaaccatgtacctcgagcccagcctaaaaccattttgggggttttgaaaggagggggaggtgtgtgtccatttccacataatctaatcattccatagtgtccaggtgatatgagaattcccaaagtctaaaaattataaaaccacctaatgttgcctaattaatcagcgaagcatctacctaaattcatactagtggaaccatgaatagagtacccactagttggggtttcattttcctagggtgaacaaggtattaataaaaatagcaataataataaggtcataacaagggtaaataggcatggctaagtaaaacagtgataacgcgggaatttaaataaagcgataatgcattaatttaaaacaaaataattttaaacataggacaacaatatgttcaaaggagatgtgccttgccttgctcgctttcccaaacgtcggcttcaacctccacgaagagcggatcttacgaagctgcagcgtctacacgaccaacggaaagaaaaaggcttttactctcataaactccatataacaagtagaaacaaagcacaaaaatgggttcttaacttcttaaggaaaaatcagagacttgaacggtccaattctgagttcaaacggccaagatatggccatttgaagtttatatgctcttaatgtgaatatttgcgaatttcttcatttcaattttaattaaaaatagggtttattgcgtcagccgaggggagggggcgcacgggccgggtccacgggcgtggtgggccccacgcggcagcccctcggtccacgatggaccgggtgcacccgcggctcaccagctggcaccgtgggcgccacgcgtcagccgcacccgagggcacgggcggctgacggccgggccccactcggcggccacatggccacgtcggcgcggtcggcgggaggcggcgcccgcgcccctatggtcgccggcggtggccataggcgcggcggagcggcggccgagagaggggaagggaagggggaaagaagcggcggtccacggctcaccccgaagcgacggcggcgatggaggatgcggccggagcggagggaggcggtggtgcggctcgggttgatggggacggcggtgttccggcggtcggcgaccaaaacggaggggtggacgagatcggcggcggtgcggcgaagccggaggagacgacgccgtggcgggggacagtcccggcgagcggctaggcttggcggaggtcgacggcgacggcggagagagaggacggggaagtgcggaaacggacgggggaggtgcggggagggtttatatagggccggggcgagagagggcggccggaggggaagaaaaccggcgcggcgttcttgagctccatcaatggcgccggcgagattagggaaggggtttccaaacgaatccaagggagagagggagggaaaattggggggaaagggagagggaatcgggggaaacatttcgccccacttgattttgaacgagggaggagggggatgacgggtgggccccacccgtcagcgagggtggcgggcgggcccgcccgtcagcggcgcacgcgcggggagaggccgagtgggccgcggggagaggagagagagagagggggagggagttgggccgaattcggcccaagagagaggggagagggttttagggtttatttcttgataattattatttgtgctatgaaaattccactaaaatttatttacacattttaggcttttaggaaatatacaaaaatcctccaagccttatttgacttttagctttgcacatttaatttttggaggctttcactaggattttaattattctaagcataatttaagggatatattttagggtcattttgggacgtgacaaacctacccccttaaacggaatctcaaccccgagattcggaagaactggcgaagaggacgggatgggctgcctttagctcgtcttcacgctcccaagtagcttcttcctcggcatggttgctccactggaccttgcaaaagcggattactcgattccgggtcctacgctccattgtgtccagaatcttcacaggcttctcgaacatcaatctgctctgaatcggcttgctcggatggcactcgaaggcatttcttgagctgcgacacgtggaacacatcgtgcacattgcccaaggatgtaggcagctccaactggtaagcgacttctccgcgtcgagcgatgatgcggaaaggtcccacatacctaggtgcaagcttcccttttgtctgaaacctgtgcactccccgctgtggcgtgacccgaagatacacaaaatcatccactgcgaattccagattgcggcatcagttatctgcataacttttctgccgagactgggccacttttaagttatcccgaatggttctgactttagcctcagcttctctcaggatatcagtcccgaacacttggctttctccaacttggtcccacaacagcggagtccggcatttgcgtccatacaacgcttcatagggtgccatttgtatgctggcctggtagctgttattgtaggagaattcagcataggggagactcttgtcccaggtcctcccaaaatccagaacacaggcacggagcataagagcttcctgaagtatcaactgtttaagttccttgttgtccggaacgcatacacgatttccattccataaggttccgtgttcatcttccgtgaagccagtggctttaccctgcttcatattcttgaggatctcctgtatatccggatcattcttctgagccttgcgtatgtgatcaagcaaggtgggctttgcttctagtgcagccaggaatccatggctaacgacacttaggttcagggcttccaactgttgattaagttccggtggaatgccgcggacacaaagagcgttgcagtggcctttccgactcagcgcgtcggccaccacgttggccttgccagggtgataatggattcccacatcatagtctttgatgagctctaaccatcttctctgccgaagattcagatccgactgggtgaagatgtatttcaaactcttatgatcggtgtatatttcgcagcgatttccaatgagataatgccgctagattttcagagcatggaccaccgcggccaattccaaatcatgggtaggatagttgccttcatggggtcgtagctggcgtgaagcataagctaccacatgaccttcttgcattaacacacaccccaatccttggcgtgaagcttcacagtacaccaggaaatccttgcgggtatcaggtaagattaacactggtgaggaaaccaacttttccttgagagtttgaaatgctctctcacactgcggactccacacaaatttttcttccttccgcaactgcgtcatgggcctggcaattttggagaaattctcgatgaacctccgatagtaccctgctaaacccaagaaactgtggacctgggtgaccgtcttgggttgcttccaatcggtgacagctgttactgtctcgggagccacagcgactcctttagcagatattacatgccctaagaacttgacttcggacaaccagaattcacacttgctgagcttggcatacaactgatgttctcgaagctttcccaataccagacggagatgctgctgatgttctttctcggactgtgagtacaccagtatgtcatcaataaagaccacaacgaacttatccaaatactccataaacaccttgttcattagattcatgaagaaggcaggagcgttggtcaagccgaatgacatcaccgtgaattcatacaatccataccgcgtggtgaaggcagtcttagggatatcttcttcacggatacgcaattgatgatacccggaacgaaggtcaatcttggaaaagacagaggcacctttgagttgatcgaatagatcatcgatccggggaagagggtacttgtttttgatagtgacttcattgagagctcggtagtcaacgcacatcctctttgtcttgtctttcttttctacaaaaatcacgggagcaccccagggagaagtgctcggccgtatgtaccccttctctttcaacccttccaactgcttctttacttcggccagttcattcgctgccatacggtagggtcgcttgtacatgggagtggttcctggagcaagatctatcctgaactcaatctcccgctttggtggcataccgggtagctcttccggaaacacatcactgaacttgctggcaacgggtatttctgacagtcccagctgatgaagtactgagttgccggtgggagttgggtgcgcaaagaagacaaccggttgatcaggcctccggtacatagtgacagtacgtcttgcgcaatccactactccttagaatttagttaaccaattcttcccgaggatcacatccaagtccttggtgtcaagaaggatcagatccgagggaaaagaaattccctggatctctataggtatggtcgggctataatactttgctgtcatagcccctccaggggtggtgatgagcagagagctcctaagctttgctacccttagttgatttctccccacgaattgcacagatataaatgagtgggaagctccagagtccaacaaaatggtagcggggatggaatgaatgaagaacgtatcgaggatgacatctggagttgtcaggacatcctccgcagtaacgtgattcacacgaccccgggtggcatccttaccaccgttgttggggccgggtggcgctgggccttgctgacgcctcggctgacgcctcggctttggcgctgggccttgctgacgcctcggctttgggcatttatcggcgaaatgcccaggctcgaaacagttgaagcacagacgctgctggccttgagcatccttgcgaccttgaccaggctgcatagccggtgcaggaggtcggggtgcacggttcccttgttgattctgccgttgctgctgcggctgtgggacacgaaccacatactgagggcgtggcacggggcgaggctgctgctgctgctgctgtgaggaggatccccctagatagggattggtgtagcggatcctttggttagccccctgttgattacggaaattcgccaagcgacgcttgtgcgactccagttccttgtgcttggcttccaggcgaatgctcttgtccaccaggcgctggaaatcgggatagtccccagagaccagacgcacagaaagttcagggtccatccctgccagaaacttctcctgtttttcttcatctttacgaacatcctccggggcataccgggccaagttgttgaactcatgcaaatactccataacagagcggttgccttgcttcaactcccgaaattccctcttcttaagggctacgaccccagctggcacatgggtcctctggaaagcggcggtgaagcgggcccaggtgattggctgtccttctggctgcgtagcctggaaatggtcccaccatagcgatgcgggcccctgcagctgatgggttacgaagataactttctccttatcattgcactggacggtgtccaactttttcccaacggcatgcaaccaatccaaggcatccacgtggttattggagctagagaaggtaggtgggcgaatgcggaggaactcggcaagcttggagtgctgtgggggtggtggtggcggtggtggagcattgtgttgcggcggattctagatatggtggaggagagcagccatcatgttggcctgctgggcgaggatttgggtgaggatggggctggtgccatgtggcggtggtggcggcggagggggaggtggaggtggaggtggactgccatggttgttgttgtggctgccttcggggtgactgccctaaccggtagcagtgcttctcctggttgtcaccatatgaagattccacacagaaccagcaaacagaaagagctgacgattaaaactaaccacccacgactaccataattcttaaatttatttctgctattaaattggttcattaaggttcaagttgcttacgcaaataaaataaagacaggctccgacacagttataccacacaccggtataaccatgccccacacaactcagcaagagaacaaacgaaaagaacacacgcgcgggcctactagctgctcgtctacttctgcgatgggtcggggcggaaggtgagcaatagcacatcctccgtgctgccaacgccagaggctcccaactcctgaggaaccacaggcgcaggctcagcgcaaggagtctccacgaagcaggtccatgccaaggactgacgaaccagctcaggcctggaggtactcttgcgggcggtaatcttctagctgcggcaaacgcggcggcgcttggggcggcagatctccccctgagcaatcttgagctgacacagctgcgcctccatagcgtccaagtccttcaactgcagattctcttgacgcagctccaggatcttcatgttgttctcgaccaggccacggcgcgccatgcggtagaagtcgatacgggccgcgtcgtacgcctctaccatgcgcgccagatgcatgatggtagcgtcatcctccgagctagcatcctggaaggtggcgtagtcgcgggctcctccacgacgagggtagtagcggtagggcgagtgctgcaactcgtccgggtagcgctggtgaagagtgccgatggcgaggagtgcagcgttctggcaggtggcggggaaggagtccctacccgcggtgacggccagcgaagtcctcttaggggagccggtgaggatcatcgcagtgacctcccaagcggcgcggggctccgcatcgtcaccatcctgctccggaagcctcttgccctggtagtccactccatgcggatatcccaggacaacgcacatgccccgcagctccaaagcaaagccagtcagatccagaccacgacggttgaggttggcggccatctataaataaagacaaaagaaaaattttagagatcagcttttgatgagaaatgaagcagcaagacagagagagactaaaggattttcacaaataagagatgatttttatttcaaaatactgctaaggcttgggttctagggttcgtcctagggtcaaggaggctctgataccaacttatcacgactggaattaacccaacatgcattccatacgtgcgtgtattattccttgtcccaggaggcaaggtacaccaaaagttgatacaattcagagtttaacaagcagaagtgtaaatagataaattattacatgggcggcgaaggcccagcacacacgaagacaaacggaaaacagcggaagactagggcgacgaccacaggcacttgacggcaggcacgagctagacaccaaagccttcatcctccaggaactccacttctgggttggggaaaaattgagcaagattgagtacaaccaccgtactcaacaagaaacacccacgaatgcagaataaatgcaaaggagtacaagggagttataataaaggggttagggtttgcagtaaatagcatttccaagacttttagttgctcagggccattttgtaaaggcgatcctgaagctacacaatgttgttaatcaaggccgtgaacccacacgaacctgccttaacccaaggcctacgatgattcagacagaactggcaacccgaccctgggtcccagctcgtcccaagccaacccaggctaaccattccacattttagttgttaagcaggttttaggaattaaaacactaacttgggtacattgctaggcttgcccataaccgagggcgcgactattcgaatagattatactctgatcagaggtgtacatctttacccacaagacacatcttcctcacgtgtaaccacgtgccacataccaccacggcatacggacggaggacatgacatagttcccaacccatcctagccgtaaacaagagtaccgacccaaccctggctacggccgggattcccgagacaggtaaccaagattgagcccctagcagcaggacaccaaccctgtgttatgacatctcgactactaggccgcagcttatgtagccttcatttgtcctagagatgtccatcgagccccgacttcgtccatccctatccgtgtacttttgtttatgaccagactgagctacaaactaggccttacccactagacatgtggaagtacggtagtgctttgtaacagagccccgaagaccggtccttatagtggccgaggtgctgctatcaaaaccatgtacctcgagcccagcctaaaaccattttgggggttttgaaaggagggggaggtgtgtgtccatttccacataatctaatcattccatagtgtccaggtgatatgagaattcccaaagtctaaaaattataaaaccacctaatgttgcctaattaatcagcgaagcatctacctaaattcatactagtggaaccatgaatagagtacccactagttggggtttcattttcctagggtgaacaaggtattaataacaatagcaataataataaggttataacaagggtaaataggcatggctaagtaaaacagtgataacgcgggaatttaaataaagcgataatgcattaatttaaaacaaaacataggacaacaatattttcaaaggagatgtgacttgccttgctcgctttcccaaacgtcggcgtcaacctccacgaagagcggatcttccgaagctgcagcgtctacacgaccaacggaaagaaaaaggcttttactctaataaactccatataacaagcagaaacaaagcacaaaaatgggttcttgacttcttaaggaaaaattagagacttgaacggtccaattccgagttcaaacggccaatatatggccatttgaagtttatatgctcttaatgtgaatatttgcgaatttcttcattcaaattttaattaaaaatagggtttattgcgtcagccgaggggagggggtgcggcggcggtgcggcgaagccggaggagacgacgccgtggcaggggacagtcccggcgagcggctaggcctggccggaggtcgacggcgacggcggagagagaggacggggagtggcggaaatggacgggggaggtgcggggagggtttatatagggccggggcgagagagggcggccggaggggaaggaaaccggcgcggcattcttgagctccatcaatggcgccggcgagattagggaaggggtttccaaacgaatccaagggagagagggagggaaaattggggggaaagggagagggaatcgggggaaacatttccccccacttgattttgaacgagggcggctagatgcggcggatttggcggcggcagtggcgctaggcgcgggcggagggagcagcgggagcggcgggaggagggggatgacgggtgggccctacccgtcagtgagggtggtgggcgggcccgcccgtcagcggcgcgcgcgcggggagaagccgagtgggccgcggggagaggagagagagagggggagggagttgggccgaattcggcccaagagagaggggcgagggttttagggttgtttttctttttataaaacctttttaactttgtttatttcttgataattattatttgtgctctgaaaattccactaaattttatttacacattttaggcttttaggaaatatacaaaaatcctccaagccttatttgacttttagctttgcacattttaatttttggaggctttcactaggattttaattattctaagcataatttaagggatatattttagggtcgttttgggacgtgacaaccgacacacaagtgtacgataaaatcgaggagatttgcagggtcgagggggctcctacactgtcagaggttgtactcccaaccatccatttttaatgagttcacttgtgcttcatagcataaattcctattcacatagttgggtttttccctgcacacattttttttgcaccggctggagcatgtacacttagggtatatttgctagtgcacaatataacagaggtatatatgctagtgtacaatataacaaatagtagagtaataaattatagttaggcagtcatgtcttaactccactgaccaagcaataagtcagcaagtggttcaaacaaataatcttattacatatggatgagtactcaacaagttttcattgtgagttaagttataattcatttagttcatcttttttaggatcaacacaagggtaattttgctagtgtacatttaagcaaaactgtagagtaaataattaactccaacttaaaaaactctgttctagacttatcccaatgacaaaaccgattgttaacttattactgaaataccctttttccacacatgttttcaactatctgtctttttttgtcacatataaaaggagcagtcaacaattatagtgtgatatgcatgtggagtcatacagtgactcacgtaaagatggaagttaacatttcacttagttcgatcgacaactacgttgggttaaccttttttttccaccttaaacactttttttttctgccagctattggccgagaccaatgaggacaccgatgtcgtaaattcaacaccatggtctcagccaaagcggtttattcgaaagcctccaagatttttgtcgccggtggttgttggcccaagtatcatgccatctgacgtgtcgctgagcgttcagctcagggacttcttattgaccaatggtggtcgtatggacaggtcggtgtacatcacactattgattatgtccttatggtgcatcatgttttcatccgttcccccctcctttttttggcttgctttcatttttacgggttttcgtgttattttttcatggtatgcttgcagcgtgaaattgctagagattgacagctccgttgcgtatggatacgatgtactcaaatcgttctccaatgggaatctgacagaggggctattcatagacccgttcagctcgattctgttcaaggaagacatgaggaacaggccagatacttttggaaaaaggattttcataccgacttctgtctcggtaacgtgatttacgtcaagctcaattgttttccttctttattccatacggtgcagcaacattattgtttgcctctcctttttcacaagattttgccctttttgtgtcactacaacaaatggcctcacttttttttttcagtatctcctgaacaacgactttatcaaacaaaatggtgagacacatgatttctccgccgatgctttggccggaaacttgcgcgactatatccagaacgttccgatgacgaagactcagatggtaacccccctcttcttcattagttagggtttagtgttcgcatcaagcctaatgccatgtatattttttgccgtttcattgagcatctcttgaacccagcaaatatatttggcaatttttcgtgcctttttacttttcaatccctgaatggatagataatgttacctgtgctccaccacgaccactggtctctgtacgccatcaacattgcacacaggcgggtggacattatggattcgaacaactacctttgattggaacactggagagcgaccaccatcgtgcgttgtccaaacgcatcgtcaagggtctgagcgatgcgctgcaggaggtagcgcctaagagtttctgcaggttcggcgacttcaggaggaacatgatgaagtgcccaaaaatgcaaatatgctccaacgactgtgcattttacatcgtgcggttcatggaggcttacgacggcaaccgggagtctatcgagactctttccatcccggtaactacagcaatcacaccctagcatcggtgtagtgacacattcatcgctcaatttcacattattatataccaattcacgaacaacattcttttcgcagaccaactcgtcgcttgtccggtcaagcatcctccaccagctgatgttcagcgagtacaaccaagccgcgcctcttcatcctgacatcgagatgttccgccgatccgatgttgtcgatcctgtcgcctaaaaaaatagttgtgctttttaccattttggaaaaactttcttcattgggatacaggatgtgtcatatgctataatctcatgtcttcaggcttcaccacagtttacaactagtgtggtaccagttcattttcaggatacaagacatcattttgtcattggtcattgtacagttcgatcctactggttagaatgacaacccccatatatattatctcctggcatgtcttttgtgcaatatgctgtcatgtatatttctaactgcctacttctttcaataatcctgataaagcaaacaacataatttttagggtttactcattttggagtttttttaactcgctcagcacaacaaacatgggtctgtttgtcggcagcaacgttcattgttttcaccagagtccggacacataagttactttttaactgaacagttaacaagtagacagactgggacaggatcaaaattcgatatcctacgtgactagagttaaaaattaactcagtcgtccagcacacctcttgtctatacacatttgcaaggttattatgcgaagagttaagtagttacccatccaaaagggtgtagcatacatcaatggactagcagaatctaagttaaaaatttacacagtaaaaccatactaataaccgagatcatccgaaaccctacgatgagttaaaaaattacttattgcttgagcagggagcatccgtacaacaaaccgtccaatgctatgggacaagtagttacataataactcgccatccctgttggcggctgttaaatgccgattctataccataagtgtacatagagataggtgcttaatctcacatattccataagtgttggtgtatatatgtatgcagatgataaaccctgaagttgggaggaaaatcagactaaagtgaggagaattatgtatccatacaaggaggggttatgaacatcatcgaaacatcagtaaatcaaccaaaaactccaagaaatagatagaggaaggtccagggagtccaccgaccgaaggtcaggccaggagggcccagcccaggttcggctgaaccccctggttcggccgaaccctggtgatcgccgttgatcccaggttttggcatggacatcccagatcactccctgatggcggttgcggggcagttcggacatttccccttctcacaaccatcataactgccctacgataggacctcacttcattcactctcacacacacttccaagcttgagctgaattataagaggctttattgtactatattgtatactagaataggaagagagtagagtagaaggagtcggaagaattccggagttgtcggtaatcttctcctatttcttttattctgtttattactctgaattcattataatattcttcttgagtaatt

SEQ ID NO: 29515 - DNA, 16740 bp, Oryza sativa
gtgattgctttggtgagttataaacactaaagtagatagtaattgcttagacgttttgtttaggtaattgttatccagtaattgatgcgtatcccacagtacgttgaggtgggtgtagaggtggtgacagccctcgagatcactaaagtcttccttgtccgggtacgtagtagagcgacatctgggaacagcgggttgccagtgcctgaagtactgcattaggattaaaaataagctttccctagaaacagtttctcactagtaaatcctctctatcctggcctatcaattgcttggtgtccttggatgaaccggaggaagtctgatcacacacgttcccttggattcgatacccttggaatactccgtaagggaagtgctacatcggtatatccgtgcgcttgcggattttatctgtaaccgtatcaattaccaacaagcatttctggcaccgttgccagggaacggttgctgatcatttccaaacccagttcatcctcatatcctttttcattttttttattctaccttcacccctgctatcctagagaagtattcctatcaaactcttctcgaccatcgtgcaacctctgtttgagctgtctgctcctcggggcgaattctatgagccacctccttcatcggagcccatttatacaactggctatgaaattcgtcccgagctaattagtatggttagggaaaatcctttttctggttttgatctaaaaaatccctaccatcatctgcgagactttgaacaagtctgctcatgccataagattcgtggcatgagacaagaaactgtgcggtggaaattgtttccgttctctcttcaagagagagcaaagaaatagtacacctctaccgttggatgtgtaaacggtagctaggaaaagctgcgagatagattctgtcttgccttcttcccagttactcgtattactgcccttcgagtagaaattctcaatttcaagcagatcgaaaacgagtcaattggtgcagcttggtccagattcactaatttagtacagtccggaccaaccctgtccttacctgagtatgtgcttctccaacatttccatacgggtttggataaggagtctgcattctatctggacataaccgctagaggatcattcatgcataaaacgccgtcagaaggaaaaacgatcttggatcgcattctagaaaatacttccttcatgacgcagtccaatgaaccccagctggaggcatccgtgtccaagatagaggaacctctaacgatcgagccatttgctgaaccgtccacttctgctagctcgattgatgagaaggttcctgagcagccatccgtcaagaatgaagaaattcagactccggattgtgccacaattatgttcagggacggttttgacgtagactacggcaataccctgaactattttagcaagaggaaaccacccgttcctttgtcacctcccgatcctatggaactcgggttcctacgagaaactgtccgggagttgacatccataatgagcgacgaatggcaaagggaggcagagctttcatccgaagtaatccggataaataccgctccccgaatcattccttgtcacctagaagggaacgatgtcggtattctctacagtccaactatcggggccaacctcatctctgtgtcctttgcattcgcttatttaagcgataaggcagtgaccccgacaaacaaattcttcaagcatccgaatagaaatattatcgaaggatttgggattgtgcaagatgtgcctgtcttctttgaagacagggaggcgatcttggatttccatgtctttgaaatccaagactttgatatcctaatcgggctgcccattgagcaacttctcatcaacacatcccgattaggtagcctcaaaataacactgggagagaatgaattctcaattccattctcgcgggcaaggatcaccttgaccgaccctctcccagaaactgagtcagcggaagaggttaccgcagttcctcctcatgagtctaccaaggcccttctagaagatgaggtccccgacttcatcaaggaagaagcagatcccagtgagactctcgacctgccaatcatggaaccaccacctcgacctccgctagagcttaaacctctacctccaggcctacgatatgccttcctacacaatgacagagaggctcctgtcataatcagtgacaagctctcggaagacgagactcaacgtcttctcaccgtgttagaaaagcatcgttctattcttggctactcgcttcaggaccttagggggattaatcccgcgctttgcacccatcgtattcctattgacctcgagagtactccctctagggaacctcaacgacggctcaataatgcaatgcgagaggttgtaaagaaagaggtcttgaaactcctgcatgccgggattatctatcccgtaccatacagtgagtgggttagcaaagttcaggttatgccaaagaagggaggaatgacggtcgttgcaaattctcaaaatgaactaattccgcaacgaaccgtaaccggatggaggatgtgtatcgattacaggaaactcaacaaggctacaaaaaaggatcatttcctgctacccttcaatgatgaaatgttggaatggctggcaaatcattccttcttctgtttcctcgatgggtattccggatatcatcaaattcccatccatccggaggactagagtgagactatattcacatgtccgtatggcacctatgcgtatcgtaggatgtcctttggactatgcaacgctcctgcacctttccaaaggtgtatgatgtctattttctcggacatgatcgaggatatcatggaagtcttcatggatgacttctcagtttatggaaagactttcggtcattgtctgcagaatctagacaaagtcttacaacgatgccaagaaaaggacctagtacttaattgggaaaagtgccattttatggtacgtgaagggataattcttgggcatcgagtgtccgaacgaggaagcgaagttgatcgtgctaaaatcgatgtgatagatcagcttcctcctctcgtgaacatcaaaggaatccacagcttcttgggtcatgccggcttttatagaaggttcattaaggacttttctataattgccagacctctgacaaatttgctagccaaggatgcgccttttgagttcgatgacgcgtgcctaaaatcttttgaaattctcaaaaaggcacttgtttttgctccaatcattcaacctcctgattggaccctacccttcgagattatgtgtgatgcaagtgactttgctgttgctgcggtcttgggctaaaccaaggataaaaggacacatgcaatctgttatgctagcaaaattctaaccagagcccagttgaattacgcaactacagaaaaagagctgctcacggttgtttttgctatcgacaagtttagatcttacttagtaggagccaaggtgataatttatactgatcatgctgctttgaaatacctgctcactaagaaagatgctaaacctcgtctcttaagaaggattttgctgctccaagaatttgacttagaaattaaagataaaaagggagtagaaaattctgtagcagatcatttgtccaagctgcagatcactaacatgtaggaacagccaatcaatgatttcttaagaaatgatatgctgatgacggttcgcgactccaacccgtggtatgccaatatagtgaactacatggtatctaagtacataccaccaggggaaaatcaacgaaaactaaagtatgaaagtcgccgtcacatatgggatgagccatacctatatcgggtgttctccgatggcctactacgaagatgtgtgccaactgaagaaggacttaagatcatagaacgatgccatgcctcaccctatggtggccattacggtgcattccgcacccaggccaagatttggcaaaatggtttcttctagccaacaatgtacgaagattcaaaagaattcatcagaaggtgcacaagctgccagaggcaaggaggaatcactactcgcgatgcaatgccccttacatacaatttacaagtcgagatattcgatgtttggggtatagacttcatgggacctttccctaagtctcgcaactgcgagtacattctggtggcagtcgactatgtctccaagtgggttgaggctatgccgtgcagcgccgcggaagcgaggcatgccaagaagatgttcacagaattcatcttcccaagatttggtacccctagaatggtcataagtgacggaggttctcacttcattgacaaaaccttccgagacctcctacgagaaatgggagccaaacacaatgtggccactccttaccacccacagaccagtggacaagcagaaacatcaaacaaacaaatcaagaatattctgcaaaagacggtcaacaaaatgggaacaggatggatggacagattgccggacgcactgtgggcatatcggacagcatacaagacacccattggaatgtccccatatcagatagtctacgggaagccatgtcgactccccgtagaacttgagcacagagcatactgggccatcaggaattggaacatggattttgagggagcaggagaatggagaaaaatgcagatcgctgaacttgaggaatggagagaaaaggcttaccacaacgcaaagatatacaaagaaaggacgaagcgctggcatgaaaaaaggataaagatcaagaaatttaagccaggagacaaagtactgatgttcaactccagggttaagcttttcggccacggaaaattgcgcagcaaatgggaaggaccgttcgatgtcatcaacacctcttcacacggggcaatcacactctgcgacgacttaggtaacatatttaaggtaaacggtcaacgtttaaggattttccttgagccaaataaaactttagataaagaagtggacgttattgaattaattaattatgaaccatgatgatctcatctaacgcatgctcaaaaccctgtatagttgtcatttttgtgcttagaataggttttagaggacctagggaaaaattagcggccagccggacccaccagggtggttcggccgagccatggcggttcccaatcggtcccaatttcgaatgatggtctcccccgctcgtccttagtccgtttagatgcgcgtttgaaggtacaacgttcggatcacaccaaaacactccttcttcctcctttcctccacctttgcacactctcctctcctattcaatccaattccttgaatttccactcatatccaccaatggctagcaaattcctaatcccattcattggctcttcctccaattccatttacgacctcaccggagagccgaaaccggcgaatcaattgatcccgatggaacactacaccatggaaggggtaaacgttgtatgggctcaaccccttgcagctgtgtcaggctcccttgcgaatttggagccgatcatcgagctccctggttcggccgaaccaggggttcggccgaaccaggggttcggccgaacccttctcggccccaatcggcccccgttcagcagcgcgatccctctccccttgccatgttacaagaacaaaaatccagggggattcgcctgcacaacggccgactacgggagagctcggcttgttaaaggcacgatgccttttccaagatgacgggaaggccgcaccgcctcccgccgagcgctttgtgggcaccctcttcaccaaggcaggggatgaggtgctccacaagtacaccacacccaccgctactccatccaccccaaagggggagcgtttccgcattcagggagtacgaactcccggcggtgggtatggtaagggtttactccggcctttaatggcatcggagaaggagggggcagcggagtcccgtagccctccacctatcaaggtgaagcttcatttgacgccccctccaattgtgagggctcctggccaattccaagaggatgaggtgaaatcgccggagccctcaatccacaagctcgccgctcaagtgaagaaactctgcaaggagaacatagagcttagggatcgcaatgcggagctaggggtagaactcgctaaaattagaaataattttgatacccgtagtcgcggtttgtgcgctaagatcaagcgtgcattcatagtgatggaaaaggaaaataagtattatgctaattagatgtttcctttcccatgaataaaatagcagtaggtgcttggttttatttttccaatcatgtaagcacttgctacaaataatgtggctcattggtgttaaccccaatgtttgccaaggtttttttttgttttatatttaataaagtttaggtttttaataagtgtgggggagatatcccagcttctgacgtgtatacactgaaaattgctgaatatctgaacacctggaaggcattgaactctacagaaaattgcaaaggtattgggcaccatagtggttcggctgaaccaccaggttcggccgaactagtgttggccccaatacctcctagttttcacaggtaagcaggtgagcatgtcttgtatctgtatatctccaccatggtatagtactagagctgaaaattgagaaacaattggttcaagcataagtaagagataaaatttccaactaatgaaattcttcatgtgattgatcttgtatattcattattctcagctgaactttgcttgtgaacaaccatccatgttttgggaaccttatacatctaagtaattgctttatgtgagatgattaagatgaaaggaatccttgcaacatggttatgactcttgggaatttattttcaaaaataaaattattttaagaaggctcaatcctccaattgactttaccttatacctaccaaggccatatgcaagtacattaatgatcaaccttatcatgcatatgactgcttgacattatattgagctttgtcaaaattgtgtgacttgtgttaaatatctttcatactctcatgatcaaggggtcactatcatttccactttccagttccacatataaaaaaaattggctaagcttctacactggaagttggctttccacaaaaatatccattcaaataaactcctacattggactatgctttcttctcctggaaaagttcttggcaaaaaaagaatgacaaaagggggaaaggcatggctatgaaaaaaaagagaaaagaaaaaaaagaaggaaataaaatttgctctcaaaacattgagcaaagaaaatatagccatgccccctccacaatcatgccaagaaaaccaatttggagagaaagtataggaaaaaggagaatcatttctttattccatcattccacaacatatttcacttttccattttcaaccacaaataaagatccttgatctaggagtatgattgatgatcttcttgagtccatatttttggctttgcaatatatatgatgcaagtatgtcaccagtttatccctaccaagctccacatatcagccttagaataggggtaaattctggcacactttgccttggtgaggatccaaaagaaaatatacatctttgagagacaagagagaaaagtcaatataaggaaaagagctagtttgcgaaaattcataaaaatcccatgagtatggcagagaagcaagaaggactggaatcaagattgttccatttatcaattactcaagatggtaagatagccattgatatagttcacaagtgcaggtatgggtgtgaatgatttatatgcttaattcatatcatgaagaaattcattctacactaacctttactcagggacgagcaaagggctaagtgtgggggttttgttggtggctattaaatgccgattctataccgccaacatttgcataaagtacagataataaagcatccaacatagagataggtgcttaatctcacatattccataagtgttggtgtatatttttatgcagaagataaaccctgaagttggaaggaaaatcagactaaagtgaggagaattatgtatccatacaaagaggggtcatgaacttcatcgaaacatcagtaaatcaacccaaaactccaagaaatggatagaggaaggtccagggagtccaccgaccaaaggccaggccaggaaggcctagcccaggttcggccgaaccccctggttcagccgaaccctggtgatcgccgttgatcccaggttttggcatggacatcccagatcactccctgatggcggttgcggggcagttcggacatttccccatctcacaaccgtcataactgccctataaaaggacctcacttcattcactctcacacacacttccaagcttgagctgaattataagaggctctattgtactatattgtatactagaataggaagagagtagagtagaaggagtcggaagaattctggagttgtcggtaatcttctcctatttcttttattctgtttattactctgaattcattataatattcttcttgagtaatttagatttatcttgtgagaattatctcttggttagttcctaaatagcatacaggattattgttcactataatcaactaaaatatagtgattgctttggtgagttataaacactaaagtagatagtaattgcttagacgttttgtttaggtaattgttatccagtaattgctgcgtatcccacagtacgttgaggtgggtgtagaggtggtgacagccctcgagatcactgaagtcctccctgtccgggtacgtagtagagcgacatctgggaacagcgggttgccagtgcctgaagtattgcgttaggattaaaattaagctttccctagacaccatttctcactagtaaatcctctctatcctagcctatcaattgcttggtgtccttggatgaaccggaggaagtctgatcacacacgttcccttggattcgatacccttggaatactccataggggaagtgctacatcggtatatccgtgcgcttgcggattttatctgtaaccttattaattaccaacaatcccccctcctgaccgatgatatgatgggattaaaaaagggttacaaaatcatacgtgttattactcatacgtatgcacgggtctaaagctaaaaaaacaactcaataagcacaacccacccaataaatcacgcagtaatataacgcggctaccgtacataagtaaatatttaactctaattgccatcatagcatcatctataatatatctttattcaaatctacacctcgaaggtctcatgtcacatggtttaactacaatgtagttaatttataacttgttacattgtagcaacgtccaatatcgccacattgtttgttacagaacatttcattcggtaccaaaaaaaaaataaacgggctgagcattaatcggacaagccgttatcacacaattaaccccacgatccgtttttttttaaaaaaaaaacccaaaaaactgggcgtgcaacacatgtagatccatcattatcgccagtgcttacgtccaaggcgtaactccacacagaaagcaaaaaaaaaaaagaatcagcaaccaagctagcttcaagttagtgggggctctcggagcacatccttccagtcactccttcatcttccttggctgctcatggcatcgccggagatcactagctccacgtcgttttgtccgccactcactcctcgctcatcaatgggttgccctccggcgagctctccacaccaacaatgtaccccaacgcgccaagcaggagatgctccctctcaatggatgccgccatgcttggatgataacgacattgcaacccccacgccgaatagggtctacaaccatgtaagttccactccttcaatcccactgtgttctatggtgaatattatcgacgtctagtttgcgatagtgatgcaccaaaagcacattatttcgagccacgattattttttttcgttgctatcgccgtgtgacgatactaactactcccactaaaaatataccattttttatattttatatatggtttgccaatatttcatgaatcacattcaccgattgattcttttaacgacaagcaattctcattgcattcaatagttaaaaactaactcaactcccattcctagaacaactaggttcaacaaacatctatgcacgataacttcgatctataagtaattttatatctctaaacctgacactcttgctacgtaattttggatgttttatatcactaccttcatgaatacgaaagttatttttaaactatcacaatgatcccgaacgcacgtctctgttttattaaccgaattaatcccatacctaaggaatacactagcaactggatacaagccattttttaactggcaatccacgtgctatactcagcagccataataattttagaaatggtatctaaactttcataatgtttccagtatttcatcgataatttattaacaaaacttatctttgctatataacagggtcctagcgtgccaccgcatatggtgcccaccgaaggcatggctttccctacatacgacaacgcatacaacttctaccagaggtatgcatgtcacgctggatttgacatcaagaagagccgtacgcacaaagcgtttcgcgaggtgtgttgtacgagggagggcaagcacgtgtcgaaggtcaccgatggtgatagacaacggaggagaccgtccaagaaaatggggtgcaaggcttttatgaagctgaggcacaactacgacggtggtgcgctctcatcggtggtgtatgatgtggtcgagctacagcacaaccaccctctaacgccatccccttcggcggtaaagcacatgcgtgcacataagaaccgcgacgacacagttatgcaatttgtggacactatgcaagaaagtcacgtgccgcaaagttgtatcatgggcgttctatctgatctccatggaggccaagacaatatccctttcacttcacgcgacgttgagaacaggtgatttttttaaattattccgtttcttggctttgtgatgttgctttcatgaaagtttcttttcgtgctttcttgcacgaagacacaaatgtggattgtaattaggacgttcccatctgaccgatgcaggaaagtagccaatgtccgaaaggaaaatgcgaatgacatcaacaagttgttggagtttttcaacgagtgcacgttgcaaaaccctaagttctactgggacgcccagcttgatgaaaatggtgtcattaagaacttgttttggagtcatgctagcagccaggttgaatttgctgactttggagatgcggtaacgtttgacaccacatacaaaactaatatttacgaaatgccacttgcaatgtttgttggtgcaaaccaccatatgcagagcacactcttcggatgtgccttgctcagagacgaaaaggtgcagtcatttgagtggttattcaacaccttcaacaagtacatggctaatttcccggctccgcgctgcatcctaacaggcaagtctatctacaaaaaactccctattgtcatccaccattaattttttccgtgtctccaatttatctacacttcctgtacgattgttttactgccatttacatcatttttttttcagatcaagatcctgctatggcagtcgctgtcgggcggtgcttccctgggataatacactgactctgtaggtggcatatcctcaaccgccactctgacccattgaacaccatttttgcacgggacgctcaaattgaaccagacatgatgttgtgcatcaatcaaacctacacgccttatgagtttgaaacatcatgggatcaattcataaagagttatgatttggagggctgtcccatcatgaaagctttatatgatatcagggaaaagtgggtgcctgcgttcttcaagaaggaatactgcaggaggatgacgtcgacgcagcggagcgagagcatgaacaagttggtgaagcacaagtttgctgaccaccaaaccgcgctgcaccgttttgctcggagaatgttggaggttataactgacaggaaggagaaggaggctgccgagacaagagcatgctcggttagtgatatttttactgggggaaacggtctgacatcactcctataattctactaaattttaactcacaccaactaattatatttctttttgtacatggaaagccaatgttggctgtacggtggccatctgttatacagatgtcgagactttacaccagggcggctttcagattgttcgaggaggtgcttcaggacagcactgacttcaggatcacacaagacgacaatttccgcaacgggtgggtagttgtcgacgttcgatgtcgcaatttcggtatttgcatagtatgggcatcgttggtacaaggatatatgcgagactaaggtaaaacagatagggacgaggatttttatacaggttcgggcccctgaattgtcaggtaatagccctacatactgttggccgaagcaggtcgttgctcttattcatcataatcacaccagtacaatatttggggtagcctatctaactgttgtcaacttagcagactgaagtatcatcacgtagtcgacaacagggtagtcttcctcctcgaatccatgcccggcgagatcaaagacagcgctagattcctctctttggttccgcaggtaccatatggggttttcctaggcttatctctgaaatcgatatccggcgtcttgtcttggcatatgttggcttgtatgttgatcttgtttattgatctattgttccgtgtcccctctcctcctagggggccttgtatttatacccctaggtgtccccttgtccaagtagaactagggaaaccaatatggatacaatccgagtagtccttatcgtttccatgtagaactctagtcatccttccttatgcggaactcctcctatatccgaaggttgtttccgtataagacatggtatgtggtgggtcctgccgagatttagtcaactactgctaggtatgtggtatccataaccctgacagcagtgtcacacaccaaacattccgaaaaacacaactagtgtcagaagcaattcaaggttattgcagatgtcgatgaaggggtatttacatgcaagtgcaaacagtgggagcatacaggtatttttatagtataaactcgatatcgatgttttatgtacgtttaacattttcagcattccgttatcacacatcgcaatactttggtttaaatgctctctcctttttttggatgtaatttaggcatgttctgcacacacatgctccgggcatttgttcatgtacaagttgagaagatacccgctgtctacatcctaaagaggtacacaatgaaagcgaagagcaacgtgccctttgataggcgggatcgagagacaactagaccagatggggttcaagaaagttacaggacaaatatgatgatgattgaagcgtttggagttgctagggcggcgtgcaaattgaaggtagcgtttgacagggctatggctgttctgaagggattgcgtagtcaagtagaggagataccgcgtgactctactgcgactgttgacaccaatacgcaagatggcattgctggacgagttcaaaacgccgaaataagcagggagcccccctcccccccccccaaagtcaagaataaaaggaaggacccatgacccggatgaggaagttcaacttggagccaagggcaaaaagttgtgcacacgggaatgtgggtggtgccatctgagggatgggcattacgcaaatacatgcccgacaaacccagcaaatttcgacaaggtgatgaaggctgctaataggggtaagggaaagaggggcaggccacgcggatccggcaggggtagaggacgtggtaccaatgttggatgcaaagttagtactgcagtccctagaacaacaaggagatcaagcaggaagggtccatcactgcgaagatgtttagacgacgagtgagctgaagatgcagctgaatctgctgggtatacagatgacgatcaaacaaatgcagacgatgatttcgggagttatgaaaacggttccgcacgattacagtatagacactccaattttatataacacagtctatatgatacttgtctttttttttcatctatgaatctgtattttaaattcaacagtgactagttccatccttatttaattatatccattctcactatccatcgtcgtatgttcagtttgatcaatgtggttctagaaactaaaattaaaaacccatagcgtctttgcgcacgagcgacaccaaaaccgaagttatttttcaacttacatacttgatcaaatcactcgagttcatccaataagagaacaagttaaattttaactcctttcagattttttcaataccatgttgaacacacactcatatatggactatgtgagttaaagtataactggcgtaccacgactgaccatatgtgatatttctaactcacccactgaatcaactcagccaaaccaacaaacatatcatgactaaacgattcattctttattatcttttaaaaagcggcagacataacaccaacatctaaaaactttaacccttttggactatgggtaatgtattcataaaaacatatggtctatcatatgtaatggtttgtggcaaaaattaaatagacatatcaaaactaatcacgtttatggcgcttgaaccgggttactggtgactgagcatctcttggcggggtctggtcatatcgaaagttgtaaatgtcctcttgtataatatcaaggtcaccgccgtcgtcgatgaaagctgggtgcagaataatcttgttgttggggtcttccggcggatttagatcgtcaacgtcagaagggggggaagggcatagggtagacatgtaccccaagtcctcgcgtagatcatgccatcatcttccatcgatggcgacagcgggtaagggggtggcgacagtggaggagggcttgtcaccccaaactcttcggggagatcactctcatgctcatcctgttgcagcgtggcatcggtggtggggttgtgagtgggatcgacaaaatgtgtctttgtggattcggtctcttgtttatcacccatggttgagttggctgcgtaatacaaatgatgagccgggcagtttatattggggaaactgacaggatggttgattcccacatatcagggcaaacaatctcagcgattttgtagcgattcttgtttgcatgcatgcgcgatatatctggagtaatgtgcgcatggataaacaaccataatgccaccacagcatagcgacgtaaagttattaaataactatatttaaatcatgtcgtgtaaagttattaaataacaatatgtaaatcatgtcgtgtaaaaaaatcctctgatacgtctttcagcatctataggctcattccagttattttttaactttgccaacgtttacttaaattctccccatggccctatagtactcccgaaacaaagacaaatttttaactccttacatgcgacatcgaaaggcaaaacaattatctcaatcagttaaactataacttctcacacacggaacgtcttcatcaccgatcggtctatgcaagttaattttaaactatttgacctcatatgcacaatcaaccaccaccgattttaacataaacatgactctgtcgtacgggtggaccacggtaaaaatttaacttgttatctgcaacatcttaactcatcaccaatatttaaaacagttaaatttttactatcacattcgctctccctttgacatgcgaactgcaggtatcgtttgcgccacaatttccgtcagttaatttttaactctctaataggttggtttggttttggtgggctgacattcctcatttgtgtgtggcgccatttaaaccgtggcgcgaagcgcatgtgagcgccactgtgtatatatatatatatgtgtgtctatatatagacatactataccgcatcctaataactaaaacactccccctcacactagggatgaaaacggagcggatagtttccgtccgctccggacaaaaacggatacggataactttcggatcggataattctcggatagttcggatacagatacgaatacggatattttctcccggatacaaatacgaatatggtaccagggtttccgtcggatacggataataattcggatatccggtgaacagtgctattcggatatccgcaggacccatgagacataccccatttctttttaactctataaccttcaatatacctttatagattttaatagtagtttatctctaacactagtccatactattaatattatttaaattttaaaaaatatttataaattatacctcattttatataaaatgagctaattatatatgttgatatttgtttctattagaagttgagttggttttcgtgttccgagaaaaatttatttccgtattcgtgtccgatcatattcgattcttattcgtattcgagataatccgtatttgttttcgtattcgagctatccgtattcgttttcgtatccggtaaaaaaatatgaaaacgaatatggtataaacattatccgtccatatccgctccgttttcatccctacctcacacctcacccccaacccccttcccacccacccaccct

SEQ ID NO: 29516 - DNA, 3017 bp, Oryza sativa
ggcggcggcggtttggggatgaggaggagcggcgaggaggaggagcagcggcgtgacggatccggcgatcgctccgcgtggactgcggcggcggcggatcggggatgaggaggagcagcgacgaggagcagcagcgtggttcggggatgaggaggagcggtgacgaggaggagcagcggtggtggaggatgagggaggcgagggagaagaggcttcgtgctcctcctcgcgttcgcccgcatctggctcctccctagggtcggagcactgcagcggaggtggaggatggaggaggatcagggacgcggcgatggtttgttccctcttcacttatgcttagtcccctgctctgccgatggtggtggaggtcctggatagggcggatatgacggaatcgacagcggcggagaggaggccacatcccggcgtccggttcacctcctccatgcggtggctggtgcaatccgagccatcgaggtgggcgacgatgccatcaaaggggtgggaagactggtcgttgccggctccatatccacaccagtgatgcggcggaccagatccaggtgcttcttgcttcttttccccacgaagagagacaaagagggagaagaaagggatgccagtgatgctgcaatgcaacgtctcctctgtgcgcctggcatcaaccccatcgatctgatcatcttctttctcctgttcgtcttcgttttctttccttcttttctctgacacgcccattgattttgcaaagatttcactgtggtgatgcctgctgagtactgttctcataatgcattcagacggttggtggtgctcccctccaaccgagtgaccgtcagcaggagagggcggtggcatcctgcggtggctggagcgacgactggtgctgctccactcccccaagttgagacctattggaggagcaggcggcagcttccggcggtggccaggcgtaggcatttgatcagagattcataatgtacacaacagtgcatcagatctttgttgggatacatacatctgttttgcattccgttttcattgatttgcaggtttcctgatcagagcagtagaacaccacctgcaacatgcacatactctggtgtttctctgcattggctatttttgccaacaagatcatcaacaccccaccctccaggtacaaatatgacccttcacatgctttgatctctctgggtgcctgcggtatgtttttcacatgcatccaaatatgttggtaactaggatttatttttggggatttttttcctcctgaatagagcagagcagctcgactgcctcttgtattgttttcattagtcttctgagaacatttagttgatatgctagcagtttctgaaattttctacctgataagtttctgaaattttgtagtagtagttgatatcttattagcttctgaaatttcgtagttcagcacaacacctagctgataggctaaacagtcctctgaatttttttaagaatacttctttgaatggctgaaagatggatggagaatcttcattgagagagatgtttttcagagctctgaatgtcattttgtccaagtgaagccattttaaaattttcattttggttggctggacagtttgatactctgttggcatcgaagctctgaaatattgtgaaagttgtggggtttggtgaggtcgaaggataacagctttggtgtaatttacaagcgcatacaaaaaacttactaacaactgcattaaggctgcgttctttcaggggagataggggggattgtccctcgttttccgcgcgcacgcttttcaaactactatacgttgcgtttttcgcaaaaattttctataggaaagttgctttaaaaaatcatattaatccattttttaagtttaaaatagttaatactcaattaatcatgtgctaatggctcacctcgttttgcatatcttcccaatcttctctatttccttctcctcaaacacagcctaagttcacaggtatattaacatattgtgtgcatggaaccatccactgaaaatatagtgccagatattgctgggaagcagtgcaaccagtccatagattagctgcacttgctgatcaggattatgaagcctaaccctgctgcttgcaagaatgatttcaagtggaatctctttatccagtttagaaatcagaattgaagaggtgcttaaattcatgctggagatgacaaatgcgtaatttttctatccatcaacacggcttgcccctctgctcgccgctggggaagattgatgcaccgacgaagtggcctctgccgactgctccctcaacaccagatccaacacgtaccaagcagtcacgccgacacattgtggatttagcttcatgtttccttctcttttttttttttgcctgtggatgtgtaattttttttacccatacagtgacatgttgatcatttactcctaatttggtgaaaatgttgatcgtttactcctaatttggtttctcctgagtgatccagtgaaaaatatacctgactaaaagtaaaagtattacttcacgtgaaaaatacacttgagtaaaagtattactacgttatgtggcagtatggttaaaatgtaaattttgtgccatttgagtttagtcgaagagtaaatctattactacatttgcaactctacctgattatacagaagtaatctatttactaagagaagatgcctctacaatctgtgtaagaagaatgagcagtaccatttatagaaccagtagtaatttttttactaagagaagatgcctgtgtaatatgtgcaagaagaagaacgagcagtaccctatatagaaccagtagtaatttttttactgatatgatatttttggggtacttcattgtaaagggaaaagcattgtctaccataaacccaattagtaaatttgttactcaaggaaacattgtatgtgtgggaaaaaaaactaaaaaaaagaaaaaagaggaaacgaacggtagttactgtgtgcgggcgaaaaaaagaaaa

SEQ ID NO: 29517 - DNA, 1374 bp, Oryza sativa
gagggtgggttgtgaggggagcgttttaactattacgtatcctgggtgaataacagttctataccccctcctcctcaagagcccaacacgcctcccccttcttttgttgggctcaaaacccacctcccaccccagttaaagcgtggtcaaaggacggtcaaatcgctgcctgttgatggtcattattgatcagtttcgactctcaatattactaaaataaaggaaaactagtgatacttgcaatgcatatatctgttagaacaataatattccactagtattaggtctactaacatttttgcagagaatgacaataaagtggaggagaatcgacatcaacatagacgataaatcaatcggacgatgttgagagttagacttatgcatgaatgggccaagaactcagaattgacacgacatactgggccaaatttcacaagtctacggaggagaacaacagaggaggccacctgccgaatatgggccaggttgggccggcccctggttcggccgaacctcccccggtgccgttggatccaggttttggctggaaggcgtggatcactccccaatgaaggttggagggcaattccgaccattccaactgccacaaccgtcattggcagcctatttaaggagctgctctcctcacttcactcatacacctcaagcaatagctctctcatttctctcaagtttagtttagtagtatctagctggtggaataggaatagagtagaaatcaggagtccggaagccttcggaagagttcgggtatagctctagcagatttcctttcctcttttgtaagctttgtacttttattagaatactcttctaaatacatttatggtattgaaatacttttcaagtatatgaatacctactttacattatgttcatgttatactgaatatacggctagcttatctgggagatcctttggggcgggtataatgtttgcttatgcaattactctatgtcatgacgatgatattagagtagtatctggtagtttaggcgtggtgtctagattacaggatatcattatttggggttatatattacggatgagaggtgggccgctgatggtgacagctcagtacgggtattccttcgcgccggtatataatcctaagttaattccctgggagggtattactccgtatttagccccggttgtatggtcatgacgggctgtcgtaaggaactcggcagtcaggggtggcttctcgaagtactaggcgggcatcggatagagggtattagctagtatattagttaactagaatgtatgtatactattagaagtataggaatagattttctttctcttttctctccacttagcttagatgatatattatgagaatg

SEQ ID NO: 29518 - DNA, 512 bp, Oryza sativa; identical to SEQ ID NO: 24413

SEQ ID NO: 29519 - DNA, 2135 bp, Oryza sativa
  unsure (1)..(2135): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtctctactagctgtgtacgttgtcctactatacggccagtccatgaatatatcctgctttcagatttgatagatacttccccgcaaaaaaaaaaagatactgtatagctatgcatgtcatgaccggattgtgaatattgaacatatatcatgcaatacgttttattattttgatctatcactcgaagagctttcgtacgtgttatcgtgtctgaaagtctctgcggcaacatttaattaattggcattttaaatttcgccgtaacatatctctggcggcggcagcagccccatcttccccaaccatggcagcagcccccacgccctgaacctgccaaagtgtccactcccatcgtccacgacttggtttgtcctctgatcgatctctggatgatggggatgagtcgttcatctgtctgaagcaatttgcccatcagcgattcattcaacgatgcagaggaataatcccaatctttgctcttgcagtattcctcaaaattgggccatgtttccttcttttttttattagaggagtttcaatccgtggtggtgggttgtcgcttgtgattttttttttgacagattgcctttgctgcccttgatgcaaaactgctgaagattaaggcatctctttaatctgctgctgcaagctcgttatggtgttgcggttctatactgtcttcgttatggtgtcgcgcttctatactgtcttttttttttttctgaattctgcagctgttactgaggctgtgtttagatctaaagtttggatccaaacttcagtctttttctatcacatcaacctgtcatacaaatacaacttttcagtcacatcatctctaatttcaaccaaaatacaaactttacgctaaactaaacacagcctgaataatggtgctggcgctgaaagttgttgttgctgttgttcatgatgatgtgctgctcttgatgctgcagacctgctgctagttttggggtctgctgttgattgcttgttgcttgccatgcttatatcaaaggggatcacctatacatttgttgataaattttctccgaaaaatttaacagatgtaattatagtaccatcgtactgtaattacactgtaacttatatgtaattacactgtaacttgcatgtaactacagtataacttgtatgtaactttcacgtaattttgaatcattagatctattacaagatttgttctagtgatgaacaaaaagatcacagcacacacatatatgaaatgatttattctcacgacctcgattttaccgaaataacatgttacggagagatttttgaaagttacatacaagttatattatggttacagtgtaattacatgcgagttacaatgtaattacactgcgattatactgtaattacatctgtcaaatttttgggagaaaatttgtcgacaaatatatagcaaaattgtatctggttttgcggtttggaggcgattttgtatctcgatgataagttgagggaccttcggtgtactttttccgagagattgattcctctacaaaagtctatagaatatccttcagagctcatccccagcctcattcctctacctaaagtctgtattgtgtccctctacaacccagagccctctatggaagtccaaaatcacgtccttcccgagacaccctcctcatcggtttataaattctcccaaacttcagaaattgatatctttcgaaccgtagccccgattgactccattcaacttccagaattcctctaaaatcaggatctatcaaatggcacaattagttcatgatgattcgtactttatttggaggattttatatggttttctattattgaccgcgatattctggatatttatcgcatgtgggtattctaattatttaact

SEQ ID NO: 29520 - DNA, 2311 bp, Oryza sativa; identical to SEQ ID NO: 24414
  unsure (1)..(2311): unsure at all n locations

SEQ ID NO: 29521 - DNA, 2100 bp, Oryza sativa
  unsure (1)..(2100): unsure at all n locations
ttacttcaaatggcataccaaaattacctttcttttgttctaagttacttctataatatatgtaaattacttttagactttactgaatctacttttatatgtttaagaagtagcttagtgaaatctaaaagtaatttagacatatcataaaagtaatttatgatttttcatcaaaatataattatatgagatcttgttgtaaagatttaattgttaagaacacaacagtgtaatcggattacaaatcagatgagtaatttaagagaaaattttatttaaagcatagatgataagaatatttttcctacttatttaatggactagtactgtaaaagacatgcacgttgacataaaaggttggtacaaatccatgccaacctagccttaaactctggcttagatttctctcacactgcaagtggaccgtcgctgattagtactaaaccgagagcgctctcggtttagattttacgtaattttaaccattatatctctatcttaaaaaataaatctggtgtccccactttaaaaaaaattgccgtgtttgctccaacgaaaaaaaatcaggcagggtatttacgttctattctttttttccggtggcgtaaatacgttactacgtattatttgtttttctccctttcttggcaaaaacaaacagtactactacgcatatcgtacgtacacgtaccgacgtacgggagtttaggaggaattgttaatcgatataaaatcacatgttaccgatttaagtgaaaatctattattagatttttttctcataatttttaatatttcttttagtttagagatatgacacgtggtgacctaagatcgtttacacgagtgccatgtgacgacttaagagcatttatatcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcttcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacaaatcatagctttaaactccatgtagggcttggtatcggttccgtcatttggtccgcggcaaatggagagaaagacttaggcggaagttcaaatttcctgtgagtaaacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatacgcatgtgtacacattttctataatgtaaatatattttggtcatatatatatctatatacatatgcatnggcataacatatatatgtataaatacatatatattatgcatgtttatacatataatataatataatatatatatatacatatatatatgtatgcatatatatgtattgaaacatatatatgcatggtttatatatatatatatatatatatatatatatat

SEQ ID NO: 29522 - DNA, 1120 bp, Oryza sativa
ccccccttaggatagtgtatgacattagtagtgacgacgaaccatgttcgtcgaatcgttccttagggagtggggattgctttgggggtggagacgtaatttatttgtaagctaggctgtaaagccggtgctatttgtacttgtatcatgttgtatgattgcatcctccgattatttttcgaagttaataaagatgtgttttatttccttttcgctgtttttcgcattgtcacctttcgtgctttcgttaggtcgaactgtgtcggcccctttgcgtatactagcgaaataggtatgctgacttttcagctttcgtctttcgttttcggtctgtggtattccgagctgaaggaagcgcttatgttttcacatggatcgagtgtaacggtgttggttagttatttcccgaaacaagctatcgcggtttcaacgcttggtgagcaatgcttcggccgatttgtttcgcccccccccggcgttttcgctgatcaggcgtttgccttggggtttttccacgaattatcattcacacaagtgcgaaagacacaaggcttttatactggttcgggcctccaaggtggataatagccctacatccagtttctttttccttttttcattttcctctttttttttgtatttttgtgccgaaaggcttacataatgagagatgccggaaggcctatacaatagtatgtacattttttacaagttggcgatttgggtgccacccgttctagacatagaaacgcttaagggaagcagcgttccaggaatggtcgaactctttgccttccagcgttgctaggcgaaaggagcctatcctggacctatgtttgatgaggtatggcccttcctacttcaattcaagcttcccgaccgccaccgggttcgccttcttccttaggacgagatggctaagcaatagctctgtcggtcgaacctttttgttgtaagttgccgaagtgcttgtggcgtatttgcgcatgtgttccaatgcttcgactctcaccccctctaggagttcgagcgacacctcgcgcccatcttcgcctccagagaacatcaccttggtgaattagcccctagctcagttggggtcattgcttcatcgccatag

SEQ ID NO: 29523 - DNA, 1471 bp, Oryza sativa; identical to SEQ ID NO: 24416
  unsure (1)..(1471): unsure at all n locations

SEQ ID NO: 29524 - DNA, 702 bp, Oryza sativa
  unsure (1)..(702): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttagtacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgtagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgctgagatcatnnnnnnnnnnnnnnnnnnnnnnnnnnnnnnnnnnn

SEQ ID NO: 29525 - DNA, 972 bp, Oryza sativa
  unsure (1)..(972): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcagggcaaagctccatggcaaagactatgcggcgaagacggcaaaggatgaagcctcatggcgaagaccgtgcatcctgggcgaaggtcaaagggcgaagggtatacgccgaaggaggatgacttcgccatatcgaggccagcaccgggaaggcccaaggtgtcatccaagccgcttcggcccattggccattaggccagcgatcgccgatttggcccattagaggcccatgcacctcaattacactgtatgcccatgtaaatgtccctttcataagagcaaccatgtaaattcccctgtaaaacctaaacccaaatagggggggcttgtaatagggttataaatagacccctagggccatgtaaatgggggattttggaagaaaaattctcagtttaatacatttttactgctttccaaccactgttgaggtaccacgtccttcgacgtatgcagttgtcatttcgacaatagctggcgccgacgttggggacctccgagcgaaaccactgagagtaaatggcaccgaagagggtcgtgaaggagaaggttgcaaagcgaatggggagtgaagcaggagaggagatggccgccgaagagggagccgagccttcggcgccatcgttgaaactgggggagcaccgtcggcttcggcacctgcgccgcaaccgccaccttcagctcttgccacttcgtcagggctggtgccaaacacggtcgacgcggcgaaggcagctacggcagcaagggcgctccagatcagggcagagatcctttcgacgagccagctgctggtgccccaagccgcttcgtcacagctggggtaccgagctcgaattcgcc

SEQ ID NO: 29526 - DNA, 1787 bp, Oryza sativa
cgaacgaacgcgaacgaacgcgaacgaacgtgactgaaacatgaatgaacgtgagtgttagtgaacgaacacgaacgaacgtgaatgaaacgtgaacgaacgtgattgaaacgttaacgaacgtgaatgcacttgaactaaaagtgtgagaacgaacgcgagcgaaatgtgtacgaacgagataattaaactattgttgaacttaccatatatatatgattatatatacttgaaaacatgaaatacattatatgttcctttgcatttagactaatacattttttttgcatgttgcagagaagacgtcgtcgttgtcgtccctcaagccgaagtggtagctagccctcgaaggaattcacgcaggcaagtgatgtaaagatgtgattgttagagatataatataagattgttagatttctaatataagattattagattattagagttagcatatgtgagtgttaaagattattagattattagacttagcatatttgagtgttagagatagttagagatttaatataagattcttagaggtttaatatacgaaacttaattagacttagcatatgtcagtgttagatatttaatataagattattagagatataatattcgaaacatatttgattgttagagatttaatataagattattagagatgtaatattcgaaacttaattagacttagcatatatgattatctaccgtacaaatacacgacacttagacttagcatatttgagtgttagagatagttagagatttaatataagattattagaggtttaatatacgaaacttaattagacttagcatatgtgagtgttagagatttaatataagattattagagatgtaatattcgaaacatatttgattgttagagatttaatataagattattagagatgtaatatttcaaacttaattagacttagcatatatgattatctaccgtacaaatacacgatacttagacttagcataaatgattatttgagttttaatacaagattagtagagtgttaatattacgcttagcaaatatttcttctatgaacagatggctgatcgcgatgaggaacagatactgtacgatacaatcgcatcgggaagcagccagtactggaacgaagaagaggggaacgaggatccaaaccagtacttgaacgaggagagggatgcagaggggaacaaggagggaaacgtggagagagatgcggaggggaatgaggaggaggatagtggaagtcatccctccgctggacagaagagggcacgcggacaacgaggtgccgcgaagaagatagagggtcggcacatcataactgaggtggacgcagacagccgacctagtgccccggcacaagcagccaagaattttgtacgccacagcggttgggttgtgagggataacgtgcctgtcagcaaggtgtactagcgcagaacaagggcacgcggggataatgacagctttgtcccgaaatcagagaaagagatgctgtgaaccacaatgctcgagacgttcacgctccttgcgggtacggagaacatagtgaaacagtggactcttaagaaaatggcagaacagttccagaccttcaagggagatctgtaccggaaatacatcctgaaggggcagacaccgaacttcgacgtattcccgaagctaagggatcactaggacgagttcgttgcttacaagacaggtcaacaagggcaggcgatgatggaaagaaacaaagaaaatgccgccaagaagaagtaccatcaccggggat

SEQ ID NO: 29527 - DNA, 1493 bp, Oryza sativa
  unsure (1)..(1493): unsure at all n locations
acgtatatacacgccttcctcgccagctactccaggactctgcctccagtactgctcctgctaccctcgcctcctacgcctgccgttgccaccatagactagcgtcgaagcgtagcaagaggattgcggccaagcttgcgctcgccggcccgagtgacatgaccttatgtgcgcagcacaatttgatgcgcaagcttgggttggtgcctgagaagggtcatgtgttggccgaggctgttacggcttacaacgccctcttctcccagcccctccctctggatcacgccatagccctatcttcactcttccccagctccttgcctcaaacgcaggctggagtgtagtgggatccccaaccccaccatgcattgggataggagatttttcttttttagtagcttatcttctttgtatttgttttctttttcttttttcactactagaggacccctcttctatcccagttggcaacctcctttacttccgggtaacgaaccaggagaaagaatccaggactaaagaagcccagtatacatggactatatataaatgaacaaaacctctatctcatctttcaatcctgccgctccaaccactcatgcatctcaccactagcgtgcgccgctcattcatccctagcccctcatcccgccctccacctgcttccgcacctnctcctcaacctccatacaggacagcgcctggcattgtaccagccattgaacgcggtagggctcattcaataattgtgtcctggcttgttggcatgtggatgatccagccaggcccctgtcttccatgcgttgctgccccccagaagagcaaaacgtcatgccgtagttccgccattgtccctctaagcatcgtctctacttctctaaccaatggagccctgggcggggcttagtgacccactagggacggtggtgttctagctgacatgttatgaccgccatctcgttgctaaccctaccaggtaagccctcttctttttgttttttattcacaatctacctcagtgatcaagaaggagagagatcagaaaagagataccacaagcaggtaactgattcacaatggtgtcggtctggggacaatggcgacaggagggtccatgtgaggaacccccaccccaacaggtgtatttttctagggaatttccttattctactccctccatcccaatttgatcataacctaagcaaagggcaccaagaccaagaacaccaaaacatccatctttctgaaattaatcctcatcaatcaaggtgctccgttgcttcgtgtccaacaaaattttaaaggttgtatgtgttgaaccaatataaattaaacttgattggttgcatacatgcatgcaaggcattccacaatgcacatttactattagcataaataaacaaagagccactttgttagatgataatcatttttgaaaacgcaaaatctaaaccgagagcgctctcgatttagtcttaaatagcgacacactt

SEQ ID NO: 29528 - DNA, 705 bp, Oryza sativa; identical to SEQ ID NO: 24417

SEQ ID NO: 29529 - DNA, 339 bp, Oryza sativa
tgttcaacctatcacataataagtttacgagtattggatctgatcaccctttgcttcctgtttacattgaattcttcgatctcagtttcaacaatattgaaggggtaatacctataccaaaagaaggaagtgtcacccttgattactccaacaaccggttctcatctctgcctctcaatttctctacttacctatcaaatactgtccttttcaaggcctccaataatagcatatctggaaacattccaccatccatctgtgataggattaagagtttacaactcattgatctctctaacaacaatttgactggcttaataccatcgtgtctgatggagg

SEQ ID NO: 29530 - DNA, 664 bp, Oryza sativa
atgctcaaatcaatgataatggacacgtgtgataatgatatgttaatgagagaacaacatctgtattaccgtggcaagatgcagtcataccagttcactgctggaatctcatacaaaggtagtggcctgacgatttccaagaccttaagaacacttgtactcattgatgtctcaaataacgctttccatggtagaatccctagaagcattggggaacttgtgttgcttcgtgctctcaacatgtctcataatgctcttacgggtccaatcccagttcagtttgctaacttgaaacaacttgaattgttagacctctcgtcaaatgagctttctggggaaatcctttgaaaattagcacctcgagaaatgtttttgccacctttgaaatcgagccatagatatttgatcctctttgtcttgactgcttgagatttggtgtctgctctagaattacaattctagcaatatgttgaagtaatcttgtgagagtacttctatagacaatagactaaaagattatttttgttattgacccttgatcacctcagaaacaatcagaaagagaaggtcctgaaactatatcaaattaagcatctttgcctctgcaattctctagcttggaaagaaaacaatcgtgggtaccgagctcgaattcgccctatag

SEQ ID NO: 29531 - DNA, 700 bp, Oryza sativa
  unsure (1)..(700): unsure at all n locations
tatattttggaacgagtatagtataattttacacctcaaagcataatactcaacttatatgtgtattattatttattatggttttagcataattttgttgtttcgttgttatttggttgtcatgcaaatggcaaaagacagtgtttagaagagtgttttcttatatttggatttaataggttcattggtttaatattatggatctaccgatttaaattgacattaattaaggattactttttttttctttataatatttttttctaaatttaaattattagctagaaaataggaaggtgagagagaggattattggaggatggaggaagtgtacgtacatgcctatgtgcgtgcacggggtgttcggaggatcagtctgcttttcatctaatctaaataggaaagagaaaaagaaaaaaaaatagatgtgcaaccgggagtacgtacgtacgtttggttttttttaatacctatccacgtacttaatgggaaatttttacataaatctaatggttgaaaataatgggttcaccagattaaatgaaatcgatggttagatgctttacttttttttcttagaatttctataatttattagagtgcaacatggcggtgtaagagcgtttctagatatgccacgtggcannnnnnnnnnnnnnnnnnnnnnnnnnnnnnnnnnnnnnnnnnnnnnnnnnnnnnn

SEQ ID NO: 29532 - DNA, 966 bp, Oryza sativa; identical to SEQ ID NO: 24418

SEQ ID NO: 29533 - DNA, 602 bp, Oryza sativa
gggcgaattcgagctcggtacccctataaccacatgtaacaatgctcaaaagcattaataattatcacaatgttattctgaagtataacatttacccatgagatgtaaagaaaaaagatattatgcatcaaattaaatatgaagattattttaagttttctatatgatcaaaattttagttatgtcttgccttgcgcctcgagatttcccgcggcttaagcgtagccatctgggtccacgtcagctccttggatgtcgatagagcttgctctacggtctaacgtacgagtacgaaaaagatagcaaataaagcctataagcaaattgctacaaagaaacgataaaaccaaggaataaataaaattggagcaaggcaaggggaaaaataatggtttaaaataaattttgatttggaaaataaaagaggggttttggtttctaaaggttggaattgaaggaaaggataaaatggataggtgtggttgatttggtggatttggttttctagtcggtgctagagtaaggcagcacgacggctagatatttggagttggttagctgatgctaaggatggggggatcctctagagtcgacctgcaggc

SEQ ID NO: 29534 - DNA, 640 bp, Oryza sativa
aaggcactggtcgcgatcgcgtcggccaaggtggcaaagcggggtccggtcaagaagacctccaaaaggatagggctcgtcgaggtcggtcgcgcttttagcgatgacgagtcctccgatgaaacccctacttcgcctactggccggagcttggggctttcgactgctccttgttaggcaagaaaagattaaagctaatcttcttcgtttaatccctcccacgagagaatagagagggatttggagggtgatttaatgcactctattgtggtgcagaactattccctctcaaaaatccccttcaatccctctttcttatagattaacagaacaaggtattagtgttttttttattgttacgagacttggaatctaaatataccctttggctacgtataatgacatcggatttatcaccattttttttaaaaaaaaactaaagcctcagtcaaccgctgactacgaaaccgtttgttcaaaacttatcgactgaaatgggccgtgtcatatggacctatgttttcaatctttcttttctttatttttgaaaagagttttcaatcaaattaatacgacatatgaacggttggctggataaactgccaccactaatttttaaaaccagctagctagatagaat

SEQ ID NO: 29535 - DNA, 668 bp, Oryza sativa; identical to SEQ ID NO: 24419

SEQ ID NO: 29536 - DNA, 1300 bp, Oryza sativa
ccatctacgagtccgcgatcgaagccgctcacggcgatgaaaacaccaaggcaaaggtaatccatctcgctttagatggcatcacccgttcttggtatttcaatttaccagctaatagcatttactcatgggagcaattccccgacatctttgtccctaactttcgaggcacttatgaggagccgaagatgcagcagcatctactcggcattcgccagaggccgggggaatcaataagagaatacatgcgtcgtttctcgcaagcccgatgccaagttcaagatataaccgaagcgtctgtcatcaacgccgcttcggccgggctgctcggaggtgaactcacaaggaaaatcaccaacaaggagccgcagacactcgagcacctgcttcgcatcatcgacgggtacgcaagaggcgaagaggattccaagcgacggcaagcaatctaagccgagtacgataaagcctccatcaccacagcccaagcccaagtacaagcacaggtcgccgaaccggctcctctcaccgttcgccaacctcagctggcaaaccaaggacagccgccaaggccaagtcaagctcccatgacttggaggaaattcagaaatgaccgcacgggcaaggctgtgatggctatcgaagaggtccaagccctccgcaaggagttcgacgctcagcaagcagtcagcaatcagcagcctgttcgcaagaaggtcaggaaggacctctattgcgcattccacgggcgatcctcgcacactaccgagtaatgctgaaacatccggcagcgtggcaacgctcaagacccaaggctgcagcaaggggcagctgtcgaagcacctcgcgaagccgcccaagaacaagcacccccagtcgaacagcgccaggacatccagctcggagtaattcaagtgattacaagggccgatccaccagttcaacagtcgaagcggcagaagaagatgcagctgcgaacggtgcacaacatcaccgcggcaggccaaggggctctgaggtacttgaactagcatatctcttttgggccagaagacgccgaaggggtgctattcccacatcaagaccccttggtgatctcggtcgaagtagctggcttcgaagttcggcgaattttggttgacgggggaagctcgaccgatgtcatctttgctgaagcatatgccaaaatggggttgccaaccctagccctcacctaggcaccagcctcgcttcgtggttttggcggtagagaagttcaagttttgggccaagtacaactggtggtagctttcggcacaagtga

SEQ ID NO: 29537 - DNA, 1001 bp, Oryza sativa; identical to SEQ ID NO: 24422

SEQ ID NO: 29538 - DNA, 578 bp, Oryza sativa; identical to SEQ ID NO: 24423
  unsure (1)..(578): unsure at all n locations

SEQ ID NO: 29539 - DNA, 1003 bp, Oryza sativa
ttatagtcctgtcgggtttcgccactatccaactctattgaccgtcgatccagcgggatggcaaaggtggaatatgcgaggagaggcagaagagtcggctagaggcaggtacctacttgctactcccctgctgcagcagagatgaaggttagggaccgctagcccatgtagctcgggagaaaaaagcttgggggcaagagccgacggagctccggtggtggaggtcggggaggatgggaagaagcggcaggggatgggcgacaaccagatttgcccttctcggccataatgttcttctcccctcttgatctattcttctttcttttgcctcattaggcggcgtctaacgcagatggatgtgtacctttgagcaatgacaactaatgagcagcttgagctcaaggcggcgtcaacagccggtagagctcaggcaaccaagattagtggcatgagtggacggagctccagcgatagaggttgaggaggacgggatagaaacggcacaacatctagccatcattcctcctctcggcgccccatccctatagcagtcatcaaggaagaagaggagcagtgccctccaaatctgacattaacactacccgtagcccgttggaggtgaggggagcgcaaccatgtagatggatctggagaagagaggtcgggtggaggcaggaggtgtggaagacgatgagtggtgaagatagtggccgtcatgtggtggaggtaggaggcatggtggaggtgtgtagaagactataagtggcgaagtatgactgtcacgcgggtcccattgactataaccagattttatcgccatgtcaaatgccatgtaagtttaaaataggcttgtagttggatatgggggtaaatagattggttcgaagagttgagaggggagaaagtgctggattattaattaaggggaataaatcggactcacacgatagtgggaaatcagacttttccttttttatgagctaaatgtatggatctttcttgg

SEQ ID NO: 29540 - DNA, 5175 bp, Oryza sativa
  unsure (1)..(5175): unsure at all n locations
nnnnnnnnnnnnnnnnnnnnnnnnnnnnnnnnnnnnnnnnnnnnnnnnnnnnnnnnnnnnnnnnctaaggcaaaggtggtggcggatagaggagagctcgggggtccttttaaaggggctagcgagcggcgacggaggcccacggcgaccggcggcgagaaggaaaggtcggggattcggaggagagaagtcgatccgattcgagatcgaatccacgagtttccaaaccgaattaggcgacgcttccaaaagagaaaaggaagaggagatctcggagatcatttcccctctattgatttggccggagaaggaaagacgcggccgaatttggaaggagacggcggcggcttgcgctagggtttcgggcggcggcggcggcgcgaggaagacggatccgacaagcggggcccacctgtcagcggctgagagagagaggagagcggcggctcggcggactgggccgacttgggccgagggaaagagaagagagggttttgggtcggctttcggcccaaagccaaaagaagacttttaaaaccttttcaatttaaattatttcttaaatgcaattccatttattaaaaatacttccttagctcaaataaatcccagaaaaatctaggaattatagaattaagcaaagtatttaatgaaattttatctggcccaattttatattgagatttaacaaattaaaattagatcttctcttctaggcttttaaaatcatttctaataattccttttaaacaacaatttataatttaaggatttttaaacaagaaaagctcttaacaaatctaattagatcattaatgatcaaataattactgaactgttctttgtatcatttaagaattgagctctgaaaaatccgagaaaatttcagagagttgacttaatcatggagaatttaacaaaaattaaatccatccatgctttacatttaggaaattttatttcccacatttaacttcacttggtaattaaagaacacttaatataaattctattattaatttattaaataatttataaatcctgaaacaaaaatcaggatgtgacaaatctaccccccttacaaagaatctcgtcccgagattcggaacggctagaaagaaaaacggaataggtaaactgcagtctatcttattattccataactccgataattattctaaggctttaaagaaaactactgcttctttgaaactggtggctgagctgcaacacttgaagacacaactcttgaagatgcaactggcactgcattggctcctgtgacgacaatgttgttgacttgaccttgcggctgctaatgcttcggcttcggacactcttttgcaaagtggcctggcttgtaacagttgaaacatacctgctgctcccttctactactgttattctcctgagtctggtcctgctgaactggcaccggctgattagcttgctcgatgttaacttcattgctttcattagtctctgatttgatctcaccaccgatattcaactgttgcgattgtccttggccagcggaaaaaggttcaccaatttggagtggcttgatacgctgcctctggctactgccttgtgcctcttggaatacagtcattttccttttacggttatccatcctgttcttcttgtcttcaagtcgaattgctttgtcaaccaactgctgaaaatcagcatagtcatgagagatcaacgtaactgacagttcatcctttaagccttccaagaacttctcctgcctttcctcgtcagtacgcacatcttctggagcataacgtgccagacgattgaactcgtgaagatactctgccacagtttgatccttttgcttcaatgccctgaactcacgcttcttcaaagaaacaactcctgtaggtatgtgtgtcttcttgaatgcttccgtgaagtccgcccaagtgattggttgtccttctgctctgttcatccggaaatgatcccaccattctgatgcaggtccttgcaactgatgtgaagcgaacacgactttctcctgatccgtacactggagcagttccaacttcttctcaacagcgtgtagccaatcacctgcttctactgggttggtagtgctagaaaaggtaggtggcctcacacgaagaaaatcagttaacttgttctgcggcggtggagcattgttgttcccttggttgagctggttctgcatctgctgtatcatcatgttcattaactgagtctgttgagccagaacttgagcaagagttgggttcccttcattgttattgtttccacttccactggcgcgagtgttcaccatctgttgcttattagagaggatagaaggagaggggttacactaaagacaagaccttaaccaggttaacactgatctgatgtgtgtagaccattatattgttcaagttgattaagcaagcaacctagtatagttacacactcatcattgaatcacaccaatgacgggaatgcaaccatacctacacacaagcaagcaacaagcgttctaccctactaactattctccaaggacactttggcggcataggttctaaggtaggatccaaacttcattccatcttgacatctgggcacttcagatcgaccatcaccttcttattcatcgatccacttgacttaacctccacaagtagaccacattggcgtcttcaagtttcaacaactagtttcagaactactccagttgaaagcaggaggggagaggatgaaaaaatgatttatagagaattctagagaaggaagaaaggaaaattttcacaaatcatgttttcggaaaattagtccttaaggtttgaccatttggcttatcctacagtcaagatggctctgataccaacttgtcacgcccggaaattcactagttatttccgaacatatttgtgcataaaatcctcgtccaggaatcagccgaggtacacaaactgacaatttaatatacagattcatcaaattaactaaaacgataaatacttacttaagaggcacttagtcctcactaagaagaaaactgcagcggaaaataaaatctagcgaagctccggctccactcccacaggcagctcaactgggatataagacaaacgtcttctccttctggatcctttttcttcaactgaggttgattgattattgcaaggtgagcatatgacatactcagcaagccacacagcaaatatgcaagtgcacaaggataccaaaggatggcataatataggctcatttgcaaaagcagcattttagcaaaacatttaagagaagtaaaacagtggagtaattgatcagaaattttaatcaacactgaacagcatacccatgctgcacaggcccaaccatcctgaacaaccatacccggctgtacagatctaactccaaaccaggagctaagcaaattattaccagttatagcatccataattattgtgagaggtgtgagactaatcacgaaaaacattgctcaacccgcccataaccacgggcacggctattcgaatagttttactctggccagaggtgtaccactgtacccacaagacacagccccacatcatgtcaccatgtgcctcagtaccaccacggtacctcggaaaggggctgtgacagtaccccttgcataacacaatccaccgcagcgcaccattcctggatcataatcaccccctcaaaaaccagaggcatggactccccagcgacccccgtgggcttatctccgccacttctcagtctggtgccccgcaatgaaccatgctatacaaaagataaagccgttgcccacgctggcttgtggttggcacggttaatgtttcacaacagtagctcgcgaaccggtccttaattgtcatgagcacgactctcaaaaccatgtgctcacaacccaccattatcaagttttagttggcaagtaattaattaaccaatcacgattgaccatcgtgagctaccattaaatataaccataagtgatagtgaaacattagttatcccaattgtgtgctaaggtttctaagcatggctaagcaatcatatctaatatctagttgaaccaatatatataaaactcaactagtccaattataataacccaaggtatcaaggaataaagtaatcaatgcaaacaggccataacaaaggaataggttcacaccacccagtgacattcgaaaataaatgcacagttgaaataaatagagaatttaaatataggatcaacatgctcaaaggaattgtgtttaggatctgtgtgacttgccttgcaataatcggtcttcaattaatcttcttgaatacttccggcgcactcgcgaaccttcacaacgacggaaacgacaagctaacacgcaaaacaaggaaaagactaataaaaaccaaataaacaatacataaaaagtaaacaaacatgtagatcataattttagatgaattatgagacttgaacggcctcattctgacttcaaatgaatttattatgaattttacaagattaaatctatttaaagcccatttaaaaagaattaaataaatttaattcaatttatggacaattttaatatgtagatctttattttatacaacttttgcaacttgaaccacattaaactgagttaagatgaattagttatgaatttttaaagattaaatcggattaaaacctttaaactgattttaattgaattatgacgcaataatgaattatttttgaaaaggaaaagaaagattattgcgtcagcggctagggtttcggtggacctggcgcacgggcggcggttcacgcgaacggacggccgagatcgatccaatccaaaacggacggccgagatcgatcggtccacgaccggctcatgacggacgaccccgatgacgtcggcgatgacgtcacctaccagcggcggcggctcggcggagcggacggctcgggcggcgcacgctcgccggcgaacgacggcgcggcggtgcaaacggagagcaccaagacgtagatcacggcgcgacgaactcaccgatgaccaaaacgacggcggaggagcaaaggacggcgccggcgacgaggagaaagcggcgaagctcttcgggtcgacgacggcgacggcgctccggcggtcttcggcggcggcgaagcggtgggtaccgagctcgaattcgccctatagt

SEQ ID NO: 29541 - DNA, 897 bp, Oryza sativa; identical to SEQ ID NO: 24427

SEQ ID NO: 29542 - DNA, 432 bp, Oryza sativa
cactcggttcgaacctggcggtccagcatgcctagtcgaagatggcgatccgaacgagcgccgatggactcagctgggggagctccacctggaagaggcgaaggatctccggcaaccacacgttgcatggaaatcgaagccccgcctcaaagaagatggcgaataccaccgtccggttgtcaccgggcttcggcaccatggccttccccggggtgaaggcctgctcctccaccaccacgccggagctgaccaacttcgccagctcatcgtcatccacgagcgaagcccctaaaaaggcggtagtgtcatcgtcgatccggccgggatcggggcccgtcgctgaggctgggtttggcttgcgaggagccatggcgaaaagcgtgcgctgtggcgaagagggagaacaggcgaaagatctagcaactcaaaggg

SEQ ID NO: 29543 - DNA, 1772 bp, Oryza sativa; identical to SEQ ID NO: 24424

SEQ ID NO: 29544 - DNA, 707 bp, Oryza sativa
  unsure (1)..(707): unsure at all n locations
gggcgaattcgagctcggtacccccttcgccgaaaggatatggagagggcgaaggcactggtcgcgatcgcgtcggccaaggtggcaaagcggggtccggtcaagaagacctccaaaaggatagggctcgtcgaggtcggtcgcgcttttagcgatgacgagtcctccgatgaaacccctacttcgcctactggccggagcttggggctttcgactgctcctggcaccgcgatcgatgcgggtggagcgggagggagtgttgccgggacctcggcttcggccgattaggttgtcaagaccgcggctagggtcttgagcatcccagttcgctagccggtcattttgccgctcggccttgggaaggggaggaagacggcgatcgaaacatccgtttcggattactcccttgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 29545 - DNA, 543 bp, Oryza sativa; identical to SEQ ID NO: 24425

SEQ ID NO: 29546 - DNA, 2286 bp, Oryza sativa; identical to SEQ ID NO: 24426

SEQ ID NO: 29547 - DNA, 2580 bp, Oryza sativa
tttactctttaaaatttaaatttttaagatggtcaaattttcggccaaaacattaggattagctcaggtcagctcggttaggtaaatgaggtaaaacatgggcctggctcagctcgtttcacggctggagccagcttgcgatggctctcgagccttccaatgtgatgcatctctccccaaatataattcgtaaactatggctagtataagaaaatttttcttaaggatttcaatcctccacaaatcctttgaaatttctttcaatccaaaagaggtctaactgtacatgctggttgagctatgtaattaattaaactgacccacaattttctctcataacattttcaaaacatttaattgtacaagatggtcacggtcgttgatggcgcagactcgtaggcttgtaagtcttctcagtgaacattagtcctctcttttagcagagaggccagatatcctattccgcgcttacgcgccgggaagagaaatcatgtgcacgtggcacgcggttttcgagaggcagatccacgcggtagcataactaaccttgttagatttagataatgacgataattaagttaatattttttttttctctagcatattgaaaaaaattctataagtgaaattggaactttcaaaaaaaattatgactttctattgaaaaactaaaagacataccgaaaagttgaaactctaaacttaaattttaaaaatattcaactcgaaatttaaacattcaacataaaatttgaaaactttagactcaagatttaacgttgaaatcaaattttgaaaactttcaacttgaaatttaaatttgtaagtcaaactttgaaatattttaacttttcatctcaaatttgaaactttcaacttagattaaaaagcttttaactcaaaatttgaaaactttcaactccagatttgaaactttttattcatattagaaaactttcaagtcaagatccgaaaactttcaactcaagatttaaaaactttcaactcaaaaattttaaaacacatgtattaaagaattaaaaaatgggaaaagagacgaaaaaagaaaaatgcgctgagggagggggcgctaaaataaaaaaaatgcggaaaaaatggaaaagagagcgtgcgggggagtgctcctgtttcagattatttgttgttatagcaaatcttgaaaaccgtggcaaaatcaacgtacttgtttaccgtcagtaccagtcctcccagcgacccagtgcttactgctttcgaacaattttgggtttaaaatcaatttccacgagagcaactcttctgtttttggctaggcaaatgaactgtgtagagcaatattcccaattgtttggtgtcatatacgggatgtttttcttttgggtatttaggccttcctatgcattacaggaatatttgggtatttagtcattgtcatgtcattgaataacaagttgaaaagaaattaagtagttggaaagaacatatgtccctggtcggaagacttgtcattatcaacttagttttgacgagccagcatgttttctttttagaattacgctttctccatttagttccatatagtattacgtatatattgagttttttttttggcagcgtgcatggtaaccttaaaaaatatatagactgataaaatagaatattaatttgccaaaaaaaatcaaggaggttcatgtaattttgctattcttgagaagatatatcaggactatatttgtcatagtaaaacttggtatcttcaggtattagatatctcaaggtgtcaaattttttttgcgtaaaatttaggtatattcagatactttctcaagtacgataaaatttctctagatatattagtaaaccaatgtcttgcttttcaagttaataaatgaagattgctatatgtggctaaacatccttaggaacaaatatttagtcaatttccttgagcttctatcgaagaaaactacactaacacataacaattaataaatacatgacaccacccaaaccgatatatacaagacattttctgcccaagctgagccacttggggagcacacttgaaaaccggcagagatgagacttgactacatttgatcacaatcaatattcgtgcatgcatcttccgtatttactgtgggaagactttcaagtcggtcaatatacattattccatctatttaaaaatataagcagcctttgtttccatttaaaaattttaacatattacaaaaaattaatagttgaagtattatatattttggataaaaaaataatattagagaccgtgtataaacctaatacaacttatatgttcaaacggatgtataaatatttatatctttttgaaaatatataagttgtattaggtttatgtttatacttccatttgaaaatataagttgtattaggtttatgcacggccactaatattatatttttgaaatgtgtgtcgacctgaaagcttcagcagcatccgtattgcccgccattaatccactcgatcaacattaactatggtatcatcacaacaaaatttacgaacatcattgatttacgattttttcattaaaaagg

SEQ ID NO: 29548 - DNA, 2066 bp, Oryza sativa; identical to SEQ ID NO: 24428
  unsure (1)..(2066): unsure at all n locations

SEQ ID NO: 29549 - DNA, 587 bp, Oryza sativa
cctcagaacacttacatacatgtggctgggttgtagttcactctctagtttgactgtatagaaattgcggtcggacggcagttcattatcaaatccagttgcccaaactgttatgctcagatcatttgcgtgaaagctcttatctatctccaaacatagcctaaaaatttggtccaatgaaaaatttggttgtcagcaattgttatcctctctggactcaccgcaaagaggaaccaaattgcccacacaggcttaaacccttgtaaacatccccatcagggggcactactataattgcccacgtagaccaaaccctagggttgtaacccaggactacaaacctataaataaaccccaaaaggtgtataatagggatatgatttttgagaaatcaatatacaactactgtttcccgctctactcctcaagtgaagcatgtgcttcagcagaagtatttgtctttcgacagcataagtcatgtatgtttaatgttttgaaccagatttcaaaattttaactatcgattgctaaatctcaaaatttcaaaagcatgaccaatcgttgtcccaaacatcgaatatattttc

SEQ ID NO: 29550 - DNA, 824 bp, Oryza sativa
  unsure (1)..(824): unsure at all n locations
nnnnnnnnnnnnnnnnnnnnnnnnnnnnnnnnnnnnnnnctaagaatggccggtgaggaggttgagcaaacaataggcagcggagctgctcctcgagagtgcaatactcaccatcaagatcggcacactagcggcaacccatccaagcagcggcggcgactcatttttcctggcaccatcggcaactttttggggatgcggtcgatgaagaagggtgagggacaggggtgcaaaagcaggatgagacccttgttggccattgcgtcgccgcccccgatgaggtatggctccagttgctactggaggtggagcaggttaaacgatattgaggttgtcgtcgcaggttgtggccatcatccttgagctcgtcttgctaatgaactcccttcgatatgagcatgatgatgaaggagtcatcgacattgggaagccggcaacaatccattcatccaatgccacctccaaggtcttcaattgctacctcggtcgacggtcgcctcctgtgcctaatttgggggttaccatcactcttttttttggttgtgcagtaggatagtttcatgttggaggcacaccatgtggggcttcggttgggcctactgaaacactccctgagaaaatagtccggcaacaaggcaccaaggaacgaaggggattgctgaaaggggttcgtcaaccaacgaagcaagccaaagacaagagtcgaagggccactaggcccaacgaccatagaggcccaagtgcaccacaaggaagggatattgggnnnnnnnnnnnnnnnnnnnnnnnnnnnnnnnnnnnnnnnnnnnnnnnnnnnnnnnnnn

SEQ ID NO: 29551 - DNA, 526 bp, Oryza sativa; identical to SEQ ID NO: 24429

SEQ ID NO: 29552 - DNA, 614 bp, Oryza sativa; identical to SEQ ID NO: 24443

SEQ ID NO: 29553 - DNA, 652 bp, Oryza sativa
agccctccttgtttatgtacttgttatctgttatacatattaaccaaatttctcgaaatttatatgatacctgttacagtgcaaacaggaattgcatgtgtgcatcatgggctgcttttaatttgacgtgtaagtacagtctcatcttccagttttggtgttatttttctaaaatgcagacaaagggggcaggcaaagggaaaaagggagtgcatgaagctgatggaaatggcgaggaggatgtctccacttcaaaccaatcaaatgagaagcaactcgaagaaccctctcaattgtcagatatgttgccagatcacttggtaagaactagagcgaaccaagatacataatgtcctacctcaaataacacacagaaaaactccctgataagcttgcaatatctcgaaagcagataacaaactggctgtcatatactgtacataaagtttaccgagaatctgctatttactgccaatccaccaaaccatgtttgtttgagtctttttactggtccatattcattttgcatcttatctctgctttgtgcaatcttgctcttcttccttgtgagttgtgatgaatgaaaactcctatgagcaccgtaatgggtccctaacacgtttgatgttgtacagtttgatgacagttccaa

SEQ ID NO: 29554 - DNA, 1681 bp, Oryza sativa
tgtaaaactacaccccaaatatttaaaataaggtcctatgcacttatacaatagaatatttatttctcatgaacgataatgtttagaaaaggagatcgagcactgctagttctatctcaaaaaataaatgtgcaaatagactacattcagctgtggcttgaccggatttccacagaagaaaggatgatccaatgagcaattattactgaggctactgtaactgaggttctatgcatgaattctacagcgagagtaattgctttgtgccatagagatgttactcaatttcttttagtgtgttcattataccttctgaatggcaaatgacaacaattgagttgaccatatctctccatgtccaacaacaaaatctaagaaagactcggttgcatgcccagctgcaaaaagggaaatgtatcataactcagctaagactatatttctgcaatcaaaccacaccgttgctacataatagtaaataagtcagcatatctaaaatgagggacagatatactatcacagaattctatgtggttgatttatatgttgtctcatatcattatgggtattaacatgctattttaacagagcctaacagattgattgttaaatcttaaatgtgtaaaaaacgaagatggacatcatggaagaattgttttgattgagtcaagagatacatgagttcaccactataatgccaatgatttcctctagtactacagtagtatataacttcactttattaggctatctgttagtactctctcagaccacaaacttttcaaaccatagcttcctttgtaagttagtatgcatgattttgttaatagtgaccagtaattagacattcctgaggttgtaggccaaatgcaagattaaaaaagcacagtgagaaacctctcaattaagcgtttatggctactgttacagacctattcgaaaataacatgacaacaaagcgaacagagtatttgacgtttttttttcagaaatattcttatccagtgctttgaaaatgaacttgtttttttttccgaaaacgcaagagccatgtgtttcatttcaagaagaagaagaaagagcatgtaagctatagtcataagctactctatgtcattaaaaagcagcataagtagtgtacagaataatgcaatttatttttgtgtttttcctgactgacgtcctagtattaataatttctccatgagccttttattttgacagagacaaattactattactcaccctaaatgggattattggagcagataattcagtctgccaaaaagacaagaatagagacaaattacaacaacttcacactgaagttgaaattcctgcacgattaatagaaaatatttcacaatggaagttaaattagaagaatgttggtagtccagtttttgtaagctgtgttgtacagcagtcagactcatcataaatcatgggcaggagaacaagactgaatccatgttacaaatatgtaatgcagtctgaatgaccataccaatttattcatagacttttatagacatgtgttaatatagctgcatattaaaatggagaagacaatgggttttcctttaatgatatgtgaatttgggtttcattggaaaatacctgagatggtatatagttcactttaaccccaccttaattgcggacgtccattacaacctga

SEQ ID NO: 29555 - DNA, 7971 bp, Oryza sativa
tgtaagctttcagggaactgtttatttagatgtatgtagttattctctatttcgatgcaagtccaaatgagtaaactgcaagtcagatggatgccttttttttatctaaactaattaaaactatagcacgacggtgaaccaatcaaaatcgcttaacaacacttaacagcccaaatgagtaaagtgtgtgtcagatggataccttgttgatctcatcctaatgcaccatcaccatagaagcagatcgggagagctaatgaaaggaggaggtgggaaagaggcaccagcgtaggagtaggcgtcggcggggggtgggcggaggattcggtgtcagtagcgggtgggcggagtaggcgtcggtagcgggtgatggggagaacgatgatgcggcggtggtggacagtacgacgcgaccggcattgggagcggtggagaaggatctgacgacgatggcgtcaccggcgaagggaactcggcgacggtagccaccgtgcgtcattgggagcggtggagaaggatctgacgatggcgtcaccggcgaagggaactcggcgacggtagccaccgtgggatcgatggcaacgcggagagaggagatcggcaaggcaaaggacggtgcgacaggtgatggggaggaggaggacgcagcgacggtggtgggtggggagggcgatctaggaggaggtgcggctggtgtcgcggcggattgcgagcggaggcggggtgggagggggtggcggcgatgggtggtttttttctcgttgattgcggatcgtgatccgtaggaatcgcgcatggatcgtgacccgtaggaatcgcacgtgggtggtgtggaagtgtgtcgcttactcgttcttgaccgtgtcaatgtacgtttttatgttggatcgcacgtctacgttggcttcaccatcaccactacgaatttttaaagtagtagagattaatttgttttcttgagaaagtgttagttaaattggatttgactagtgtgaagaagatgcatgctacaagaagagaagataaaattagactttactagttccttaaactaatacatggttagcatgtatttatttaccagtaatgatggatttgaatacttgaatgttatagttagcacttaggttatattgttgtttaaccattagttgcaaaggacattatacatcctagttggggtgttgtttagttgtacaagtgaactaggaattgactaatattaggtactgtcattgatggagttgtcttctgcgtatgacgatttctaaggtcctaaattatggatatgtaaatgaatataggctagtgtaataaatgaaaatgtagcttcgttcgttgctataataaggactgtccttagctactcacgattttttaactgttaaagggtatgttttgtggaaaaaaatatgtagaagttctttttagagacagtcatactacatataatctattttttgtaaaatttataaattaatatttaattaatcacgtgctagtaaataattactaacaacttcagaaatcctctgatttcttctacaatagagcctcttgtaatttaactcatgctttggtgtgtgttgtaaatgaggcagaagaggagtatttataggcctggaggtgcactgggaatttggacatgctaaagcatccttagagcatattcattctcctcttgccaaatgtccagttgatgacgatttccaccggtagaaatggtcacaaccgtcataggatgaggataactgtcagctggtgaaattttgggctgtttgggctagctgctggctggcccatccagcccagccccactatgtgttcctctgaagtttgactcaaatgattgtatcttattgggtttgtgggctcaaaactccatgggcttagatatggaagttatattctcatccttcatatatatatttcatctcaactttggtggtttgtcttctacatgcaaatatacaccaacacttgtgaaaattgttaaaaataaatcctacccctatattggacgttttacatttatggttttatgcaattattgacggtgttaatttggtacttaacacaactgtgtgctgctgtttcggctcatctcagaattccaaacgaacgcatggcctatggtgtcccaagctccactgtttattaattagattaaaattagaaattggcgcgccggttggcgcactgtcaatgcgtggataaaaatcaaatatttaatacaacctcttcataatatttttatttttattttcttgtgtaacgtgtagcatatagtacttgaaaaaattagccaatgatatgagtaataatttgcagttttagcacttaagagtttaataaattgatttgtgattaatttatcatgtgcatataaaatattgactttatttgtaaattaatacaattggtcaaaataatctatttttcccattactataaggatgtgttcagcagcttaagattgaagctaatcacacatgcacataaaaaagagcaactcattagcgcatgataaattatgtgttagctatttttttctgaaaaagtactactatgattttttaaagcaactttcgtataaaattattttgtaaaagacgcatcgtttagcatatttggaaatgtacacgcggaaaagtattatcaatgccttataaaacatgaagacatttattttcccagtcctcgagatgtcttatagaaatatgaagtatgattcaggtgctaaaaagcataagaagagacaactataatacttttgaccaaaagtatgccatatttgtattagacatataaatttctcaatatttttagaatctcaatttgtatttcgttccgatgcctccaaaatcctgaacacagccttgatatcatttgacttgctagattttagaagagtgaatccactcagtaccactaagttttccccacttttacaatctaccactgactttgttaagttgaataatatgccattgtgttttcttgaatctctattgcgtgccatcaccatccatgagccgttagttggcacccgtttgataaattgaattttttcttaatgcctaaaatacccttagactaacataccctaggactgaaaaccctagccgtgaacctccaaatcaatctggcagtgtgaggcggcgctgactcccatcgatggaaggccggacgcccaactccccgacgcgccgccagccgccccagcccccgacgcgcggccgagcacccggctccccatcgacgcgggccgcaacgccgccgccacgggtcacattcgcgtccgcgttgctgtcgccgccgcaggcagctgcatccgcgccaccgccggtgtcgcaggtcgtgtccgcgtcgctctcgccgcgggccgcaaccgcgccgccatcacaggccgcgtccgtgtcgccggaaccacgccgccatcgcaagccgcatccgcgtcaccgccgccgcaggccgcaaccgtgccgccatcgcaggccgcgaccatgtcaccgccgccgcgaagggtttgagagagctctgcactgctagtgtctgattgtctgaatactatgcaaaacagttttggcattatcccatcaaacaatgtcgatagattactatacatttctccctggaaaaaaaaccatgtacagtgagttaggggcaaataggtctttttacagctctaacagatgtccaactaacggcttgtggacggcaatagcacacattagaggttcaagaaaacacaatagcatattatttaacttgacaaagtcagtggtagattgtagaagtggggaaaacttagtgatactgagtagattctctcattttataaacttattttaatatgtagaactgaataatgaaaatccggtttcagatacacaaataaacatgaaatgacttttgttttttaacaggtacgtcttccgttatataattatataattattttgattttctttttccaagttaaacatttttaagaatgatcgagtttgtagaaaaaatatagtaaaatttccaacacaaaacaaatgttttataaaaaaaatatattcaatgatacgttcaatgatacatgagtattgtagatgttgctaaaaaaatttatataaattatttaaacctaatatatagtttaaaaaaatcaaatcgactttaatatggaacggaggagtactccagtaataacggctttgcagtttgcacggagacggagacggcaacgggagatttaaagcggccgtcgaatccggaccggaaacggagacggcaacggcgttccccgcctccttaaacagttaaacctacccaaatccccaaattccgccgccgcctcctcctcctcctctcgccgccggcgagaaccacggcgaggtgaccaaccaaccccaacccccatcgcgccccccgccactgcctcttctccccccgcccgcccgggattccgtccatggaccggccgaggaggccggggagcgaccgccggtaccctccgctgcggttcaggaagcggaagaggagcagcagcgacagtagaagcagcaagctcaacaacaagccagggtctgataaggtataccctaccacctggaacgcgcccctccatgcttggtgtcgccgtcttgttcattggattttgggggtggggggttagtcccctttggtggttggggtttagttttaaaaaaaggattgctggaatcagaggtgctagatgctgaatcaaacctcgaattgcttcagtgaggatgaaatttggttcaagagaaattaatagtgtcggttcgtttacttgttctatggaaacaaaagtatatgttaatgtgcccatgtttcttccttcagtttttcttttcctttttcctctccaagtattataggtttaaggagtcaggcaaaggagctttcaattttatggcgcttcgtagttttgctcaccttagcaagggaagatactcctaagaataagaaaatagtgtgacccttgagagaattgctatcaacttttttctgtttctaaaatggcttgaagttttctaggataggggatagtttttgttttcttttacttttgtagattgtcatgccagggctgtttgtcacgagtttaagtattgtccatgtaattactctctatgagactatgaaatctttgttttcgttttttgtcctctgaccaattacaataacacatgccttcttaaactgatccatagaatttctttttgttatttattaaactcaacctttttatggttattttctgctggtctagtcaattccgctttgaacaattaagataatcagattaatctactattttgtgcagtgggaggatgtctgttcaatttgtgatgatggtggtgattttctttggtaagtgtgcttacaatcaagttcataacatgttgcaatttagcttgttgcataacttgttctcaatgaaaaacagtagtggttaatgttattgcttcttactattacttgccctttcttagctgtgagggcagatgtttgaggtctttccacgcaacagagaaacacattacagaaataaaccagtgcacaacccttgggctaactgaagaacaatggaagatctttaggcaaaatgatgaaaaggtatatcttatttgagttgccccattctttagaatgaacgctcttttatgtctaatattgacatttttttcttgtttttttgggtaattcagagtgaaccgctatatatatgcaagaactgtaagtataatcagcatcagtgtttctcgtgtggattgctgggttcttcagacttgtcatcaggggctgaggtatgacaacaaagccatttgattatttttcatgaaggctttacacttgattgaaatgacaatgtggtatctagtacaacaaacaaggaaaaataggaggagactcaatttttgctaataaagaatgtactagggtctaggatatgcattttctttcttctttttattttgctaggattaagatgccattttctcattgtcatatgctccaaatgtctgttcaacttctaatatatgtatgctatcatatgagcaagtccaattatttgctaacttttgcatgtctcagcaggtattccaatgtgaagatgaaaaatgtggacacttttaccatccgaagtgtctagctagactactctaccctgatagcagtatgcagcccttaaattttgaggaggaagttgcccgtggactgaaattcctttgtccggtgcataaatgccatgtatgcaagggaggagagaacaagaatgacatggaaaatcaatttgcagtatgcagacgctgtccaactgtataccacaggaagtgcttaccaaggtttgacttcacattggagagatgcctctgccatcttccaaacattctactgttgaaacatggttcttcttttcttttgctcacgctttgcacttgttttgcagtgacatagtctttgaagatgatgaaagtaatggtatcgtgcaaagggcgtgggatgacgtacttcgtgatcaaattttgatctactgcatgtgtgttaactatgctacttttgtcaatcatatgaactgctcctcttgcccacccaaaactaaatggattattctctttacaggaagcatgagattgatccagaactgggaactcccgcgaggaaccacattatctttcctgattgcaaaaaccttttaacacgtggtccttcgaagcccaaagggcaagaagacgcacccgcagtactagatatacctgaagaagacatgtcgcctgatcattcctccgaaccatcccagccgcctccacagccggcagctgaaactgatcaaactgaccaggatctttccaatggtttcaattcgtttgcgccgaaggccttgttcccacttccatatccaggctcctgtggttggcttgatgactgaccatccaacctcactcatctagataaatcctaacacatatatacgccagcagattggtgtaattcctgctagaacactttgttcggaaattgggaagttagaatgtgcaacgcaatctactctgttgaactgtcacgtgctaagccacttgtgtgtattgttatcattattatgttattattttaatggaagataacattgcggttgaccagtgtccagtagcctgcattatgtttctgatgtttttgtttccagagatgtccaagtgaagcaataagctggtgcatatctgtgctattatatttatgtatttcgacaggcaattttgtggctaaacttctctatatctgttgtgtattattgaatttaggtgccgaaaaggattaaaaaatgttcgaaaaaaatattttgtattgaacaggaaaaatctgtgtgttaccctttccttttgtcatactacctttctgctgcagctgattcattcattaacatatctcctagcttaagatgatttgtgcatgcgttttccactcaagggtatattggcagcatagcagactgttcataataaatatcggtgccgaatttttcttcaaatcatggccgttgacaccgttcctgcctgatccaggcatccagctgtgctcggtcaagctgaggaaactaccagggcttagtggctagcagcacagttaggctgcgttcgttccagttcccaatccctcttcctcgtttttcatgcgcacgctttttaatttgctaaataatgtttttttaaaaaaaaatatataggaaagttgcttaaaaaatcatattgatatatttttgaaaaaaatagcaaatacttaattaatcacatgctaattgaccgttctgttttccgtgcgcactgttcatgtctggaacacaagttaacgaacccagccttagtgagcttgccatcttaggtttgatttctcctttctataaaatatttagggagggacgtctctcccttcaaatctttttttttcttagcc

SEQ ID NO: 29556 - DNA, 6818 bp, Oryza sativa
attaagaaagaggttaaaagaatatatactatgcccttcattagtagggagataaaaagagaaggggagaaaacgaggaagaggaaggagtacttttggttcaatgactaaaaatgagaagaaaaagatgtagtgaaccactctaaaattatgccgaaaaagagagatatatttctactaaataaataaagctaacaacggtaattaaataactagttatacatataaatatgcaaagataaacagtttatccaatatgtatgttgttatttatttattgagaaaggtggtcaaattcttcaaaaaaaaaataaaatatatctcttccattccttccttttgttcattcttcaatgatcagtggctgtgtgtacggatcgaatccccttggcaaaaactagtataacattttagctgtcaggcaaagccagatcatcggcgctcttataccatccaaaattcatgagaattagccctcttcaacccattttaaaattacaaataagaatctgatctcttttaattatttgacaaaatgatagatgttgataactgataagcgcattcatgatgctcttatatccaggtcccagctactaggtacaggtagctggcaatgcaagtcagaaggatcaagaatccgtcaatgctgcctttgatcaaattaacaaaaatcacatgatgcaaagttgaatcttgtgcccgtggaacccgttacaaaataatcacggcctcgatcatgatctagctagagagagaactcatggagattggaaactctggtgattattctaatctgcaccttaatgctcactggaatctgaacaccaaccctctagacgactacttggaatcccaatgagcaaatcttattgacaactcaagtcaattacagggatggcctattgaataatgattaggaatgctaaagcaaaagtaattgcgacaccatggactaaaaatactgtcaagctgcagcacaaacaagaaaaaaatatagtttcttgaagaggtgtgtgtgtatactactttgtgtttttggatccaacgaaaccatcaattttttttctctgtgactgaattgggcacagacaataagcacactgttctaagtgatcagaagtgcacctgaaggaacagttttgctttagatttagcagctcaccgtgtgatctgatcttcgcagttccaagaacttttaatggtgtgtgatcgatattcacaaggaaaattaaggttcgctgaatctccaggcacgcaggcagagcaattagctagttgtgtaattgaaagaagaaaaaaagggagtgcaaaataaaatgcagctaaaatataagagaggtttatatatacatgcatgcatgcatgccataattaatgttttgtgagatatatcttttgttcaaatcagggtactgtcatatatttcttatacacgtaatctatacattgttgcaagttgcgacgttaagttttccccgcaaaaaaaaaaaagttttccaaaattccaagttggcaaatttaaatcaattatattattgcatctcccagctgattttatatgtgtgaaagaccactatatacctgcagcaactaaacatctctcgcacacattgatacctatactgattacaaactgagatatatcataatgacgtactactgttcatactatcaacgtactgatcttaattagatcaagtgctgacttaatcaacatgcctcacacgagtggtcatatatagatcacacacgcacaaccatatatacattcaacatatatataaacaattaaccacatatacacactactcctcaactgttgattttaaaacttcatgtaaaaaaaaaatctgataacaaattaaacctgcaggatcaatgaattaaccctagcagggttagactttggatgcacaattattttttaccgcgctgcaacttacatcagacgcaacatagacaatgcgtttgtgcagaacgtacagtgcccgaagatacgactaccccatacttaactgatcagtagctacaaatgctgacacagctaggttaattagcttaagttaattacatttttttaattaacaactaaaaaaattaataaatttaacccagctgataccgtacgtacacttgtggtcaatgatcacataaaataacaactaatttaactcaaacccctagcaattggtctcccctctccttcttaaccttctcacccaattaatggatggattctttgattccaccatcacccttctcccctactaaaccctccacccccatggatgctctcctctagctatagcttgttctaagctctagccgctgccgtcgtggcgtagagagagacattttggccgcagcgaaaatctgtttttctagtagttgcgccgcccccatggaggccaactaccccaagtatgtcctctatgggctcctcatcgtcggctcatggctgctctcctgcctcctccatttccaggtcttccacctctcgctcttcccctacccctcctacctgctgtcgcgccgcgtcgtcctcccgctggcgctcaacgccagattcctccctcctcggcccgatgttgccggcgacgacgatggcggcatcgtgaggaggcgctcgtcgtcgccggcgaaggctgcggcggaggcgtcgtgcgatgggcggtatgtgtatgtgctggaggtgccacggcggtttcagatgctcaccgagtgcgtcgaggggccgaaggtgttcgacgacccgtaccatgtctgtgtcgtcatgtccaactccggcctcggccccgtcatccctcccgccgccgccggcaacgccaccgtcgacggcgacatcattcccaacaccggatggtaaggaacgcgtcgtgtcagtcgcctcgccgtcgccgtcgccgtcgccggttggtgatcatcttggattccatggatgcaggtataacacggaccagtacgcgctggaggtgatcttccacaatcggatgcggcggtacgagtgcctcaccagcgacatggcggcggcgacggcggtgtacgtggcgttctacccggcgctggagctgaaccggcacaagtgcgggtcgagcgccacggagaggaacgagccgcccagggagttcctccggtggctgacgtcgcagccgtcgtgggcggcgctcggcgggcgcgaccacttcatggtcgccgcgcgcaccacgtggatgttccggcggggcggcgccggcgactccctcggctgcggcaacggcttcctctcccggccggagtccggcaacatgacggtgctcacctacgagtccaacatctgggagcgccgcgacttcgccgtgccgtacccgagctacttccacccgtcgtcggcgcgcgaggtgtcggcgtggcaggccacggcgcgcgccgcgcgccgcccatggctgttcgcgttcgccggcgcgcgccgcgccaacggcacgctcgccatccgcgaccacatcatcgacgagtgcaccgcctcgccgccggggcggtgcggcatgctcgactgcagccacggcctcgagggcagcatcacctgccgctcgccgcgccgcctcgtcgcgctcttcgcctccgcccgcttctgcctccagcctcccggcgactccttcatgcgccgctcctccatcgacaccgtcctcgccggctgcatcccggtgttcttccacgaggcctccacgttcaagaagcagtaccaatggcacgagcgcgacgccgacgccgacaacgacaacgccaccgttgatcgccggcgatactccgtagtcatcgaccccgatgatgtcgtcgaaggccgggtgcgcatcgaggaggtgttgaggaggttcagcgacgacgaggtggccgccatgagagaggaggtgatcaggatgatccctaggttcgtgtacaaggaccctagggtgagattcgagggcgacatgagggacgccttcgacatcaccttcgacgagatcatggcgaggatgaggaggatcaagaatggcgagatcttgggatggaagctagatggtgacgacgatgtggttgcaaaagattcatgacacaagtgaaatggagattttttttttgtgttaattagtagtgttcgttttgttaattgttgtgtttttttgttgatgttaaattgtcactgttgccgtgtatgttagtgacatataaatataaatataaatatatcagtgcgtatattggcggtatgatgagcgagagaaaattagaataaaaaaacaatcaactagattgctttcagtttgtatatatgtagattttattaattgtatcttgtcaagcggctgtgtgcccaatatatcctcaagctttgaagaagagaggctttcagttttacatattagtatagcttgaatgcaaattacttatatggtttggcattggtataaaataaatagccaaatttcctgcacaaactgctaggagctagatcgattaaagtgtatttgatatacaattcttcttctattcctattatttcaaaacaactttgtacatgtatatatatacactagaaaatgcccgtgcattgcaacgggtgaatgttattttaatcttattattgttatacggtttagtgaaggtgaaattcaatatgggaatttgctttgatatatatttttctagaaaatcatgagctgcaattaggagtccgatcatctcaaattagcatgcgagtttttaaagatatttcttatacgactcattttgtattccaaaaatgaacgaacttaaaacccgacttaaatatggatctatatttccaaaagcgaatggatttaaaaaccgactcatacacagatgacgtaccaaagtaccagcaaaaatatcttcaatttttataatggtagagaattgtcaatttacactatataataatctagaacaaccaaatgcacatgatcaacaataacatggatttttttttctctctctattaacatggaagtcttttagacttggagagcaaacacaacgacaaatagataaaggctcgcaaacacgacgataagataagcactcaaacatatatcgcggttatcaacctatgcaagacagctcaaattggtacaactaggttgagttcaacataatttgataaaatttgagtcattaccttgaattttgagcgtttatcatcaatttgacccagttcgatccgttcaaatttcataaaccctatagtagatactccacgtgatttagtcaagtaggcgagaacatttctcagttggatggattaaagccaacaaacagattcccttacaacctcaattatgattttacccaagtgatcgaagaccctagcattgtatgcaccaataagactaaaaatatactacctccatttgttttataaaaaagatgatgttgttgacttttaaagtaacttttgatctttcacattatttataaaattcatgaaaatatgcaagtataagtcattcttaaagtttatttaataataaaacatgtcacaataaaataaatataacatttatatatttttttttaatagaacgaatggttaaacatcatgtcaaaactcaatggcgtctattagaagaagaaaaaagagagtagtgataattattgatccaatgttttgggcaaaactagttcctagggtgtgtgacaagaaaggtgtgtgtaacagtgccaaacaaatggcatgcatgtgctggggagacttagtaataaatccaactcaatcaatgacttggagtcaaaaggaaaatagatttgagtattcagagtagtctgtatataagcagggccaagctattgtagtgaaagttgtggaacaagctaagggtgactatatctcatttcatttaatcatgaagctttacaaatgttaagtaatactgtactagtttctaacttgattcctttatgactccattaattggaggactgttatcaagtctgaggttacagaaggccaacgtgcaagatcaggcttacgtgctattaagaatgtcatgtcatcatgccaacaagacagatcagatcactcaacaaatgagtgacttaatttttttcttaatcaaaacatgacactgtttggtaggtgattcttgacgtgacgaatgggctcggcatgccaacctacaattgcatgacccatcaacaacttttcattgattttcattcacttccacatcgcacgctgaagtactgatgaacctagagcactcatatgatcatatcgtgtaggtcgctttattctaaagtgctactattattgcggctcacactttttaaattgataaacaatttttttaagcaatttcacggttcttgaggaggtaccaccttttctatagtaaatttggtacttcttgatgtctaagttgagataccaaattttacactaagtttttttaccttatggtatcttctcaaataccgtagaattgctttttttttataaaacctttcttagtcaatttttttgggccagaagttaaaccgtgaagtataaggaaaagcaaatcgatttctgaatgggccggcctgttatgtaattcatgggttgggccagaaggaataggtccattttgcctccctcatctcttgcgcttgtgtgaataacatccctcaaccgaaagacagggtataacgcctccttcatctctgaaaactagagcaaatcatttccctcagtggttttgctggcggttttgtccgacgtggcgttgttgacccgttgacaagctgactcagcgtggtgggacccacatgtgagtgtgtacctctctctctcccttatctct

SEQ ID NO: 29557 - DNA, 2663 bp, Oryza sativa
atcgccgcgccacccgccgggtgcactctcccgcatcaccgccgccgcacggctacctctctcagtcgcaacgcgccaccagccgcattgtgcccgacccacgtcgacgaactgcaccggggtgaagggaaaggccaggggagggagagataagggagagagagagctacacactaacatgtgggtcccaccacgctgagtcagcttgtcaactgggttaacaacgccacgtcggacgaaaccgccagcaaaaccaccgagggaggtgatttgctctagttttcagagatgaaggaggcgttatacccggttttccggttgagagatgttattcacggaagcgcaagagatgagggaggcaaaatggacttattccgggccaaaaagaccggttgtttggacagatcaggggcatttaagtgaggaacatacagaactactgggtgcagtaatccaaactcctgaagccaaataaatcagatggatcatatatatatacgagttaatttgtgaattgagagcatttgattaattcagtcagagaagccagccttgaattaattctttgagagagagatagaaggggcttatatgctgttggagaaattgaccgcgacgacgcacacatgaggggtatttgccgcatcagattttagtatagttaaaggagcaacataagatgaagtcttctcagagatgaaatagtttgagcgagtaaaactgattccttttaatttcttaataacccaaaacttggaagccaatcaaatgaatcatcgtgtggttttatcttgactcgagacttgagaggataattgatggatgctttcgtcagtttccaacacccaactttgaagtgcaatcgcctacatgtatttgactatctgtacttctgaatccataaaatgtacgtcataggatttgcccaaatgctgtacgtatataggagtatatgatagcgagtgatttctgactgcaaatgctgctgttggagattgaccgtgatggatgagcagaagctactcctgcttgttcaagtcttcggctgatgaatcccggccctgactgaaccagacgtcagatgaatatatagatgatgaggtgcagacttgactggaacagcttgacatctccgtctctgagactgagaggtatatactccatctgaatatctctcgatctgtggaattggtccatgttgttggattttcgtctgttgtttctgccgcctccaactctgtcaatttcgtggatccatattgtcgcatgcagtttgacctctacaatgttggttactcgaggacgtcaattttctggggccagtagtcgagcaagttttcagtagtacacgcttggtcgttatatccgttcgaattaatagatgagataaggtttatttggagattaattttttggaaaaacacacaagtctatcttatggaagacatatgtatgagatgcttagaatcaccttgtccatcctaggaaagaatgatctccttaaaaaaagagtgatctcctagctagtcacttgagacatgcgtaacggagaaaactagaaagaataattcggtgtgcgaagtctgaagcattgcccacagatttctaatagaaggaactcaaatcatatatacatatacaaatcatccccactaccagaaattctctgcttcttggtgcttcccacgtcattagtttttccaaaaccgttcgatcgacaatgcatcccgcatccgcgccgtcccacatctcgctcgccggtcccactgcatcgctccccaccgcatcatcaagtatgtcttacccaacaaatttgtggttgcatggttatccgaagcaaatgcctatagatttttaacagaatgaactcggactcctcaagtgtatcttacttgataaatttagctgcttgcattattgcgaaagtacctttttcatgaaaaagtttcagtactacactaaaatacaagagacagttaagggaacttgaattcacttgacaaatttgtggctgcttgcattattgcgaaacttatctttttcatggaaagtttcggtactgcactcaaacacaagagacagttaagaaaactagtacttctcaattgtgtcttacctaacaaatcagcttcggttgtgcactctaacacaagagacagttgagggaactcaaactccaaactcctcaagtgtgtcttacctaataaatttgtggccgcgtgtattattgcaaaactacctttttccagaaaacataagacttattcggagcattgcctatagagtcaggacacttatcgggagcatattgcttataattttttaatagaaggaactcaaactccccaagtgtgttttactcaacaattttgtggctgcatgcattattgtgaaactaccttcttcatggagaaattttagtataatgtctcaaacacaagagataggagacaggagtactccattgagtggttgatacttgatagtataatgtctcttaatgttgaggagaaagcttaaggaaaagacgttgtgtctaagggcgatggtaggtagtctagtgctaatgtgatgcacaaagcccaaaacaagaacaaagaaaaattcttcaaagttcaacagaccactgacttcaagaaaaagaagaagaagaacaatccgaa

SEQ ID NO: 29558 - DNA, 4056 bp, Oryza sativa
taaaatttgtcaggagaaaactaggaggagagaaggaggggttgataaaaaagtgattgtgacctatgggacccactaaaaatagtctgcacagggattttgtactgtgagttttgtgacttgtgaagttcctcatcctacctagcagcccaggaccagcaaaattgcccggcgtattgtaaacgccctaagagcaaggataagagtgagctataaacttacatggaggagagaggtaacaaaaaaaaattaaggatattggctctcacggaagagctagcttaacataagctccaagacaaatataataaatgtacacgtgagagatagctagagagaggagaagaaaattgtagccaatcttatagctaatctattatatatgttggcttaagatgggctaatagtaggaagtgagctctaatattattctcgctctaagtaaaataaaaaaattgaacaaacatctatctagattcgttttaaaaagttgatttttttctaggacgaaatgagtactactcatatttctgaatatgcaacgtacatctttcattaaaaaaactactcataaatattgttgagtttttcaaaagaagttgtttttcagattaaatatgtaagagcatcatcaacagtctagctattacatccccaatcctatatttttgggattttggttaaaaaaactggtccaacagattcccaaaagagctcttgatgttttaaagttcccatctccaattttctcggtacgtgtatttgagggcgagagaacgactcccaatcccctccttccgcgtgtttctcccctccttccgcgtttctcctctccttcccccgtcggggcgatctccttctgcgcacgggaaaagaaaaaaactagaatttctattggtagtttaacagaagggcccacttttagtttttgggattgaatttaggctatctcttggaggaaggggttttttcaacacctattttcagtttaggaatcccaaaaattaaattttggcgatagattattagtagactgttggtgatgcgctaaacatgtgcttggttgtttggtttagaaataaaacaggatgagttagactcatctattcatttggtataaggtatcgggttggtgctaatttttaaagcatgtcctacatgtcaccgagagagaagtggattggataggtccactagtttaaaaggcaagactaacccagatcttatagaatatgtcatgtcagggtccatcccatcctatccatatccaaacgaaacaccctcaacctaacccatctcatcccttaaaccaagcaacccacactagtagtacacccctactgccgatgaggagctattgttggcttgttatatgcgtatttcatcggtcggatatcagatcactcatcgatggtagcagatagtagctgggggtttccaattcatgagtatagtgggaaggattggattgaaggttgtgttgttgtggttgttattattgttattattattattattattattattattattattattattattattattattattattattatttgacaattcaggtcccgttctttctagtcttttttaagtttgaccaaatctatagaaaaatatagtagtgtttttaacacaaaacaaatatattattaaaatatattcaatgtaagatttaataaaactaatttgatattttatatgttactaaatttttctatagatatagtcaaacttaacaaagtttgattagaagaaaagtcaaacaatttatgtaatatgtaatggagggaataccagaaaaatacgatttctaaaaaacaaaaactttgattgcattgtgtaggtcacttgttcaaggtttttgtgaattttatttctcaaaatactaatgtattgttacgttaatcaattaaacaatcaacctcaacaattccagcaaatttttgtttcaaataggtactccctccagttttataataattgatgttttagacaagattgaggttaaacttttgtaactttgaccatcaataactttaaaaatatttactttaaagaaactagaacaacatatatagatttgtatttcaaaacactataataaaaataaacatgcatttatttattgtatatattataatagaaaataaagtcaaatgtatattttgtagaccgtgtcattgtccaaaacgccaattaaaatgaaaccggagggagtagtgctgtagacttttagtgacctcctttatatgaattcattcatgcacacccaacccaatacaacaaattgtcaaattattatttattaaattacttcctttgttttatctttatgttggacgtaataaaaaaaaagaggagggactacattggagttatattttctacatcttttcaaagaggactaacgtaactatttgtacttggttcgatcgtagtggtcacacatgaattttcaagaaaaaaatcattaaataattaagaaatgcacaatcctaattataaaccctcattactaccaaggttaatcaagcacttcaatcaaatcaaacacaagatttttttagataacgagtcatcgagattagggatgaaaacggtcggaaacggtcggaaaaaccctctaccatttccattttcattttattttctcgaaaatggaatcggaacggtatactcggaaacggtaacgatatcggttatatcggtatctcggaaacggaaccgtcggaacgggaatataccgatatcggacggaagtcgaaaattcatgtcggaaacagcgaactgtggtatcatcccgcatttaactatgtatgaagatgaccttataatttcacccttgcatcattacgctgccacacaacaccgttatatgatgattaataagttgacaataagattgataaataatataaataaagttcaatgatacttcaacatcaatgtggctaaagcatacaatgtggcttacatgataggattacagcataactaatattgtccgactttttttaggatatagatttgaagtcttcgagaacaccaagctcacaagctggcatggcttcagctgatcagctccttgtcaaacatcattcattatttcatcatcaattgacatagctatatcgtcgtcctacagtggcacattgcataagaacttttatgttgacactgtataactactgttgtaattaagtttcatgctaaactagactttttggtatttccaggtcgatcacagagaggagtcaagatggtggggcccgccagtggatcccacagtctttcttttcctctctttcttttattttttctctctctcttatccttcccttctctcggttcctttttctgctctctcgatttcttctctgttttctctctcgttctcttctctgcctttggctccttcacgcgcgcccgagaggagagaggcgccggagatggcggcctggcgcagggcggcggtgggggaaggagagaggagaaaggggcggcatcggtggggaggaggaggctggggcggtgcggcggcgctcggcgcttggctcggtggcacggaagccggcggtggagcatgggggagggaaggtggccggctgcgacggaggccgtcggggcgaaggaggttgcggccggcgtcggcgacctggtggcggcgcccaacatggcgcggcggtgccccagcgccgatgaagacgatgatgcggtcaggcctagttggcttctttattcggaatgggctgctccttaatgcctaatgggctcctcctcctgctagccaggcccagccgacttccttcttcggaattttgtcggaaatttgacggaaattaccgataaaaaacggttaccgacaaaacggtcggaaaaaaccccatatcatttccgctaccatttccgaaagagattaccgtttccatttctgataccgacaattaccgataccgattgaaacggtcggtgcaaaccggaaacggtagccggaattctcggaaatttccgtaccgttttcacccctaatcgagatccacatga

SEQ ID NO: 29559 - DNA, 1071 bp, Oryza sativa
ctggcgccgtcctcctgccaccgtggcgcacgcgaaccgacgtggcaggaggagggcgctagccatgctggcgccgccccagggaggagggcgccagcatggctggcgccgccgcctccattcctgtttctctgtatggagttacaacggtgtcatttttattttattttttcggatgttttttcacactcaggatcacgatacaaccaaccacaaaaaaaatttaaactcgaactaccacttagctaagtctgaaaatatctagcataccacttagtctactttgcaccttcactaaaattagaccataactcttttagtaaaaccctttgatcagcatgttaaacataatgcactctaccactatatgaaattacttaatctaattcaaaatataaccacatgaaatgacatatataagttaaacagtacatagagatgcaatttttttatttttattttatttttttgatatttttttcacacttaggagaacataggaaccaaccgtataaaaaataaactcaaacggacaaaatatatgacatgtagaattttccaaaactctaccgaaatggacaaaatatgtcatctattaaaataggcataactttctcatacggactcggaatcaggcaaataatatatgcacggacatctacagaaaaagttacatccgattctccctcgcttcgccgggttcggcgatattaaaacctccaaattctgcttgcaagattgtgttttcgaggagagaaatttttcggtagagctttggaaaattccacatgccacatatttcatccgtttgagtttactttttacatggttggttcctgtgagttcctaagtgtgaaaaaaatatcaaaaaataaaataaaaataaaaaagttgcacatctctctcccctgcactagttcggagagagaggagaggagagtaaaaattctacatgtcacatattacgtctatttgagttcaatttttctatggttggttcttgtgtgtccttaagcgtgaaaaaaatatcaaacaaataaaacaaaaataaaaaatttcgggggggggggg

SEQ ID NO: 29560 - DNA, 12123 bp, Oryza sativa
  unsure (1)..(12123): unsure at all n locations
cggcgacagccactctggcgccccaaaaaggaccatttttgggataagtttttctaagggtctacttgcgaaataagtttttcaaaaggaccaaaatgtgaaaaatccagaagctcaaacacccaaatggaggaaccacactcacctgcacagccgggccgccacgtggcggaatcttcgcctgccgccctcttcgccgacagaatcccgcgggccccacacaccacacgcgcttcaattcgatcggccgtcggccaacccaccaaacggtaggaaaaaaaaagaaaaagacgcaggaaaatatcccgcacatgctgggcggccgcgagaggacggttggaggtgggccccaccggacagttgggcagttgggagttttttggttgagctgatcctgcatacctgctgcctacacaacacatcagccggtgtgtagttcatttgacaccttggaaaatgacgtggttgatcatgttagcggaacacttgggtggttaagtgggcaaaaatcaccctgctatcatggacttgttagggaagatctttctggaaacatgtatcatcgacgcacgtactcctgattgattagagaagggtcgtggtcgatctatagtgtcgttttatagtacgtgtgttcgctacgtataatgtacagtaatgcttattgatgtcgtgtcaatggtgtacacttcatgataatgaagttgtccattctaacatcccatgagttataggaggttcgtcggcatagtattaaatcattcgttgttataattggtaaaagatgccatattattaattaggtttaacgatagctactttaggcccctttaaattgtttgaaagtcttatagaatttcattcctacaaagaaaaaaaaattactactaacgcttttcaaacaaaggattgaatcatatattttaatttctataaatagatgataattaagagattttttttagaaaagttacctagagttccaagttctaacctcttcgaaaatttcttgagtctaactctcttatctaatttctgtgttttttattaaatattcaaatgattgtttctgtattttctcatgttttgtaataaactattttgcagttgtattcccgttaaaattatatgtttttctttgctatacttttgtgttattcaatcatgtgttttaacggagccttaggctctgtccgtttgcctgggttgggaacccatccctccagcacagaaaaagaagcagtccattagtacgtgattaattaattatttatttttttttcaaaaatggatcaatatgattttttaagcaactttcaaatataaactttttgcaaaaaacgcaccgtttagcagtttgaaaagcgtgcgcgtggaaaacgagaaggggggagttgggaaccttgacataagaacagagtattattatgagtaggtgatgggtacgtggatttcaattgaaaaatctctccagatcagtatcatgcgatggatcaaagagtgaagcaatatattgactcaaatgcaccggaaggctacgcaacacgatgtgagaactttttttttatcaaagacctggcttggtttctttaagaggaattgatgatcaggtttaattatcaagtccagtagtagtaattaattaattaattagctagagatttttgatcaaggtgttttatctcattaagctaggtccagaatgccgtgcctagctgatgtcttttgaccacgtaaaacaaaggccctcgtcaagaaaggaagccgtacgtaccctctatagattccctcgtcaagaaacagaggccctcgatcgtcaacattattacagggtttcttaatttaattcatatatttcccaaataccctaatctaaattttatagatgtaggtatcgtgaaggtatcacgaggtgtttttcttttttaatttctgatttatttggggtactttttaatgatttgtttctttttcatttgaaattctccgagattttccatgaatctctgtgatatattggtgataacgcttggatgatactatatattcactcattgtactggatgatatatatacctctatatgatatttcgaagagtcatggagatacaatacgcaaggcagaatcattgagttttattctataattataaaggtaatactaaaattttatagagatatacagtaccataaatattcgaggtatcatagatatcttgatttttttttataaaaaattcttccacggaagaagcatggtatcttgagtactagtgtagtatcactgggtcattgtataatcatacaaagataacagtacaatttgatagagatatagagatataatgatacttgataaaatattttaagtatcataaattcgtaatacctcgaggtattgtgctctctcatatccctttttgttttgtcagatctggccaggaatgcaagcattatagaggaatgcaagcattatagaggaccaaattttgtaagaactacactaattcttataaaattcccgtgaacttgaaaaaaaaattcatgtgtgtcaatgagccttaggacttctgtaccatatgagttttagtattttacagataccaattcaattctcaaaatattcctccaaaatacccccgatcaaagcaatcttttaatttgcaactacattaggggtaaatctgcaattaaccaacttgaaaaattcttggctcaaatttgtcgtccaaaagagttcgctatgaaaatgactgaatgttttatttttccgtgactgatgttaacctttgccttggaagtaggggactctctctctttcttgttaacttgaaccagctgctttgaaatggaatcaatcaaatttaaatcgagggttttctttccccaagtcttagggacgaagaatgcacggcaccatcggtggtgttgccctttccacctcaaaagctttttgctttcttcacgcgccggcctgcgatcatagccgctgctatctgtccttcttcgtgactgcactactgctgctgcagtccgtgtagatttgggacagaaagaaaaggaaaagggcagtgaaacctttttcctctttatttatttgaaatttgatgaaattgggacgaatcctttttgtgtttccgtgattagtttaatttagttttccaactatgaacttggtaggtgtgcatgtgttaattgtgtgttcaatttgtagtaagtaattttgcatgccgacagcctgaaaaatgtttttctttttttttcttttgaatggtactagtatgggttcgacagatatatcacatcagttcaggtatggcaaccggtgccaacgctgactactacgaccaaaaattatgctggtgtttagttctagggtgtaaagtttcagagtatcacatcgggtattatatagagtgtcgtataggttgttcgtatagggtgttcgggcactaacaaaaaaactaattacagaatccgttagtaaactgtgagacgaatttattaagcctaattaatccgttattagcagtgtttattgtagcactacattgtctaatcatggagcaattaggcttaaaaaattcatcttgcaaattagccgcaatatgtacaattagttgttttttagcccatatttaatactttatgtaggtgttcaaacgttcgatatgacaggctgtaaagttttgggatgggatctaattaatccataattaattagtgacatgtcttataccctgtttagatgcatagactaaattttagtccctgtcacatcggatgtttggacactaattagaaatattaaacgtagacaaatgacaaaacctattctataaccctggactaattcgcgagacgaatctattgagcctaattaatccatgattagcctatgtgatgctacagtaaacaagtgctaattatagactaattaggcttaaaaaatttatcagacgaattagctcttatttatacaattagttttattattagtctatatttaatacttctaattagtgtccaatcatccgatgtgacagggactaaaatttaaaacctgtattcaaacaccacctaacacaggcctaagttactattagcacactaactacaaactgacaaaacagtgaggtttttcaagtgttgacagagatttcttcctgctaccggttcaaattcaaacaagacaagtgccagctgaagaaagggagaaaaccttggtccttgttgtagcgccgtatcacattcacatctaccaggacaaaaggcagtacatggaaaacgaagatgaagacccgcataggagccatcgaaacgaatacgatggttacagaaaagcaatcaaaatccaaacctgcctactgatcactcggcgtcatttatttttttaaaaaaaatacagagacagtaattgtctgtttggttggcaaccgaatttgacacacctaatcatcattttagtagagaatgtatatggttcccgccacaactctacaggtgtccaaacgggcggcacggcccggcccggcacgggcacgggtctggcacggcccgtttcggcacggcccgttaggcacggctgatgaaacgggccgtgccgtgccggcccacgtgccgagccgccggcccaagcacggcccgtggatggccgggccgtgcccgtgccggcacggcacgcccgcggcccacgggccgttcggggcacggcggcccacgggcctgcagtgcacagtgttttttttttaaaaaaaagcaaaggaaatgtataaggaaaaaaaaattaaaaatggaaataaaatgtttaaaaaaaagtaatgatttactaatgttaaaaaatgaaaaaatggtatttaaaaaatggaaataaaagttttttaaaaaagtaatgatttgctaatgttaaaaaaaagaaaaaatggtatttttttgttgtgttgaaaaatttaaaaatatagattgtgattcattattttgaaataatttgaagataaatccacacttgcgaaaatattgcaaaagaatttgttaaaaatagtaatgacctttattgatgtttatatcattacaggatacaatgatacatgctgcctcgttaaaaactttgtcatgtaaaaactcataggggaaaatgagaaaaccatgacaaagaaaagagtacagctcaaaggtcagaactacttctaaaaaaattctactggggttggtctggatccaggtagagttgctcgaactgggcggccaattcttggttgtccgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacatgcgaagaggcgtctccacttgtagccgacgaactgccaccaccttggattgaacttgaagacgatccaccccaaatcctaccccactgtatcttcttcttacctgtagtggggataggagggggtctctgctggcgaacttcctgaaactttacttcatatcttccaaaaacctcatataatttacgtctaacctcagtataaaaagaactataatctacacctatagtatctccaacaagtgataaaatagcagacaatccccttaatttacacctaggatctaaaacaaaagcaagagcatacaacataggtatatttttccaatatttcaaatatttttgttacatgtgaaagacaggttcagttagaacgtcatcattttcgtattctttaaataaagtagcaatttcaagaaggttgtgcaaaattatattagcagttggataataaacttgtgacaaagttagagtacaatcataaaaagtttctagaaattggtaaaatttttggacaattgcccaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagctttcacaccggccgcattgcaaaacctcttccatgcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagccctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacactaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaggggactccccaaagttcaggggtaaatcttgcctggcgattaaccggacaagagattcccgagcaaccatgggatcgtactcccaactgcgtaccgtaccgtctgggtttaccataagttgctgctgccggagttgtattccttgcttcttggcacacgactccgcatggcgcttgaggtgacctgtaccaccagaagaacgagcagataaaatttgcctacatattctacaacgggctttcgatacctcccttccgtcggggcatgtttcctttatctcgtcgaagctttgccacacaccggaggttctcgatctcttcgagccggtgtgtgtcgaaacacttccgctcgcggttccggaaaatccttccgaagctgtctccgcctgaaccggtacctcctcaacgacagccgtatgaaccggtacctcctccacagatggtggagttggagccgatccggaggcaccgtcaaaccccgacatgtagttggggtcgaaatcacccaaggtgaacgacggcgactggtatggaaagttcggatccattctgaaaatttaaaccgacataaacaaattttcgaatatttattgaattcacaaacacaatacaaataatacacaaatttgaatattacttacatctttccaaccgcgagctcttcaaacctctgcgatcaaactgttgaactacgaaactaattttgatttttgacaaaatttgagcaaattttgtcaaaataaaaaaaaatgcacacttgagaacaaagagagcacttaaaacacttgagagcacaagatgaggagtgtgggatgaggagaaatggctggggttcatgccctatttatagggcgaaatttgagattttttggaattttttcgaaatttttatgaattttttagcctcccaacggttattttcaaatttgaacggtcaaatagccgttagtgccacgtggcgccttcccattcgaccgctgcccgccctgtcagtgcgccgctcgggccgccggcgtgtcgtgccgcgggccgtgccgtgctggcccgctacagtagccgtgccgtgccgtgccggcccgcgggctcggccagcggcccaggcacggcacggctactcgggccgtgccggcacggcccgttactgtagcaggccgtgccgggccgtgcctgctacaggttcggccgtgccccgggcggcccgtttggcccggcccatttggccacctctacacaactctactaactactacaaatgaacacagccatagtttgccaaaaagaatcacatcatagctaaataaatgttttatgtaatatatatcgagagaaaaaggaaatagggagaactccaattgccccgagagtggtgatctcacttaataggaatagccctatgtcaatatggtataagtgaactcaggataattttaaaccaaaacaaatacttatagaacctacgtggataaaataaaactgaaacgactaaattgaacttttggtgaaacttaaggaattagatctattcaccctaaaaaatcagctaaagaaatattttacgaaataatatatcaaacaataataataataataataataataataataataataatgaagaaaaaataaatatagggaggagaagtccaatccccaagagagcggcgaagaaagaagaaagagaaacacgggtgcacgcgctttcgcacccttcctttttaaaacgccactcccggccaacccggcctctccccatcctctccgtctcctctcctcccttccaccacgacgcgaccgacgcggcggagaaacccgcgaagccgcagtccagccagcgaggggccgccagccgaagctgaagcgagagctagggtttgctccaccccttgaacccgcccgcgcccccgccgccacgaggccgatcgaggtgcgtgccaccgtaatctccgcgcgtgtttgtcgtggggttgggttgggttgggtggggtggggtttggtgtggatcagggaatgcgggatctggtggggtttcgtgcctcgctcgctcggggatttcatttggtggggtggtggtgatcccatcctcccccactggattttgatggatgcgacccccttccgctgaaatcggagggattttggttgccatgcgctgctccttctgtccgtacggttcggtgaatcgggagttgtagattggtggtgatgatgacccagtagttggttctgatgctcaatactcgctgcgatttcgctcccctttatccaagggaagggaagggagaggggcttcctttgcgttcaaatttagcaaagtaggaattgtgtgagattggtggtagcgctcacttttttcagctctagatcgttagttctgcataccatgaagattcttgtatcaggagaagattattatatttattctgtggagaacgatatcagagatgatttgtgggggtgatttttggctgatttctgctctgcagggttctgcttctgaggctgtcaagcctggcggctaattgggatggaccttgtgggatcgctgctggtgaacatgactcacttggttgacacctcggggctccagttcttcggctggctcatcaccgccggctccttcggcctcgccgcgctcatctacgccctcctcaggctgcagagggcggcgtcgctgtactggatcaaggcggctgccagggagaagaaggcggcgtggaagtcgttgcggtgccccagctccggccacacctggaccgaggactacttccgcggcggccagccttcgacgtgctgcgtgtgcctgtcgtccctgaccacagctcagggtgtgggctctcggggtgccgatgccgttgtggtccaccgctgctcggtgtgtggggtggcggcccattctggctgctctcgtggcgccgagaaggactgcaagtgtgtttcacagcatggtgcttccaccttgcttcatcactggtcggagaggtgggtggagctggatgacaacccagagatgtcctctttctgttactactgcgatgagccatgtggtgtgccatttctcggcgtctctccaatatggcgctgcctgtggtgccagcggcagatccatgttgattgtcatgcaaagctgttaaaggagacggggaatacttgtgatctaggccttctcaggaggctcattgttcctcctctgtctgtgaaagaagttgcccaaggaccagcaattactggaatgctcaactcgatcaaggaaggtcttgtcacttcatcagttaggggcaggattaagaggcgaggcaacaagaaacgcatgaacaaccatcctggtggtaagacaagtccagtccccacaaacagctctatccttgattctgtgcttgaagggtttgctagactgcagaacttgaatggaaagtatgcgctggcaaaccataagtctagtggggattctgtcaagcaaacacatggatatgacagccctaatggagggaagaaaaagtatgaaatcattgatttgccacaagattcaaggccactgcttgttttcattaacggcaagagtggaggacgaaatggaccttctcttagaagaaggcttaacatgttgctaaatcctatccaggtaattttccttaattctttacttacgaaaatggtagcagctcattcttatcaactgctgagtcaattaaactgcttgctagtttctctagctttatatgcatgatacatctgctgaaaattgtagccagcagttttccttggttcattctacgatacttgctaattaataggcattttatacctatgtaggttctagattgatctatttgtcttttgatgttgccctcagagtgaagttgtactatttttgtcatttgcacactttattccgccaaccaaaatagtcactgagatctgacatcatcaaatgtttagttaatctactgttaactttagtattagccgtggttgattgtgacatatttgatactctattcttaacctggaaaatctcattcttgtttcagatatttgagcttagtgcttctcagggacctgaagttggattgcaatttttccacaatgtaaaacacttcagaatccttgtttgtggtggggatgggactgttgcatgggttcttgatgctattgaaaagcagaactatgaatctcctcctcctgtttccattcttccattaggaacaggaaatgacctatctcgtgttatgcgctggggtggaggtctgtcttctgttgaaggacaagggggaatatgtgcacttctaaatgatgttgaccacgcagcagttaccgtgcttgatcgctggaatgttgccatcaaagagaagaatggagcagaagatcaatgtaccaagcaagttaaatttatgactaattatataggtacgatgcatctctcaacttccatcatcttactcgatattatgatatatatctcacttcaaccagaagttgctgaatatgttattttatcatgtttggcctgtaggtgttggatgtgatgccaaggttgcatatgacttccacactacgagagagaaaaaccagataaattttgcagccaggtagggattgatttctacatatatttttctgcaaaatgatgtttctccatttggaacaagcaaaatccctgtagaaattgaaccttttatggaaacccctgaaatattgacctcccttagcatttgatcttatgctacctcctcttctatcacttttactagtcaaaataataataataattcaattttctactgagcagtttgtcaacaagctgatatatgctagagaaggcgctaaggatatcatggataggtcatgttctgatttaccatggcatgttagtcttgaagttgatggaaagaacgtcgaaattccagaggtaacatgctacgcatcttttatgtacctccacagtccacactctgatttatcatcggatgagcttcttatatatatgctatttctcatcaggacgcagaaggtgtgattgttctgaacattcctagctacatgggcggtgttgatctttggcaaaacgacaatgaacatgatgatgattttggtttgcaatccatgcatgacaaaatgcttgaggttgtctgtatatctgggacgtggcatctaggaaaactgcaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 29561 - DNA, 1875 bp, Oryza sativa
cttgtaacttcctaagaagacatctaactcttaaacagactggctataaagcaaaataatatgttctttgggaaatattccatactttttccaaaataaattttaacgggcttattttgcgtgatggcaacataataaggcatcttatgctgttatgctgttaagctttaaacatgaagggtaacaagagctatctgattttttttttttttggcaagactgatactgaagtagcagaaaataaaattaaagagcatatagtcatataataacatttttcatttaccatcggtggaaactcttttcatcttggtccatatgctgttctccactggtcaattcaacatggaaattgcatgtcaagcatgacaccatgcaatggtggtaatttgcatcgcatctccaagagaagacaaaaatatatacattcagattggagatcgagagttgccaagaagctggcctagaagattttaggttcctgtaaaggcaaagaaaatgcatcattttttgcatggcttgactctgataagaaagcatttgatatggtaccaatgcacatcacacaatgttttatgatggttgtcatctcaatttgagtctaagagatctgtgactctgcactctttttagcgtgctttttttgggtatgatcaggatcataactaaatctaattctactgattccagtaactaaatacaaataattgcttgcatatgtcctctcaattgtaaaaattcaccaattatttattcaaatctaaagcacaactaaaaaccattattaagagtgaagacgcatggtataaagggaaatacatctatataatcaggttcaatcttatattctacaatttaatcctgttaaaacatctacaattcaattctagatcctaagcctgatgatgtatcttctaccaataacatgagaagcaagtggcataaagcaatattgcgttcatttcaaaaggttggcatgacagtttgacttctgcttacattaatttgggttaggaagtgttacaatcagtgaatgattctgactatgcttcaggagtaattttgaagaaaacaataaacgtcagtaacccaatatcattacaaaccttgcacttctgatgccaaatacctttaatataatctacacaacgtttaatataatttagattaacataccttttgtccagaaatctggcaaagattgatcattcatggtatcatctattgtgatatcctcattgatgtttatagcatccctttgtaatcctctgccaggatttctttcataggcaatgatttcttcatatgccttctgtaagatgtcttttgctgctttatacacagcctttgatgcagatcctttgtcagcacatctgatggcatcagcacacaggacattgtaacggcttgtaatggattgacaagtagcatctttgtggttattgctgttgtcttccaacaattcatcatgtctggcattcctcgtccaacgtttcaaaaagtaatcaggtggaagtgtgcgtggatcaactattatgaatactccaagaatatgacggcataaaatacctgagaacttaaagtacttgcaactacactttgccatcttactggaagcattataagtcacacagaatgtgtctgatggatcatcttcatcttttgtgatgctgaatttgtttactctgccttcttcagttttctgaatgatataacccaaggattctgtgaattcttcttgaaacctactgaagactgcttttgtgtaagtgcttgctgcctgtttctctattggcgatgcagtccttgtagttgcctcatttaaccgagtgtctatatctgcttgtgcttcattttcatatcgacttgtcatgg

SEQ ID NO: 29562 - DNA, 892 bp, Oryza sativa
aaggttgttatgtcctcgacatgttgtaatgtgatgcataccccgttaatgcgacatcacgatgcaatgcggcaatgatcaaatggtatattgtactttttaccttgctttgtgtcataggaaagctgtactattaaggggggtgatgcatagacatataaggagtgatgcatgtgctcaaaatctttttttcttggaagcatttctctatttggtttgttccggaaatttttggaagttccgaaaatacacagaaccgattttaacctcctggaaaattttggaagttccgaaaatatccgcgagccaaatatgcttctgcaaattttcggaagtttctgaaaatgtttttcggaagttccgaaaatccacagaaggtattatgggttctggaaattttcagaaatatccgaaaagaatttttggaagttccgaaaatgggcgttgacttcgattatcctagatctggaatttttggaagttccaaaaattacttttattgcgctccaacgggcaaatttgtgctgtgggtataaatacccacctcccctcacttgtgatggctgctgatttcattgcaaatttgtgtgcccttggcttgcatctctctctaagtttttgagcctctttctcgattcatctctccactcgggtttaattcggatttggtttttaaattagcctattcacaccccccctctagacctaattgaccatttcaattggtatcagagcctaatctcctaattaggcttaatcgcttggagagatcatgtcggattgaacgggggatggcaatgatggtgataagggagctaggtttccttatgactatccctccacatctacatcttatgtgagtacctatagcggcaaagcttcatacttcaat

SEQ ID NO: 29563 - DNA, 415 bp, Oryza sativa
gaggattcagtttcttccataagaaacgcacaaccaaaaattactgtctgaagatgatggttgacacctgagaaggtaacaaagggcatcatatacttggtcttcttatatgacgtgtcaaatgtgacagcatccccaaaatgccgataggcttctttagctctagaatcagcccaaaaaacattcatcagacaaccattcttgtcgacctgtatggcatgggaacacctggggtcattggcttgcttcttcttcagataatcaagaagaccctggccgtcaccggtctccccaaggaaattctgcctaagagaggcggtcccgtcagagcccatcgcagcgatcttgttggacacatcaggcaatcctctggcacgaagatacccgtatctggtgccgatgccaaggctatggt

SEQ ID NO: 29564 - DNA, 13917 bp, Oryza sativa
ataggattaggctgttagggtaggaagctgtgcaaccattgattacttctttctttttctttttgtccaaagatgagttagtagaaggaagcaaaaccagtgtagcctatgtcaatgttgttaatgaattgtaaattgaggtgaaatggttgagatctgtatcgttaaccttgtaaaaggtgtcctgtttcatcatagtttatctgggtatttaccagttcacgtaaccttgtaaaaggtgtcctgtttcatcatagtttatctgagtatttaccagttcacgtattaactttgcactggtgtaaacaaaaatatttacatcggtctaacgacaatgataaacagatttgcgacaaaattattttcatagatcgattgtacaccaaaatgccattccattctgcaagagagatgagctgaacggattacatatggactcgtgcaaatgcatccatatttttctttattcttcctttatttgtgcactaaatttagttatgtgcacatgttgtaacacacagtttataaactagaaatcccatcttttcttgacattgaacattatggctgaattctttacattgtcttgtggaactttaagcgtcaactgaactttagccttcataggcacctccttcgtcttgccccctgcatctccaacctgcatgccaggacgcaatttgcgtcaacttcttacagtgcaaaaatatagcaaggaaaaattatttggcacctaatttaactgaggtttgtagcttatgcagttcatgaaatgctagacatactggaaaaatgctattgctaatctatggtctcggttgttttctgatgaaaatgcgatctctgatgttgacattgaaaatttgaaatataggtgaacgcttacccaaagagatgcccatccaagcctttggtcagactcataaccagctttccacttgacatgcttactggccttgtgtttatagataaaactccagtagtttgtgtcaaactggtaccggtagctgaaaatggtaaataccatataaacatattagcagggtactcaagcttcccatagtgtccagagctaggcattcttataggtgtgcaatctcatccataaagcatgaacagtacataagtgtctagattgagtttatgttacatttccttagttttaaaaatgagttttatgggtcaagtcatcccaactatataaggatggattgtctctcttttcactaagcgataaagatgaattaatctagcatccgcgaaggttcttcatccttgttccacagtctcctcaagctaaaagatctatccccttcagctttgcttagctaggtgaactaaggttcatcacatgtattgtcacatatggtgtttctagcatacacaactatttcaagctgtattggtgacgatgacttgcactagagcagcttaccttaacttgtctgaaggagtgaattggcgcttaaatgcaaaggatagtgaattggatggtaaagagaggcttggaataaatgataactcttcatcctataaaatacaacaaatatccatcatgagtggcacagtaaaataaatgtcaatggaactgttgtggggcaggaggccaaggcccatgacagaaacgaaggccagctgagagatgcttaccttgtaacgatattttatgttcatctcattgtcactgtacaatgcagtgcaaactccattcagaacatgagacctcactatgccgtttactgacaaaatcctgtcaccttcatccaaatatttctgcttaactgaaacttcaccattgggaaagatgaaggttgtcctcggctacatacaaataagatcaatgaactcatgcatggtgttttctagtttcacattatcaataacagcaagggctacagtgcatttccaataactattttttttcacttcatcttagtgacttggttgcataaatactgaccaatccatcaggtggaaccacagatgataactcaatcttgcatggtgaatcacccaaatttgctctcaccgccacttcccctttttgctcctaattaagagaacaaaaaatgatcacatatactatgcggtatcttacatgtatcatgaagacatatttctatagcacaacaaaagctatgctatataatagcaaatagatacaaattaccaacttattgttccatgttaaataattttggcacatacaaaggccttttatagactcatgcctttcgaaaacaagtataacgtatatgccacagatgtgtgacttccaagaactcatttcattcactaatttacaataaagaatagatagatgttcatattaaatgaccatcaccgcatttcatagggtcttccagaaaaaagaatgaaggcgtttctcgatggattcattttgactgaatgagtgactgactattgcaagtataaaactaaaaaaaatgtccatcaaattcaacaagaatcattgaagttcataattaagcaaattgatatcatttgatcaaattgctgctgagtaacaaccaaagagatccccacagaaaaaaaaaaggaacatacattgagaattcgttagtcatatggcaatttataaatgtgtttcagactttcagcagatgtttcttcaagttcagtcccaatgctaattaataatttcaagaatggatgggaaaatgcaagctgataaggaaactgctcaaaaataaaatcactgcaaacaaaacagatgctatcagaatagcttctccatatacataacacacctttctactgtggtacttcaattgaaagtacctatccaagtgaatacaagaaacagttgatttgtcatattcataattgcaagacagagacaaaaggtgggtcgagcagctgatatgaaaatatgattgctctccattctggcagttctgaaacataaggtagtctcaaaatctcacagtactgctttatgaaaaaagaatgagcatcaatagcaacgtaagagtttataaatcacgcatatttactgatggatctttacataggaatcattcaagcagaaaatggctctacaacaatgatttttacgataatgatatatcgaaggacatctgagaaactcaaaaggttacagtaaggacagaatggatgacatcaagttttaaagcactagtacttgatattcataaaatgcaacacatagtgcaatacataggatctcacaatttctagccagtgttccatatgtttcccaactcagctcaagaactccaaatataacaccgattcagttgtaccaaactgttgcacaaacttaaccaatacatcctaaacaaaaccacttgcatctgttggcaatgccaaaagtgctcatattatgcagaaggttcgactatagaaaatagttttcaaattttgaaatttacgcagtcatatcacaagtatgcatgattatgcccagtgatgtatttcggcacctagaatcaatattaactcataaagctaaacccagaaagcaggcctgcaaatgacatgtagactttttattcttcctcccccaacaatgcaagtatatctggtcctttgtgttcttcactcaacagcttacttttagctgcctactaaatctcaagaaaacagaatatttcactgacacccttttgcatatcccgtttctgtcattccggacaaagtaaggtcctggattaaattcctctgttcttcaaaatgagatgaatttatctgttttcccttctctttcataacccatatggctagataaatgtcaagagccagatgcaaacagcagcgaagacgcccaatcacatttcacattagggtcaatcgttcccagcaaagcactaaattaaataaatcaatcaagaggtggcaccttggtgtcgtgcttggcgctgaggcgaagcgatccggcgaggtcggcggcgccccgcagcatggcgcttcgggctacggtgtcgacggcgacggagaagttccgcgcgaggagcgcgacctcgggcggcggcggctccaccgccgccgccccggccccgccgaccccgtggtggacccggacccggagcttggcgaggccgtccatgacgcggcaggagaggcggtgggagaagagccgggcgtcgctgtcgaactccgaggtgacgcggacagccgaccgcctccgccgcggcggcggaggggctccctccggggacggcggaggggcggggcccgggaacgcgtggtgcgcgcccgcgctggcgtcctcgtccatcggagggggcgggggcggggcggagaggagcgccggggccgccattgcgcgcgacggcggcgagatgagggttgggttggggagaagatgagagagaaggtgggggaagtggtgtggagtggagtgaagaagacgcgtggcgagcgtttgcgtcttctgctcacacaaagatatggtatcgtatgcgtatctccaaattttttttcctttttttttcatcacacgaaataacgcatatgcgtacacggattgagatttcaaaacaccgtacctttattattaatagatgggtttatcattcatgacaaaattagatatattaccgaaagttctcgttttttggttttatagcaccgaaagtttctaattcattttattagctttcaacttcccaatccgttactatctagagcacttccatcatttacagctctattgctattagattgattaattctgactgaaccatttgatcctaccttctcattcactcctctttcattcccccgagtcaccgactagcacacgctatttgtgtattatttctgtaattgtgttctattatattctaacctaatcgatctaccccttcccccacccccagtgcgtatcgtcaagctcattccgtgtcgcatatatatctggatatccctctctaggcgcggcggcagcagcggtccgctttacccccaccgcaactgcccaccccttatgtcctgttaccactcaccaacagccacccatccatcctatcactagcagcaacgcgacgctgctgctgccaatcgatcatgttgctgttcattcttcatgtaggagaaagattaaaaaacttgttgctgtgttcagatcggcaacacataaactaaacttttgtcattctgtgtcgcttaacttagcttttgtcatgtatctgaatttccaaacaaattgcaacgacaaaacaaaagtttctgtgattttatcctgcacaaatctgcaaatgctagcactaggaaaatcaataagatgcatgtagcaagaagacatggacaactcatttaaacttcagttggagttcaagcaaaacactctctagctcagtacaaagcatgaatgattcaatcgaaagggggcagactagcataggtggaggccaagcaacaacacaggcttcgacgagcgaatgacgcgttaggagtggtgctcaaaaggtgagggtgcagcatcggcttcacgtcgtgcgccacgcgagggggagcagcgccagtcggggactcaggagagagaaagaggagagaattagaaggtaggatcaggaatgctctaggtaggctgtgtttagttcacatcaaaattgaaagtttggttgaaattggaacgaagtgacagaaaagttggaagtttatgtgtgtgggaaagttttgatgtgatggaaaagttggaagtttgaagaaaaatttgcatctaaacacggccgtagtaacagattggaaagttggatgctaataaaatgaacaagaaaatttcattgctataaaaccaaacacaaaaactttcattgctatatatccaattttgccttgattcattggacctacatgtcagtaacaaagacatgtgacttgtttatgacattggatctacacgtacacatcaccaaatcatatttacgctttcggattgcataaaagatacattgcaaacacaccacccatatccctacactcgcgatattatagacattgctaataaagcatacttttatgtgtatgttttttttattaaagagatgagtagaaacaattatggtgctagtaaggcttaagcccaagctcttagctctataatgttaacaccttaacaaattactccctctttcccaaattgatcatcatataagtttatgcaccaagaccaagaacaatttaaatcacatcaatcaagacactatgcacacatgcattctcccacaatacatgtatcgattaaggctattcccaaccctagacactagacatagtttccataaacttcacatcatcaagaaactagtactagacactactattccaatgcaaacaccactattctatacttaaatttaatgctacttatctcacatgatgtcttggatgttgtgtaaaaaccatatctcgtgcaagacatggtttcctctctttcctcgtttatttacttgtcacatcatttttcgttctaggtggtaacttatttaatgctatgaacaacatcctagtcattgggttgggaatggcctaaaaccttatgccaactacacccacatattctctcatattgcattaattatattctgataaaatccatgtccatgtagttatatgatgatcaatttgagaaattttggattctattacatgatgatcattttgggaatgagagagtactatgcaaattttggagatgtggaagtacacactaactcaagctctcgatgcgattgaattctggttccatgtgctagcaacctaaccattgcagcttagatttaacaaggaggaaatacaaggtcttagagttttatcaataaaacaaaaaaaatgcttcgtaagaatataagtagcacatttggtgggtgtgagccatgcgactcaagcgatcccttgcaccctttccaatccccttcttcatttttctccgatgtccatggtaccgtgatagtggcaatggagaggggatctatctctcgttttagttaagtaagtctatagggtttctttaattgcttttaatacttcctccatttcataatgtaaaactttctagcatttctcacattcatatatatgttaataaatctagacatacatatatatttagattcattaatatctatatgaatatagataatgctagaaagacttacattatgaaacggagggagtagtctttatcatttaaatgtattagatagtccggagtatgccttttattaatggaattatattcacttaggtttatgttctctttctatcatttttcataagtactttatttgtgaggtggctagttcatatatgagattctcgaagaattatactagctaagatcctaaaaaaaaatagaaaggctttatttgttaagcgaacgggtgacccaatctatagcactaacttttggtaccgacttgttatacggttataccggtttattaactttctcaaatagatgaagaaaatgcctcctgcttattcatttgcattttcatttcatggagttggtcaacacttaggctgtgttcgccaatccatgttcccaaccgaaatagtacgcgcggaaaatagaacagtctattagcgcgtgattaattaagtattagctattttttttcaaaaatagattaatttgatttttaagtaactttcgtatagaaaatttttgcaaaaacacactgtttagcagtttaaaaggcatgagtacgatagacgagggagatggatcgggaaaaggggtgccgaacacagctttattgtgctcccatctcatgcaacaatccaaattatgaagtctctttgttctactttataaacttttatatttctcaatagggtaacaatagattataatatattctcttatttaatatagagtaacactaaataaatttggccattttaagaaaaataaacactaagggcatgcacaatggttgtcaatagtggtttcttagtgtagctaattaggaatacttgttgacatagaggaaagagaaaaataagagacaaaacatcattgttatgtataacaacggcttaacaacgactcttaatcactataatatggaaaaatggttgcacgaaggtgaaaaaagggaaagaatattaataaaaaaaatatttttcgagttaataattagagcctttgttatctcaactattataaaaacatggtctctaaataatcatataaaatattatttaagagaccatactctagtattgaacctgcccaaagagcaatatttctgtccttattttgtttagagagagcaagagatattttctgttcctctcctgtccccacacaccaggggtctccctctctcctctcctcttccttccactctcctcgctgggtcgcgcgcttccctgctctctacaccgcgtccataccccagttaaggccatcccgaatctcgaggcagattggacggctcccattcacccccaccgtacaccgggtccacccacccacccccacagtcgccgccccttcccccgccgcgagagtcagcgccctataaatacccgacctcaccggaaccctagatttttgagagctccccttctccgccaccgcaagctctcccctgtacccacccaccgccaccgcggctactaccccgccgccgctatcgccgccgccatcacgagctactagtagctaccgggctatcgccgccgcttgccctgatgccgcagcaggaggtcgccgaccagatcgccgccgcggcggcggagcggggcctgcagaggagcggctcggccagccgcctcaacgcgggggcgccggagttcgtgccgcgggtcgccgcccccgtggtgccgccgccgccgccggtgatccgcgtgttcgccgcggcgcctcccccgccgcgggcggccttcttcgcgccgccgccgccgcatcaccggccgtacgagtactacgcgcctgtgaggggcggtcagttcgccgccgccgccgccgccgaggagcaggaggcggaagtggacccggatgcgacggaggcggcggagccactggtcgacgggttccccgacgaggtggtgcacaagattaccaagcaggtaggcatctatttccccgtagatagatgtatcataaacagtagtagtattcagcaaattatattgtgatgatttaggggaaaaatcgattagaatgtttaggttttgggtttactgatcatgtattgtcttaaacagcgttctgagttggctcaagtactgagtagatgctgtttgtagtggctgattacgctaattttaagaatgcacaaacattttgggatgcaatttatgaaaaattcctagttatgtgtagaaacaatgtatcgctaaattcccttaattggtgaggtgtttggtgctgttcaacttaggttcttcatatgtgatactccttctaaaaaatgatctgtgcctaacaatttctaatattgatcgtcgcattacccatgggcccacccgttgcgtctcgggtgcaggccactcgcccttttcggttcgcacgcagagttactctgccagcacgttttgcatctcaggagtaatgcatttcacggctctatcagatccccaaaaatcgatgttttggttcgccggctaaacaacaatcaactaaaagaaaggaaaacaaagtatgtagctgatctcatgcagaacggatgtgcatggctcctttttttcgtgaatgtagcatggacgatgtgtcccctaagactgattaacatggggagttaatatctccttagtttctcaagatggaacgtgctgatcaaacctggatggagggagtagtctgttgtgctgagcatcgagagcacctgtggttgtggatggttatttgaaacatggttgttgtggcgttgtttgctccgttctgcttggtttgtttctgttctgttcaacgttgcccatgtattctcctccattctgctttaggccctgtttggcatggttccaactcctagtttcttgcagaaatagaatttactatttaaaataaagtgatctaataatctaattttagcctaaagcgtgaacagaatatctcacactaacaacctttgatctagccccagttccaactccagaatttttggagctagtaaaacccagctcaaacaaacttggagtttgatctgtacctaggaaaattcagttccaaaaaacttggaattggagctgtgctaaacagggtcttagttcaccttaccttgcctcagtgacacttaggtgcctgccctggatgccttggcatcctggcgcctttcaagcacatggttgccttgcagccttggtttggaaaacatttaagtgtactaacatagtgaagttctaaattatttggtgaaattttatctaatcagctgtttgtttagtgaatctctatcatgattgagggaaacattcctaataggctagtgttatagcagtgagcatctagtctactttataaaactgcagaatacaacagaaatacttttgtccttcatgactttattattgactttattatttagaatttagtggaggcagctgttgcaatcagatcatacataattgtgactcagctgtgcaaaatatgttcctatgttttatttgtgtattcaattttcattggactgctttttaaatagacacaggcttgtaaataggtagtaggaaagtatggttctgtttggaactgatgtgcagtggtcaagagttaggacatttaagatattttttacacaaatagtaaaacattattgcttatgtaatctgtaataactaatcagttgacaaatatgtaaatctttaaaaagctacattaaatggagttttttcggatggtcataaattcccaaaggatgccaagtcctgtcaaatagcgttagtcgtgttgttttgtagtgtctagtagatcagtcagagagagaaggataatgtgcttattttcgcatagatatagttatttagagttcgtctcatgtttacctaggtgactcctctgtgttaaggctctccagggagttagttagccattgcctatgaggtagatgagaaaagagacgggagaaggggactgtaggtaaaattgccttgatttgataggggatcaatagatctgatgctgggtatacctcttattcattgctgcgggcttgctgccagggagtcgcactgctgtcagatgttagccttatagggctgtaccttgctgtatctgttgctgccactatccttagttccctatagtttttttcatggtgctgggcagcgaacattgttgtcgacttgtagcaactgtggcagtgtggctagttctctacctaaccctgctgtatcgtccctgttctggtggcagcaagccttctggagttctggttgttactagttgtctcttcagagcatagagttttgtttgtgggactttctgggccagttggtgtggattctttgtgccttttctcttttttttttcatctactcttccagttgatgccataatcaagttcatatggtttcatacttgccttgccatcttgataatcatgttgacacctccttatcttttcttttgtgttttctcttgcctgaaactatttgaggacaattttgtaggtggagtactatttcagtgatataaacctagcaacaacagaacacttgatgagatttattaccaaggaccctgagggatatggtgagttgtgtataattatttgaatgaatttaatttttggagaaattgattatttttttacatgattataatgatgtctaaaagtaatacattttttcaaaacaaaatggctgtgggtaaacatttttcttacaatagtttgctaagctttactagtataaacaaactcttttttgctaagctttactagtgaaaaagaactatctcctattatttccaaaagtgggaattttttttggtcctcctagatgttggtacatggatatgcttgatattgccagatgaaagatgattgtttttaggttattaattattttcctaaatatttgggttaagagagggaatattaggttttgtttggaatattatattttataacaagccatgtttggtggtaacatttcttctttttcatgaatgcagtgccaataacagtaattgccggcttcaataaaataaaagctttagtgcataataattcaatgcttgccgccgctcttcgaacctcatcaaaacttgtaagtttcttcattccgtactgtggtatgctcactttatgatggttatctttgaaggacaacatatgtttatttttaggataaaacaccaattttttatctactgatatttctagccaaaaaaaaattcctgttttatctacttattccattcacattgcaggttgtaagtgatgatggaaaaagagtaaagaggctgcagtcatttactgtatctgatatgcaggacctgcaggtattcatgaatctcaatcgcatgctgtttatcttatttttttgtaaatttgtgataatctacactgatttatatggcttcttcatctttgttgtagtcccgaatagttgttgcagaaaatcttcctggtgatccctgttatcagaatcttatgaagatcttttcaactgttggcaggtaggagtttgcaacatgtgagcatcctatttccccttttgaggatcttagaaaaataatatattgcgactttttaatgttctagtgtgaagaccattcgaacctgttatcctcaatcttcaaatggcaatagtcctgctactaatagatctgccaagctagatatgctgtttgccaacaaggtaattcccattcaattgttataaattatgttatcataaattcataatattgttggtaagtgaatactaattattttttattcttatggaattgtatcaattacattagaatcattcccaaactttcatcctctagcagtattgcccgagtgcattctactgcagataaattatattagaacatttatcagtaagaaggcttacggatgtatgcttgagacttgtcccttatttaagaactaagatagacttccccatttagcgttggtttcaacttcagtgacagctagatgtacttatgtttttgataattgctgaaatcaattctgaaagctacaagaagttctattttgccaagctgggtaatagtggctgttcactcgaggtgaacatttctcttggatctatggggcacaatatttgttagtttttgtcatattcttgcttgatttacttgctagtttgaacacattgttagccctcatccatatgcttttctgctgtaagcctgcaattctttttttccttttttgacacctttatcatcatggaagttttttcacttagctataagagatgaggtctcattcatgttgtgtttcaatgtgccaaatcatttattttaaaacatgcgtgaaattttcttgtttattttttacttctttttagaaaatgtgcaacatagttgaagttgtcattatacttttcctgaaaatttgatgttattgttacttttcccaacaaaacaagcaacatggttcaatgttttcaaactggctagttgaacctactcgtatggctaccaactagacgattagtcatgactaatcagtgataggggcagagtagctactgagagtaagaggagcagaatagcttgagaaagaagaataatcattggagggggagctggagtagctcatcttctcctgcttggcaccttcagcagcttgagaaggggaagtgaggcagggccagagtgccactaggtccagggagggggctgtagcctttaggcgctcaagcccaactaacattttcctccccttctagttgccgactattatggatgactagttgctgactggtcagatgactaggtctatagttgag

SEQ ID NO: 29565 - DNA, 23972 bp, Oryza sativa
attttgatgggtgtgtgcctaggccaagtgttttggaaccgtctgttatggtattgtcatgtgttttgaagccaaacattgttgttctggttggtacagacttggtgagttgcatggttaagttggctaccactactaccattttggacccaagttatatatggggaagggtgtaagacattattcatgaaaaatgttacaaaaaaaaaacatagaaaaacatggagatgctcgtcttagttcttgataggtcttcaggaaattgggtcattttgacagaagggtgctcaacagattggattggatgaccgaatatattttcacctgctgcttgcctactcccattctcgttactttgtttggtgtgagagaacgataattacatattattttaaatataatggatgttccattcagtaatgaaaaatatccggccgttgcactactaggatgtaaaaacacacatgttcatgggtgtatatttgtatcacctcgttgctgttgtgatgaatattttcctgaatttcctgaatatctggacgtcatcacaaatagcgtccatcctattttcctgaatttctcagcatttactacttacttaattacaataatatataataattacgataaataaaaaaaaatcggttactctctcaaactgtttaatttaattggatcacttaacccataaattattattttttctcattttactctctaaacttttaaaaataatttatgcttaatagcaattctccttttcattttctctttacacaagtatcattttaagctgaaccttttttcgacccatagatgataccccttcgtcacacttaatgcgcacacattttaccgataaatatttttattataaattaaattttatttgatgaaaaaatttttattggattgtcatttaaaattatttttatgtcattactattttgttgccaacattataatatagaaaaaatttaaagaaaagattagttttacggactgtgccaaatttgatcgcgtcttggcgagtgggacggagggaataccattatcaaaggttcaaaatatttgcagatttcatcatgattgtttgcttataactaagttttgatgcttaaatcaatcttgttttttgtaaacagtgataaaaaaaatttaagtaatgtttgagatgtaagttgtaaagcatataccaatgtacattatataacttatatatagaaagaaataaattattaggggttgagtgctcagacaaaatagtttgagggagtgaagtagacccttttttttaactatatttataagacacagtaccataaaactacctatttctctacttctttacctttttatttacatacttaaaagattcgtattgtttctgccgtcccacctgacaaaaatctaatctaacttagtctaacgagaaatctaatctaacttctgtcctattccctcccaaccccacctgacatacagaccaaatcacaagggaaatcaaaataccaagttcatgtactacctatttatttatattcctatttaaatttctattagtccaattcctgttcctatttcaattcaccaacgcaacaaatatatttggtacagagttgaacatgagacaaatataacatgtaactggtacaaagttaacaagaattcagaaatactcgtacgatacgtctctacagtacagtactccttaagtatattgtttcactatcttcacaattatgtctatcctagataaagctccaatcctgagatgcagtaacgaaaattaccatatgaattcatgcatcatgtttaccatgctcaaagtttacgcagtgaaagaaatcttcatatcgtatatcggatgagtgatttaagagaaaaatttatttaaagtatagaaggtaagaatatattttctatttgctaaggaagaatcgggacagaggtctctcgttagcaacaaaacgagagtccacttagcagcgatcgcccgtgtcacagtcagtaaccaaaaagaaaaaaaaataaaggaaaaaaaccgatcggttggcttcctttccttttctctaattgcgcccttctgttgcacgcctttggcattcacggcgtctcgccgaacaaccagtggtgtcatgctgcgccgagaggcattctgacagggttgattcatcaatcaatcaatttccatcgctgcactgacatgcttcgccgcctcaggcgggcacctagatccaggaccatccaaacccatcacgtagcatctcaccgcactgttagttcttccaccaattactccctgcctaatcactttgaatcttaaatttctgcctaatcacatgggatccgtcgcaatttaactttgcgattttcttaatcaagggccttttaatttgctttgcctaattgttgatgctgtcgaacctatgatattgatttatcgttgcaagaatgttgttatgcgccgcatgcattatgcagtgcagttcgatcgcccattgggtttgttcggctgcaacacagctatatatcaagcatagtaatttgtgtctgtactctgtagcaatggatcaaacagccgaacagagccatctgaaatttgctgtctttcttgtgcacaatgcaccaagaaaaatgctaattggaaataagagttgtacctgtgatgtaaactcgtgcacttggatggatatcatttttgcaaagatacatgtaaatattagatgtacgcaaactatagctctcttcatcaatgaatgttgatgtatttctatggtttactttcatcgtgttttccttccctatcagtgaggataaataaccatttatacaattttagtaagtttttgtagaagaaaaaaaagggggtaaacatgagttattgagtataggtgaaaagtgattgatagattaaaaaaatagttaattggctttctggcacgggcagtttttatagtgataataaattaataaaaacatgatttaagtcttaataatgtaagactataaatctcacaatatttttttgacgaaaactaaacagaatatagatataatctgtcttcgttatggtgattatcaaataatccagaaattatgccattatatgtaaataactgttccatagatactagaccaaagttggtcggtccaatcaacaatgtcatcaagcttaaaccaaaaagtttctaactacattcgaaccataaggtataatagtgaaatatgtaccttctgtgataaaattgatgggacatacataatttataatacaatgtgtcaaatctaaaatttcatgataacttttgtttgaaatatgtagttatacagtacaattgaaatatttcacatagttttatgtcaaaagtacttaattactcacaaaaattacagtatcttttactaggtatgccctgcctaaaagatatttgacaagttttcgtcaaacttataaattatgaatttctgaccatcgatactttctcaaatacttagtgttaaaaattaaataaatattgtacatagaattaccaagtagtatactcccttcgttttaaaataatacattatttttattcgtacaactttgaccatttctattagaatataacaataatatcaaataaaatagtaatattgtaaaagtacctacgaaggagtatttataattaacaaacaaatctacctatatttataatacttttagtcattgatggcaaatcaaaatataatccagtaccatctatagccatgaacgaacacgcggctgcaaaaagccccaaatttttgagggcccacctcggaatgagctaatccatctgttctaaaatataagagattttggataaatgtgacatattctaatactacgaatctggacaagatattatatggctagataggcctgctagggagcaagcgagaaacaaaaaaaaaagacagccctaggcgaacacgtcgcttctctcgcaactcgtggtaatcgcgtgcgtgcgtcgaggctaagacgtcacgactcctcgcaagtccaattcagcaattcccgactattgcacgcttgtgcctgcgtgcgtctagagagagcgaagagacgacgacgatgatgacatgacgccgagctacgaggtcgggagcagctagcgagcggcggtgggacgagccgagtgcctaagccctagcggctgggggatggctgtggctgcctttgccttcttgttttcctcttctcctcgtcctagactcctcaatcctcatcagccctgaattggtatttgaattaaattagtaatttgaccaaaagtatgccatatttatattagacatatgaatttctcaaaactcttttagagtgaaaaaccctctcacgtcgcactccccaggggcggctcgggaggcgacgaccccgccgcccctctcccccacccccacccccttctccgcctcgccgtcgcccgagcggccgccggcgaagccacgcagccacaaggacggcggcggcggggcgctcctcgtctcctcgcgctcgggcagcctggggagccgcccggagtggcgacggcggtgtccgccagatccgcgccgttccggccggatctggcaggatgggctggcggtggggaagccgtcggcggcggggacgggcgacggtggcggtcgaggcgagttgcaccgggtggtgttgtgggtgatggcggcggggatggcgacggcattggggtggcgatggtggaggcctgtcacaccccgaagttctttcccaagcctaaattgaagctataaatggtcttaagaaaatacctgtgtaaagcaagagtaaaccttaataaattaatgcaaataataatcggaattggcaggtggaatttttgttgagttctacatgccgaaatacgctaacaagatttttagtggaattttcagagctctagaaataattttaatcaattaaaattgagcacagacaatatttaaatccttggaaattcatttcttcctttttctttttctttttccttttcccttagtgggccgccggcccattcccctcctctctccccgcgccttgctgggccggccggaggccacggcccagctcagcccgcaccccctcctctctctcagggtcaccgacaggtggggcccacctgtcgggtcctcccccaacctctagccgctcgccgccgcgcctcgcgtccgcgcctcccgggccacgtcgtccacgtcgccctcgcacccgcgcctcccgcgcccacttccccctctctcccgctcgcccgcgctcccgagacggccgggattcgattttcgaatcccgcctctctctcctctcccactcccccacgtcggccggcgattcccgcctctcccggccacgtccggccccctctcaccctatttaagctccgccgccaccccctctctctttttccccatttcgccgaactctcccgagctctctatcgctcccgcaccgtgcatccacccgccgccgcctttcccgccactccggccgccgctagctgccgctaggctcgccgccgcaccgcgccgtcaccgccgtcgggttcgcgtggccgagatccaccccgtccacccctcctccgtcgaggttcgccgccggagcgccattcccaccgtgcgacggtgagagccgccatgtccaccgccttcggccggcgttcccgccttctatggcccctttctccctctctaaccttttccttttcgttctttaggtcgtcctggtccccgtccgccgcttgtcgacctccctctgtcgctccttgtcgccggtcatcgccgccccctccggtgaggactccctcccctttcctttccttccccgattccccatgcgccgccgccacccgcgctcgccgtcgccttcggtcgtcgccgccgccggggcgccgtccgctgccgccgcccgcgccgccgcttgccgtcgccggtggacgcgcgcgcgccgccgcccttgccatggccggccggccggctttgtgccgagccgagccgagccaggccaccgccgcaccgtccgatcggccccgggccgatccgggccgtcgatcccgtggaccggcggtggaccacccgcgtggtcccggtccacggtagaccgaccacccatgcgccgctgccatgtggggcccacttgtcggcgccgcccctctctctccgggatttatttattgcgcaataattcaattaaggatttttccatttatagtaaaaacacagtgaatcttctaaaattcataactaattcatccgtgctccgtttaagcccattcaagtctcagtaaatcaagaaaaatttgtagaatccattaaaaatggttttgttctatgtttcagtagtcttatagcctatttgtattgtttgctttgtatgtcgcttagattccagttcttccgacgctccggtgtacttcgagatagtcgccgaggttcctccagcagcagagcaaggcaagtcatgcttgtcacttgaacatgttgatcctatattgcaaatgctctattgtttttcttcaaatactgcatcgttttataatgttactatgggatgtttacctattgttacagccatgctattttggtaccatgttcctttgttagcttgggttataacatgaatagactttggactaggaattgcttagccatgcttagttcaactagcacacaatgggggaaatcctattaatgtttagactgtaggttctaatggtaatgttggattagtaccaccgctttggtgttgaataattaaaatgaatcacatggtgggctgtgggtgcatggttttgttggtcgcacccatggcagttaaggaccggttcgcgggatgccctggaagaacttatcgtacttaccacaagccagcgtgggcaacggctgggcttgttgtgtagctttcctctagctgacgcatccaggcaacggtgggcgtgatggagcggggcgggccctgcgacggcctctgtcgcttgcggattcacctaggcacgagaggggactgcccgctgccttgcgaggagtgggggtgaaacttgaggtgtggtgtgcttggttagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtttggtctaatgaaattggatagtataggtggatggttgggcctatcgcaacgtggtatagcgttggacagtggatgaataatattgattaattattacaactgtttaattctttctacctctgtttataaatgctcgctttatgcaaatgaaccactctagctctcctttgataattccctgcatcatacccctattccggtatgacttgctgagtacagtgggtagtactcagtcttgctctattttccccaaccccagagtacgagtatgtgtcagatggtggtttctccgaggagtagcttcgtccgtgccgtcgagggtgcctgtggagtggtgttcccgctgcagttcaagtcaaggcttagctccagttatctttcgttttttcgttgcatttatgtaagacttttatgatgtttgtaagacgtggatctgaatgtcaacattgtcgtttgtgtaccccggccggtcctagatggggattttaatgcacattctgcttggaattctattcgggaatttctgggcgtgacaaggccgcggatccggcggtggcgcacccggatccggcggcggcgcggcggccggcggtggccagagcacggaggctccccgcggctgccactggcgtcctccggcgcccctctaggcatcagctggcgttggtggagaggaagacggccggatctggctccttgcccagatccggcgcgtcctcaggtgggaacggggtggttggagtccagtcgtcgtgcaggtggtgtgaatatcgcaggtatcctcggtgtgcaggtgccatttggtggctcccgtcgtggatgctatggttgatgggtgctccgaggtgaaagtcttgctccgctctcggtgctagcaacggcgatgcccttgggcgccgttcaccttcttgaaggcgttgctactggagccctcgttcaactccacttcaagagttttctccgggtgaaaacctagattcgttaggatcggacgatgtcgccgttgtcggcgtaatcttcttgaaggcttcgttttaggaggttatctcttgttggacggctgtacttaggttcagtttgtcaatgtcggggtttttgccggttttcctttaattaaccgtgctgttgtaaggtttttaggttcggtttcccttataaactggatcaactctcttcttctatagtgaattgcaggagctccctgcctgtcccctcgaaaaaaaaactcttttagagtctcaatttgtatttcattcgggtgcctccaaaatcctaaagatggccttgatatcatttgacttgttagattttataaacttatttcaatatatataactgaatgatggaaatcctgtttcagatacacaaacatgaaatgacttttgctttttaacaagtacatcttccatttcatattatataagtagttttgattttttttccaagtcaaacatttttaagtctaataaagtttatagaaaaaatataataaaatttccaacacaaaacaaatattttataaaaaatatattcaatgatacattcaatgaaactaatttagtattgtagatgttgctaaacaattttataaatctaatgaaacctaaaatagttttaaaaaatcaaatcgactttaatatggaagagagggagtactgcagttataacacccttaaatactaatgaggaatcatttcttctaaatatggtcacatcaacatcggtgaaaagacaattgtaacacatagagcataattgagaaacgaacagaatgttgtaattgagagatttaattttacctagagaacattgaagatggaaaggtcatttgagattgcaattttacctaatcccattatctttcactttccattgtcaccaaagaagatgttgtcttgtgatgcaccttttggatcaagggaggataacattgactcttctctggtgcatccgctatcaatcacccaacttcttccaccagatttgtattcctacaagagatttctagttttagatacctagattacttgggtcctctcatgttagtaacaagtgtgttaggcacccaaatcactctctttatagaaatatttttgcccctagggccaacatacttggccacaacacaaccattagcctattataactctaaagtgcctcaccttattcaaaacaagggttctttttggtggagagatgttatctgttatgctgatgtctttaggtctattgcccaatgtttggtgtactatggtaactctgttacttactgggaagatctatggaatggaaatattagatgtcaagagtatggttctttatatgctctagccatgaataaaaccgattcagtgaaggatgttgtgtttaaggaatttgaagactgttttcaattacctctacctctttcggctaggggttaccaagattttctgatcttaaaagatgagctaaatgttttaactctaagtcattgggatggggacagctggtcttttatctggaacaattcagtttactcttcacagaagttttattccttgaactttgtaagccttttgttggcaactttttgtgacaagttgacaagtataatcgcagcacccaaagctttgcggtgatcctagagtcgccaaccacctcaatctagcaaaagctaaatcaagatgggttttgataaactaaaccggctagcggagccgatctagatagaacgatggataactacccgtctcgtgggcaaaacgggaggttttgaggacaaacctacaaagaggtgaagcactctcgcagcggcgacggacgatttacagcgcaagtcgacaaagatagacaaactaaactagaattagaagtaaaagtaaaagaacgattcgactgattgatagttggttgagagattacaattgaaccagccatgtcccttatatagaggttggtcttgccctctacaggccctcctccacgtccaactcgggatagaaaggaaacctcgaaacccgataaaacagactcgggctcggactctgccagtcagaccggccacacaccgccggtctgactggcccactgtcggcggtctgaccggccgacaaccagcggtcagaccaacccaatcagaggaaaaccgacaaacttctaaactttgtcaattttccctattttattcctatgtgccaaatttaggtgtaaacacatgcccccctggctttttgacgaacaacgtgaatctaaaagcatagagcatgttttttggtcttagggcgataatccaattaccagccatagaacctcctaagcgtcttgccaaacgctcaggaagtatttcttcgagtatttcccattgattgctcgctgaaaacgccttgaagtgtctccaaaaaatatgcgttccctcgaacaataccgcatactagataaggaccctcccaactaggatcgggtacccaaaggcaaaattgtcttccaaaccaagtctccaacttgaaacaactttgctttcacccttttgttgtatgccttggccaccctcttcttctctttctgtatctcctccaaagccttcaaacgcttgtcgatgacttcatcaaggttgtctcccatcaatgtcttgtaatcttcacttgacaaatcatcttgcctgatataacgaagagaaccaagatttacttcaaccggtaaaacgacttcttgaccataaaccaactcaaaaggagtgactttagtagcaccatgtttagatatcctatgcgcccacaatgctttagaaagcacctcatgccacttctttgggtgttcctcaatcttcttttttactagcttcaacaacgtcttattactcgactcagcttgtccattagcctgagcgtagtaaggagaagaactcaacaatttaacaccataagatttggcaaaactcttcacttccttagacataaaacaagctccttgatccgtagttaatgtttgcggaataccgaatctatggataatatgcttcaaaataaagtcaattacctccgtatgagtcatattcttgagcggcacggcttcggcccacttggtgaagtaacccgttgcaactagcacgaacctacgcccctttgatgacgaaggataaatttgaccaatgaaatcgaaagcccaacctcagaacggccatggtttgatgatagggttcaacacggtggcgggcgccaattgaacattgccgaaccgttgacaagcttcgcatcccctataatatttgaaacaatcttcaatcatccgtggacaatagaatcccgctcttctaagcaaccaattcatcttatgggccgattgatgagttccacaaattccttcatgcacctctcctatagccactttagattgatcatcatctaagcacttcaataaaactccatcaatattccggtaatctaaatcttcaagcaatgtatatttgaacgcttgccgctaaatcttccgatcaaccttaagtgcaagatctttcaaatatctaatcaaaggaattctccaatcctcttttgtttcctgggcacaaacgtccgaatttacaattaatttggcctccgtttcgaatgaatcatgcccctcagccttctgtccagaaccggtcagaccggccgtgcaaggctagtcagaccgcccagggtggccggtcagaccgccggtatacagccggtcagactgcctctggtcaccggtcagaccggccgtgcaacctggtcagatcgcccttggtctgcaattttgccaatttcgctcaaaggtttaaaataagcaccggctcttctaatataaaaaatactcccctcttcacattatagccagatgcttgctgtgcttagtcatttgctctagaattatcatgcctagcaatatgtctaatagcaaaattatcaaaattggcaataatatccgagcattgattaagatgcctatttagtgatctgtccaagaatttgtaagctccggcaacttgttacaccaccaattccgaatcaccaaacgcttccacgtgtttagctccaatcatctccatcacttgtaagacgaataataaagcattgtattcggcttgattatttgtacaataatattccaaacgaaccgatgcctcagaagacatgccattaggtgaaaaataaaactactcctatgccttgactctctttgcaagaagaaccatcaaaataaatcttccaaggtataacttcaaccaagcaaacctcttcctcataagcaatatctacatgatggtctactataaaatcaattacaatttggcctctcatagatttcaatggttcataagccaaatcatattcaatcaaagcatatgcccacttgccaattctcctacttagaattggcctttgcaacatgtgtttaataacatcggcttgacaagcaactatgcatgtactagatactctctccgtcccagaatataagaagttttagagttggacacggttattaagaaagtagatagaaatgagtggtggaaggttgtgattggatgagtagtggaggtaggtgggaaaagtgaatggtggagggttgtgattggttgggaagagaatgttggtggagaagttgttatattttgggacaaatcctgagggctaaaacttgttatattttgggacggagggagtaacaaataatgccgcaatttggtaaagcgtagtatagacataaacaaagtctcactatgaagacatacctcgcttcggtatccaaaagacggcggctcaaatatgtaatgatatattacttgccatcttcctcttgtgtcaaaacggcaccaatgactttgttttcggaggaatatataaccgaaacggcattccggctttaggcactcgcaccacgggtggagtagacaagtacttcttcaacccctcaaacgcttcttgttgttttgcccccaagtaaaattagcttcttttttcaagcgaagtataggaataaaggcatcgattttacccgctaggttagaaataaatctcatcaaataattcacctttcctagcaacttttgaacttctttcttgcatgtcggtgctttgaaatcatgaatattttctatcttcttaggatcaatctcaactcttctctcatgcaccatgaattctaacaacttccccgccgacacaacaaaagcacacttgagtgggttcatcttcaaaccataccggtgcacaatctcaaaagctaacctcaaatcggccatatgtccctccataccatccaatttgataacaatatcatcaatatagatttataagataatacctagcaaatcatggaagatcaaactcattgcccttttatatgttgcaccggcgttcttcaatccaaaagtcataaccacccactcaaataaaccaacaaatcccgggaacctaaaagttgtcttgtacatatcctcttccgccataaagatttgattgtagccggcattaccatccaaaaacctaatcaccttatgacccgatgcatcattaatcatcatgtcggctataggcataggatatttatctttcggagtagctttattcaaatctctaaagtctatacaaactctaatcttaccactccccttcttttccaccgggactatactagacacccactctacatagcgacatggcctaataaaccccgcttttaataaccgatcaatctcctccttgactcggtcatataacaaaggattgaaacgacgagatggttgtttataaggcctaaaacccggtttaattggaagccaatgctcgacaagatcatggttaagacccggcatctcatgaaacttccatgcgaagcaatcaacatactccttaagtagctcgattattttaaccttataatcggctctcatgtttttgtttacaaaagtcggccttggcttagttccatcacctatgtctacttcttccaatggatcagccgatgtaaacccttgaccaagcttttctacttcatcaaaatcttcaatagtttccccaatatcattcttttgcagccactctaaattagcttcttttctcattatacaaagtgatatggcctagccgtgctaaactaaccggctttacagagataggtacaaatttgccattggagatactaataaaatcataactagaaagattcatccccgataagcattgaatattcccatgacgccactcaaatgttgcatcggcccttgcaacttcggccgatgtatccgcttgaacaatttcaataccatcgctgtcccattgaattaaatattgatgcaaggtagaaggcacacaacaattggcatggatccaacaacgacccaaaataacattgtaattatcttgcacatcgacgataaagaaagcggttggcaacgtcttgttctctacggtaagctccaccgaaaagatatcttttgcctccgttggttcaccattgaagtcattgaaaatcatattagttttcttcaactcattatctccacgccccaacttcttgaacaacgagtacggcatcaaattcacggcggcacctccatccaccaacatcctagtgatcggcttcccatcaatatgacctttgagataaagaggcttcatatgacgatttgattcatcgggcttctcaaaaaccgcatctttaggacctagtaaaaattgagcaacctcggcttcatccatagcacaaaactccataggcaacatacacaccatgttgaccttcatatcttcctttggagatgaattatacttagcaatcgattgttctcccttctccttttgcacaacaaccgattcttcagcttctatggatttacgcctccacacctttgtacgcggtggtcgcaactcattgaaccttctatttctttgctcttcagcctccctctcttttaattcttgggcccgaagacgttgcaacctcctcttttgggtagccgtcaaatccttaggcatccaccttggtttcggctctgttccaggaggtaaataatgccctctgttgattttatttgaagacgacgaagccctcgagctaccctttgcaaatctcctatcaaaccggcgctggagtgcagtcaaaccgggcgcagacttttggtcagaccggccagaaacacctgtcagaccggcctgtggctggcggtcagaccggcttgttggcccggtcagccagagggcatggtcagaccggccgactgcgatgaactggtcccagctttggatttgttgcttgaagactctccaacttcatctccaaaaggtattagcacatcatgagaccccactttgatagtaatcacctccgaagtcctcgtctccaccttagcacgctttccttccctctttccttcattgatccgatttttagcataaaaccggctattgtttggtgaaaacaaacgctcacgagctggtctccttggtcttccccatccttggttgtattgcattggaggcatatgattgaacattggtggcgttgcccccatggcatgtagcaaggaaaagaataacccggtggcggcattggataaggcccccatgacatgtcttgagaacgatgatatgtaggtgattccgaccgtcttggtgaataaccaaatcgctccctaggaggtgatcttggtctttttcctttattgcgagctttctcaccagcttgcctctcatacttgtccaaaagcatatcgaatgtcaccttagttttcttaggagctttagaacttaaagcttcactcctattctccttccaaacaccaaccttcggattctttggcaccatcatctttggcctaggctctccaatgaccactccttttcccttagtagattcggcttgctctggcagaatcaacaccttcttatcattgaaattaattgtgttcaccgggaaagaatcatgatcaagcttcatcttgaaaccatcagtgaatttcaatcgtctgtcatctatggccgattgaacctatcgtcgaaacacattgcaatcattagtagattgagaatgagaatcatgccatttacaataagctcgacgcttcaattcttcttgagatggtatgacatggtctttaggtaatctaatttgtttttcttgcaaaagataatcaaaaatcttatcgcatttggccacatcaaagctatatttaatctcactttgccgatctttacgaggagtcggcattaaattagaacaaacaaaaggcttatttttgttagtccatgacaacttagcaacatacatatcatgatcaccctcatcatcagaatcactagtctcaaggtaatcaatcaaattaacattaggttttttctcaaatggtctaacaaatttcttactatctttaacccagcctttttgagccagagccttttgcatgagttgactaacatcaagaaattgttgtccttctaatttttctttaataagagcaattaaaccattaaaagcaaaatcaaccaaatctctatcagttatattcaagctgtaacatcggttcctaacatccctaaatctcttggcataatcaaggacatgttcattgtatttttgtctaaccaatgtcaaatcacttagcctaagttcagtctcaccagtataaaaataatcatgaaatctttgctctaattgaggccaagtatgaatggaatttgctggtaaagaagtaaaccatataaaagcagtaccggacaaagataaagaaaacaagcgcaatttaaaagtatgagaactactagcctcaccacatttgcgctaagaactgacctacatgctcccatgtggtcctactatcctcaccactaaatttggtaaattcgggaactctataaccacgaggatatgggatattgtcatagtaatcaggatacggcttttggtaaaccttagcacgattcctaacttcaatcccgaatttatccctaataataccagcaatcaattcctccatattctcaggcctatgttgatttggtggtgggtttggtggcctaataggttgtggttgtagcgcaatataattatatttgccatatctagtatcgggaggatatcccctagtaggatcattgtaaacattaggaatatgtgggggaacttggggattaacaatagatacaggggaatcatgtactggaatatggtataaaagcccgttatttgtcattgggtctaccccctgaatcaggataattgtgtcggtttgaccggtccagggcccagtctgaccggcgtccagaggcgcggttagaccagtctgaggtccggtctggccgcagggaggaaacccggtttgaccggccagtggccggtcagaccggtggcaaacgcgcggtctgaccggccatctggcccggtcggaccggttgattgcgttgcccatccctcaccggttgtttgcatactcgccccgtcggttttgctatatatttgatctacatggggtttgctagtactagtagaggctttatctttggattgaaaattggctaagaaagaaccgaatttattcctcaaaaaattatcaaaacgagattcgaaagatgcatctatcttactatttaaagcagcaatggatgaatctattgtacttgctacgtgttgttggatagggattgatacctcttcagtacttaccacattaaaattaggtttaagcaatggtccaggcttgagaaccacaccttgacaggtcctggtgcatgatctcatcagtgcctcccgcgtgatcgccttaatgtactcctccatggccttgcatgcttccccatcaagatcctccaatgagattggcatgatattggatggttccacctccgacttggttgatggcggctttgtcatggcggcgtcgaagttgagatgacattgagcaaatttccccagcggagtcgccaaaaattgtgttggcaactttttgtgacaagttcacaagcacgatcgtagcacctaaagctttgcggtgatcctagagtcgccaaaccgctttaatctagcaaaagctaaatcaagatgggttttgataaactaaaccggctagcgtagccgatctaaatagaacgatggataactactcgtctcgtgggcaaaacggaaggttttcaggacaaacctacaaagaggtatcacactctcgcagcggcggcggacgatttacagtgcaaatcgacaaagatggacaaactaaactaaaactagaagcaaaattaaaagaacgattcgattgattgatagttggttgagagattacaattgaaccggccatatcccttatataggggttggtcttgccctctacaggccctcctccacgtccaactcgggatagaatccaaaggaaacccgaaacatgccttcccgagctaggaatcctcgaaacccaacaaaacagactcgggctcggactctgccggtcaagccggccacacaccaccggtctcaccggcccactgtcggcggtttgaccggccgacaaccggcggtcagaccggcccaatcagaggaaaactggcagacttccaaactttggcaattttctctattttattcctaggtgccaaatttgggtgtaaacacctttctcccccaaggtcgttctcctggatttggaaatcagaatgtgttaacaagataagggtcttcatgtggctgttactctgtgatcgcctaaatacaggagatatgcttgacatgagaaagtgtgcaaaatagaatgatgatttaacatgtgctttgtgtggtttagggttaagagaaacgagagagcacctctttttcagctgtccctttactgaagcttgctggcataaattgggttttcattggaattacagccttgaattgaatcaaatgctatctctggcaaggtcagcttttcaaagaaatggattttttagagatcatctccatcgcctgttggcacatttggaatcagaggaatgttcttattttaagaaatattccaccttcggttcagtcttggcttaggtcttttaaggaagatgtactcctgcatttctgtaggatgaatggtccccttttaaattcagtttcttcctggttacaaactttgtaatatctgggactgtggttttctccttgtattttttttttgtatattttgattttgctttaataaattaaactactgggcggtgcctggtagtattttggacaaaaaaaacacaaccattagcattcttcctaagaacataagaagcatcaaatgaatttggagaagcacaatcattaggaatgatacttttggccctaacaaagttgctaaggccttatggcttgttaagcatcacacttttgtccaccattcccttaggtggagggacatacctaagaccttcatgagtgtagttgtccctttgatagcctaagtactccttgagagcctttctacccatgtggcacttaagaaggccattgtggaggagtctcataagcttctcatttttcttagtcaatgcactcaacgatttggagttagtagcacaagcataccctcacaccttgagcatggttcattgcttgagcaatgtaggaacaagatgcctcactagggagagagacactagtatttaaggtttcaaacttttcttcatgggagaggtaggctttgttgaagctacccgctctctcttggagatgtgagtttgccacctcaagatgagcatgagattctttggtttgcttataaagtcgtaccaaagcctcatttctctctctccttagtaagttcaaccttgaattcacgagtctgctctttctcatgaatatgcattagctcttgcttctcaagggttgcatattgttgttcaattttcccaagcaactcgctcaagtgtggcaaatgattccttggttatggacttgaacaagtcctcatccataacatcctcttccccatcactcataatatcaacactgaatgacttgagtggagaaggtaccttaggctcaaccatgagacatataggagcgttgtcatcactcgagtagttgaagagccttagtgtaggagatggtgacggcttgatggtgaaagtggccaattcctcttcatcacttgagcttgaaccggagtaatcggattcaaagatcaagccaatgtgggcatgaactttcctttcatgcttaccgtgcttgtgcctctccttcttctcacctttctaatcttccttagcgttggggcaatcggcgatgaaatgtccaggctcatgatattcatagcactttcttcacgagtgtcttccacttgacttgtcggaagacctcttggaagaactccctttgaagaagctgcttcttctcatgaactttccaaacctcttgacgaagagttccatctactcatcttccttgtccttcatgttcttgtaactttcttcctcttcttcttttgccttcaacgccaagtcttctttcttgatgcttgagattgagctttggtagatgtactgggtgacatcattggactcttgctcaagcatgtctttggcaagaatacgcccgagcatatcatgagtgttggtatttcttacgaccacagataaatccgcaagcgcacggaataccgctgtagcacttcaccttcgggtgaccccaaaaagatatcgaactcagggaacgtgtgtaatctacctaaggctaagactatctaaggacaacaactgatggtaggcaggctagagaggactttctatgcgtcttaattatctaggctaagcaaaggtaatttcctatctattgcttcgggcaccgacgcttgctggtctgccagcgtggttccggctatagctctatgatgtatccgaacgtggaggattactgggacagaattcagggctgtcaccacctgccgcctacctctgacaaatccgtgggatagacaacaaacaaaggtaatctctaacctagacaccacgtctaagttattaattactactctaatactcgtacaggaacttccttctctatccaaagtcctagtactagagcacttagtatgaatactaagcaatgaacccgcaaagatggaaacctatcttacttagacaaagtaattaaataacataagaaaggaacacgaatgcttactttatagaagaagttctccgaacccagagcaaagtgtaccgacaactccggtactcctccagaattccccctatgaagctacactcgttgaggtagaagtcggatgagcgccaaacttccggacactcctacagagcttctcctcactctctaccttattctaatgtacaaatgatacaatagagcctcttgtaattcagctcaaagttgtgtgacttggaaatgagaaggtgacctccttatataggctccaaatgacggttaggggcatgggaaatgaccaaaacaccctgcaaccgtctctaggaaggaatccaaaccgtccacgtggaagcagatggttgcttcggctgaacccaaaaacactcctcccggcctctccttcggccgggaggttgcttaatgggtccccaacaacctaggctatgttttgtcctaattttaaatggtttttattaacttattgggcctccaatccatgtaaacgcgtcctgaatgcgcggaggtgcattttgtgacatgacggatgtgttttctcctcaaattacctacatacacatatttcaccaacactagtggaaatgattagtaataatccctaccactaagttggataccatgttttatttcattatatgtaggtattgactgttaaatattatgatttaaggaccgtcaacaatgaggcgtgagattcttgtagtctggactctcacgtatgattgtcaccaaggtagagttccttggtgtgatggctcggatcattttcttgaccacaacttcatccatcatatctcatctagcatgacaaaacctctcgacttatcccttcaagatctccaccttggactcgcggacactatccatggcttcatgaacattctgaagtgtgtaccatatctctttggtactctctatgccatccactcggttgaactcactaccgctcaaggtgctaaatatggcattagcggcttgagcgttcttgtgttggttcacgtcgtcctctttggtgggatcattgggattctgtaaaatatagtcattttcgactattctccaaatagaaggtcaatagatttcaagtgcatctacatcttatgtttccaagaggcacaatccgtaccattgaagtacggagctttgccactataggtactcacatatgtagatgtagaggagtagtcaaatggaatttcggttccgtttttggaaacctccttttggtccccccttttggcccgacatgatctcttcaagaagttaaccctaataaggagattaggctctaatactaattcaaagggtcacttagcctagagggcgtgaataggctaaataaaatgaaaaccggaagctaaaacttaaaatatgtcggatagtctgatccaaggtcggacagtctagtgcaaatcagattgtttgaagagggatcagactatttgactagcaggggaacgctacaacaacctatagatctaccacacaaacaagagtataagcacaaccagcaactaagttatagcggcacaacaaagcaattagtagaggaagaaggagaatgaatatcatcgggatttcatgctgaagtatttcccggagttcaaattttttagggtattctactctccgttcagaggctcaaaaagagccgagtcttttccaaccctttttctcttgaggttgcacaaatgcacacctccttccactagaggtatctcttttcttgcgggggcgagatccgacctttacaaacttctcttggctgaccacgagtagatcggtggctcgagagcgacgcctagccatctaggagtcatcaacctccaagagtaacaaacacgacacaactcttggacaaaccctagtgctcaagatcgagtgaaatacacactaagcccccacacaccaaatccacaaccaccaagatccaccacacaaagaacgaggagggatttaaaacagggagaaagagctcaaagatccaaagcactttagtaccaagctcaacccaaagtgaatgagttgggtagccctagaatagggttaggtggcaaattactctcaaaattcatcacgcaagaaccaatatgcaaacaaattgagtaaatcatagggcagacatacagcttataggcaggattgtaaaaaacaaacaaacaaacaaacaaacacacacacatccatccatgagagagctagaggggttcatttgcataaagctagcatttaaaagcagtagttgaaagcagtaaaacagttgtagtaattaatcaatattatccaatcactgctcaacgctacaccacgttgagacagacccaatctaccacctgaactaaccagttccattaagctaaactagtaatgatactaatcacggtaaatcaggttgaccgcccataaccgcgggcacggctattcggatagttttagtctgatcagaggtgtacaactgtacccacaagacacaaccccatgccacgtttccgtgcgctgacatgccaccatgacatcgaaaagaggccgtgacaggaccctatgcataaccccctctaac

SEQ ID NO: 29566 - DNA, 1574 bp, Oryza sativa
tatggctgagaacagtaggtaaatatcccatacagtatcattataaaacaatgcataatttaaaggaaacatagggcatttgcaatatgggatcaatatgttcaagtgacaagcatgacttgccttgctctgcagctagagggacctcagcgactatttcaaagtacaccggagcgtcgggagagccgaattctatgcgacatacaaggcaaacaatgcaaacaggctataaggctactgaaacagagaacaaaaccatttttaatgaattctgcatttttgttgatttactgagacttgaatgggcttaaatggagcaaggataaattttctatggaattttagaagattcactgtgttttattactataacagaaaaaccctaaatgaattattgcgcattaaatagccctgaatgatgtcattggagagaaaggaggcggcacccacaggcgggccccacatgtcattggctcagggtgcgccggtccacggtagacaaagtccacgggaccagggaagggtggcgcaccacgtggtgcacacgtggcgctgacatggtggccacatgggctgccacgcgggcggcagatgggcggccgcagctcgcgcccaggcgctcacgggcacagctcaagccggcccggcggccatggcgatgcggcggcgcggcatgaagcagcggcagcgcggggtcggccaccggcggagagcggcggcgatgcggcgacgtggagtggtgctaagagagggagacatcggtcctcatcgaggggttcgccagtgcggaagaaggcgatgacaggcgacgggatgtcgactagggatggcaatttcccctgcggggccgggtcccatgcggggacccgaccctaagggggcggggacgggttcagtttttgacccgcgggagaggcgggactggggccccgcatttttgcggggaggggacggggaggcatttcacccgcggggccctgggggtgtatattaaacctcaaaatgtagcccatagaagatccaaaagagcccaacccaacaaaattcttagatataaaattaaaatcctagcattatctctccatctcccctctcgtcaccctctcggctcaccacataggtagaggcggcggcggcgccatcgcgccaggggcaagggcgcggttgagctggcaaggacgagggcgcggttgagtaggcaagggcagcggcgtcgacggccagggcgtgggcgtgggcggcggcatcgatgaccaggcacgggcggcggcggctgccagggcgcgggcggcggctgcggccagagcgcgggcagcagcatcgacgaccaggcacgggtggcagcggcggccagggcgcgggcggcggtgtcgacggccaagcacggcgacggcggcagtagccatctgcgggccgtggcggcttgcctcgtcgtcttccagctcgccttcctcgtcgccgtacagctcgccgtcctcgtcgccgtcgtccagctcgtccaccggcatagccgggtagtgcggggccccgctcacccgccgggtcccctacagaaacgggggtcggggggagaa

SEQ ID NO: 29567 - DNA, 683 bp, Oryza sativa
atttaccgagaaagcaatatctggcctcgtactatttgcaaggtacataagtgcaccaatagcactaagatatggaaaatctggtccaagcacatcctcaccataggggttttggaaggatatgacttgtccatattaaatttctacaaaattttctaggtatatgcaccttggtgcacaaggattccagaagataaatgctcaagttgtagacctaagcaaaatttggtttgacccaaatccttcatctcaaattccgtctttaaatgatgacgtgcttcattaatatcttgtgtattgccaataatgttgagatcatcgacatataccgagataatacaaaatcctgtggggtctttttgataatgacgcacgggcaatcatcatttttagtgtatccctttagtgaaaggaattcacttaatcggttgtaccacatcctgaccgattgttttaagccataaagtcacttctgcaacttaacacaatacatgttacgatttaccttctgattcgggatgtcgatgccgtcaggaaccttcatgtaaatatcagaatcaagtgacccataaagatatgcagtcactacgtccatcaactgcataaatagacgattttgtactgccagtgatattcaatatcggaaagttataccactcataactggagagtaagtttcgttg

SEQ ID NO: 29568 - DNA, 672 bp, Oryza sativa
ctccttcaccactttcgctgccgtttccaccgccgcctctctcatctaccgccgattccattttcgccgccaccatctccccctgttacaccaccgccggtgcctccatttctgccgcccccaccgccacagcagccgaagtccccgtcgtccgccggcgagactaagccgacggccccctctcctcatcggagtaagagaccagtcgggttcggacgctgttcccccccccccccactccgttcgggagcgtgcagctcgaggagccacatgaacggcgcggaaagtagcggggaggctgagcggcgaacgggaaacggtgccggcggcgactctatctccagtgggagggagcactgctcgccggggggcgtcaccgctgtccatccatggagcctggacctggacgcaacggggcaccggtgcactcgtggcgggcgcttgtggtggtggagtcggaggtgtggcagcgacggcaaatgcggcgccggggatggtggcggtggccaccaaccctagaatggcgcccagcatggcgatggtggtgactccatcgaatcgacggaggaggtggcgaaggcgatgaatgcggtctcggcgatggaggccgagaacggcatcgaggatgaaatcaaggtagacgtacttacgcgatttcgggctgcaggaatt

SEQ ID NO: 29569 - DNA, 4272 bp, Oryza sativa
  unsure (1)..(4272): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatgactgtcatgagaagtcacaccacagtacccagaaggaacagaagatctaaactatttagaaagtctacatcgacattgttcaatcaaacattcagaggcatgcatcatggtaaacagtgtccaaagttacactaaagcattcagacacaagaaagaagaagtaacctatttggtccataaagtaagaaaaattgtgaaacggctttcattttccttagggaaaagtagatgattacctgccagaaagagaagaagacaatccctttgatgcataagaattttgcaagaggtttgtgaggtgccagctcttttgcaaacaagtggtagaaaataaccagtgcgtataatgccatggagactgaaaagttcagtatgattgtgaatgtccagctgacccaactggggtacagaccaagaagctgaagagtaatcattagaatggcgcatatgggcctaacaacaacaaattgccaggtccagtacttcagaagcttcagtgttttatgctccaatcgaacattgcggggctgccatagcaaaacatcacaaatatattaattcctttttgaacagatagaagtgaagcaagtaatagaacaccctaaagtctaactacaaacttaagttctgaaagaataaacttccagattgtgcagattatatgtgcaagatagaacactaaaagggagaatgggagatgcaaagacaggttcttaggacaacatcgactcaaactataaactgaagtgctgaaagctccagactacctctgcagattgtaggtgaataataaaaatgtagaagggtgatgcacagacagatttttaagtcatcgctttaggtgcatgcatacaggagaatttggtaagagaaagattaaaactgctgttgatattatagtaaaaaattaccactcatggtaacttggtttaattaatccagattccagacaatgctatataaggaagcaatgaaatagaaatttaaaattcaagtacaaaaaggtgatccatggtatgggataaaatgccagtaaaagagaagcagggaaggtattatgctaagtcatcaaaacttaatcaatatatagtgctatgtaaagaagtaatcaaacagaaatcttagcactcaagcacaattacagattatagaaacatttaaagaatgaaccagggtataaggattaaggaaattaccaggaaaagggaaacagggaaggaatgatgaagcaccctccctttgatctcatcaggaactatgttcttactaatagatatattcaaatagctgtacatcagtgccataaacttagcaatagcctacatagtgaaacaaagagagaaggttagtgaatctcggcattgggtgcaagaatgtggttaacccaaaaggactcaccagtgcctcgtagcattctttgacagcatccaagaaagtgaaaaatgttttgcttcccttgatatccagaagaccaacaaaggaatttatagcatataagggagccatgagaacgataataagtatagccttctgctccttgggattcttccaatagaaaagatgctgcgacaccaactgtactgtaaaatgcatcgatagcattacacagcaggctgctccaaggagggtaagagtaggagcatccattttcgtaagatccatcccagggaacagtgacatcgacatggcgcctgtagatagatatattcaagtttattcaccaggaggaaggaacatatattttgagataacaattggtcaaaaacaggtcacataagaaaacaaaagcaccaacaaaatgaaattagaaagtatgtattaccataatcaagattttcatggaattgttttaatacaacttgcattttggtttcaaaatttaagctgctttagatattggtgtttctgtgattaaattggttagtcattagcgaatggatatctgaagcagatgccagaaaactcaaacaatatttagcagattttacctacgaaagggaatccaaatatgcctcagctttctacataaacataggttggttgcagcactatcaagccaagtgatgacacgtaggtggacaaactgtttgttcattagtactgaaatggcataacagaactaacctaacagggaaatgtaattaataaccttccatgaaattgtatgctttccattgttcaaagggatccaaacaattgacaaaggaacagcagacatttcacagcctgaggcactacttcgcggtacagagtacagtgttatacactaactagaccctttgaggcctcctatcgcaaacatttgaaagacataggaataggcaaaatttggatggagcaatggagaaaaacaggaattcacggggaaaatcttgggcttcctgtaacaaagctttgcgtattagtactattagttaagtataaagtacattcatcagctagacatcataaccattacttccatcctacttgctctctccaatccgtctccattcagatccacccaaccatggatgtccatcgggctaaggcctacgggtagcggctgcggcgtgtactccaagagcaatagaggagcaacctaaggattccccggcggggtacggagtcctacggacgccatccgcgccgccgattaaaccgcccccctcccaaaacccatctacggggtcggagatctacacggactcgctcgtcgccgtcgctgtcgccggagagaagaggaggaggcgagggggggggggtctctcacctgtgagttggagggcttcgccgccgtcgaggccccttgctctgacttgtcctcctccctcggttcctcctcccggggtgtgcacagagagagagagagagttcctcgcgacccgcgtgagaaagcgagagaaaatttattttccacgtatacgggtgactgacaagcgagcctcactgcctcaggcagaaattaatttttgcagacttgttttccagaaggtagaacagatcgccgacgtcggcgctatcccacgtgttgcacgtcctcttgcctccgcgttttcaatgatttcatcatcccggttcaaggaaaatactcctccgtattaaagtaagttcgttattcaatatcacacatgacacatattaatgcagcataaaaagataatagaatatttccattttatcaaatctcaatatagtttttttccattttatacttcaatatatttattctctacttttatactcctttcatccaaaaatctaagacctattttttttaaattacacagtacaacgcaaacactcacaacgcacgcgcactcacccctatgaacacacgcacataaaccctacccttatgagcatcttcgaagactgggtcggcaaattctggagagattgacgaagtcaccacaggcgcctcgctggcgacgtaccctatgaactcaagcatgcaaaccctacccccacaggcgcctcgctggccaccctacccctatgagcatctttgaagactgggtcggcaaattctggcgacgtaccctatgaactcaagcatgcaaaccctacccccacaggcgcctcgctggccaccctacccctatgagcatctttgaagactgggtcggcaaattctggagagattgacgaagtcaccacaggcgcctcgctgtcgacgggtacgtcgcctaccactgaaagcacaaacgccattaaatcctggaaaattcgctcctatggggagtcgaacccaggacctcaggtaccactgtggttcttgtaaccattaggctaaaggccctttcgcatctgtcggtgacatgggaccgggggtatcttgactagaggtttggggcagctgcagtcacccacgtggcctgaccccctcgggggggtcaggcccgagggtgatgtggccgcccctccctctgtcttccc

SEQ ID NO: 29570 - DNA, 32672 bp, Oryza sativa
gttgtgatttaacttccaggcgaaggtgcaagccaagttttggtcaagatagggtaggtccccacccaaaagaaaagtaggtagaagtggtgcatgtggtatccccttgagatataaaaggaggaccttgcccaccaaaaaggaggaggaaagaaaaaaagaagaaaaaaggaggctagaggggttctggagcctgaactctctggctctccggctctctgtaactccttcacacacagatccaccagaacacaggagtagggtattacgcttctcagcggcccgaacctgtctacatcgcccgtgtctcgtgcacttgctctctcacgaacattctccagatcgatcgagggcgaagaacctcacttagcgcccccggccgaaccggcaaaggggggcctgcgcggtctcccggtgaggagctccacgctccgtcatctggcgcgccaggtagggggcgcgtgtgtctttctaagccctcgtcctctttcgtgtgcgccaagcttctcctgctcagccccatggccgaacgggcagtggcgcacaatctctctccgagcgctagcggtgacgacggggagcagaacccgcgccgtcgagctcgtactccactgtccccctctcgccgaagtcttgggcgggaggaggcgctcgaggaggtcgaaagatccgcgacttcgccgcacgcgggcgatggagaaggacggcgagacggggagcgtcgtctcctcgtctacggtgatggcagcacgccccagggcgcgctccaggctgcgggcgcgctcctgcgtcacccgcccgtcatccctgatccagagactccaacccgacgttggctagatgacgtggccaatttggtcatgacggcgcagcagcgcctacgcgccggctggcggtcctccgccaccaaggccactggcgttgctactgctggctccgtgtcgtcgaggcggagggcgcggcgagcggcggccgctacccgccgttcgtccgccattccctcgtcaacgcctccaacccaagaagatgtgcgtagggggccagatgcctgcttcaatatcgagcgccggcgcaatgatcgccgtgctgcccacgcatcggagggcgcttcctcgtccggagcgccacttcggtccgggcacgggggccagccccccatgtccccggttggcggtgccggctgtcgagcctttgtggcgagccttcggaacgtccgttggcccccaaggttccggcccaccatcaccgaaaaatacgacggaagcgtcaaccccgccgagtttctccagatctacacgactgggatcgaggccgccgggggtgacgacagggtcatggcgaatttcttccccatggccctgaaaggacaggcgcggggttggctaatgaacttgccacccgcgtcggtccactcttgggaggatttgtgccagcagttcaccatgaacttccaaggcacatatccgcgcccaagtgaagaagcggacttgcacgcggtacagcgaggggacgatgagtctcttcgctcgtacattcagcggttttgtcaagtccgcaacaccataccgtgcatccctgcacacgcggtgatctacgcgttcagggggggtgtgcggcacaaccgcatgctcgagaagatcgcctccaaggagccccagaccaccgcggagctttttcagctcgcggaccgtgtggctcgcaaggaggaggcctggacctggaactcctccggttccggtgtggcagctccggccgcccccgggcccgctgctcggtcagggtggcgggacaggaggaggaagaagaggtcggcccattccgacgacgagggtcacgtcctcgccgtcgagggcgcttcgtgggccacccgaaaggggaggcctgcgagcgacaaaaagaaggaggccggcgctcccagtagggagcgcccgaccggcaggtggtgcaccgtgcacaatacctccctccacgacctcgtggactgccgcgcggtcaaaagtttggctgagcggacgaggaagtgggaggaggagaggaggcaggagcgccgtgagggcaataccccggcggctcccgccggcaaccggcgtggtgaggccaagcagaaggcccccgccgaggacatcaacgatgccgacgatgacctagggttccaggagcctgaggccaccgtcgccaccgttgatgggggagcgtgtgctcacgcttctcaccggagcctcaaggccatgaagcgagagcttctggccgtggcccctacccatgaggcgacgcggcgggcacggtggtcggaggttgccctcaccttcgaccagaccgaccacccaccgtgcgttgcccggggaggacagatcgcgatggtggtttctcccaccgtttgcaatgtgaagttggggcgtgtcctcattgacgggggtgcagccctcaacatcctttcccccgctgcctttgacgccatcaaggccccggggatggtgctccggccgtcccagccgatcatcggtgtgacgccggggcacacttggccgctaggccatatcgacctcccggtcaccttcggtggttccgccaacttccgcacggagcgggtgaacttcgatgtggcggacctcagtctgccctacaacgcggtcctggggaggcccgcgttggtgaagttcatggtggcggtacactacgcctatctccagatgaagatgccgggccccggtggccccatcaccgtccatggcgacctcaaagtcgcgcttgcttgcatggagcagcgcgcggaccacctcgccgcggcatccaagcccgcgggtggcgacgagaggctcagcacctccgtcccagccgccccgaggcagcggatgatcacgtgcgacgaggtcccgatcaagcaggttgccctgggcgacggcccgtccaagaccacacgaatcggtggtcttctggacgacaaataggaagacgcgctcgtctccttcctgcgggcaaacgccgacgtcttcgcctggagaccggcggacatgcccggggtccccagggaggtgattgagcaccgtctcgccgtacggccgggcgcaaggccggtccggcagaaagtgcggcggcaggcccaggaacgtcaagccttcatccgcgaggaggtggcgcgacttctggagaccggattcatccgagaggtcatccatccggagtggctggcgaacccggtcgtcgttcccaaggcgaacggcaagcttcggatgtgcatcgactacaccgaccttaacaaggcatgtcctaaggacccttaccccctgccacgcatagatcagattgtcgactccaccgcggggtgcgaccttttgtgttttctagatgcatactctggttatcatcagattcgcatggctagggaggatgaggaaaaaactgcattcattacccccataggaacttattgttatacgacaatgcctttcgggttaaacaatgcaggtcctacttttcaacgtactactcgaatttctttgggtagccaaataggacgtaatgttgaggcctatgttgatgacttggttgtgaaaacacgcaaccaggagaccttactctcagatctagcggaaactttcgaaagtctccgcaccgcccgcataaagctgaaccccgacaagtgcgtgttcggcgtgcctgcgggcaagcttctcgggttcttgatctctgcccgaggcattgaggccaaccccgagaagatatgagctatagagcggatgcgcccccccagcaagcttagggatgtgcaatgcgtcactggctgtatggccgccctaagtcggttcatatcgaggctgggagagaaggcgctacccctatttaagctcctcaaacgcttcgggccgtttatctggacggaggaggctgaacgggccctcactcagttgaaggcgtacctcagttctcccccagtcctggtcgccccggagccagaggagccgttgctactctacctggcggcaactccgcaggtggtcagcgcagcgttggtcgtggagcgcgacgaggacgaccctcgctccgcgcatccccaccctgtgtcgactcgacccgggagagagcagggaggagaggcccccgagccgaacggtggcccgaggcccccaacgaccggaactggccctctgcccgcttgtccgacgtgccaggcgcccccgaccccaggatggccccaaggccactgcgggaaggccgcgcctgtcgccctctgaccccgaggtcgtcggcacagaagccgagtgcgccccgcgcggcctctcggacaaagagcaccctgtatcgactcgacccgggagagagcagggaggagaggcccccgagccgaacggcggcccgaggcccccgacgaccggagctggccctctgcccgcttgtccgacggtgccaggagcccccgacccccaggatggccccggggccactgcgggaaggccgcgcctgtcgccttccgaccccgaggtcgtcgacacagaagccgagtgcgccccgcgcggcctctcggacgaaaagcgccctggagatgcggcccctggcgaagaggatcggccccgacaaaaggtgcagcggcccgtctactttgttagtgaggccctccgggacgccaagacccaataccctcaggcccagaagatgctttacgctgcgccattatttccaggcgcatcgggtcacggtggttacgtcctaccccctcggccaaatcttgcataaccgagagggtactggacgggtggtgaaatgggcaatcgaactctctgagttcgatttgcactttgaaccacgccacgcgatcaagagccaggccctcgccgactttgtggcagagtggacaccggctcccgagcccgtctccatccccgaggtcagctcgggcccttcgcagctgcctcacaccgcctattgggtgatgcaattcgacggctccctatctcttcagggcgccggtgcgggggttacgttgacctcgccgagcggagatgtccttaaatacctggtccacctcgactttcgggcaaccaacaatatggcagagtacgagggactccttgcgggactcagagtggcggttggactggggatccgccgcctcctggtgttaggcgactctcagttggtcgttaaccaggtctccaaggagtaccagtgctctgacccgcagatggatgcttacgtgcgccaggtgcggcgtatggagcgccattttaacgggatagagcttcggcacgtgcccagacgggataacgcggtcgccgacgaactctcaaggctcgcttcctcgcgagcccagaccccaccgggcgcctttgaagaaaggcttgcccagccgtcggcgcgacccgaccccctaggggagacagacacgcctgaacggcccccgaggcccgtcggagtccaggcctcgggacccgaggggagcgctcccagctcccttagattgattgcttggatcgctgagatccaggcgtacctcgcagataagactctacccgaggaccgcgaagggagtgaacgcgtccagcgcatctccaagcactacgtgctggtggaagggaccctctatcggcacgcggctaacggagtcatcctgaagtgcattcctcgggaacaaggcatcgagcttcttgccgatatccatgaaggcgagtgcggagcccactctgcctcacgcaccttggttggcaaggcctttcgtcagggtttctattggccgacggctcgcaacgatgcggtcgacctggtccggcggtgcagggcgtgccagatccacgccaagcaaacccatcagccggcctaggccctgcagaccatacctctttcatggccgtttgctgtctgggggctcgatatcctgggtccgtttagacgggccccgggcgggttcgagtatctgtatgtcgctatcgacaagttcactaagtggcccgaggcttatccggtcatcaagatcaataagcactccgcacttaaattcatcaggggtatcactgctcggtttggggtgcctaaccgtatcattacggataacggcacccagttcactagtgagctcttcggtgactactgcgaagacatgggcattaagctttgcttcgcctctcccgcccaccccagaagcaatggccaagtggagcgtgccaacgcagaaatcctcaagggcctcaaaaccaagaccttcaacatcctcaagaagcacggcgactcgtggatcgaggagctgccagcggtgctctgggcgaaccaaaccacgccaagccgagcaaccggggaaacgcctttcttcctcgtctacggcgcggaggcggttctcccatctgagctcaccctgaggtcccctcgggccaccatgtactgcgaggctgatcaagatcagcttcgcagagatgaccttgactacttggaagaacgaaggcggcgcgcggcccttcgagccgcgcgctaccagcagagcctacggcgctaccatcagcgtcacgtccgggcccgatcactctgtgtagacgacctcgtcctacgccgcgtccaaacgcgtgctggactgagcaagctctcaccaatgtgggagggtccgtatcgagtgatcggcgtcccccggccgggctccgttcggctggccacgggcgacggcacagagctgcctaacccgtggaacatcgaacaccttcgtcgtttctacccctagtgggggtcgggtgtcaggtctcgggctcgggccaaccccgcaccccctcgggcgtgcagggttggccgggggctaccacatatgcatatacttatcttttttctcttccgtatttcaataaaagctttttcgatttcctaaggactgtgtctgtgccattgtttccttttgaagagttttggcttgaattagcacgctcgtgctcgaccctgccctcggtggcccgggccggcggaaatcgccaaacggggcccagaaccgagccgtgccccggggagtggtgaactccgggggggaatcggcaaaggcccacaatcgggtccccataaccctcagtcaccacgctcccggcctggctagtctcgacacgtgcatctccccaggcactagccccgacccgcgccgtttgaggctgggacctgggcacgagcccttgttcaagccaagacacagaaggaccgcggcacagaccatcctcgtctcatacacacaacaaataaaattgacacagaaatttcttctttatttgattgcagattaaattagtttatacaagaagggggcccgaaggcctcggaagaagaaaggaaaaactatttaagattggcgggggcctgggggctcacttcgaggctcccgggtcgccggcctcgtggtcgctgtcgtccacaccaccgtcgccgccctcctcgtcggagtcgagggcgaacgcgagccgaggggccgtaccctcgaagctgtggacgatgtggtcggcggcgtcccggacctacgcgcgcgcgtcgtcctcggttccgggagggaactcgtccagcgctgcccacggggagaagtccgggtccctggcctggtagcttgccagtacaagctccactaccccccgggcgaggtctctcgaggatgacttgatcgtctcctcgagctcctcggggagccgctggagagtcccggccatctctgagaggcgctgggcgaggccccccctggttggcggcgtacttcgcggtccgctcgccccagaggcccgcttgccgcccggcgcggtctagacgggagacggcgtcccgaagcatgccgggccctacctcgcccgccaagcggagggcctcgacctccccggcggacgagtccagcgcgccctgcagatcggcgatggtgtgttcggcagctgtgaggcgggcggctagatcgccgtcgcccgcggccgccccgccgctgcgcgccctcgcgtccagctccttcgcccgcgcctcgagctcagcggcccgctgatccagtgcggccctctcggcgcgggcgccttccagattacggcgcgcctgctcctcccgcgctgcctcgtggagggacaggctgtccgccagccgctgcgccgcggcctcggcctcctcgagagctcgctcccgctcggtgagcgcgtcctcgcggaggcggagtgcggactcctcttcggcgcaggcggcctcgtgcgccgccagcgttgcctcccggatagcgatggcggtctcgcggtccgccaggtccctctccctcgcgcgggcgcgctcttccagcgccgtggcgcgagcctcaagggccacttcgcgccgccgggacgccgcctcgttctccgtcgcccgccgttcccgtgcagtggcggcgtcaaggactccccgggcggcgtcgagtttcttctctagctccgccacccggctcccgtattgaaggcggagatcgtcccgcgcctcgttgagcacggcggtggcgatgagggcagtctcccgctcctcctccacctccctggcgatctccgccagctcccaccgacgggcctcgagctctgaggcgtgccggcggtatgccttgcggcccgcctccaccatggcctccaccgagcgccgcccctcttcgacgcgcgcccacgccgcgtcgagttccgcccgctctgcttgcaggacctccatctaggcacctaacccgtccagcaccgtcgtgttcgcggcagccagggcctgcaggaggggctctgtgttcagtggagcggcggaaggcagaggggagagccgcctcggtgtgggcgctgtgcggctcggcccgccaattgacgtgccggactcaggggcgtcccccgaggctggctcgtcccgaacgtcgcccgaagggtcgggtccgagcggtgcgcccgcggcctcgtcgtgggtggcctcggaagtcgtcgtcgcctcgggcggagtcgggtcgggggcttggcaggccgcctggcgtgcgcgcgtcgcctctgcctcccgggctgacttcccggcccggtggagtctggcctcctcccgagtggcctcctcagcctggcgaacccggacggcttcctgggcagcctcctcagcttctcggaggcggtccgcggcttctcgccggacagcttcccgcctccgggcctccgcggtcgctgtctcctcggcctcagaccggccggacatggaatggcgagggggacgcgacggaatctcgctgaaagcggaagaaaaaccagaagacaaaaagaaacgggtaagtgaaaactcgccttgggagaatgaatacggccgcagtgggcgcggggacgaacctgcgaggaggtcggctaaacgaccaccttgggggggagatgaggtttccccggcatggttcggtccccccccatcttgcggagccgcttcttttttcgctccccctcgggctgcgacgtcggcacagcaccctccgggcgcctgctgctggcacgcaccgccccgccccctcggggaggagatggggagggggtatcctcctgtttcctcttcccccgggcgtcggcagggcggctgccccccgggcccccgtcacggggcccagaagcacgaccccctcccggggtagattgttcccccctgcggctcccgcccgcgccatcgtggcctcgaggagcccgctcccctgacgccccgaccgcttgcatgatggtcaggatgttggcgcgctctggatcgctgcagagggagaggacaccttgggggatgagggatgcctccacggagctgagattcagcacccgttggaccaccatcttgaaatcctcaggggcccagtcccatctgcccccctggtgggtcctcatgtagtcctcggacccggtgtactcccaggcgccccgggcgcgccgctggagtggcgcgatccggcgacgaaggtagtcgccgaacaccatggcccccgtgagcccctgggatcgcagacccgccaggcggtcaagaacggcgtcgtagccatctcccagatctaccggcgcccgccagctggaggcctgcgccgggggctggctcggaagtcggaggtgcgcttcgtcggcgagaggggtgtagaaccagtcgctcttccagtcgtcccacttcttgcgaaggacgcagggaatgtagcggttcagcactggcccccgcagctgaaagtagcagccaccgactaccgacggtggcaacaccggctgtacggtgaagaaccaccggaacagccgaagagatgggcgcaccctgatgaacatctcgcataggtgcgcgaagatggccaacgtcattaccgcgttgggggtgaggtgcgccatctggagatcataaagctccagaacatccatgaagaaagaagagaatggcgggaccagccctgccattacgaaagagaggaagaagacggaccgccccgggtaatgcggcgccgggcgtccctcgcccagcgcgaccacctcccggccggtggcagattccggcatgaatcggcgcggcagcccggcctgcctctcgctcacgatgcgggaaggcggcagcacgctaccctcgagcggtgcggagccccgtgccatgacgccggcggaggaggagcttgagagcgagcgagtatggcaagggtagggcgccggaaatggagagtcagagcacaagtggcaaaggcaaagggaagagtgacgagaggaaggaaacaaatcccttccttgatgtcttagtacccttgccaacgctatgcccggctcctcgatccccgcgcccactacctcgccccctcgtctttcgcgcccacgcctccactaatcccgctcgcccgtttgcggcgcacgaggcggatgtgcggccgtggcagtcgagatgggacatatcgtgcgcgcgttaactacgctcgccgaccgatgcaccgtcatcacatctccaggcgaaacgaactggctcgtcccggttcgcgcgctacttaagtaatgtagcggtcttaaagaaagccgctcattattgtcggtcggtttttccttgccgatgtgcgcgatttgcgaccgctgggtttctgctgcctgtagagaccggccccatctgtcaccaggtctaaggagtggcgtcacgcccgagcgcttccctcgaggggggcgatcgccctggcgtaacgccgggggctactgtcggtgacatgggaccgggggtatcttgactagaggtttggggcagctgcagtcacccacgtggcctgaccccctcggggggggggtcgggcccgagggtgatgtggccgcccctccctctgtctccccgaggggtcgggccgctcccgtttcggccccgagagctggggcgccccgacccctatgggtttggcgccacgtgtgtgggttaggtgagcacagcggcgctcacctaaccgcgtttattgcgggttggacgagcgccccacgccgcatttaatgcagcgtagcacactcgttcggtccgtgacaggtcacagtgtgtgaccggtcacagaccggtcagatcgcgggttaggtggcaacaggcggcctgacacacgcctcgccccgtcccgtcggaatgatgagagcctccaggcactcgtccctagccggagccggcgtgggaactcctggagttggcacgtcagccccggccagatacattccaggcttcatcgcaaccattgcaaggaagtcattgtatgaagaagggcagacgtgtagcatgctaaactgacacgtggtggacaagaatgaccggtctgtgactggtctgacgccggtcgcgtcatcggcagacaaccgtgctcccacgatgcatctgcttccggtggagtggaggtaggtatgacccatctcgtcggatggtcatttggaaagcagccatggcaaatctccgcccattaataagggagtaacagggagatccccggtgtcaggcgagtgacggcgctgagcctcactcaaggacaagttgtgatttaacttccaggcgaaggtgcaagctaagttttggtcaagatagggtaggtccccacccaaaagaaaagtaggtagaagtggtgcatgtggtatccccttgagatataaaaggaggaccttgcccaccaaaaaggaggaggaaagaaaaaaagaagaaaaaaggaggctagaggggttctggagcctgaactctctggctctccggctctctgtaactccttcacacacagatccaccagaacacaggagtagggtattacgcttctcagcagcccgaacctgtctacatcgcccgtgtctcgtgcacttgctctctcgcgaacattctccagatcgatcgagggcgaagaacctcacttagcgcccccggccgaaccggcaaaggggggcctgcgcggtctcccggtgaggagctccacgctccgtcagggatgataaggtttagtccttcaaagttttaagacaattagatagctatttaataaattttaagtaaaatcatattaaaaaaatatatgattttgtttgggtgctacccgcgcaattgcgcgggtcacccagttagttatgattatattttcaacatttgcactattaagggcccctttgaatcgtaggaataaaaaaacggaggaataggaaaaacataggattctgacaggaatgtaagtgtaaaacagaggattacaaaacacaggaatgatcgtttgattggaccacaggaaaaacacaggaatcggatgagagagatagactcaaaggatttttaccaagagattggacctcttgctaagtttcctctaaaacctatatgcaacaagccattccataggaattttgtaggatttggaaaatttcaatcctttgaatcaaagggctacgtggaaaaatttcctatagtatttcaaccctataaaattcctttataattcctttgattcaaaggggcccttatcattgttaaaatactgtatttttttcctatttctcagttttttttcatcaaacccttatctcgcgtgaaaatgccacatcgaagcctccatttctttcttctccctattgagacgccacacctttcttcctctctcttttttttcaagtatttatttttcacactccttttgtactctccgacctcgcggttttaaataggcgaggtaaaggaggaagagtaggaggaggaatccagcgggtcgggtctcgtgtatcgcgccgcctcgcttccttccggccgcggctcgtcacgcttctcggcctcctccgggaggtgcgtgtgctgctgctccactgctcttcttctctgcttggattcatgtcctgttcgtgtggactctgccttcgcttctcccatttcttggtgattaatttgtagtggaggggagcgtgttctgggatttttggttttcttgatgaaatctttcgggttgatttgggtggtttttgaggtgaaaacgatatgcaatgcttgttcttggattggcccagtacgagctaatccatctgatggttgttttctgttcattctccatggatggcaggtaggatggtttctttcttttttttttctttctgtttttgtttcttctctgattagatgtggatgcattgggtgaaattttggctctgaatctctgatagagtgataggtcttggtgccgggatggtaatttggtaggatttgtaaacttttttctgggtgagttcgtcgcacactgataaacttctgaacttgagctgaatttcatgtctcgatcaaggaggttttgtctcacggtcactggactgtatcaagttgactttttgaaggctttttgattgtgttcttggacggacaaaaatacaaaagctgcaactcctttttttcctttctgtgtgtttggtttcttgtgcgaccatgaactcatcgaattcctgctttattaatataagaggcaaaatttctttcctttttcttcagaaaaaaaaatgaactcatcgaatttggattgctgaataggaagacagtgagataagcagagagattgaggcgcagaagcatcggcattgagccgaatggtgtagagagctccagggatggatcgccggagctggctatggcggcggagatcgacggagaagagcccggccgagaccgagagctcggtttcttctccatccgagaggctgtctgatgaacaggtgagaaaaaaaaaacaagtcactctctttcttcttctccctgtatactgcattcacatttcagaagtttatacatatttgcacaatttaaagtcaaacagtaggtactacttgcaatattagaatatcacgataattgggcagtaatcttttcctaccaatccaaagacacgcagctcttctgcgtgttctcggaaaataaagttcatattttttttccgaaatcgcggtcatttccgcatgtttatctcacatttctcaaactaccaatgggtccaaggagcaggaaaaagtaactgggtaacagtaaaagaggctcaaatgttgaagaatgataatacctgtctagtgtctaggagtgttgtgcaagcatgctcaaacgaattgatgattgtcaattgactttgtgagccctacgctccttccattgaacagatcatgtaacatgtgcagtacagagaaaataagggtccatctgatatggcaaacatgtgaggtttcatccggtttcagatctgtagaggctggaagctttggtaatctaccaccatgttgcagatgtgaactctttaagatttgaagctctgatggcattagataaagattttgatggaggatcagagttcctctgcataaaaacagctcagttcttcctgaccaatcctagttgtaccatgtagggtacaagaattattctttctgtttgatgattcatccatcctagcaggtttattctcttgtctggtgatatcgcgaaaatcgcgcgtttgcgacatcctcgtagacatccacatagcagctcccaatcatactagccacatgacaaaatgaggggactgtaagatagattcagtttcccttcctttgtttggtaggtgacactggcaattagtccatgatcatatgtcacagtttttgggtaggcctgtaaactgaaggagagaatgagagagaggggtcctgtttgtttctataccgggaagggattataggacaagccttacctatccatggacaacaaggatgtgatgttagttgggactagcttttctctgcaggaattatggcttgcatgagggcaagatgcattttctttggtggccactccatccatctccatgtgctgcagcatcaccctttggcccaacccaaatgcctcataatgtgtctgctggcacagagcaatcaagatgcctctctctctctctctctctctctctctctcacctctgttcatgtgcaacatttacttgtgaattcctgatctttgaccatcagctctacctgtacctccaaagaaatgtctggaattctgatggagttgtgcatttaattaggggtgtcctattgtatagaagttaatatgatgatgattatggagtaatggtgctcaaagtcctaagaatccccttaatcattgtgcttctctgagcataatgttgggaatcatgcaagaacatgatctcagaaagtaccatgtcgtacttcacgtgctcatttgcttttgtccagaaaaaaaacagtatttaatactttgataattgattcttccaaattttcagatgcatccaatagaggtttcttattgttacttcagccactccctttgttctgcaatactgttgcatgactaatagctgaagttcacaagaaattttgcatgaatagcctcctaattttgcactttctagtcaggacaatgtttgatcctgtttgttcttggttaggatactccaaagagttctccaagctcagttcaatcaccggagatctcgtcgaaggaagcgcaggatgacaatgtgaaggtgaaggtgttgagcgagagactgtcatctgcagttttggacatacgtgcaaaagatgatcttgtgaagcagcattcaaaagttgcggaggaagctgttctaggtatgatgttaaacatgactgaatcgtacagtttcagtacatgaagcaaaaattcaaacaaattattgtttttcgctgggccaaaaaatttaagaaatgactctgtttggacctggatatactgcatatgcatatgcagatatgttccttgtctcttgcttttaattttttgtactgatcatgtggtccaaaagctcatttgtagttttatcaattccctgacttagaaaaagaacattcttattctaaggtcctctcaacctaatccttaagttttatgtactaatatttttttcacgaataatgtactaatgatttgaagcaaaagcttaatcccctagaaagagttctttttttaatctgatcctagaaacagtgttatttctacacatgcataaatagaactgacaactgacaagccagatcttcataacaaaaacctgcaattctcctactaggatgggagaaggccgagaaagagatagcatcactgaagacccagctgaacgctgcaactgccaagaactcaacactggaagacagaatcgttcacctcgacggcgccctcaaggaatgcgtcaggcaactccggcgtgccaaggaagagctggatcatggcatccaggacgcgctagcgcagcagtcgcgagaatgggagtcggagaaggccgacctcgagctgcgagtagtcgagctgaaggcgaagctggaggcgaagtccgagttctcggtgaacgctgaaactgatgcgagctcaaggctggcctccttggagaaggagaactctgctctcaaggttcagctgctggccatgtcggaggaggtggagctcaggaccatcgagaaggagctgaacaggagggcagcagagacggccagcaagcagcagcttgagagcatcaagaagatagccaagctcgaagccgaatgcagaaggctgcaggtaatgccatttcctcttttttcccccaacagctctgcattttggacagttcccgttcttttctgatcagaaattcgctccagttcaataaaaagtacctcatggtactaaatcgttttcgatcgttggatctaacaatgtccaccctacctagctagatttaacgatcgaaaatgatttagtaccgcgaggaaccatgcaccaggaccgaagcaaatctcttctgattagtacgtagattctaccttggtttccgttagcatgcttttcagactgctaaataatacttcctctgtttcacaatgtaagtcattctagcaacgcattcatatagatgataatgaatctagctacacatatatgtatagattcattaacatatatatgaacgtgggcaatgctagaatgacttacattatgaaacggaggaagtaggatatattttgcacgaaaactttgtatatagaagttaccctaaaatgtcaaataaatctaaccatgcgctaagagatttcttgttttccgtgcccttacttaatcttcattttcattagtttcacgtaccaactcaaggcccatgagtccgctaataactctctctaacactaacatctgtgagaatttttggcaggccaatgcacggagagaactcaagcgtgcaccaagctcggtctacgccgagtcagtcaccgattgccagtcagactgctcggactcatgggcctcgattctgatcaccgagctcgatcaattcaagaacgacaagagcatcacgaggagtgcgagcctcgcggctgcagacatcggcatgatggatgacttcctggagatggagaagatcgcgtcggcgaatagcccatccaagagcgaggccgaggacgccgctagcgtccagctggtgaagctcgaggagaagatcaagaggctggcaatggagaaggcggacagggagaaggcgctgcacgaagctcagcgagagctcaggaacacccggcatcgggcgatggtggcagaggagaaatcggtcgaattgcagaggcaactgaaccttgtcaagggagtgaaacattccatggaaaccgaaatggaagccatggagaacaggaggaatgaactggaggggagaattgagctcgcccatggcgagatcacgagcttgctcgacaagggccgcattctggaggaacgtctcgagtccgaaaaggcgctgacgctggagctggctgctaagtatcagcagatggatgcactagaggcagagaggagagagctgcgtggtcacctggaagcatcacaatctgaagccaaaaatctcggtgataagatcactcttctagagaagaagctggaggaggagaaggcgttttcaacccggctcgcagtgaggtgccatggaatcgaagctctggaagagaagaagaagggtacagagcatgagttggagtcggcacgagaggaaattgcatctctgcagaagaaagttagcatcttggaactgaaaatccaggaggagagggcactgtctgagaaactcgcgacacggtcttgtgatctagaggcactgggtgtgcagacaaatgagctcagatctcagctccaatctgcaaactcagaaatcgctggcctgaatgagaaggttaagatgcttgaagaggctgaagagaagcacaagccattgactgcaggattggagtcccagctcaggttggcacaggctgaagccatgcgcctgaaggatcatgtcagttcgttggagaagaagctggaaagccagaagaacttgtcatctgcctacattactgcattggatgcttctgaagcccagaagaacaaattcgccagtcggtttgagctcaaagaggcggaagtggaggaattgcgcaggaagatccgtttgctcgaggaggaaattcacaaagagaaagcacaatcttctgaacttggagtgcaatgtcagaatttgaaagagcaatttaccagcagagctcttagccaaccaatgaaacctatggcaagtaaagaacttcacattaaaaaggtgaatttcatagtactaattgtacatttattcagtgatttatcatatatattgcaaaatcaagccttgtgacaaacactaaaacttttagtttgtatgctactaatgagatgtcaccactttctgcaggagaaagagctagctcgtgcagcagggaaactggcagactgccagaagacaatagcttcactgaacaggcaacttaaatcgttagcagattttgatgagtttgtccccggattcgagaacgacagcgtaatagctgaaggctgggaggaaaatggtctgaaactgttgaactctgcaaattatccagcacaattgggatgtttggcggtcaaatgattgctgttgttgcgagaagactgccattgttttttgttctggctgtcatatgatcacatggttgttgtgatgaggagattgccaggatccttctgaagatgctatatatatatggagataagttaatagtttatagataagcaaaatgttcatacggaaacgatgttaataaagttattcaagccttgaagggaactatgtaaagattaattttgttccccttgtaccactcatggaaatgggcaattttcttttcctggcattaatagtaggaaactggcgtgcatcagatttccactaacaactttacaacgaaagagaggtgtctcgctatcaacaattacattatctaccactgaaaaaataattagccgtaaatacgagcacacgtatcaaatataggatacttaggtgggtagttccaccgcaaggaacttaaccagttcagctaagctcatttcactccactaactacttccatgccattatcgattggaaaagctccatatttaatcccttgaccgctcggtccaaatttagtccttcactatgaattcgttcaaggcttcagaccatctttgaaacaaagaaaaaaccacatgaatttgaaacaaaggaaaaaccatagtaatactgattttatcctatcaaaccctttaaaacaaaattgtttcctatccattcctttgaaatttttatggaatggatcatcctagagcaattttagataaaaataaacatgaggtctcaccacatgctttccttttcatgtagaatttttgggttttttctatgtgctaatcaaagacaatttgaaactttcctatgcttcagaatcttataggaattcaatgagtatgacattctattcttacttttttttctactctatgttttcttaatactgagttttagagggtcgtcattattgatctctttcaaaccacctcatctttcgtagcttttggtgatgtggctccgtgtgacatgacaatcttaattagaaatttcttaaataatatatagcttctttcaaaaagaaataatttgagatatgggaaaggaaaaggaggcaaggttttagtatttgttcaaaaagaaaaaatttgagatatgggaaaggaaaaggaggcaaggttttagtatttgttcaagtttttgtttcactgtcgttcattatggttgctatattcataccgttactatttgctcatgtggacccaactcaagcgccatgttaccgtacccccagtttagatgtaggatgaaatgtggactgttccaagagtcaaggaactataatgaacggttttatagttgatggaccaaaattggacaaaatgtgcacttctcttatcaatttatatagagtaaggaaacactatgatcaaaactaaactcttcagcttgataagaaaggacggactagcacacaaaaaaggggtgataatacgccatttcttttatattgctcagaaggcatagtaaaatacttaattggcccggcaagtatttgaagaattgagaatccagataagtgctattgttcgagttcgaataaactctaatacaaatgatattcattgtacaaaatcgagtgaagggcaaagcaccttagtcaaaaagtcaaaactggtcaacactgactccagtgttgtgtgtcctatctatgcgacttgctgcttcttgcttttctttttcattcctttgcttttttcaccagatttttttctctttgaggtgtgcatttcagaatcactgtcatcatggtcgagcattctagtttcgtcttcatccatttcactcgttctattcttcttttcctttctttcctttctaacttctgccccaactggatctggctgcttggatttagtctcctcgagttctgaacatccaacaagagcgtaagtagatgaacacgtggaattcttcatgaatcaattcgatatggcaatgaacttcgtttcaaaaagtttgaagagtagcactacatcttgggctttggggtcctagggctgaaagatgtagattactatcttaactagcccttctattcaagataatagaagcactgctctattaagtctcactattatttaaggtgatgtgtgctggaattacattggtaaacaaagaacagtaataaatggaatggtaccttcagtggagaaatgtgaatcaataaccacagctgtcaggtgctgcttgaggaagacctgttacgaaacaggacagtgaagagcattagatcgtgcaactacaaggataaaatgtttaaacctggacacagtttcaagttgcacaagaatcatggtacattataacttcactgtgaagcacgtaatttccgaagggagatatatcttaattttaaatagaatgcagcaaactagcaaaacaaccaccaaaaggcaattaactagacagcaaaagggtggccagaagaaaaatcaataccaataccaataccaatacacttgcgcatgccaaccagtaaaagagtaccccaaggttaagtctaaaatgtttgactagcccatgatgtcttcatgaccacaataattcacttatatggtatgtccaaaatgaagcaatggcaaataaaagcagaactgaaacagtatctgttaattgcatggaaaatatagtatttgaatactatgaaattaactgttaaacgtaccgcagagagcagctgccttgtatttgtgtcccagatgcgtaagtaactgtccagtcctacaatagtaaattggtttcctgagttaatgcaaacagaataacctagactagtaaaggtgtgcaagacaaatacatgtaaccaataaatttgcgctcaaaataaatgaatatgaaataattggaaaaatattttttcaaaatatgcagccttaccacaagatgctatcaaaggtagctctggatgtctaactatagatctaatacttccactgcatttaccagcaaagcaaccaagtagttttcctgggaaaagggtgcaagctaaagttaattctgtaaatagatacattaaaaagaactaaaaagtgaataccgattgcaaagtgtaaggaatttacatagaatataatctagaatgttgtaagcatacaataatcaaacatcttttgatatctgataagggacatgaacaagatatctttctaacgcctgaattgaaaccaatttatctggtatttcaatatcactcacagatagtttagtagtctcaaatcccctgaaaatttgttggcatatttgctcaggttagtacaagaaccataacagcacaactttattcatgctatagttgagggatgtacacaggaatcaattgaggaggtgcatttttagcaagaatattcaaccgaaggttttgattcacagttgatgttcctggaaacccacagagatgcatatttgttttctctgttcctccaaaaaagtgcatgatgcataagctcattgcagaatattaagttaaatttaaataaaacttctccaggcagttaaatgtatccatatagcacatgatgaactaactatgaatcgatcaggaaaataaataaacaaccaatgttgtaccacctatgtaagcatcagagcatggtagccaaaaaatagtacaatgaaatacacatgccagagtgaactttagagtacgaaaatgaaaagagatttttatttgaactatagtatactagatacaaaattcaaactaagctacaactctgaaaatataattcagaatgtattttgacttccaagtgccatcagcaagaattatcacacaccagctactatcatataatacctgttctcatgtcaaaggaagcaaggtcccctcttcctgtaccaatgtagacagcatgtccatttgggtcctcagcaactgccttgattggtgactccctaaaatcaactgaaattacaggccttctttgggaagcagtgtcatataagcgaacctaacaatcagaagaagcaccacaggtacaaatattgagaaaacctcatcaatgcagtgttattttgaaagatgaaaactgatgtatgagaacatcctatttagcataatccagtatcggtttcatgatttattatacgaggaaactatacagcatgacaactaactggcatgaaaaaactaatcaattgcaatcattctgctttgccattataaagttggatcagtttcaatgagacaacaatacagaaacagagcagtttgaccaaactagttgaaaatggatcttttttgttagcatatcagcaatacctgatgattatttgtgcaggctacaattttacgatggtcatccttgcacaaaaaagttccagcagtgaaccaaggtgcagtgaatatctgaagactgttgcctcgaggcttcaggtaaaaaaaagaatgaagtagttaatgcgtggcagtctgctataacatcagataaaagtgcaagtagacccagaaaaaggataaaaggtgtgagtcagtgagtgcttacagacttggcagaccatatcttactacaagatgtgatatcccacaaattgacttctattcctttcctaaaatgaaatattattattagcgcctcaaccttcataaaagctactcatgtttccaattgagtagttagtaatcagaagcaatatttttttatagtacacttagatgctacataatgaatataaagattattgtaaacccaccctccgaacatcgcgtagctttcaccagcatccactgaagaaaattgcactgtacccgaattgctcacatcccatgagcttgatggcccaacagccatgtccgaggatgcattttcctttgcgacagacttgacatatgctttccccttctctgtacaagcaagaaatgtgcctaacctgacatatgcaatgaatacatcataagtatgccattatctacaaaatgaaagaacactaaagcatggagaccacaaatgcaggtggattcataacccatatctacatggcaaattgagtgtgcacaataaattgccaaagagcatcaaatgaaaattacatggatgagtccagcgcatgtcttctgaagagatgcagcgtggctaaggggtcctcttctgcagaactatcagccggtgccgcccgcccagcagcagcgttgacgcctgcgagagtctccccattcagtggattcagcagctcaacctacacacaaaacccacagcaataaacaaccagcacaaaaatgctcaacgagtgcttcagctctccaaatgcaaacgcgttgctcaccacgccgttcttccgcgccacggccaaaacctgtagaagaagagaagaagcgaggaacgcagtgaggatcatactctgaccaattaccgcggggaggaataacgggaggtcgcgaacactcacggggtcgacggcgcggtcggcgagcgaggcggcgaggacggcgcggggcgcgtcgggcgcgccccacgtctcgacgaccttggcgacgcccgccggcttcgtgcgggcctccacgactgcgcggttgaggatgaataccacaaaacatgatcagccctctcaccggaggaggcaaaccagcacgccgccgccgcggcggcggcggcggcgggaagggtggggacgggctacctttgatgaggccgaggatgtcggtggtgagggcccggagcggcgggcagccggggctctcgaccacgctcgtccgcggcatgccttcttctctccggctagaagcggccgccggcgatggagggggaggaggcggaggcgcaacgtcgggaggagtggagaaagggcggtggtttttttagggttttcgacgtgcgacacggcgccctgtttcttggcccgcgcgtattctagtcctgggccaggtttggcccaatgggctctactgcggcatcgacagaatcgatggctttttcaaaaaaataaaattgtattatatacttcttctctatggaaaaagtgtaccggaggtcctgaacttgtcaccaagatactaaaacgtcctccaaccgcaataccagatatggggggtctcctaagtatgcaataccggtcacccgaggtcccagggcaggatttctccccgatttgtccgacgtggcagcggttttgtccatcgtggcgctttgacctcggtcgtcgttgttgactcagcagcccggtagttaggatataacgagggaaatgtttggcgcggtttgcttctcccccaaacaccgaaaccctagcgagcgggcggcggcggcggcagcgatttgtagagcggcggcgacttggcgagtggcggtacggagatgtcgagctcgatgagcgacggctcgtcgtcttcccatcagtggaagccttctcccgtgccttaccgggttggtcctctggattaccaacccgcggtgatgtgccgatgccgatgcccggcgaaagcggcgaggtggatctcatggagcacggacaaccctgggcgccgatactacaagtgttaacatgctagggtaagtgagggcttttggttgttctgttgttgaatttggatttggacggtttgggatttgaatgtagggttgtggtttcaggttggggggtgtgatttctgggcatggtgtgacgacccgacttccagtttcatcagtgagctattgaatgacttgcgggacatggtgaattcgttgaggagggagaaggaattgttgcataaggaagttgaagacagtcgggctaagggggagcgagagaggagagaaatagatgatgtgagggctatggttgctgtgaaaaaggaaaaaattagaagcttgaaggctaggaatcaaaagttagagaaggagaaaaaaatccttgtaatctgtatgctgtcacgtatttttatgctgtttgtggtgttagttgggaaggaatgagacatgttgatgtgtggactgatgtgtggtgttagatgtgtgttgtctatatgctatgtggactgaatggtgtgatcaagtctttcctttgatgtgtcaaaatatgtatgtatcagttgtgcacttgtgctatccagttggaattaaatttgtgaatgagtgggtgttaagagcaatatggaatctgaaagaaaatcagcatgcaatgtgtatcaggttgtgcaaattttggtgtttgttcagggaaacaaaatcaagcggtgtatgaaaaatccatttgtgtagtgaatgaaacatgtcaatttctgcagcaaatgtccatgtcagcaggaaatgaaacaaatacaaacagtgtatgaaacctgccaatttctgcagcaaacctcatgacaatgcaaaatgtgactccatatttggcttccagcagtaacagataagcaaacattcattgtctgacattcaaatacacataataagtgacatagctagcctaacagtctggcatgacaacataaataatttgtcttacatcactgataagagagccaaatagcatggcatcatagagatcacatagccaaacattttggcatcacagattacttggctaaatagtctgccattacatcacaaaagaagttcaaatattgcactaacattactgacaatggcacattcaaagcttctttgcttcccagggcagaagaataagtaatcctccagctctcttctttggcttgttttttgtaggctcttgagctgagacagtgacagttgccttgccagatgtgagcctcacagacgcagtagtagagctgtttgaatggggaactattgcttgaagatctactctagcagatccaccctgagctgttgaaaccttggcctttgcagcaaccctgaccacttcctggctatccattgctgcctgtagtgggaaagtatggcaattaggtaaagttagcgaaagtgaaaatagtgaaaaattgttgccatttaccttgctctttgattggttgctcttggaatgttctgtggtgcttgttgtagtaaggctgacagctttcctcttcctgctttgagcagaactgcctggtgtgtttgataacaccatctgttgacttggtgatggaagctactcagaactgcctaggttgctagaacttgcaccatgatgctttgcacaggtagatttgttgtgcccaatttgcttgcagctagtgcatctaatgacagtaccatacttggacattttggtaggcttgggtggttcatgcatctccctcctccttttagttcttggccttcctggcatctttatgtatccaggagcattgagtgcttctctatcatcctccggccaagcactcattccctctactggctgaaggcagtgcacatgtgtgcttctgaaatcatccacatagtaacaaggtgctatgtactcatctagcttgttggttctatagtaaatgcaagatattgcatgagggcatggtagtcctgacagctgccaatacctacaagagcattcctttttgtccaaatgtattgtaaacctatggtcatggtgattaacctcaaaattatcacctccattgcaaattgcatggcaaaaggctgactcagctatgtaaacatttagttttttctcaatccctggcatacaacatttgtccactttgcaccatttgatttctgatcactaatcctaaccatgacctttctcctaatagtctcaagcattgtgatgattggatagaatctagattctaaaatccatttgttgaaagattcacacatgttattgtttactgagtcacagttagaacctaacctgaaccaggctctactccaatgctcagggtgtgtgttcagtatggcttgagctccagcttgagtcacctgagcaagttttgccctagcaagattgaataacatcctgcagggagcctttgcacacctccagaactttttctggaattgcttgtcaggaaaatgcctcttccaattggcataaatgtgcctagcacagttcctgtgctcagcctcaggtaggggtggaaaaaaagctcgggctcgtgagctcagctcaggcttggctcgagctcgcttagctcggctcggcttgaatgccaaacgagccaagcccaagcctccttttcagctcgtttctaaaacaagccaagcccgagctggctcgtgagcctaggccatcatatatttatatggatgattttattttgtagtggagttattatttgttaatatgtaatttatcgtctagatcttgatgaattgaatatataaagttattttaattttacatgttgatgatttgttattgcttttcttaatgattacaaattatatagcttcaacggaaggcttgcaagctagctcgagctggctcgagccaagaaacgagccaagccgagctcatgttttagctcgtttccctaaccgagaggagccaagccaagcctagcttgttgcgagccattgcaagccgagccgagctaaggcttggctcggctcgtttccacccctagcctccagtgcccacttctcaacagcatttaggataccctgtatggaaatacaaaaaataaaggttcagtgacatgtgatggaaatttacaagtgaaaaaagcagtttgtaatgatattatcttctgctgatctgaaatgaatacccagcttgcccctgtccccactttcaagtccccacaaagcaaatcaagaaaccaatctcattcctcattgttttctttggcaaccactgcccaagcaatagggtacatttggttgttagcatctctgcccattgcacacagcagctctccattggttgccctcttgaaaaaacatccatccagtcccacaactttcctacagccagctatgaaacctttcttcaatgcatccaagcatatgtagattctcttaaagactggtggaaccatgccaatctctctgttgataaccacagtgctaccagggttgcttctaagaagctctagttgatacctatacaactgctggtattgccccttagtagcctcaaactttttcttttgcacaagccattttgctctcttcaacttagccacagaagcatctgcaaacatttcctcttgtacaatagctttcatgtgagcaagtagccaagaaggattagcagctatgaagtttccatacttctctgctattctaacagaggtaactagcctactatccctcctaggtggacaagcatgcaaattttcaaatgttactatttgccaactgttggacctagaatttttggatagcaaacatacccagggacagttatgccaatcacacttggcccttaccctttgcccatcatccttaataaagttaatcactttcttctctgcaagagcatattttgtaatagccttcttgaattgcttcttacagttgaacttcatccctagttcaaacttaggcacaccttcactcttcttgtaccttggttccttacttctcttagtcctcacctccccatcactaccaatctcatctactgagtcctcctcatcgctgtttgcataaggggtttcattccctgcatcttcaacaccaccatgcacacttggttgtcccctctctagaaagaagtcatccaggttctctagctgtcctgccttcaccttcctcttgaccttcttgtaatgtttctctatctcagcagcctcttcatcatcatctgactgagcttcatcccctggaatatagtcactatcttcatcactatcagaaggtggatcgttagctatgggttcagtgtcatatgttggctgatttggaatgggtgaactgtctgaaggttcatggctagctttgggagcactgctaaaaggttgatggctaactagaggtgctgattcagattggtacaaaactatcctcctatcagtttcctcctctgctattgctttacccttgtcaacttctttccctttagatgcatctacatgtacatcccctttttccccatcttcttcactctcaacttccaattccatctctacctcataaatcactctcatcatcagacttatcacacaaatccacaattttgggctcttcaacatacatatctgccacctccaattctccagtacaatcacacatcaatttgcaagccttatcatcacaaagagcccttagacctgtttgcaaatccctaccaggaaacaaccagtggagcattgtccctgacaacatattgcaatgctccttcaggtgtccaaataactccgacaaggaaatcttatccctatctacatatgacaaagcctcagatccaccgcaatacttcttctcactcccatctaacagaaaaaccccattcatatgaaacctaaccacgagagtgtccaacacgtccatccccttcatgctaaacaacatataaaactgatttagggtatattataattgacctacacatgcataccatgtccaaatcgaaacttttgcacagaggtaagcctaaataacctctaatcaactacatacctaaataaaaaactcccaacttacatcaaatcccagataaaaaaggcatctcacaatataaaaaatttcacttcccaaatcccactggtaccatgcaagcacacacagttaactacgaaaggtaatacctgccagattcggattcccaattggaggggtactcgccgatgcaacctcgaggtcgcccaaggtggctgctggtcgccgcgcctaagccgcccccagatccacctcgagctcgaggtagtcgacggtagaggcacgccggtcaccgcctcgcctgcacgacactccgcccgtccgccgcagcctgctccgaatcgccttcatcgctagctgcgtcgccctcgccgatctagggtttccagaggagggagaagtgaagtgaatgccccttcagtgcgccacgggttgtcctaactaccgggctgctaagtcagcgacgacgaccgaggtcaaagcgccacggtggacaaaaccgctgccacgtcagacaaatcggggagaaatcctgccctgggacctcgggtgaccggtattgcatacttaggggaccccccatatctggtattgcggttggaggacattttcgtatctcggtgacaagttcagggacctccggtacactttttcctacttctatactccctttttttccacgctagtgactagtgtgggaccgtgggttcaacactctcttttttttcacgcatatgcttcctaaattattaaatggggacgcgactacgtagcacgaagtcgcttcgttgcctaaacacgcaactcactcttctcctaattagcatatgtacgaaggcgcgcctctttccaaaaagggtatctcgtagttactattgcagagctaagttacttctacgattcaagtacttcctccgtttcatattataagacttataatatgaaacggaggaagtaattatttaaaatgtttggatatattcaatgttagactcgttttatcgtatattttgagtacagcataatggtacaaactaaactaaaataacaatgctagtgtagccaatctttagttttgatgattggtggtgtcctttgtagcaatactggacgctatacagattcctcactttgatgaagcaatcgtgtctctccaacagcacgaagacacggatagacggctataagatgcgtcgcgcgataggaggaaaccgagagcgctcttgatttaactttttcaattattaaacatgtgctttatgaaaaagttttctatagaaatgttgcttgaaaaatcatattaatttattttgaaaaattttaagcatataattaattaattatgcgctaattcacagttccgttttatatgttgaaggggaaggattctaactcccttgctgaactcagcctttaaagccactctaaatttgaattttttagttttttcattatagtttatttttcaccgtttacttttaaattgctaaaagcatatataagtcctattcataaaatattttttgtttgctgttttaagccaaacgttgtgcttacatttagactcagctggtaatccttagctagttccccatgcgagcattttttttttcttcaggccattcaatttttgttgcatgtttgtgttatgcatttgtttcagaattgagataaaaaaattcagcaatttatttttttttcgcgttgagagaattttgataaagaaaaagtgatagggcaaaaggaattaatgaaccatccactggaattgtagggataatatatgaacatgtcccattggggcattcaacaatcggcaatgttcgacaagactaaccagaatattcaacaaaagtaacaacactgaaaccatcagatggtag

SEQ ID NO: 29571 - DNA, 8050 bp, Oryza sativa
aaaagaacgtcgctaatgcaacttagagctcattaaggctgggaacccctcctccccggcacgcaaaacggagcacgtactattgcacaattaattatgtattaactttttttttgaaaaatggattaatataattttttaaaacaactttcgtatagaaattttttacaaaaaaacacaccgtttagcagtttgaaaagcatgcacgtggaaaacgagcgaggtgagttgggaaaactagcataaaaagagtaaagaactcaactaaaacaaaaaaaaaaacaatcatgcaatagtcatagatgcagcttaagaaaatagaaaaatcaaggttcgcaactcatgagtcaggatgtgcttatgcatgccaaattacatacttcattcatcccaaaatataagcatttttagaatagtgccaaatcaaactttttaaatgttgactattaatagcaaaataatgaaaaagatcaatcatgtaaatttgatattgctagatttatcattaaacaaactatcataatatgcaactctttttatttaaaacatattacttttatagacattgttggtcaaagtagcatctcgaagaccgtgtagatatctaaaaatgcttatattttgggacggaggaagtagctgaaatgtaggaataagcactttcacctgttagacaaaactcaacctccagtacctcatgttcaaaattaaataatgtagtgcatgcatgtatgcatattctgagatttggtgtgtatatagaattaaataaggtaggacatggtctccagtttgttgagcttaggttaggtatgcatatagaatgcaaaacaataaatttaggtgtaatctatcatggatggttggtatgagctttataggcatcaccttccataatccatcacttgcaagaattagaaaatcagtattctcgtctataggttcctccaccacatctggctctgagctgaggtgcttctttaggctccggtctccaaatgcccttgcaaccgcaagctgaccatcaacacgcggtacatctcctgcaagtaaaaaatttttggaattgaagctcgatagattgcatctcatatgttgtgacagtaacagcatagaagcagttaagagtagggtctgtgtacgccactgctggtaattactaatgcaatattggcataggtatgcttagtgttagggtgtatcctggacctaggatctgatgcaatgtcaaccaatgaaacgggctcaaatagatgggcagtattgagggccacatggctagtatatagtcatacaaggacataaatccaaataagaaagcagtgtggaactaaacattagatacactagattagcaaacaaaaaaacctcagtaaaaaacatctataactttaaactgttaattacaatgactaaacccccccccaaaaaaaaaaaaaaaggaaaaagagttgacaagaaatggtcatttacctggtaagtttgaaacaaagccaccttttttctcgattgaatgccgctccttgtttggttcatgatcaaccgaaagctgttttgctacaccactcttgctaataactgctcgtgaatctccaacatttgcaactactaggttcacagaattttcactgcttattaatatggcagtaacagcagtggagcctcctctgcccaactcagctgcgctttccaatatttttgcatccgtaagttgatatgcatttcgaattgcagcttgtgggttgctcaagaattctggctgaggttgaaggagtcaataaataatcagcacagttgtgaattcagttgactatcttcaattgcatagacattatctatatatttaggtcactccatagttattcctagcatggttcttgcaagtagattgtagaacaagcacagataacacttgtaagcgtaacagaagtacaactcttcttaccctgtttatagtttaccatatgcattatagattgacttgctctttctgtgtttttgaggataagtataatacctaaaagaaaaagagtagtgatgctggtggtaaatcgccaccccactaactccgccttgtttttcttttctcaaaatgcttcctacatttctttaatattatgcaatcttcattccatatattctaattccatttttttaaaccttctaaactcagaatttaacacataaaagtacatagcgaatgggttatttttactgtaagtacagacactgtcagatgctccttaaaacgacaaaaaaaatgaatgacacaactatttattgtgaacagcattagaacttggatggttcatttttatccatagtaaatcaaaggacatgtagctagtaaaaatacaatattggaacaattgacgcatgatgacaaaacaatcttactatctgagcatgtaggcaatgcagcaagtattgaggctaagcctattaacaggacattgaatttgaaatattacctgctttaagatattatcaaagagatgtgagcgcaggaagtctggaacagtgtggcccaaatgcccatcaaatattgcaaacagccccagatcatgctctccttcttgcctgtactctgccactagatagtcctccatcggatgatttgattttcccttcacaagatggtaaccatgcttgacacgcttgcctgacaattttgtttttcctttccctgtttctggtcctgacgaactaaaagcatctttcacctgttaaacaaaacataatcgttcgtcaagcatgttaagttgctaatagtacaacactaagcaaagcaaatatataagcttgcggaaaacatccagcacaatggagcaaaaaaacagttttcgcttttttgacattggttgcatcacagcaagaataaacacaaagaaggtgcataaggtagtctaccaaaatgaatttagtctggatttagtgatgtgtgtattctacattgagtagagtataacatttcaagataacttctagtttccaggctgcaaactctaaaactcccaaggaacaacgtcaatcaaacgagttcttgagttccaaaagctttcataaaaaagaatatccaaaaaaatctaagcataaaataaaattcatgcttaaccggcaaaagccggagatcgtgttcttgaagttttatggtgaaatggaccagattcccataaccaacatattgaaatgcttgtctctctactggtctagacgagttatgttttgtttcctcagtagttattttctccactgatacatgtttcctgcttctgctagtaggaacgagaaacatgataactccaagaatctaacgtcaacacggagtttcatggcatcgggactcattatgtttatagaaccacaaaccattggattgtcgtaattaagcaacagatttggcccaaaataaataaatagacaccatagcctagcatcattccaagatttttaagacatgttcagacttctagccttcgccatttcaagatcccctcaagctaatatgaaaaggaaaagattcgacacaacggtgcacctaaatattaccccaaaaatagcacaggaatagcaaaaaaataaaaaaaaacaataaacatgaaagggaaatggaggccaaaggaagaacaaacaagaatccccatcctccagtcctccattactcagtaccttgtccttcatcttgtggtagatttccttgccagccattgtttccctcttacaaaacctccaattccgacttctttagcctcaaattcaacaagcaccaacccggacagcagcagcagcagaaagatggtccctttcttgaaaattcagagccctccctcccccttctgcacctctctgcaccacaaccaaacttccctttcttggatcagtctgaagcaatcagcagtagttgtaggcttataattgagggaagggggttggtggggagtggggcttgattgggtttggatggagctgcttttgggaagaagattgggggggaaatgaggctcgaggaaggaaggaaggagaaagggggactggatcttggatagaatcggttgacctgagaaaggggagatagggacaaggactggtcaagtagggacaagtgagaaaaaaggaaaaacaaaaggtttttttttctgtttttctttttctattcaggatggatttttcttttcatatatcaactgtggacagagatgcgacagaactgacagatgaccctgtgaaattttccatctgaaaatttgaagtttcatgagaataactaaaatccagagtaattgaattatgttttaatagctagtattgcctattttcttatttcttttttttcagaaagagaaagctttactgatgagaacaaagttatttcaatcgttgagaacaaggccttgaatgcaggtgggaatatgctcccaccatagtgcacaatgcttcgttctactagtcagctgcgctaactcatgagtaccctattgcaacctctttcgacatgacgatatttcacctctgctagcaactcctttgtactttgcacatcggcgataatgtggtaccattgggatcggttctcttggtatggctttagtgcattagctacaaacaaacaatcagtctatttttcttgtttcgagtttttatactctctcccccgctctctggtcattatacttgatgttcatgtaagatttggataattttttaaatctcaaccatctgaaacgcttaattttcaaaattaaaagaggtgcacttaaattacctcaaaaatattaccataatatcataattcttttccatctgaaatttgaggtttcatgagaataactaaataaatctagagtaattgaattacttcatccgtttcacaatgtaagtcattctagcatttcctacattcatattgatctaaatgaatctagacatatatatatctatagctactattgtctattttcttatttcagatctttatactctctctctccgatctctagtcattatatttgattattgggcaaatttttaaatctcaaccatttgaaacacttaattttagaaagtaaaaaagtgcacttaaatttacctaaaatattattcataaatttattagattttgtaaaaacttattttgaaatttcaaaagtttgactaaagtgtcgaatatttatgaccgtatgttattaaagcagttcgatgataaatctaatgatacaaatctatagtaaaaaaaaatatgaaccgtcgaactttttcattgtttgctcgttgccttaccagtcttttcgaatttgagttgtagaacttaatttataattgatcatgggttgtttcattattttcttttttaagccctcttaaaattactttcttggatgatttctcatataagaactagttctcgctcctagttctcatgtatcagaaacttctatatgtattaactatttagtacatcgagtacatactattatattgtggattttaaagagaaaaacacgtgcacaaagcatttcctcataacctgtttttttctatcccactactatacacacgagtactaccgcaggacgacgacggccctactgcgcaatgacgatgactagcgccggctgcgtcgctagctcgctgccccaaccctcccttcccagatccagctggaggggggagggaggcggcggcggccaccccatacaacaaaggagttcgccggcgatgacgacgtgtttttttttaagtttacatgttcattgttgttaacttgctgtagatttgaatccaatgattttgtgttgcaactttacaatgtttgtgattggattttgtttcttggatgagatttgtgagaatttgtggtttgtgatttgaagcccctagggacgggtggggttggcgagaaaaaaaattttggcgctgagggtatttttacaagcgggactactgtagcacctacagcgtctggaaagattcaaactgccccctgatttttgcaggcagtgctttggtccacctgtaaaaattagggatttttaccgtcgtttagatatagacggaaggttttgccgcctgtgagaacatgttttgaccgcctgaaaaaacatttttttctaagtagtgtcagtagcaaatatttgccctcgttaaattactattgaaagcgcagatagtattaagtcttgcacccatgggtgacagcttcaccggtcaccactacgcctacttttcccatagaacccatttttattcttgttaaaaggtggctaggcatgcaaaacgtccataagttaatgaaatgatgggcaatttacatcttaaatagaagccgacgacaaccatgatagctaaggttagttgccacacacgagattctggtcgagctactttatattaatgggaaatgcacacaagcacatcaacacacatgtatataacaattacatatatccgtaaatgtgtgtttttttaacgcattagatggatggagggggccatggataaattcgtgaaccccattgaaacttctacacaaagtgaactcatggtcccatgtgttcttaattgtggggatcagaatttgaaccgaaaaggaagaaagatatccgtgtcacccacgcacagacggctcgaagcgaaatcctagccacccgccgccgtccctcccaccctcctcgatgcctcgctgccaccggagctcaccgcctggaaaaccgggcgacaagcaaggatggcggtggcggggccaaaacccgacgacactccatctacagcgcgggggaagcgacgcaaagctcagaaagttgtcagtgaacttcggcatgggcggcgttggcctcagtagaaggccgacggctacgggccgacagcgtcggcggccgcgggacgcctgcgttggcggaagtaagaggccggtgctggaagctacgacagcggatgagaaggaggttgacgcagccgactacagcgggtagatgacgacatttggagtaggaggctgacgtgacgtggttggtgatagaagcaagttgcggtcagcaaaggcctatgtgacgcaagcttggtgtgtccggcggtggcaggaggccggcacggtgacgaggttgagagcagcgaggcgcaggccggccagcggcaaactgagctggtacggtgcatggcgaggacaaggtggcagtgatgcggatgggcggcctgagatgacgctagcagtctagctgtggcagtgacaacggtggccttgtgaggtgtgcgttgcaggcctaccataagaaggccacttgtggcgacgacaccataagaaggcctcgttggcagattagtgcggagaggagatccattcttctctctcgccctccaacctaaccgtgtggatggatttggaatgcgtcggatgtcgagcttctactcgatggtcagctggcagcaagatgctggcgcggtggctgtgcgtcgaaggagtgtggttggtggtgttctctatgaccagcagaagatcttgacacgaggaagtaggaagattacaaacgaaagcctagcctctttgagctagcaagggcgacgcttgcgagcgccacttttccccttagggtattattgagtgatctcttttgccccctgatggattcctctaggtgaaatgtcttgaacctaggatggacggtgctggcatctcagtgtcatatcgttcttgaagtcgtcgtttggaaaatccttttccttcgagatgtcgtattactatctcattagtagttcattagtagtgaggtctgattgtaaacgtgtggtgtggttgcttttttttccaggctatagcctcccaaggctatattcttgtttttttttattgttctatccatacgaaatatcgcactatacctatatgtgttgtttaagaaaaattgaaccaagttcacatgaatcaacggtgcttcccaagctataattaacccaactagatttaagtttaatcatccctgcaaaagaaatattaaggtaccatgttaaaacaaaagaaacattaaggttaattacccggactggggctgcaggaatt

SEQ ID NO: 29572 - DNA, 3087 bp, Oryza sativa
aaagtttgacaaaaacaaagcgaacttttcgcatagaaagctcaagcgcatgagcggattcacctatattttcaatccaaagaacatgtcaaatgctagggattatagtatcattattttctgctacacatgcatcgatcaatcttggaaatggagagaaatactagaattacacggatgggatttgtgtccagatccagaccaccggcctatccaaatcgtagtatctttggaacgagtctacgctgctgagtggattgatttcgtaagcgaaatcccccaatggttttgcgcaagtcaagagtcgtcggctcgtcgcccgtcagcagtagttgggggaaagcatgtgacaatgtgattgacgtactatcaacgaacagaatcgcgaacggtattctgggagaaaatttagatgaaatacgggcatgtgtgatcatgcatctaagtttttgaccggtcatttttacatgattcatgagaaggatgtgaatttggtggacaggttttcacaggattcgtctattttctcgggagagtttttcaaatgcccagatttctgcttccagccgccgtccttaactccttacatattgttcaacgttgatagaaatctgaaatgataaacaaaatgagtacaacttccatatgtccaaatgagtaaaacattgatactccctccgtttcgaaatgtttgacactgttgacttttaagcacatatatgaccgttcgtcttattcaaaaacttttgtgaaatatgtaaaattatatgcctacataaaaatatatttaacaatgaatcaaatgataggaaaagaattaataattacttaaattttttgaataagacgaacggtcaaacatgtgctaaaaaagtcaacggcgttaaacatttcgaaacggatgatggagtagaatgctaggttgttgacatgaatcagtttttcttggtacatatgtttctcacgagagttttccaagtgccgagatatgaattagattattcaacatcgacagaactccaggatagttcagagatgataaacaaataatgaatacaacttgcattcgtcgaaacagacgaggaggacactgacagggtgtcatcctattgtcgttcatcgaacagcacacacacacagcacacaaactgaatttacaataatgcagtcaagcatcagcagaaccctaaaggagcatacacacgccgtcagctgtgttgactgactatataacaggattggatcggcctatttatgtattggtcagaaagaatcgctgcgagaattggggatgatcttgacgtcaagaacagaagagaaaacagcagcagccagtgggtaaccgatagacgacaacaagatgagccggagagttggatcatctgatgaaggcgtgccttcttgcccctctttggtcgacctgaagctgtggggacttcggcctcgtcacctgcttggttgatctgtgtgcgaaacaacgagttcacgtttgtgagatgaaacggaaaggtcgatgacattgtaggcaaaaatcttggccgtttctgctcttacctctggggacgaaatggtctgtcaaacttcgggagaggccgtgcttgtggcaccaaggtcctcctgagctgcttcaacgctttctcttcctcaatcttcacatgaaaagatcacagcaagttagttgccagaacagatgaaaatgcatccaacaatgtagggattttgagaagaaggcataagaaaataataaccttttgtgcgaattcattttcctctcgcaatctcttgtaagttatttccttttccttcacctgcacgacaacgaattgctcagtaaattcagccaatttggcaggctcctccaaaccagataatagaacaagcttgctttgctgaccatattgtcaaattctgatctttggaccgccctttcatcaacatgtaacttaagtggttgaacttcagtgagaggcttcctctctttctctggaagaggaatgggatccctgcaacaaaattaacagtattaatatgcatcttataagggaaaccaggaactgttgggacaagagaaaccgtaatgtgaaggcttactctttcattatggggtgtgccttcactactctcctctgggcctcttccctctccatcctctctctttcttccattatcctctgttgctccatctcatgcctcaccaaactctctaactgaaagccttctggcctcgtgcatggttttggttcaggcttcggtggtatctgaagagagagaaaatgttaaggctagcagaatatgagatggtcagcaaccaggacatgtaatattcggtatgttactttgcacgtaccactggatagtcagttgtgtagggataaggattagccttcggaatcctggctttctcttcctgtaattgcttttgcagcagttgtgcagctagctgcctctctttctcatgccctctttcctgtaacatggataacaaagttatttgcctgcaacagataggtaaatgcaatgtgttgggaaaacaaataactttcatactgcttacatctgtatgtaaattgaaggggtttggtattgtcaatctgggcacatctttcttgctatgatatgaagattctgagcaaagagagagctacaaaatagaaaaggacttagaagaaaggtttctggaaaaaaaataatgagcttactagcatgacttagaaccctcaccttatcaaatagatccacaactgcaggaggacccaagcgatcatcggtagagaaatggaattccttgggggctgttggttgagcctttagatgtggaaacacaccaatatcacccttgctctcgagaatctgcaagaaatgatgttcagactggatgttttgaagcacaatgcaatcaatgtatcaaatgtacaagcttcaagaagataaggagacctttttgttcagtggctttgccttgaacttgggagccttttctaattcttctagttccaattcctgagaacttttcaccctgcagaaagatgatgttagagtaatcgaaaataatcaataacataaaatggcttgttttctgaatgatgc

SEQ ID NO: 29573 - DNA, 1598 bp, Oryza sativa
ccggtcccatgtcaccgacaatccccatgtttctaattatatagttttaaaagtcacaccagttgctaccacttatgtcatctcctcctttacttgcttgctcgatctaccactatttctattcattctctttggaatttttaaaaattggatcttatagttttaaaagtttattgtcacgttgggtttcgtttttttaatttctatatgtcccgtcaaacgttgccattatactcctctatggcctgtccactatctcttctctttattatcattgagattttaaaaatcgaatataattatcgtttgggttcatttttacttctagaagtcctgccaaaccgttagcggctttgccattgtacttctctacagctcgctcgctgcctcacttttttattgtcattgagattttaaaatcgaacatgattatcattgttttttttttactttttagaagttccgaacctttaaaaattagggtttcattttttataatttttagaagtcccgtaaaatgatgccactatgcttctctatggcccgtccgccacctactctttattgtcattgtgattctagaaatcaaacataactatcgttggaatttatttttattttctagaagtcctgtcaaccgttggctgctctgcaactatactcctataaaccccgctcgttgcttctcctttttatagtcattgagattttaaaaatcgaatatgataatcaaatggggtttatttttttttactatctagaagtcctggcaaccgccttgctcgttttcttcatggcctgctggtcgtccctccttttaatcgtcattaggatctatttggtgttttatcaacagtttttatatgttgtatcaaccgtcaccactctactcttttataggtatgttacttaatttatctcgtcatgtgttttagatggtcttttctttcaatagtctttatttttatcacaaattttagttatttataaattttattcctaattgaaatcttatttttatttttccaattttagaatttatttttttttcaaattttaattaatatcatattgtgttcttttaatttttttatttttttattttcaatttcagttgtttcaaaattgtattcctagttgaactctcttttaatttttctaatttcagatattattttattttttattctgaattttcattaatcttgtattaggttcttatatggattcttctttcaatattgcttatttttaattctgaattccagctaattttaaattgtattcctacttgaaactcttcttttatttttttgctaatttcgaatttttattttatttttattcccaattttaattaatctcgtattgggttcttatatggactcttctttttaatattccttatttttaattccgaatttcaacttttttaaaattgtattcctacatgaactatcctttcttttctaattttggattttattttatttttttcaaattttgattaatctcgtattgggttcttacatggaaacttctttaaatattgcttatttttaattccgaatttcagctatttttaaattgtatttttt

SEQ ID NO: 29574 - DNA, 9876 bp, Oryza sativa
  unsure (1)..(9876): unsure at all n locations
cggagaacgctccggattcaaaggcgatggtgttggtgttgtcgctaccgttgccattggcgtctcctccattccattgctagtcgacgtagaggaagaccgttgctgttggcgtcttctcctccattgctgctcgacgtagaggaagaagaacctggcgtagaggaagcagtgtagagagcttattgtctatcggttccgctttctcataaaaacagaaaagacaagaaaacgagcggctggctcgccagccccgttgctccgctccgctaactcggcccggttggctcgactcggcgcacgagcgcgcggtggcagttcgaccaccatcttaaccgctcgacatgtgctctcatttagcaacttacttctcattggttccaaggtgggattaatcttttaacattaattgtgtgcctttgaaattagtatgattaaatcggggctagcccatttaattctaacaataaatatgcagattacaaaatacagaaaaataaaaaacgaatgtttgaatataatgtgtaaaagagtaggaattagaaaaaataagtgcttaaatatactgtatagaaagaaaagtaggaatttgtcgacgggctatacccgcagacgggatttgtagagtatgggaatcgttggaacctgcagacgtgagatcagatcgagcagacaaggaaaaagatttatactgatttggaccctcaaggatagtaataaccctaatctagattatatggatttatggatggaatatcaccaagattacaatgaggaatttcacgactagactaatccgccgactagaaactgtcgaggacggcccgaggagatctactcggcgaatacggctatgacttcctctggattgcttctcaatgtagctttggctatggcttgtaattcgatgcccttccctgaatacgggggtcttgtatatatatagtgtagatcatatttttccctgaataggatttgtcggtgatatgggtccaggggtatcagggccatagagaggaggctgcccccgggaggctgcccccggtagccacatggccctccccctgaggggggtcgggcccgaggcagggtggcgaccgccccctccatgccttggggtcgggttacctcgacacccttcgcacggtgccgcgtgtgctacgataggtgggcgcccccagcgcccacctaaccgtatttaaggcggtgtgagcgagcacaccatggcgcattaaatgcacaccgccttaaatgcggcgcatggtgcacctgactggactgtgaccggtctgcgaccggtcgaatgaccgatgtggacagggtagtgcgcctgcgcactggttgcatattaggcggtgtgccgcctgacaccccccgtcacgtcgtgatgaggagaggctgcttagactctcatcaagaccggagacggcttgcctaacccggtcagggtagaatttccgtttcccagcgcaagtgaagacccaaaaatcttcactcattaaatgccgaatgacatgcgtgtcccccgtgtcagactgatagatttgacgggccccacgccatagcaaggcatgccagagacttccaaggcaagcaacaagacatgcatttaatgtgattatcctccctgaataggttcggtgggcccatgtggtaacccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgacgatgaagcttatcccccatcgtctcactggccgaccttggcccctgttatttttgggtcatatctaattcgttatactcaaaatacacctttggtacaaaattaataatctcacaaggatgaaatatcagtaattttctattactggttgatcccatcttttacggcatcaattccttttttgaacgtacaaaaatttggggagctcagcgtgtctggaagcacgggagaacgttcttttgctgatattattaccagtattcgatactgggttactcataggaaaatcagcctttccctatatcaggcactaatttatttttaacgtctaattagatcagggagttcttccaattaagaagttaagctcgttgctttttgtttcaccagaattggagccaggctctatccatttattcataaaaggaggtccaggcctacttagggaggggttgagccctttttcacttgaggagttctcctgcccctcattattaacaccttctactccaacaaggagatcttgtaatttctcccacaattagctaagcacaagagtagggtataacgcttctcagcggcccgaacctatataaacccctcttgtctcatcgtccttgaggggcctgacccctatgcactgaactatccaccgagcccttgagtctcacctgctgcccctggccgaaccaacaaggggctctcactatcccctgcttgaggagttcaccctccgacaggattctaacacattctattccgataaggtaattttcttctttatctgtcgtatttcgtaatcaaatgatacattgtcgtatataatcaggtatatggtattgcggtattccatgaatccatgtataggaggtatgtcttatccttgacactgacataattaaataaaaaagacagattcaagggaaatttttctaaagttgtagcttttacgaattttcctccaaaatctatgtagtattttccctagaaaaaagatctctgtagtatcgtccattatattagagtttcaatggaaaggagatgatttaattatttgtttcaaatatgcttttaggaattttttttcatataaatttgaaactccctaatttttctgtcttttttctgttcgagcctgattgatcttgaccatgtcgtgaactactgttctccctgctctcaggatacagagagatgttgtgcagggctcattttgagttttcgactgtatatatatcgagatatatatgtttttcagctgtatttagcagcttaaacttgagcctgcattggttggtgattactacaactcgaatgggactaggagatgttaaatttaagaaaggtactacatgaaattgcccactgggagatgttaaaattaagaaagatacatgataaacagccgctaaaaatatgagctaaccatcacgatttggggttggtatgataattaatgcattttactaccttagaaaagataaagtacttcttggaactccggtcataaatatttgattttgatgttaaaaattagatttgatctctgaccatagataacttctcaagtgcttaatttataaaaaaaataaaaaagtttttttttgcggggaaaaaataaaaaaaataaaaaaatatataagtttgactaaatcttatctaaaatttaatcatttatgactggagtgagtactttttatatgctaataaaaacactccctctcatcatgaaagttgaggacaaagattctatcaaacttttgaaaaatttgaacaactttatattaaacaagttatttaatctactaataagtttgtaatattatgatagcacttttcaagcaactaggaaggaagcccgcgcggatgcgcgggcattttatttattgttttatataatagtgctaaaacaagtcatatctcactatttctacgtcgtgagatagatcgtagacttcaatatacttaaattataagaacgtctcccagaattaaaaacactttgtcccaattacatataaattctatcgtaacaactcattatcactattttaaaagctcgctaactatcaatacatgaaattgcgcataataaaataagcctaatatatcattaatacactacttagctaagtgtttatgtctcacttatttccaaatccacatataaatattcttaaaaatatcactaacgggtgaagccggtcatagccgtagatactttctttctctattaccttaaaagttgggtagctgtgtcccctcaagatcagcccgaagcacatattataatttatctattatatattaataatatattaaatttcctactaacgctcctacgccatcacgtggtactctacaaacgttcctacatcaccacatgacgctataataaattagagaaaatcatagatattcggagaaaaaaataatatgtagtatttatttttacttaaattgatgggcctattattttataccattatattagatcttacttaaaaaaataaaaatgtaatttgtcttcccgtcataatccccatccacgtgcgagagaaaatgcatacgttcgtcatgttcactaggaaaaatgtatgtacataaagttcaccaggtacgtacagttcatcgggaaaaagatacagccgaaagaaaaaaaaaactcaaaacaaacatacctatatatataggatgttggaaaatatacagtacaaatcacatacgtaatggaaaccttagaactaccgttggatctgacaatgaacacatgagatttgtccatgtcacttacatatattccttagtatgattggaaaagaaaattcaaccatctttgaattaggatactccatgttagagaaagctaaaatatattacttccttttttcttataacatttgaccatttattttatttaaaagttggtataaatatgtaaaattataaattgagattatagattgttgatcataaaacaagtcatggtaaaaaaaatatcatttatattttttaatacaaatggtaagatgtcatatcaaaattcaatggcatcatacagccactcaactcggccatttgtacgccacgttagagggtaaataacgagtccaccaatttaaatgaaaatcgatggtgagattatatagtaccatgtgatggcctaggagcatttgtagcagcgtcatatggtgacttaggaatattcatataaagtttaatgaacgtttagtatataatagtttttcttgctgcgaatagtagtaccgaagctttatttctttttcaatctaacgtacgtttgtatatgtacttatgtttttttcacggttagtatatatatacatctaatctcatggtttaaaataacgggtccgctaatttaaatgaaaatcgacagtgagattatatagtaccacatggcggtttaggagtatttgtaggaacgccaatatgaagacttagtactgttttgtagatcacaaattggatatataatttaaaaataatttgaaaagatgaacatttaaagatggttgatttgatatttatattatagatctagtttaacactgcatctatatatttgtgaagtaatatatttcatctttatatcgttgatagttctattttaaagaccgtcgatttttttgatggtactaagtacttatattttattttggcttatagtaagtacgtgcatatatattttttcttccggcaaacattatgcacatgagaaaggtattacatatttaatagtaaaaaataacaggtccaataatttataaatcgataacatatatggataaaataatggatcgaaaatcgttcaattgtatgtgtatatttgtgggccaatatatctttatattgtagagcgatatttgcttttttgatagtactaagcatgtatgctttattttggttgtcgtatgtacgtacataccttctattcctccggcaaacagtacagagaaagttattatatatatatatagatataatgtattaactgaaaatcgacggcatgtatatatctaatctaacggtataaaataatgggtccaccaatttaaatgaaaatcgacagtgagattagactgtgccacgtggcagcttaagagcgtttgtaggaaatttaatggacttttagtatataatagatagatagatagatagatagatagatagatagatagatagatagatagatagatagatagattctacgcatacccttttttcttaaaaaatagtaagcatttgagaaattatttgtgttcaaagtttcaaaagatacgaccagctcatattctaaacattaaatatctaatgtacatgtccatttcttataaataaaaacgtacaataatattatattggcactgcggccggtagaaaattctcttgggaattactgcccattaattaactgatcattaattgtgcagataagatgagtgagatagagatatggctgcatcaacgacggacaagtatagctttgccgtgcatcgagagcgacacgctgtcgcgtacgagagtacgtagcgcgaatatttaagcagcccggcacaaacacagctaatccaattgctgtcttccacaaaaccaactgattacttagtactgtaacgtcattaatttacaaaaaggaaacgtccaaactacgcacaaaaacagaaattttgtgcacaaaattcgcaaacaagaaccggaattttctttaaaacactgttcaaacgagctcacaacttgcatatatacacacagatagtatactaacccttagaaacgctcaaatatacaccatacccttatatattacatcttcaagagattagatcggtttatcttacgattgataaaatcattataaacgtctcctctcgttatcgacgggtatatcatctatcactaaaaggataattaaccgtaaatacgagctacaaacacctgtgtcaagtttacgatttacccagcataatcatcatcatagagttatgctgacacggcaatttaatcaggtcggcatctttgttctagcctgaaaacgccctacaagcgaaaatctgggtcgaaatggcgtcgagaagtgcagggtcacgatcgagtagtcgttttcaagtgttttcttttcttttgtaataagtaaggagacaatcaaacatgtactactaatattaatcgattccggccggctatgatcttcctcctaatcgtcccaaccgatgacgggatttttgacacgtattggctgccaaccatctcatcacctctgcattttcagaggttttatgaaattattatatatccacaaaataattaaagcttagggagttgggatccaggtactcggtttaatttacatccatgggtgacttagatcaagtttagtatagctaactaatagctctaaaacatatataattaatttaatagttaattcatacaatagttacctgtaaacatatattacactattaatatctggttccacctgttatatacatattatatcttggagtccgtgctatcgctggctataaatatgtagtccactgctcttctctcttaccccctccattccaaaatatagggcacaactaatttttaaagtggtttcataatatagggcgtgtatgcatgcatgtaattaattagcacattctctcctctaaattattattattttaaatcatatactcacaagatccttaattctattagttgcatgtattgtattaattaggtgattcatgacaacaatgagatattaattattttttggtctttgggttaagggtggttgtgtcttatattttggaacggagggagtattttttatctttttaaaatatatttatagttagtttatagtagtttgctattgtatctactcttaggattgccatcagaagaaggcgtggacaaatgttttaattggcgagagatgcttgatggtgtgtgtggatgtgtgtgtatgtccatcatttaaaaaaaaagaataaatgtaatgttatactctcgaatgattgtgcttcacctcattgcatgtatgaaatgctcaccatatataagcaaacaaataatatatattttttatatgtccatgaaatttcagccaatgctttttacaggctcgctccgtcacatatcgtaaattttggttttgatctttctatacccacactaattaatacgcgtagtgtctcaagccatcgttacttaattagttagttaaacagataaggatactttacacatcaataatgcggcaccatgcatgtacgtacatcaccacttgctatttattttgtaggttttaataagaaccaactgcttagttcgaaagaaaattaaattagctaactaatgcatcaaatgatgttagactagtttagattatattagagcgtgggggtcacggttcagattgtagtgtgtcattatgtgcatgagtgtaagtcccacgttctgtcagcgttcaattttgagtcctatcttcttcgtagtattatattacgacaaaagagaattcaaatgacttgaactaactcaatcattcaagcgcggaaatcaggatttaaaacccacctttgtttagttaattcctcattaaaaaagtaaaaagattgagaaagatttattatatatccatcgaggtgtgaaattaattctttttaattcccttcatctcataaggagtaacccagaacaatctcgataacgaattggttaattttgcgtctacgatcaataccagttttttccttcacctgggctaggagtgtagattctccgacaaacaaacgaaattcatgttgaggaatgcaaattttgtcccccactctgatggcctttatcgccattggattctgttctttttctgatcttaaaggtccagccaacttgtagttatgctgtactctagtagcctttcatttgatagagacggtttataatagcaaatccaaatcgcaataaatcaaatagttgatgtagatggcaatctaaccaaaatttagatcaccacgagagggttttgaagcgtcaatagaatccaaacagtttatgcatagctggcaagcatttcctggcatgcgtatcatataattggccacaatgttttacagaattttgaaaaggaaatgaagttaaggacacaactgttgaagacgtcatttcttccagggtttcatttgcctttcactgttacaattgttcaagcacatgatttgacttctttttttaaaaaaagataatagaattcattgtgtcctttatttcatccaatctacaactcgttattactgcctccgtcccaaaataaacgcagccatgagtttttgtgctcaactttgatcgtccgtcttatttgaaatttttttatgattagtatttttattgatattagaatataaaacatgaatagtattttatgcgtgactattttttttagtttttttaaaaaaataataaataagacgaatgattaaagttggaaaaaaaaactcatggctgcacttattttaagacggagggagtaccaagtttgtagtttgaacgaacgcttattacttatcacagcttatggatcataagaaacctaattgaaacaccatcctaaagacatacaaagataacacacctctactttcctaactcacctttctcgtttaccgcgtgcacgcttttcaaactgctaaacggtatttttttaaaaaaaaaaattctatatgaaagttactatctttcaaatttattttaactaatactgaattaatcatggacttaacgcttcttcgtttcacttgctatggagtgagggttgcaacacaccttatatatgtttgtcctcctcaaatacgatacctaaaaacagagacaacactatatgtttgtcgtcctcaaatataaacactactataaaaaccatttttcctaacatagaagatcttattttcgaaggcggacatgaccctcagagccaaatgactatctacaaaaatataaatcggggtgaaatttaatgtccgtctgcgaaaatattttcgcagacggtccacttaagcgg

SEQ ID NO: 29575 - DNA, 1145 bp, Oryza sativa
tcctcctctcctctcctcccctcctctcccctctccccggccgccggccggaggcggcggcgtgtgctcccggcggaggaggcgaggcggcgcggtggctgtgctcccggcagtggcagcgaggaggcgcagccgaggagggcggtgcggccgaagttcgggcggcggcgtcggctcccctcccccctccctcccagatctggccggaggagggaggggggaggccgccggtggcggcaacggtgtggagcggcagcggcggcggcggtgacggcgctgtccgggcggcggcggcggctcccctccccctccctcccagatctggccggaggagggaggggggaggccggcggcggcggcgacggcgctgtccgggcggcggcggcggcatggagcggcgacggtgcagtccgggcggtggcggcgcgggccgggcggcggcggcggcggcggctcctggcgcgattttcttttgttcgttccttttattttcgcaggcgggccgttgccccaactgcgcagtcgtcgtggtgcaggcggacctctctctcgcctgcaaaaatgagttttggccgcctccaaaaatgccttttctagtagtgaaaaacaaattctcaaaattagagtccaatcattctactgattagaacttacacacatcaccgtctataattgacgtcgaaccaaagcgaaagatatcggaaactgaatttcaaaccagccgctcatgcatgcaaatatagccgcgtaacgcacatggaagccgatggcagccatcaagcggccaccgcatgaacacacaaaacgctggacaacgaaacgcctccgtcgtggttgtgagatgaggcggcggaaagttcgacgagagggacgagacatcgtggctgtgagattaggcatgatttgatcgtttgcctatagaaagttaatttagtacccatccatcttcatacataatgggctcaaaattatttagcagaatttaaggtcaaggtgaaattagtttcatgctattcagaatttacttaaccaaaaatagattactcctagcgatgcaaactatcaatgagcaataaatatactctaaactcaaggtaaaatatagagatccgaaatatccaatctaccatatagttcatattcat

SEQ ID NO: 29576 - DNA, 836 bp, Oryza sativa
ttgtgcgccactgcccgttcggccattgggctgagcgggagaagcttggcgcacacgaaagaggacgagggcttagaaaaacacacgcaccccctacctggcgcgccagatgacggagcgtggggctcctcactgggagaccgcgcaggcccccctttgccggttcggccgggggcgctaagtgaggttcttcgccctcgatcgatctggagaatgttcgcgagagagcaagtgcacgagacacgggcgatgtagacaggttcgggccgctgagaagcgtaataccctactcctgtgttctggtggatctgtgtgtgaaggatttacagagagccggagagccagagagttcaggctccagaacccctctcgcctccttttttttctttttttccctttctttggtgggcaaggtcctccttttatatctcaagggatactacatgcaccacttctacctacctttcttctgggtggggacctaccctctcttgaccaaaacttggcttgcaccttcgcctggaagctaaatcacaacttgtccttgagtgaggctcagcgccgtctctcgcctgacaccggggatctccctgttactccctcattaatgggcggagatttgccatggctgctttccaaatgaccatccgacgagatgggtcatacctacctccactccaccggaggcagatgcatcgtgggagcacggttgtctgccgatgacgcgaccggcgtcagaccagtcacagaccggtcattcttgtccaccacgtgtcagttcggcatgctacatgtctgcccttcttcatacaatgacttccttgcaatggttgcga

SEQ ID NO: 29577 - DNA, 17849 bp, Oryza sativa
caaagctctgtgtgctgtattgggttattgggcatatcctatggttttatgccagatatgccaaatttccctcttctgtgcattaatatagttaccaaatatgcatgaattttgaaccactgtttttttctctacatcaggatggagaaaaatggttatataagcaactaagcaatgtatttttggtagtgaagtgtacataatggatacagcatcacttgttatcctgatatatttatttaagatggttttcttgcatgtttggtagtgcaaatggacaccatcaaattgccaatttgccatgatcttggtgcgtgtatggaatcaagtagaatggtagtctcctgcaattgctccacgatgactgaatccacgcggaaggctgtccatttttggcagttcagacttagagagaggttagcattggcctattctttggataggtttaggtcatttatgtgttgagtaaaatttggctaagaagctacggcatatctgttttacgaatggaaaaaatgtagctattttttcatgtgtccttgttgcttgattggtcaggcaagttgccaagttattgctccgtattgcaaattcatcttggtaccatattaactttgacaatctgctttttttggtgtatcaataaatcaagtaaataatgatgcaatgaactcttctgatggacaagcaacagaaaatttacttgataactatattgtttggacgtatgttctggccaataatcttgattccttcttatatcagtccatccttatccttgacgccttatcagtacactgtaatgctcatactgattgtgctggctgagacctaggcgggggccaaggccttcatttaggtcagtacacaccgcctcaggaggtttattccttgtccggtacatatggttgggatgttggatccatttcatttatttctgcaggatgagattgtgaacaatggattatctgttattaggcttgggatgctggtctgatgcaaattactgtagattattcaagtcaaagttactatagtttttttttactgttggagttctgtttcagtgccaaatattcgctgagcatgatgttgtgttgcagtggtgccctaattgcgatttcaatgggatgttctagacagatgtgtggagtggggtggaggagaagcgtagtcgatgatggtgaaacacagcgtgtttgaggaacaaggtgatcgacttgaagggcgttgccagcaaccaggctgcttctttgaacaccttggttaggtaatatattcaagctatgttagatggaaattacttttatggaaataggtgcatttgtgatagcccatatattatttctttatagttattagtgcaattacaattatttagcatgcaagctaatagtacttctaatgaggctacaaatgcatatcatacttatatatgtttgtccataacgtgttgtttagaacagcttaaacaaaccaagcaggaataatttttatttatgtttcctgatcaattaggaagtatatttacaaacgatggcatatgggataagaggatttcctttctttttgtgctatgaatcccatcaaatttctgctatttttagttcacgcaggagaagcaggagaagagtatacaccgtgcttttgctctcagtattgcgaaccagctcacaaatatattccgtgaccgagagaagtgccaatacaatagttttaggaagttgtgttcgatgatcagttctgagcaactgaaccccttgtagagttgtccccattgcagtggataaaattaccaagtgcctaacacacattccatcagaagtacaacttgggttttgaaagacaaaaaaattgctatgtaattaacaatgtataaaaattctatattgttctttttttcaatcaatcttgagtatatatctcattctcaaacatatatctttttctattatttgatttgaattatcaaatactgtcgtagcgttagcacatgcatattactttgctatgtaattaacaatgtataaaaattctatattgttccttttttcaatcaaacttgagtatatatctcattctcaaacatatatcgttttctattatttgatttgaattatctaatactgccgtagcgttagcacgtgtatgttactagtatttaaggatggagaaagtacttgttctttgtaacatatggattttgtagtatttttgtgttttaaagagatctatttaaacggaaacaatttgcattgagcattcgacgcgagacgaaacatcgggcggttacgccatgtgggcccgcatcgatttaaccataacggctcgaccttttcatcttccttaatcctaattattctcacattttctcttaccttcctagctattgaacaggttcatcgggatattggcagaaccgccgttgctggtggccacgactgcaacaatggtagcagggtgttcttgatctggtcagacgctagcttccggaaccacacgattgagcacgtattgtcgagggtggcagcgatgaggttgacatttgtaggggaggtggagctggcaccagaacctaccttaggagcactcctcccgatgctagtggctgtcgcccttccactcctcctgtagtcgccaagctgtcgcatccggttctacgccaccttcatccgcatgtcctccttcctcatctccggcaagtcaacaataatctcgtgcgcgtagctagccagcatcgtcggtctgattcgagagttacattttgttttgattcaatgttctgatttgagtgtttcattttgttttgttttcatgtttcatccattgatttcttggtgttgcaattagtatggatgttgtatctgactgaaatactttcgatcaagcgatgaaatattttttcctacttgatgaaacatctgaaatttttttgttgaaacatttttttatcgagtagtgcaacatgtgaaacaatatagtgcaataccatgtgatgttctatgaaatatcctacatccaattttgtagtgcttcccttatttatactccctccatctatttttgatagtcaaaatctgaaaaatttatttttgatagacatatttcaatccaacaacctatcatcttaatgactttctcggattttatgcgtgactctccattcttccacacaatattggctatatgggcatcgagaaatgtaaatattaatgaatcgcttgtttacgataaatgactagtagcatgtttaaatagatgataaatagaattacttatcattgatttatgtaccaagatgaaatacaatactatcaaggagctctccttttaatcgaaaagaaaaaaaagtacctctcttttgctgggccccacgaagaaagggagccgcttctgctgcccatggcaatggtggcagtggcgaccggccggcctgcaacccggcggcgtcgtctcgtgctgcgacgcgagatgtatgtatgcatcctccaaagtcttttttcgcggcatgcaatcctgaaaagtaatacctctgtctcacaataaatattcgtgcccaacatttgaccgtccgtcttattagaaaattttgtgaaaaatttgaaaatatttagttacacataaagtactattcatattttatcatctaatagcaataaaaataataattattaaaaaattttaaataagatgaacaatcaaatattaaacgtgaatatataaaactatatttattttgggacggatggagtagtctgttggctcgcgccttgatggcatggcatctttttctctcttgtgctgatgctgaccaagacggcacatgtgctgatgtgcctgcgtgcagtagtttctttggctggctgctggttttggctacatcaggccgtgtaatggcacatcatgcacacgcacgaatctgatggatacagagccgctagtccaagcagtactgctaatagcgggcctatctcccgtgctttcgtagctcctccctcctactactactgtgtaggagtagtgtgtggatggataggatacggatcgatggcactgtgcctgtctgttctgcacgacggaggacaagttgtgggttgcgtttccgcgtcatactccgtctctgccaaaataaatgtagtttttcatatcttacgttttcgtttgaccgtttattttatttgcaatttttttacgattaatatttttattgttatttgatgataaaatataaatagcactttatatgtgactaatttattttaattttctcataaaatttttaaataagacggatggtcaaacgttggatacggattcccataactgcacttattttgaaacagagatagtacgtacctagctagagtaagggcagttaggccttgcagtgagcggacattggttttggttcgttgtcataccggagctaggtcaatttatcatacccattcccccgcgaggctcctcatgccttagcaacaagctaagatagaggcacggtttgcgagccgtgttgggcgaggccatgtctctgtgacatggtctcgcccttcttattatgaagcttataatgatgtcagcttaattcgtcagatctaaaatgatggcgcaatggatgaaatcaggaaaaacggaacatgtatggtggagaagaaagatggacctaccaccacggatatcaccacatgaatgcaaaggagaaagaagatggatctaccaccacaggacactccacaacctccttctccctcctcacccctacccccaccagccggaaaagaagaaatataaaatgtcaggggctgacatgaaaaattaaagctaccacttaaaaccaatttgtcttatattcgctcaataaaaaaaccatttctaggatggagggtttttttaagacggagggagtagaagagatatggtactaacctacgtggtgcacactctcttctcagtggccactcataggagtagcctcgtgtagttatctctagagagatggtatagattgctcccatagtgcaaatatagcttgagcccgtaggaagatttttatttcactttgtttatttgcccatcaatccttccgttgattttatttacaaccttatccaaaattgtgctgttagcacccttaattagacaaaataatttataaaaacctctaaaataaaaataatccacattcttactagtcattcttgctcccctattccatcatctttggccaccctagctcgttgtcgctggctcctcctcctcgcctccatcatatctacgcaccactattccaccaccacttccccgtctacggtcgttgtcgctttcccctcttattaggcagcaaattggatggacaagcttcgtggctgcacaaatcaggagtagcttgggtcgacaagctctgccgagttgggggcaactacagctaatggatttggcgttgttatagattggaagcggttcggactaacaagctccacggttggagggagttacgaccaatgggatttagcaatggcttgggccaacgagctccacaaaggcttcaaccaatgatgtctttggcggcaagggccagtggcggagccagaatttttccaaacctagggctcaattagttgaatgtatataattttgcctttatcttctagcttttgaagttttaaaatggaatttcaatgaatacttaggatcaggagtagggctgcagccctagctgccctactcttgtctccgcccctagcaagggccaaatatagttcttagatcttggcattgcctatccacaaatcgccaccgtctttagcaagcttgggcacttgcgacgtcgtcctattggtggcgacaacctcttctcaacagcgacggtggtcggcggaccttcctaatcatacgcgcattagaggtggcttattcctagtcttcattctcttctcctccatccctgtttgggacataacttttttcatggaaaacttgtggcttgtagaaggtactcttgttgtcttacactttgtaaacaaacttcaaagtcagtccctttcctccatgatggcatccgagcctacgtgactagtggggttactcctcttaggccatacacagtaaacgctctaatgtttacaggatgtctggatctaagattttctaatttttagagatttttttattttactttcaatgaaaacatcacctatctcatcgtgcacttattcgttcatcggctacatccaaaatttaggttttaaaaattaattttaagctaatttgaagctttctattacaatctatttttcatacttgacttttgaaccgtgaatactatcgatatggaagtcttacatataaattatttttattgcttagttggttttacaaaccgtagtctaatcaaggactcctttaatcaatcatcatagccgaattcgttggttgaagttttcccaatcatccttttatggaacgtttctttttctaaaaattctcacggctccaaatagaggtccttgtagaaaattgaatgtgttgttgcttgttgttggactgggatactatagagctcaaagcctcaaattacgtgcaagacgacgttcctactcctgcgtaccgctcgatgttggttggcctacgatgttttcgtgtcaaacttggtggcgcacgcacacgcacaccaagtcgatctctcgctgtcctacatggtcgatcggatactgtcagttttctttgtcctctacgcacaccaaagtcgcctactgctgcgcgatatacactgccaacgtactgcaaggatcccgaatcgatattggagtatgggctagcagtggcactgtggcagctcccggccggccctagctagcgtatgtcatgtcgttttacaccatataatttccaacttgtcactaagtgccggtgcatgacgtacctgcatgcagaggtttatactgtactgtactattcctatgtacggatccctccgttaaaaaaaaacgaatataggacataactgtattatttagaccttcaactccaaatttcaactttcgtttttcgttagcacactttttaaactgctgagcgatatatattttttaaaaaaatttcatatagaaattgtttaaaaaatcaaataaatttattttttaaggttacaataattaatacttagttaatcatgtgtaagtggtctttcttgttttgcgtgccctgaaaaattttcttcctacccatgaaacgaacgaagcgtaataattaatacattcgccttaaaatatcaactctagttcactacgaccatgaaaccccttttacactattaacctttttctttttttttgcaccattggattatagagatatgtggacatttttcaaataactgcccgcctatcaatgtattttttgttttggtccaagggctcgtcttcttctctctgtatcatccctctctcgtactgagtaaaaaaaacactcatgcttaacattaggagtatttacttatcacttaaaaccaagagtaaagtttttactctctgtggattttgagagtaaaaatattacaaacggttgaatcttatcagtaaaaaattacaagtggttaaatttaagagtaaacaaaatacacacaaaaaaaagtaggtggcagcaaggtcacaacttggcgaggtagctgcggcacatccacctgcgatctcgatgacagtttggtaagggataaccgagaagacaatgctaagaggtactgtggcgttgcgactagcgggagctagcttccgagccaacttcggtggcacatgggcgagtggatctggggtggcgcagcatgcgacgaggagcaggacaggtggggtgaggaccaggagctctcaattcagtgtccgggatgatgaggtggccgctgcttgcacatcttgccggtcaccggcgctgcattggtcattgctgctgccaccgctcgcatgcctcgctagtggccctaattccttgtgttgcctctcgcatgccttgctgttgtctcggtggcgaaaggaggtgggagagcgagagatgcagcgtgagagggagaatgggtgccagggactaaatgcaaaaaatggtgagaaaggaggatgtcatctggtgcacatatgttagatctaacggtgaagatgggggttgcgtgtttccacccaaatgagaggttgcatttgaaactttccgcaattacaatggatgccaagtataattttgttctggttagtttagttggtaacatataacatatgaagaaatcacaaatcccagtcaggggagtggaggatgagcggccagtgcccatataccaccatcaccgtcatcacggttgcatttgctgtggacgttggtggcagccggtacggagctgtgctggtgggtcgatggtgggctacaaaggtagagtacgtgcgagcggcggtgcggctaagcattgagccctacagtttgcggacgtccgcgcagcggtgcagtacctgcctctgcggctctacctagggtgcgggaattgtgtattactttgcatcattcgaccatttcggtaaactgatatagactatcaactgtcctattacctctgttttatagtgttttatatcataagccgctttgatttttttcatagtcaaacttttaagtttgacttagtttattaaaaaaaatatagcaatactttcaatgcaaaacaagcatattatcaaaatatatttaatattgtgtttaataagatatacatgttactaaattttttatatgaacttgtttaaatttaaataaattcaattagaaaaaaattcaactgcgacaatatgaaacagagggagttcagttactgcgagtcgataaccaaacttttttggtctcggtcatttccacgttttggtgtgagtttgtttggttcggttatttttagccagccctatatgtatagagcaatagttaatgaacgcatgcacgtattaaccacaccctaacgttggaaatattaataggcctgatgcatgacaaattgcatgcgcgcacctgtgccggggtcgttgcacgtattctcgcgatcattgccgaacagtcaatgtcaattatatcgacggccggtttgcgttagcgtttgcttaactagtgtactagtactaaatagaagtattgtactactagtatatgtagcgtattcatcgtgaggtaatgatatgatgtcgatcgatcgatcgatctaccgacctgttgatcatcagtgactgaatttaaagctgctttttatttgaaaaccattgctatcttccgtccaagttacgtatgtaccactgccgagcagttattttgcttttttctaagaaaaataaaaaataatatgattttttattgttttagtttctagtaatatgtaaaatttactagctcttctacgtcgtattaaagttgctagtcacattcatagtatgaaaaatttctaaccatgccgatatcattttcaataataaaaagtactttttagaaatttacaaaaatcaccctataagctagaagtttgatgtttcaccccataaattattttgttgaaaatgcctgcccacctacttagttttgtatcaaaaccacctcggtatgcacgtgtttaaccgaatcaacgtgttttcataaattatgagccatcaatgtagtctttaccaaatttaaatacttcaataatatggtcttaatactttttagagattccataaataatgagagcttaaatattgttgaaccaagtttcacaatatgcataaaatagtttaataaaacatgaagaataaatataatgtaagtacttggataagattgactcgattagcatggcgtgtggtatatctatatcaacgataataggctgatttggttaagtacgtgcgtcctaacatgacttttacaccaaaacttagtaaaggtgtgtatttgtaacaaaaataacctatgggatggtttctgtaattttctcttttttctcgaccgttttcatccctgaatacacaggatacagacgatgaaaaatattacgccatcgatcgatctcctgtgtcctgtccaattaaaactcgcgggaagccggcccaatacaggtgttggcagactggcagcacgcggcccacgtacccttcatgcatgaacggaacggctcccacttttgagtcttttgatccaccacaattttaagcacaatatgtcaataaggttgggttcttccttccattttcccaacccacctctctccattttcacgcgcacacttttcaaactggtaaaaagtatgatttatacaaaaactttgtatatgaaagttgttttaaaaaacatattaatctattttttttaaaaaaatagttaatacttaattaatcatgaaataatacgagcttcgttttacgtgccgggggagaaggagttcccaacccatcctcccgaacacaaccttagtccacttgctatacctcaacctcgattctacgtcgagtttgtttgaagccccttatctccaatagtagaaatcttcacccataaactatacaaaaccatgtaatttgggtccgataatagtatagatgtttgattttgctgacataatatcgtagtcagtaaagtaaacataaaaataatatgtgcgtcccacatgtaactgaagtgagaagaaaaaatattgggcccgcgtgtcagtcccatcacctttcttctcttttcttcctaagcctgggagatggggggcagccgataggacgggagggggggaggaggaggtcggtgagcctgggagggagggagagagaccaaatgcgccggcgggagagcggggagaggaggtcggcgagtctagaagggagagaagaggataggaggttggtgagccttggagggagagagggagagaggcggtcggccgcaccggcgggaaagtggggagagacggtcggcgagcctaggagggagggggaggcaccggtggaagagggaggggagaggtgaccggtgaggttgggagtcatgttcgctgccgctaccgcaatgacgacaaagacgatgacgcacacgcgccactgcgcgcgcccaccgttccaccaccagccccgtgcacgaaggcagcgccgctcagctccagcccgtgcgccatcattgccaaggagacgaaaaccacggagcgcagctcctttccgttaagccactgcatgacgcggtcggcctccatgcccacgctaacattgccacctccccctcccccaggctcgccagctgcctctccccccctctcccactcgctgcatccccctctatcctaggcttgggaagaaaagaggaaagatgatgcggttgatacgcgtgccccacatattttcttctcatttcactaacatgtggacctcacatattatttttattttgctgactaggatgccatgttagcgaaacctagcaaggctagcatccatactactataggaatgagatctaaattgcacggttttatatagtttaaggttgaagatttttggtataggagataagagatgtcaaataaactaaacgtaaagttgagggacggcaaatggacttttttccattttaagcagcggcggtagggttggtaggtaggaagatccggcgccatgtacaaacgtcgccgtcggtcggtatcgttttccatcttcgacgtacacgttgatgttactaatacgtagtactggtaccacatggcagttagacacttaaacttggcgcctggatctggacatgccgacgtagatcggtcatcacacgttcaaaccccaccctgagttttttaaaatgaaaggtagtccctcggtttcacaatgtgactttctagcattgcccatatacatataatgaatctaaacatatatatatatatatatatatatatatatatatatatatatatatatatatatatatatatatatatatgtctagatttattaacatctaaataaatataagcaatactagaaagttttacattgtgaaatagagaaagtaacagacagtgcctacttacttcctccatcatagaaaaaaataatttctgcatatgtttagatacatatatagtcagaagatgattttcttttcttacgaagggtgcatctcacagtgcaacctgtttttatatatatttgttgattggtgagagacaatttcaactccgtacttggtaccttaataggtgtagcggcctattgaaattaagtacacgtatggttttctttatttatgattgttagttggtgtgcaacgtcactatatctgtatcttaagtttgtatgcgcatgatatatatgttcatctaatgaccatcccttttatcaatatccatcgtttatcacgctatatttcatgtctagctttaaaaatgatcttattttcatgggctggcaagtttcaaatttgatccaaaatattctttgatttgctaaccatttttttcaaaaaaaaaatcaaatttctgaactttcaatccatacgtaggtttgtggtttggctttttttttttgattcaaggttccataaccattgccaagagtgccacattatattttgatcttttggccggggtcggaagaggggctttaggtgtgggatatatagaatagatctccatgttcggagggaggtggctaaccaatagcacatgagcatgcttggaagcaagcggtgcagggggatgaggtcggtaacacgtacaacaagaactcaagtggctgggaggtgttggcgtcttggcgagatgtggtgctaagtgttaacaatagtggaggcttagtggatgggaatatcttagctaaagctgcacaaaacatctggtttgaagtggggggataattagtagggaagagggaattgagtgagtgagagagagagagaggaggtggctagtgaagcatgtggatgttatcaaggcaggggttgtgtctagaggaggaagggtgacgtcatcgtgttgcaactttggataaacggaggaaagccattgacagagacagctcccaggcaggtcggacaacctcccaagctccaccgctgccatcttctttgcggattgtctttcgacattaaaaaatcacagagaaacattgttagccgtttggatttaacaacggtattggttccgcccctaaagaggacgagtacggtgagggatttttttttccttaaaaaatgaagtacaggtagacactctcatttatttttcttgaccgaaaagtttctccaatatgaatttggatttccctccgacagtagcttctagatcctaacctcgtttggatgggccaaaatcctgacgaggccacgtctatcagtgatgatttccatcggtttttctgaaatgtacagctgcaccgaaatctcggccaaacggaaaacgggagttttcaactttgtgctgaattttgtcaattgcattgtcggttatcgaattgaaactactccgaataaattctgacaattggttagaatggtttgtcaattgcgtttgttcaatatctgcgctaatcgccaaatctcccccaaaatcttacaaagcaggggtcgacgaggcggaaacgagaacgacccggacactcacaacgggcaggagtgggtctcataataagttcatatttcatgtatccgtttaacctaaaaataagttaatttttaacaattattgtattattccatgcttccaaacgtataagacttattccattcttttgtttttttaaaaaatctaagtccaatttatagttactatgtgttaaattaagttgttgattagaacccaaaagccattgagggcggctagggaatgtatcccgtctgaacgggatacttgagattgacatcaatgctgacgtcattatacgtacgcggtaccacgtatgatacctacactactacgaaaacgatttttccgtgtggtccaaaagggttttcgcgtgcggatctcccgcccatctgcattgaagtgtcagcaaaaatccgattttttcgtgcgcacgcgaaaatctaattttcacgtgcgggtggcttatgtcgcaaaaaaaaaaaaaccaaaccctaacccaagccgccgccctcctcgtggtcgccgtcgtcggcggtggcgttgccgccttctgccgctaccggccgccgcggccggctcccagcagcgtcgctgccgcccaccgccgaatctgggcgggagaggggcgccgccgcccactgctggtcccggccacagccagggttttaaatttcaaaatacgattttatgccagtggggggcgaaattaccgaaatttcggaaatttctagccgaaattatttgaaaatttgactgaatttgaataaaatttgaccaaattcacaaaaacttgcaaaaaaccaaaaatttcgggcgagatttgagtatgccggtgggggtgaaaattaccaaaatttttgaaatttctaaccgaaatttcaaaccctggccgcagcccacaagcgaggccgtgctaccgtcgcccgtgagagacgagagagagatagaagaaatgaggataacgatgagtaggtggagaggataagatagaaatttttgaagtggttgagaggggaaaaatacctgaggagggtatttcgcgtgcggtgctcttaagatgcccgcatgcgaaaatttattttcgtgtggtccgcttgcaaaaataggtttattttttgcgtgtggactcttaaaaggcccgcatgtgaaaaccgatttttgtgtgtggtcctcttaagggtccgcacgcaaaaatgggaggacaatttttctagatgcggtcagttatggaccatatggaatctaacgaggggctcgtacaggaaaatcgttttttagcagtgcaattagttccaagacatgatatttgtgtaacaggtcagataccctataggtatcatgtcaaggtacaaaaacatgatacttaagtaacaggttagataccctataggtattacgtcaatgctgatgtcactgtatacgtatacggtaccatatatgatacctattggtatcgaacatgatacatgagtatcaagtatgatactttatgagtaccaagtatgatacctgcatgtaccagccatggtacctgggtaccaagttggtacctgtaggtaccaagtccgatacttatatataccagacttggtacctgggtaccaggtccaatacatataggtaccaaagtattatgatactactaaagtatcatagcacactaagaaccaaaaatcatatcttaccaagacagagctcaattaaaccaacaaagaaaattgattccgggaaaaaaagtcatcatagtggtagaaacacccatagaacatgtagaacaccccaagatcaaacctcaaacccaagccaacgcaaaagctcgggggtcacgagccaagatctaaatatatggatccgcaccacaagaggccttgtcctcgatgatggtgacctcatcgacgatggccacctcctgaaacgtggtgagtagctctgtcttcgtcttgtgcttgggtacctaccccacgataagcttcacgatctcctcctctacttcgcccacacctccagcgacagcagcggcgacaatggtggcggcagcttcctccactcccgacgtgccatcctgaacggccagccgtcatcgtcgcctctttgctggtggtagtcagagagagggagagagagagagagtgaaggggaagagataaaggagaggataagactgaatatgtggttggcgagcgagaggatatttacagtagtagttatcccgtacactgtcccatagtttttctgaaaggcatttgattacttattggttgcatgttcattagtttttctttaggaaactacggcgggtttgaacaccagcctgaactttattcatatggtaaataaactttacaaaggggggaggtacagagggacggggagaagaaactatcattagttttatcacattgtgaatgaattaattacttattagtcttggtgccaaaagaaataggtcttagatgctgacggagcgtggggctcctcaccgggagaccgcgcaggcccctctttgccggttcggccgggggcgctaagtgaggttcttcgccctcgatcgatctggagaatgttcgcgagagagcaagtgcacgagacacgggcgatgtagacaggttcgggccgctgagaagcgtaataccctactcctgtgttctggtggatctgtgtgtgaaggatttacagagagccggagagccagagagttcaggctccagaacccctctcgcctccttttttttctttttttttttctttctctttggtgggcaaggtcctccttttatatctcaaggggatactacatgcaccacttctacctacttttcttctgggtggggacctaccctctcttgaccaaaacttggcttacaccttcgcctggaagctaaatcacaacttgtccttgagtgaggctcagcgccgtctctcgcctgacaccggggatctccctgttaccccctcattaatgggcggagatttgccatggctgctttccaaatgaccatccgacgagatgggtcatacctacctccactccaccggaggcagatgcatcgtgggagcacggttatctgccgatgacgcgaccggcgtcagaccagtcacagatcggtcattcttgtccaccacgtgtcagttcggcatgctacacgtctgcccttcttcatacaatgacttccttgcaatggttgcgatgaagcctggaatgtatctggccggggctgacatgccaactccaggagttcccacgccggctccggctagggacgagtgcctggaggctctcatcattccgacgggacggggcgaggcgtgtgtcaggccgcctgttgccacctaacccgcgatctgaccggtctgtgaccggtcacacactgtgacctgtcacggaccgaacgagtgtgctgcgctgcattaaatgtggcgtggggcgctcgtccaacccgcaataaacgcggttaggtgagcgccgctgtgctcacctaacccacacacgtggcgccaaacccacagggggtcggggcgccccagccctcggggccgaaacgggagcggcccgacccctcgggaagacagagggaggggcggccacatcaccctcgggcccgacccccccgaggggtcaggccacgtgggtgactgcagctgctccaaacctctagtcaagatacccccggtcccatgtcactgacagtagcccccggcgttacgccagggcgatcgcccccccccccccgagggaagcgctcgggcatgacgccactccttagacctggtgacaggtggggccggtctccacaggcggcagaaacccagcggtcgcaaatcgcgcacatcgtcaaggaaaaaaccgaccgataataatgagcggcttccttcaagaccactacattacttaagtagcgcgcgaaccgggacgagccggttcgtttcgtctggagatgtgatgacggtgcatcggtcggcgagcgtagttaacgcgcgcacgattagtcccatctcaactgccacggccgcacatccgcctcgtgcgccgcaaacgggcgagcgggattagtggaggcgcgggcgcgagagacgagggggcgaggtagtgggcgcggggatcgaggagccgggcatagcgttggcaagggtactaagacatcaaggaagggacttgtttccttcctctcgtcactcttccctttgcctttgccacttgtgctctgactctccatttccggcgccctacccttgccatactcgctcg

SEQ ID NO: 29578 - DNA, 917 bp, Oryza sativa
cgcccggcgccgcattacctggggcggtccgtcttcttcctctctttcgcaatggcagggctggtcccgccattctcttctttcttcatggatgttctggagctttatgatctccagatggcgcacctcacccccaacgcggtaatgacgttggccatcttcgcgcacctatgcgagatgttcatcggggtgcgcccatctctccggctgttccggtggttcttcaccgtacagccggtgtcgccaccgtcggtagtcggtggctgctacttccagccgcgggggccggtgctgaaccgctacattccctgcgtccttcgcaagaagtaggacgactggaagagcgactggttctacacccctctcgccgacgaagcgcgcctccgacttccgagccagcccccggcgcaggcctccagctggcgggcgccggtagatctgggagatggctacgacgccgttcttgaccgcctggcgggtctgcgatcccaggggctcacgggggccatggtgttcggcgactaccttcgtcgccggatcgcgccactccagcggcgcgcccggggcgcctgggagtacaccgggtccgaggactacatgaggacccaccaggggggcagatgggactgggcccctgaggatttcaagatggtggtccaacgggtgctgaatctcagctccgtggaggcatccctcatcccccaaggtgtcctctccctctgcagcgatccagagcgcgccaacatcctgaccatcatgcaagcggtcggggcgtcaggggagcgggctcctcgaggccacgatggcgcgggcgggagccgcaggggggaacaatctaccccgggagggggtcgtgcttctgggccccgtgatgggggcccggggggcagccgccctgccgacgcccgggggaagag

SEQ ID NO: 29579 - DNA, 567 bp, Oryza sativa
gaggccacccacgacgaggccgcgggcgcgccgctcggacccgacccttcgggcgacgttcgggacgagccagcctcgggggacgcccctgagtccggcacgtcgattggcgggccgagccgcacagcgcccacaccaaggcagctctcccctctgccttccaccgccccactgaacacagagcccctcctgcaggccctggccgccgcgaacacgacggtgctggacgggttaggtgcccagatggaggtcctgcaagcagagcgggcggaactcgacgcggcgtgggcgcgcgtcgaagaggggcggcgctcggtggaggccatggtggaggcgggccgcaaggcataccgccggcacgcctcagagctcgaggcccgtcggtgggagctggcggagatcgccagggaggtggaggaggagcgggagactgccctcatcgccaccgccgtgctcaacgaggcgcgggacgatctccgccttcaatacgggagccgggtggcggagctagagaagaaactcgacgccgcccggggagtccttgacgccgccactgcacgggaacgg

SEQ ID NO: 29580 - DNA, 819 bp, Oryza sativa
gcgcccaagtgaagaagcggacttgcacgcggtacagcgaggggacgatgagtctcttcgctcgtacattcagcggttttgtcaagtccgcaacaccataccgtgcatccctgcacacgcggtgatctacgcgttcagggggggcgtgcgccacaaccgcatgctcgagaagatcgcctccaaggagccccagaccaccgcggagctttttcagctcgcggaccgtgtggctcgcaaggaggaggcctggacctggaactcctccggttccggtgtggcagcttcggccgcccccggatccgccgctcggtcagggcgacgggacaggaggaggaagaagaggtcggcccattccgacgacgagggtcacgtcctcgccgtcgagggcgctttgcgggccacccgaaaggggaggcctgcgagcgacaaaaagaaggaggccggcgctcctagcagggagcgcccgaccggcaagtggtgcaccgtgcacaacacctccctccacgacctcgcggactgccgcgcggtcaaaagtttggctgagcggacgaggaagtgggaggaggagaggaggcaggagcgccgtgagggcaataccccggcggctcccgccggcaaccggcgaggtgaggccaagcagaaggcccccgccgaggacatcaacgatggcgacgatgacctagggttccaggagcctgaggccactgtcgccaccgttgatgggggagcgcgtgctcacgcttctcgccggagcctcaaggccatgaagcgagagcttctggccgtggcccctacccatgaggcgacgcggcgggcgcg

SEQ ID NO: 29581 - DNA, 310 bp, Oryza sativa
cgtcgctcgggtctttctccgccgtctccacccgctcgggaccgccgcgaatcgtcgcccacctcgccgtcccctatctccaccgcaagaacaccgtcggcagcctcggcggtctactctgcgccggtctcctccgcgtcatctcctcgctcgtgccgcctctgccatcccctccgttcagcaccccccctcctccccccgtcttcccttccgtccttccgtccatccagcgcgctggcgatcctccacccagggcctggcgtcccatcgatgatttagggcgtcgcggtcctccgttcagggcaccacc

SEQ ID NO: 29582 - DNA, 844 bp, Oryza sativa
ttctgtgccgacgacctcggggtcagagggcgacaggcgcggccttcccgcagtggccccggggccatcctggggtcgggggcgcctggcaccgtcggacaagcgggcagagggccagctccgatcgttgggggcctcgggccaccgttcggctcgggggcctctcctccctgctctctcccgggtcgagtcgacacagggtggggatgcgcggagcgagggtcgtcctcgtcgcgctccacgaccaacgctgcgctgaccacctgcggagttgccgccaggtagagtagcaacggctcatctggctccgggacgaccaggactgggggagaactgaggtacgccttcaactgagtgagggcccattcagcctcctccgtccagataaacggcccagagcgtttgaggagcttaaataggggtagcgccttctctcccagcctcgatatgaaccgacttagggcggccatacagccagtgacgcattgcacatccctaagcttgctgggggggcgcatccgctctatagctcgtatcttctcggggttggcctcaatgcctcgggcagagatcaagaacccgagaagcttgcccgcaggcacgccgaacacgcacttgtcggggttcagctttatgcgggcggtgcggagactttcgaaagtttccgctagatccgagagtaaggtctcctggttgtgtgttttcacaaccaagtcatcaacataggcctcaacattacgtcctatttggctacccaaagaaattcgagtagtacgttgaaaagtaggacctgcattctttaacccgacaggcattatcgtataacaatagggctgcaggaatt

SEQ ID NO: 29583 - DNA, 903 bp, Oryza sativa
ccgctttcagcgagattccgtcgcgcccccctcgccattccaagtccggccagtctgaggccgaggagacagcgaccgcggaggcccggaggcgggaagctgtccggcgagaagccgcggaccgcctccgggaagctgaggaggctgcccaggaagccgtccgggttcgccaggctgaggaggccgctcaggaggaggccagactccgccgggccgggaagtcagcccggaggcagaggcgacacgcgcacgccaggcggcctgccaagcccccgacccgactccgcccgaggcaacgacgacttccgaggccacccacgacgaggccgcgggcgcgccgctcggacccgacccttcgggcgacgttcgggacgagccagcctcgggggacgcccctgagtccggcacgtcgattggcgggccgagccgcacagcgcccacaccaaggcagctctcccctctgccttccaccgccccactgaacacagagcccctcctgcaggccctggccgccgcgaacacgacggtgctggacgggttaggtgcccagatggaggtcctgcaagcagagcgggcggagctcgacgcggcgtgggcgcgcgtcgaagaggggcggcgctcggtggaggccatggtggaggcgggccgcaaggcataccgccggcacgcctcagagctcgaggcccgtcggagggagctggcggagatcgccaggaggtggaggaggagcgggagactgccctcatcgccaccgccgtgctcaacgaggcgcgggacgatctccgccttcaacacgggagccgggtggcggagctagagaagaaactcgacgccgcccggggagtccttgacgccgccactgctcgggaacggcgggcgacggagaacgaggcggcgtcccgg

SEQ ID NO: 29584 - DNA, 233 bp, Oryza sativa
gggagcgcggtgaccgagggttatggggacccgattgtgggcctttgccgattcccccccggagttcaccacgccccggggcacggctcggttctgggccccgtttggcgatttccgccggcccgggccaccgagggcagggtcgagcacgagcgtgctaattcaagccaagactcttcaaaggaaacaatggcacagacacagtccttaggaaatcgaaaaagcttttattg

SEQ ID NO: 29585 - DNA, 4382 bp, Oryza sativa
gtaaaaaacagatcgagctaccaaatgtcaaactaaaccacctgaactagcgaggaaacaacgcatcgaatgctggtcatacgagtgaaaaaataactggaggcgatgctagaaaacctgctccaggttgcaatatttgtttttctggggttgtacggactaagctgatcagctcatgtgaagggcttcttcctcgacttctgtcaggacatcgtcctcgaagaacgcctggtggagggcctttatgcactgctttgcctcgctatcatgaacaatcagagacatgttaacctgttgaaggcggcaacattgatatcaggaaccaggacatggatacagcgttgtcaagtgtgagaacagtcttatcaaggactaccttggatgcaccttgcgagatcatctggacattcaccccgcttttcctcaacacttgaaaggccttcaagaccagatgtgtaggtgtgttcagtgtgagtattgcggctatcctatggaaagaattaggtatgcgcagaaaatcataccttttccagtataagagatgatcgccgtacgtttccaatgagtgatattattgccctctgctgaagtagatggacaactgcaattttctcaagctcttcaactacatggtcaagttcctggaaatttggcaacaaagcgaacaagactgagaaggcaatgatcagagcagaatgattctgagaatagctacatgccacaaaactatggggaagctaacatttttactacctatatatgccacctttagagaatgagcagtccaagtgcactaatgaacatttaccatcacaaaataccatagtaagttccatatttatcactaacatgcaattagaacctaaaatggtcaaagttgcggactggagaccgtgttgatgtccaaaacaacacctaactagaaactgagggagtatcttttataaggcaacagccaatataaacaaataataagctcattttttgcaattatatagagttagttttaccttgaaagaatgtactagtttggtcagaagtaccggcatacagtattacaactacttgattttgcatgtagataggtgcacttgcctgttgaataagttccctgctccagatctttgatggatcaagcgacacagaaatactaacttcactagtagccacacaatctacagatatccctagatcttcgaatatagagaagaccttctcaagcgcatacagagagcgatcagaataatgacatgtgaattaaaattactggaccaattgctgaacatacctttgccagaaaaccaaattgaccaagcatccgagtgcttactatatccaacatagtgacatttgacttgagcactatgctagttagcacaacctatccagagaaaaataaagaacaatagaaataaaatccatggcccgagagttgaatggtactgatgtgagaacatgttttaattaatctgctacagaccttatccatctctctttgtttagtgatcagggtgcctggagctttagggttgtacgaattcttaaccctgactggtatatcaccttctctagcaggtctcatagattgtggatgtaatacctatcatggagcacaacaatgcattactatcaactaaaagttctcttttctaaacgtgcgaagagcaacttaaattgacatagtgagcaaacccttatcactttgcactttgcatatatagcatttactttgcagtttgcacttcgcacaaatattttcatttacatctaactgtgaagagcgtaagccattcatgctccaaatgaatacatacctgggcaccaaaataagcaagttctgctgcctcttcaaatgttaagtatggcacagtggttgcattcgggtagatatttggatcacaggtcagtacaccatcaacatctttccatacctatgacaggcagtggtatgctttcagacaaagtaggtagtgactttctgctccactaagctaatcagcatgataaacaaattaaaatagcaaactgtaggctctaatttttgtttgtgaagagcaaaattatatttagacttcaccatggacctgaatttctctcaaccccagggctttaccaatggttgtagcagtcaagtcactgccacctcggcctaaagtggttacagcgcctgatttccagccctgcaagtgatgacgattgacttctaaaagaaaaggtaataacaattacaatgaactaatagtttgcttcataatgaataccctctggtgagaataccttcccaaggaacccagtaacaataggtatcgctggatcacgaatccagtctccatgtaatctcttcgcaacagcaggataagttgcctccaagatgtccgcgtttccgaaatcgtctgttgttatgaaaccaatatcaaatgcgtcgtactgcaaaagcattggcaaatacaatttaaaaccaacaaaatttcacattacgattcacaacacgtatagctgaaatttgatctacagggaatttagaaagctgctaacgttaggggaaggaatcacagatgcaatggaggatctaataccgaaaagtgaaacacagacagacagtgagatacaactaacaggcatgagtttagaaaatgtgaggaaaaaaaaacagcttcagaggctatcaccaaactttcaatacttccttccatagtaattaaatacttatatgcttgcaaattcatgcagattgataaaatcacatgctctgaagaacaatggttcactgcgtagacaaagaatatgcaaagaagtacctgccgtgcttttactccgattttgttcaaataagcagcaaaaatccgtgtagacatgcactccccaaatgaaacaaggtagtcagtggtccgaagtgtcagctctttcatcattgcaatacctttcaagagctgctccagttcatccagcatagctatgagttccattcacagggagccataagattattgcattaatggaacgaaatctagaagatgttattatggtagtggagttactgtgtattacagatcttggcagtgcaagttcctccacagttctggattgatagcaaagaaaccatcaagtgaaattagaaaacagtttgaccagtaaactgtttgaaaagtagactcacttaatgtgtagatctttgatcaaattccactcttcaatttccgaaacacggatcacgccgcatcccactgccttctcaccagcctacaaggatcacagtaacatgtgttcaagacttcaaagtagtagtgctaaacaagtaaagattctttaagtcgctctgcgctcgaatatctcggctacaatgcaacaatgaattctgaaggaaggtttgccgttaaccaaattttcatttacttacagctaaagctactgtgtactatcgtccagagagcctatatatatagtcaatgttgagacactgcaatagcaaatgatggatagaaatgaagctttcacctagcaactctaatgtccacatattcctggtcagttgcgatcatcattatggcagtagaggtgcaaaattcacttcatctaacactacccagtgattacattgaaatgaatgctcatggattcaggaaaaacttggtaaagcagacacatattacagagaggcatatctatagcctagaggaggaggaggggaattggaaggcggaaacagtacgaggaggaggagattggtggtcttccccatggcggagaggacgacgacggggcgctcctcggggaaggcgaggatgaggcccgccacctcccgcatcctcgccgccgacgacaccgacgaccccccgaacttcatcaccacgctcagctggtccccacctcccaccccgatcccacctagggtttccgccgcggcggcggcggcgcccactcccttggcccgacagcgagcggagtcatcggcggccgccgccgccacctccagtctcccgcctccgccgcggcggcggcggcagcgagccctgcccaggacaccgatacgagctgctcctcctcctcctcgtcgtcctccatctcccgcgccgccgatcgccggaggggccggcgagacgaggcggaggcggagcggcgcggccgctaatcggagagcgatcgccattctcctctcctctgcagtttggtagagtgagagagggagaggggagctcactgtactgggtagcgtgaaggcggtttttcggttttacgtaacaggactctaaaggcggaaaacgtaattgcgagagttcgcatggatggagaacggtgagaggccctccctgtgctcttcccccttctttcctaactgacatccatcattttccacgcgcacattttttaagctgctaaacgat

SEQ ID NO: 29586 - DNA, 7658 bp, Oryza sativa
aaaaaaaaatactccgtctggtcatagatatttaatgtttaaaacaaaaactcggtcaatcttacagaagaataataagtatatgatttcaaaagaaaagaaagagaaaggaataagtttatggtactactatgatagtgtactaacttttaagaaaaatcttgaaataccattttttttagtttttaaactatttaaactaagtacgtacttgaaaagttattgatggttaaagttttaaaaatgtttgaccgaatcttatttaaaacgtgaaatatttatgaccgaacatgatttttctactgattttgagcataagttaatgctgcatttcaaatctggatttggtccgggaggctgatggcaggaggcaacaactgctccaacctgcatgtctgcatcctgctttgccaggttgggggacagggatcactgaaccagcacagggaagcagccaatccaatccaatccaatccaaccaaatccctaactaatctcttcatttgtgtaatgtattagccagatgtgcatatgagcaaatcaaatctagtatgaatctagtatctatcacctcagcgttgcacataggcatgattcagctggcaatggcttcctcactgtctgcaaaaaacagtttgcataaataataagaggccagagaattcaattgtgttggatcaaggaccagactgcctgcccgctgatcagtgacaaaatcattgttggattcagaagaggctgaatctcttgtgcataagcttctttattgtgcatcaagctgtgtgtgtctgcatgatcgatgtcatggaattcattcaaaagacactgggttcatattctcatcatgataatggacatggtttcaatggacaaagatcctattacatcacaaacaacattcagaaaaaaaaacgacaacagaaagaaagaaacccagttacatcatcatcatcacacatgtctctagatggcgagcctcatctcatcagttctcctagataaacagcatatatgccatacttactataactttttgataaaccagatcatctgatgcaaatgatcactgatcaaatcccagtgcattggtcttgactgctttctgacttgctgattacattgcgttctgaaggccagcagagtgcaggagcacggtcttaatttcttcaggcccgagtccaggaccatccctgcattgctggcaaaacagaagtacagagcaagcattaagagagtgaacaacaacggtaggatcagatcgaacacaactgaaaaaaaaccctcagctggaggagaaaaatattatgatgtggagaatgcaaacctcggcgcggaaaacatccattgcaaacccattgaaacagctgatgaccgcctgctcgatcccgaggccaaggctgtcgagagccctcaatgtggacatcagaatgccgggcctgcgtgcgcagaacatgtggatattgactgcatgaccttccctcatcctaacttcgacctgaacaaacaagagaggtgaatgtcacttggttgctatacaccatattgttaccgctacatgaatcaacaaggcctgaatgatcaagtacttgtgcagactgcaaagtgcaagtaccgcgaaataagtaatattccctccgttccaaaatataagcatttcttgtccagatacatagcaagaattgcttatattttgaaacaaaaggagtagctcccaagtgcgttaatcttgagcactaaagcatgcttaagcatataagtatcaagggccaattgcataattgccactagtgcaaaggcttaacaatcatggtcaaaatttgactaaccgtggcttgttgaccactagggcttggaaatgaggttgggcaaagttcctccttaacgcggccaggaaacgtctgcaatgtgggtgttgatgggtggaagctagccgatgatggtccagtaagcgaagagctaggagcagactcaagttcattgtgaagatcgttaatcctctgcaggagctccttcaagtactcaattgcatcaccaaggatagaagctctgtccatctgtcacaaaggagaagaaaactggtaatgagatgataaactatagatattaacatgaaacgagtcagacatagttggcattaagaacactttgacataaattgttttgtactgctacactaaaaaacggcacatcgtacatggcgctgaattgttagactgcaacttgtcataatatcccaagaactgtagtacatcaggtctttctttattgttcaaaaccatcttgatcgctgtgaaggaaagtagtaagttcttcacacgaaaggactgcagagaactgaatatgcacttcgcatgccgaaacttccaaagtgaacgacttttttcaaggaaaccaacaaaagttaaagacaaaacatccaacacgaagaactacaaaaaaaaaacagaaagaaaagggggaaaagaatttgtgagttatctggtatctggtcactttcaactacatcttgtgcatggcactgtgttaatcatgcatcactaaatctggccatggatcagaatcaaagttccccataatatgtgtaatctcaagctacgacaaattataaagtcctagaaaaaagacattgaagtataatttcagaactgaaattaccataactgaactgtaaaacaaccatccagcaagctgaataggaactcctcatgttaccatgtgaacatgacaaggtatgacatagatctaatgaaaaaaggatgtttttttggatctgaagtggagccaattcaagaattcagcaccaaaattggaaccaatttcagtgacaaatatcatgacaaacacactcctacaggacctacaccagtatacatcactcaagaactgaaacatgttgccaaaactgaaattagaaaagtagaaatagaaaatgctgattaatttaattaataagatacagtctagtagaaactggagctgctgattaattaaataattagcaatgaacagtgaaaaaatagaaatgaggtcattaatcaccttgctgatcttgggcaccacggagcgcagcatgtagaggcggtcgttgagcttcttcctgcgccgccgctccgccatgaggttcttggccggcatccccttcttcttgcccctcccaccgccgccgccaccgccgccgcctcctccggccgccacgggcgcggcattctccagcgaggccgagacacccatggacgaggcgtccacgctctgctcgatctcgtcgtcgtcgtcccaccccatcccgccgccgaacgcgccgccggggggccccaggaacccgagcttctgccccggcggcgcgaggaacgggggcggcgcgtcgtcgaacgggttggaggaggcgaagtcgtggaacggcgggagcgccgccgtcgtcgtgggcggcggcggcgggacggaggacgacgggaaggccgcctggaagtcgaacatggccgcggcggtggccgcgtccatgttgaggagcagcgacgacggggtcgacgccgagagcacgtcgcggtggtggtggtggtggtggtggtggaacgggaacgccgtgaacgacgccgccgccagcgcgtccgccgcgaggtacgaccagtcgccgccgcctcctcctcctcctcccgccagctcgtccatcttcgccgccgccgccgccgcctccgcctcgtccatggcaacctcgccgccgcttcttgctcgcctccttgcctcgcagcgctctgagaagagaagagaagagaagaggagtccgagtagagacgccattgctgctgcttcttataggagaggagaaagaagcagccttgagccgatgtgcttaattacatttatacctaattaattaatttaattagttaaaccaaaacttgcttaactttttcttaaaaaaggactaatacttacaaggttaattagctttttttttggtctgacaaaaataaggttaacattacaagattagcctatgatatgactatgatgacactatgttttttttaatagagatatacatgcatggccagcttgttcagtttgtgtcacgctagctacaaaacatctctgggtttaattgcagaaaaaaaaaggacgactttttttaggttgtttaacactttggtttttggtaattgcatctttctgttcgttgcagacgtgaaacagacaaatctgacaagatagtacaagggctatacgggaggtgttttaattggaaacagtgttgttctatttccttgctttataattttttttacaagattcataattgtaaaaagctgtgatattctgcgtatttacttcttttatgcagtgttttgctgcaatgttgaaacaaaaactgttgcaccggggtagagacggcaggaggcgaggaggggcttggtctcccaaatggcttcgaatttttacggcaataggtttcgcaaattttcaaaaaagtaacactttggccttcttcaatcaaaaaatttttaaagtgtttttggctccgcctttgcacctaataatttacaaaattctaaaatgtaaaaagctgtctttatattattttcatgttattgtttttttttataaatttgtttttatgcagtgttgtgctgccatgtttgaaacaaaaaactgctccacctaatcattcacaaaaattctaaaatgtaaaaatctgtgatattctgtatattattgtttttataatttttttatgcagtgttgtgccgccatgctgaaacaaaaactgttgcacctaatgaaagaacaaatgacctggcagacatgtctcttgaagcttagatggatcaaaagggccaaaaagaaagatgttttttttctaattgatacgaagaacctgcagggaggtgtacacgtgtaaggctgcctactgcacccagtagccaaaagttgccttctgtttctaatctttggatggtctcacaaaaacagatgcttatctactggtaccttgtggacatatgtaaaaactgtctttagccaacagatttgtcagttgctttagctcattggtcaattttattctatttcagctttccaagtatactaaagtttaggacgatatatggactttagcttaaatataacacggcattgaggaaaacctgcatataatctattagcaatatgtaggataactgaaacgtagcatcttatctaaatggatcagccatatgatgtgtattggatgcattgtatttgtatctaacgtggtgagtcaatcattcagatattttagaaacctgtaaaattttcacttagaacacatgtggttattaaaaaattgaaaaggagggagaagagagataaaaaaaaaaagaagagggaatgatcattctattcacggtttgagaatgagaggagggtacatgattacattgctgctcaacacacctcgagagtgtgcaatgcaacatgcccaattacaagttctcccaagcatcttgtgaccctgccggagatgagccaagaaaatcataggatggaacacaatggaatagaattgaaggagaaaactgtgggcaaaaaaaaaaaaaagtatgccctgcccactacactagggctagggatcacatgagttcctgtaaagagagagagagagagagagagaaatttggttgctcttgccattcgctggtctaaattgtcatggtcaatttttacactataactattatcacaagttggcacgctaatacaagagtgctgaacaaataaagggcaagaatttttaaaaacaaagatctgaacattagagaagggagtgctaactagtgctagcttggatataagtttcaagttaaacacatatatgtgcacaaatagaaagacaagttcaaagacctttgtctgttcacctgacatttaacgttgacaatgtttgcatcttcatgtatgcctctaccatcgacgcctatgtcctaatttgatgcctcgacatctcaacatgtcatagatcaccatatcaccacaacaataattgataattttgcatcttagatctcatagtatatccaatagatacagtcggtagtagccaacctcaacgcttccaagagtcgatgcgccatcaccatctatatatatggtctattgtcatcactagaattcgaaacaaccatcgtaccgctagctggtgaaactaaccactggttgtgaccatggataggggatgacagtgctattgagtttgttgagtatgggagaggaacaagagaggggagagcagatataggctaatgacaagaggaattatctatttatagactaatttttgggtgggctatacgttagaggtgaagcagtgcaaaacaagaggaatgagataaaaaacttactgcgtatgtgacgtaatatatagtagtgaggtggaaaacatagacactcatagtcatgcgctatgggcatctatcttgtggctacacattatgcttgtgcagaagcccccttctgtttccaatgagtttgattactaattgttgcaaatcagaagatggtaaaaaaatatatagatgatgtgatgtatttgttgagggttggagataaatatgaaagcgtggagtacgtgtcaagatagagtgagtagtaaatgcataatgaaaaagaaagaaagaaagaaaacttagggcactatatcactgtatccgatgcaataaggtaatggattgaaaaacttaaccgctattttttttcgtacacattttatggccacccacatattatgttggtgtagaagttacatgtctatatccaaaccctgtccatgtggaactaatgttgatcatagtgttataaggggacaacctctaacaagccaatggtgttttttaccctattgtaagaacacttctagatccccttaaacacatcttgttatatactactacctccgtccttaatataagggattttgcgtatggagttgcataggtaaaatcccctatattataaaatgtaggtagtaatttggaacggtgagagtaagtgtttgtcaagcgtactataaaaaaaatccaatgtttttgtgtggaattcataaaatcgtgtcaacatccatcgcaggaacataagtcccatcttggtagttctcattccgtcccaaaaaaaacacttaacgtaggataggatgtcacatataacaaagaatccagataagcttcaatttgttcagatttattatcctatattaagctttttttttgagggggtacatgtctttgctgacaggtcaattgtagctctctactagatctgattacatcgaacccttgattttgagaggccacttgtatatcatcaacttgcagttccaggtgctgcagcatacttacaactctaccgtccattcataaatttgtcattatttttgttgaaattaaatcaacatcaacacaaagtgtagggtgagatgaggccagtgtcatcaagaggggaaaaaaagctggattctatttcagcgtggctccaaaacacatctttattttttcatgcaagctagaaaactgagaaacaattaattcaatagcaaaatataactcatgcaagctagaaaggatatgggctaatctgaaccgtcaagataccatctagggatatcaaaaataagtgatgatgtgcctttt

SEQ ID NO: 29587 - DNA, 2090 bp, Oryza sativa
aataacaaaaaaaaaaactacgcgtattgcgatgagctaccaaactagttggggctagaaagtgccacactagtagcaatacccaaccgtatgcgatggagacggcacgacaacgaggcttaattttttagcgtgtaggcgagggaatgagcgagcgagaatgcgtccatgaccatggatgatcgatcgatctgaatcggatgaatgaatgaatgaatgcaagagctgaaagggagtgaagaataaataagagcaaagcaaagggaaaagggggagcggccacacaaccaggcttcccgtgacagctctaaacccaaacccatttttttttgacctcctcccttgccaaagaggtgattaattccagcgcccgtactgtgtgcttgctgtcatctacgcagccgcagccaccaatcaccgccggccgacgcgccgcccgacgccgggtgccctactctccatgcaaccggcctgtccctgacaaatattacaacagaaacagagcacaggttttcagccatatatagtagtaacataattatcaactactactacctccgttttatattataagactttctagcattgctcacattcgtatagatgttaatgaatctagacactcattaacatttatataaatgtggacaatgctagaaggtcttataacctgaaacggaggaaatattattaaggaggagaccatgagataccaaaatttttagcgtaaaatttgatacctgagatactttctcatagtaccttttgaaggaccgtacaatcactctaagattgcagcaatcctttttgaatatttgttatgaaatcggaggaaaaatattattatggttttcttgcatgtggtgtccgtgcaggacaaatttgatttagggttttgtctgctgttgcgacctggaaactggaatgcatgtgacgagcgaaaaggatggagactggagaggaccagagttttggttacctgccttgatcgatgtggtagacaaccaagggcagaagccagacaagtcgcattcccgtctgaagctaccctctgaccctgcaacaaacggagcagaaagtcagaaaaccatgtatgaatatgagcacaaaaaatatcgcgtaatagagagccacttacgtacggtagaataaaaaggttaatgagtaaagcaacctgtaactccagataaccaagtaggaacaagacagcaaatccgcaatgaagacttgtaagttgtaacatcttagagtgaagcaaaaaaacagttacttcctccgtttcatattataagactttctagcattacccacattcatatatatgtttaatgaatctagacatatatgtgtgcctagattcactaatatctatatgaatatggacaatgctagaaagtattataacctgaaatggagggagtacaagtttcaatcccaattgcaccaaacataagagtggcagactaccagaaagaatcatcacttatgatttgctcatttgtcgcaggaagcatagcttcctctctgtatattttactgaataacaggcagtacacatgtggtgtaatcacaaattcacaaattggatgaagtgagatcaccatcatattgccaggacaaaacaattacacatttcacaaaaatatttcgacaaaagataaatggctcgcacatgcactacacaatatctctggacaagcccataatatcgctcaacacccgaagactgcccattgctcaacacccgaagattgcagcaccattcagggatccaatgatggcaatggcccaagaccagccgcgaaaaagcatttccattctccaaaattggaataatcatgtaccataaacaaccttgagatgtgcctagtgattctcaattgccgatgaatcttcatcgatatctgcacgtgatccttcccacagttgctgctctatgcccagtttcctgagctctgttagacctcgctccactgcagataacaaaactaacagtgctcagtaaagcaaaaaactgaaaatgatggcattcttggataggagaaaaaatggatgaggtgtgtaaatctaggtaaaaacaattggaaaaa

SEQ ID NO: 29588 - DNA, 1570 bp, Oryza sativa
ctgcgccccaatgctaggttattttttcaacaaggaaagttgcttattaccatctatagcatcatgagaagttgggctactgcattgcgaccaatccagaactgaagccgttcttcagcaatgtcttcctcaatgccatgagttttagctcttctccagaagtatataagccatgcctgcattcaatatatattccataaatcacacgtaataaatggatgaatttgatagttcacatcgctgaaaggtttacctgcttaaagctaacatcttctgcctcttcatggctaagatctgcaataggtcaaaaagttcaaatttaatttaaactcatagaaacaggatgaaatgtttacatacaacacaagctcaagctgttagtggaagttttgcataaatctattagacaaagggaagaaccattaccaaacgcctccaagaatttaggttcaccaggtgatttaaaatctgcataagagaagaatttatacctttcttagtttttttttatgagtgaaggcagcaccaatgaagaaatcatattacgcatgtaagttaaacaagaatgatatgaaatgataaaagaagtgcaaacctgatgtgaattgccgaactatactaggtctccggtgttgaccaagtgcaaccacaacagcatcttccacctacagaacaataactagtgaggagagaagtgataaggaagcctagaaaaaaaaacctgtatttataaagcacatatggtttgtcacttgtccaaacatgcaaatatactcagtacaaaaagaatgattacttagtgctctattacagtggaagtaaggtaaagcctggcaaatactgttcacacttccgtatttcagagaacactccataaaaaaaaactctagaggatattagaagaattactgttgtgccatttttgctgtaaatgttcgtctctgcattagaatgagtacaagtactgtgtctggaatttcatctctgagaatctatagaacagaaagttaataaaccactgccaataaaagggcagtggaataccttcaatgatgaaagctctctaagccccatttcaactgagagcatgctctctatattgccttctcccattacatcactcatatctcgcacaagtttatttctcctttgggcgtcatcctcacctgcttgaaaagatccaagaataattaactggagtacatggaacaaactacgatctacaacttgtatattataaagatgcagacatgccttgtttgagaggttcctccttagccttttgaccagcagagagaacaacctcaaggggaagaggagctaatgatgaccaatgttcatgctttgataccgcaatctcgggataaactccttcaagttattaatgggccatcacataaatcacggacagggaaaaagttaacagtacatttcaacatcatgtgcaaactacaattaagcattttcgagaccagaccagggtcacaactagttactttcaggccccctaagccctaatctaagtgacacctagccatatacatagtcaggatggagtatggactgtttg

SEQ ID NO: 29589 - DNA, 7272 bp, Oryza sativa
  unsure (1)..(7272): unsure at all n locations
agatcattctctgagtcatggaccggagggcctttgtgtcagtctctgcttcctttagctgctccatagctgttacaacctcttctttggcacactattcaaagcatgagaagaaaacatggtcaaataaaacaccatatacaaaccaacactacttccatattttgattggtaggaagtatatttacatccagttcatgctttagtgttgtcacttccccatctttaccatcttttgattcccttgcagccttcagtgcagcctgtagacaaaaagcattatataaagtgttcgttgatgggtaagaaatatcctctttatttttctggtaaaattggaaggtatgtactccagcatatccttcaggttcagattttttttttacaataagaacctagcatgactatagtaccgcatgtgcatttcaagacaaataaagcagaaaaaagatcaaatgaaattccaaaatgtttcatccttttgttttcacaacaagaaaaacactaaaattctaacacttccaaattttacatataaattctaagataaaaaaaacagtactacaagattggcatgccagctatccataggtaaaacacaagaagaaaaactaacctccctctgtttaagggcagcttctttcctgccaataatcatgacaatgttaggttatgagtctatgatcagttctgaatttgtgaaacatgcatatccaaacatgatgcaaacctgctcaagaggcgagcttctaatgataccccttccccaagggcagctacctgcatatcaacaaatataaccttagctaaccaaagatacaaaatgctcagtgtaatgaacacctcctcaagtaaaggagaatattcgttccaataattcaaattcaagtttaaattgtagtgaaaaattcccgccaaaagaaaaactgtagtgagaactagagatagactcaatgtctagtgcacatgtccaatttatcataatacaaaaaaaaagataaaacaatgtttaatataagattatctcacctgtttctcaagctccttggctctagcttctgcttcttcacatctttcttcagcaagtcgtagctgtcaatcaagattcagaaaataatttgttaaagatcagtataaaatcaagtactagattgcctataaaacagctctatggttgctatttcaccttttctagaacactctcattctcctcttgtagtatatcaagctgtaggacagcattgcattagtcttaaaaacatctgataaacactcctcaaaaagttctaggtcaaagttcgtgacagaaccatgagctaaaatatattatacgtataactagtttatagagaataaggaaaacctcatcttgaagtgcagacgcctccctttttggtgttgattctctggagttgagatgccctgtatcaaacctgaggcaaaaaaaaaaagtaaataacttacctgatgcctatttttaggaacatttgaaaaaatgggaaaaagaaattcaagctataagaagtggccagatggtcataatgtgattattccaaaactttaatgcaacaagcaatgtggtgcccctagtaacatacttaaaagagaaaagggtgcgtttagcatggtggacgactaaagggcactttattttactaatcctagatatattaactagtcagcaagtaaacgtgcttgtagcatgatggtaaataccttccagtgggaagctaacgaccagggttcaaatcttggtcttgcaccaaaaaaggtcactcgctggttctaccaaaacaaggttaggaattgatctatcgtccttgtgtagggggcaagagcctcaaagcatggattaaggcccgatccatagggggcggctccccatgtaggaggaccagcttttgtggcctttctggggcctcggtttcaggtgcttcttcttaattgaaatacctcaggggagatctttccccttggggccgaattttttgttattattaataactagtcagcaatgcccttttcagcacaataaaagaaatcatttgctagaataggtaaaaattatgtataatttgatagattctgcggcgcagttcagcaaagcgcggtaataggaaactggccaagaggcacacccacaaccccaagatgctgaccaattgattcaatcaaatatcagatttcacaatttaggtaagcgattaagatttcggacgcataataatttactacccatccttaataagcatgtattattgaactcaaaacttttcaatccattacgcccaagataagagggctctccactataccgaccaaaactgaacacatagtttggcatagggctgttggttcaaccttatgatatcaatgcatctttttttactaacaacgccaccaaccaaatacatccctttatcaagagcagtttagttaatgttgtgaactaccaacatcacttcttctgaaaaacagcgcaagcagtaaaaataactcatttctgctcgatttggtggggttgctagtacaattaaccatgcattcattttaatatatcctaagagaagtagaacttaaggaatgctattttaagtatagaaaacacagagaatgctgcagaccatgcaacagatctggggaatgtcattgacgtaccttttctgccgactgcggtccactggaggctccacagccacaggtggaataggcgatggtgtccgcaatgtcgtgctggttttgatcggtggaaccaccgtggtggtcggccgtgaagcaacggcaggcctcccagctgatgttgagcggacagtaggaggtggctctacaatgttcctacctaactaatgaaaacatgaggagatcaaattagcagaagggcacaggataagcggtgatcaaatcacgaagcagccagaagtcccaatgcattcatcacttctcccaatttttacaattcagaaggcatcgctatagaattggactgacattggcgagatgtaaactagcttcactagcaaattcatctgctcaagcatgcttcagaaccaatttgacttccgattgaccaactatgactcattcgtgcaccgcgacagttcaaaccatcgaaatcctaagttgagacgcagcgggtagcgagatcagcgagagatccgggggaagcagaatttaccgcaggggagggagatctcgcggtgcggccgagcaacgagacgccgttgctgccgtgcgccgcggcggggcgcgcggagccgaacctcgcggggggaggggcgggcgggtggtcattggcgtagtcgtcgtcgtcgtcgtcgtcgtcgcggcccgcggcggccgcggcgctctgtgacgccatgacctgggccagcctcgcggcggccgcccgcgccgcgacgttctgcgtgcggcgcacgttggagacgccgccgcccagccccgcggcggcggaggcggcggaggaggtggaggaggagcggtggtgggacggggagacgccgcccggggaggaggagcccgtgctgctgccgctccgctgccgcccgtagacggggctccccgcgcggaggcggtccatggcggaggcggtggcggcggcggcgctcgccggagggatctgggccgcggcgcggagatggcgaggcgaggttgagaagtgggaaggaggttggaggagagtacgctgctcgcgactccagtagagtttcgctgttttttttttccttctgttttgccttctcgcagtaaaccccctcgtcttctcaatttttaaacaactacgcgtacttgtacatttatgtttgtacgttaggagtacacctagtagtatttgattgatttgtgagtgtttcttggatataataccacatctgttttatattataaattattttaattttttataagtcattttatatttttaacataaataaggaaactatcagagaatatattcaatgttaaatttaataaaaccaatctgatgctataaacaatatttttcctataaattaggtcaaactttaataagttaaaattttagaaattcaaaacgtcttatatatggtatgaaacggaaggattatttgcttttttggataatggggttgatttcattaagtaatgaaattacaacatgcttatgcactttatgtcaatattttcttatataagagaatatattacatgtttactgtaggagaatattccatattctattaagtgatactactattccatacttattacaagataatatttcttttttaattatagcagcaatattctctcttatgccaaatttgtgcgaccatgttctgtttgataaaatatggagaaagacacggtatgatactatagtacttacatacttagctggcacctgtcatgttagaaaaagatccgcaagccggttatctactaagtcatatatttatgtcgtatcttattatactccctccgtttcaaaatgtttgacactgttgactttttagtatgtgtttgaccattcgtcttattcaaaaaatttagtaattatttattcttttcatatcatttgattcattgttaaatatactttcatgtacacatatagttttacatatttcacaaaattttttgaataagacgaatggtcaaacacgtgntaaaaagtcaacggtgtcaaacattttgaaacggagggagtaatttaactggatgagcatgtgcctctggggcctttatgtatgagtatgacgaatcaattattatatatgcacattaaagagataattatatgccaagtaattagcattgatatgtaactatatatggtatagatcaagatttaagtggcatgtattaattaatttccaattgttggtgccctatagctaacttttattgtggttatccactttgttttgcttttaataataagaatcttccatgttcctttcgagtagaagagagtatctgtataccttatggattccattatggaacataacccttattccgcacatttctttccatacattatgtgtcccattttagggtcaattccaatgacaacgctatgcgctagtacatggatgggcttatcttatacggagtatatgattatatgtagaaatcgcacgtcgaaatttcatcatagatgatactacaaaaacagaagaaattaacaaaaagaggcaataataatagtaataaacataaatacctaacaaaacaaatggttgatgtagaaagaaaaaatagagaggacctaggtgtaaaacaaaaacacatctactccgattaaaaagcgaaattccactctgggtgctcgcggacgagagcgatgttctcgctccgtgctggcgcgcatccgatccgatccgctgcggcgggtgagccacgcggggacgcctccatccgccgtccatccacgcggccccacacgatccaacggccagaaacgccacacgcacgggctgctcggtgttcggggcccccgcagcggatcagcggggagcagtggttagttggagaaaatggtgggggcatcaagcccagagagcggagaggacgcaggttaattaccccaccttaattcgcagccacaggtttggttagatctgagatccaacggctacgattcgagagggtagtgtccctcgaaaacttcttgggctctgtaattaattaatctccaaaatcacagttgatctcagggggaaaagaatctgcccatctgggttaactgcagctttcttgatgcagcctgcaggtgcaggcaaaaagcaaccttgttagttcactgttctaattgataaaaacacattaaagatctcatgtcaccttgtacccgagctcagtttttttactttttcatgtgttgaatcgtgattcaaatttatttgcacttagtaaagaataacttctgctgtagcaaagcgtaggtccgttgccggaggcttgggggccaggggtgcaggggcggagcccccgcggtacaaatcgtcatcccttttaggttccaccatatatatatctcttgtaagctgccgtgcggcgttgtaacctcaccctgatacagtgaagatattctgctggctggcgcccgtggttttttttctctcctgctttagaagggttttccacgttaaatcttgtgtcttctgtgattgatctattgtttattgttttttattgtttgtttgcctatcgcgcttcctaacatcatcgaattattaaagattatttgctttatgttttgaaaaatatattttcacaaaaaaaatattgtattgcttagaaaacaagttatctgttaagattatttattaaaatgtttaaaaactttttttaaaaaggagggctaagtccttgcgttgcttggcttggcattcacttccaaataataacccagctggcgaagctggtgatcgatgagatggagctagcaaaataattatgattggcaacgtacgtgcacgcagtacaagctacagccaaggatcacttgattatggggcttttaactatttgacacttttagatttgacaaataactatttaccatccctatctcaatgacatatgggtccacatatgtctatgacatgtgggcccagtgataaaaaagttaattgccacatctaaatatagtaaatggttaaatatctccttgattatacacctgataaatcacagctagggtaggcttcactgccttgcattagcttaggccgagtttagtttcaaattttttcttcaagcttttaacttttttatcccattaaaattttctacacacacaaactttcaacttttctatctatcgtatcgttctaattttgacgtgaactaaaacacgcacttggttaaatttagagtactacgatatacatacgaccatatcgtacgagcattcaaccacgtctcatctatcgatccttgcattcggcatctttcatgtgtgcctagaaaaatactgtaataattgtgtctgtgcaagtgaatcgtacacacacatatagctactctaaattactccctgacaccattgatttttcgaccaacgtttaaccatttgttttattcaaaatttttgtgcaaatatgaaaatatttatatcatgcttaaagaatatttgataacgaatcaagttataataaaataaataataaatacataaatttttgaataatacgaatggtcaaacgttggaaaaaatcaatggtgtcatacattaaaatatggagttagtatcatctttcggcacgttgacataatcagttgaaa

SEQ ID NO: 29590 - DNA, 8623 bp, Oryza sativa
ggatgaacatacagacttctgaaagagtcaaccaggatatatcggttgtcatatatggcatgacccatcaatgcttaactttagcacatggcaaatgctgcatatatagcttaattagtgtgaaacaagtattttaattagcaactagtaaatcagtgtatattactgtatcgatttatcttgtgaagatcgatcgatccggccagagacattggcatggatctgatcgatcgaggtcgaattatatttgcgatctatctatctatcgtcgatggcgccaagaggaagagccaaatgtagccatgtgcgcgtgctgcccgtatatatcaatctatcctcgctagctccttgctatgcatgcgttgccggctatatatatcgaccctgatgatctctcttggcctaatatatatagctatcctagctaatctactctacctaacctagctaattggccggccatgcatgctgcagtagtacgaacgtgccagccttgggaaacaattttagtacctcgtgggatgttccctaacttatattcaaacatgtaaaggcctgcttatttggtgaaataaaaatatttaggtgtcacatcgtacgtttgaccggatatcagaaggggttttcagatacgaatgaaaaaactaatttcataactcgtctggaaaccgcgagacgaatcttttgagcctaattaatccgtcattagcacatccgggttactgtagcacttatggataatcatagactaattaggctcaaaagattcagttacgattttccccctaaatgtgtaattagtttccttaacttatatttattggtccatacatatgtccaaagattcgatgcgatgtttttgggaaaagtttttggggaactaaacagcccctaacaccatcaaatagttatagaaaaaaagaatcctctaatgttaaaatccaactcacacatttataaataatacttcctctgtcataaaatataagtatttttggacttcgatactgtcttcaaaatactatctactttgaccaacaatatctataaaaatagatgtgtcttaaataaaaagagctgcatactatgataatttgtttaacgataaacctagcaacatcaatttacaagattgatttttttattttttctattaatacttaaggttaaaaatatttgatttgtcaatattcaaaaataatgtaaggagtaaataataataataataagacaaatccaacattcacaactgaacttgtcttttgtttttttgtcttctcggtgtgtaaatcgagtttaaataggagtaatagataccatgcacttcaatacttcatattattatattttataaagtttttcactattattttaattaaaataaataaatatgaggagatacccgtcttgagatagcaacatccatgcatgcatgctatagcctgccgatcaagacaggctactagctagaagaagatttttcatctggacatcctttattttgttacatgccatctaagtagtcataaaaaaataaaaattaataacaagaatgattaatatatatacatggtaaaattcaactcctacaagttgtagaaaacaaattaacctgtatccatagtcatatttgttatttttattatattttatataaatcaaaattaaatatgtatatttgtatagtgatatgtgttatattaatctatcttgttaattttataaaaaatattataactattttcaatgatatataagaaatgatgaaatattttcccgtgggttgataacgctttcgcgtgctatagctactacgaaacctttgtcgaaactactggtggcccgtcactcaccgcacatcaatcacacatgaacagcaatctcgatcgctgcctgtctgcctgtctgtctgcatacgactatgccgccatatctgttcatcttcttactgcagcactactgctgcacaggagaaatcaacaacacgattagtgccacagtaccaaatgccgatcgatatctcatagaggttccaaactgcaagatccatcgatcgactaactttcgagcttaactaatgacctgtactcctagatagttagactgacaaaattcagtcgtccacaatggatgatatagccagtcaccgacagaagctgcagtcaatatgtacagaggaacacaacagccacacctggactgtcagcccggcctgaagttccttctgtagccttttttcgcccagcatcagtactgccctgcaaatgggacgcatgtcttcacagcttaatcatcggttaacttgttattaattaatgttaatacttctgcatgtgttgatcaaagcagactgaactaaagcagacacgacatgcatgccactaaccaaatgtatgcaggagtatagtataatgcacacacgacagactgtttatgagtgcaaatgattgcgtgcactgcaaattatttagttttgtcccattggtttatcttgcttgtcagaaaattgccaatcaatctgtgatttgatgtcacacaatcagcagtactactccctctgtcctataatataagggattttaagtttttatttgcaatgtttgaccactcgtcttatttaaatttttttgaaattattaattattttatttgtgatttaatttattatctacagtattttaagcataacttttcggtttttatatttgtaaaaaaaattgaataagacgagtggtcaaacgttgtaagtaaaaactgaaaatctcttatatcgtgggacggagggattagtaaccttcatccttctcctttttgtttaaaggcagtactaatcttcagaggaaaaaggaacagagaagaacagacgaacgtgccatgggctatgcagctatagcctactaataagtctatgactgggccatgtctctcatggaaaggaaaggtggtgccacagggaaaaggggtgatccatttgtgcccatttaaaaggaactcaagatgagtgtcaagattactactcaagctctagtctgtaatgtgagtgagactcctattaggttcaggatatgaagctcttgttccagtgtccctgctgctcatgcttctgcgtcatgaaggcaaagaagaacagcagccaaggcaaggaaggaggaggaggaggaggaagcaaattgcaagggggatcagtcatggtgaaaaactgaaaaccacagaccattagtagcttctgttgatccctgtcttaatttggaccatgtgcatgtccagttagtttcttcggttcatctctgttgctgcagcagtttggtagttagttttcatgtgctgttgattgctgctgccactcatctggccggccactgtcgatctccgatcttgatttttaagtctttatctagattttgttgatgtatctactatagtcaaataaaaaggcatcattatttaccttaattagagttttgtctggatttcatcccttgatttgtttcaagttactaccttgttatcccccctcccccagcgcattggtaaagctgtggttagctctgtatatttcttgtgctaattaaccagttcatggatgaacacttgcagaaaaattactgagcagctaggaggcgtaattaaagtagtgatgttttgtggatcagtttaaagtgttgtcatgctcaattagcagagcaaataggtgaagaaaagtgtgtatgctaattactgaaaggatgcatatgcatgggggacattggagcacgcctgcttaatttctgaaacattgatctgaacaattaaatttctgaaaaaatgatctgaacaacatgaccagatttcacataagtgctttctgtccgtgcatcatggatgccatgactgctattttcttgcccatgatgatctattaatgctgattctaggattcaaaaaaaaaaggattgctcacatacaatatttgcaacaaagaaagtggcacactagcacatataatggcatttggtttgtgcctaatcaagctagcctagtataatcacttcacaattccctatagtacgtagtttttggttacttgtcacaattgtttcttagcttcatggcttacatatggcgcgccaattattttactacacctacgtattttgtcttgatcttaatatactagtataaaacaaacgagtataaccatcacaagtttttccatagcaaacatcttagaaaatatataaacccaacgttaattaatactacattcatattttaatgtacgacgccgttgatttttttatccaacgtttaaccattcgtcttattcaaaaaatttatgtaattatcatttaatttattgtgccttgattcatcatcaaatgttctttaagcatgatataaatattttcatattttcacacaaattttaaataaaacgaatggtaaaacattggtcaaaaactcaataacctcatatattaaaatacggagggagtaattagaaaaaccaagtcctctactaggaatgggctgaggtgacggtccaagcactagacggcccacaggtcggcgcgccttagcccggcccattgatccacgccgcggacctaggtgagacggcccaaacgcggcccgtttaggtttggggtttttggcgtggggagttggggggcaaagcaagcgaagcaaagcagcggcgacacggcggcgatggctgcggcggcgaggaaggggacggcgacgccgctgggcgcggtgttctcgccggaggagacgaggagggccgtggcgcgggttgccgaggccgtcgccgaccgccgcgccgagctcggccgcctccagggcttctccgccgacaacgccgccctcgtctccctcgtccagaggctccccgacgaggtctcccacgacatcatggtaccccgcttccccttctcccttgctcctctctccgatgagcaccatggttgcgtgtaacgatgcatccgcgagccagtttggtgatgatgtttttttttgggtgttcccgtttgcaggttcccttcggtggcgcggcatttttccccggccgtttaatccacacgaatgaactactggtaagggttcccaccgttgggaatcggagcggctatggatttcgattgtgatggttgatttgtctaaatctcagcatgtaatggttgattgtgtctaggtgcttctaggggaggggtactatgtggagagatccgccaagcagaccaccgagatattgcacaggagggggatggagctggaagctcaagtggaagcgatgaaggcaactatctctgaccttgaagctgaggcgaagttcttcgaatcaactgccgccgaggcttctgtaaggctttcttttcttgtgttgtatgtttcgggcaggcagtggtatgttagtgtttaaataagttaaggtggctataaatctgcaatttcattcaatttgcttgaggtcacttgtaagagaaaaaaatgaatagtgttttgcaacaggccatcattgatatctatgaattcctcatttgcagcaccaatattgtactttgccagctaagctgtcacctcaggcttatcttaggtctttggtatcatgtttggatggtcaaactaaaacgcactaggcaagcagtcaagtggtgcttagcgcctgtatactgcataggcagcccaattgcaatcaggaagaatttggcatgtattcagacataccgtgacagatattaaaatagatgctcaatacacactttaattaatccccatttagttcaacagggaacatgaactattactaacccaaaatcaagcaaggtacttatcctgtaagctgtctagtgccctgtgcagcctgcctaggatcacctagcactgccaagggccacctagttcagccattttggcaaaaaaaaaaaaaaaaaggttctgcaggagggggcccttgctcacagagaacttaacatagtattttctggtgttatgtcttatggaattgtgaattgttcacaaattggcgttctctcttcattcttccgttttgagctttgtttctataaagatacttaatctcttttgcttatactggcaggaaggtcttattgaaataagggaagaatatgatgaagatacagaaataaattcatcaacattgggtaaccatttggaactttcttttcattagctactggtgttctgccttttctatcatatttcagattttcagtatctgtttgatctttcgtgaacccatagtatgttgagttgtaatgttaattcctaatatactattgttgtgagtccttatttggtctaatctcctaaattttatcaagttccaagtaatcttgtgcaagttgatcttctggtatttctccctcgttctacatgcaaatgctggctgttgacagcatcatatctattaagtttaacatatataattaaacattacatgaggacatcttgttgtgttgagatatcattatgatactccctacaagtttctcagtaaacattttgaacttgcatctagttggcaagttgcaacgtcttcttaggcatgactagtttctttactctcactcacagatgcttcaagttctgcttcaggcatgccagacaaagacagggaatatactcaaatcatggcaaggttagatgaacttgaaatggaagaaaatgatgctggtagtacttctgaagaagatggagaagatgatgaggatgacgaagatgatgaggaagatgctggaccaagtgaggatgataaggaagatgaggaagaagagaatattctaattgatgacaatgatcatcataatgctagtttgggtgcctcattttctggaagtggtggtaatgatcagagtcatgaaagtgcgcaggtacttgtttctcaaactgatgtgacatgatattgatgttatcttgatttagttagtgcgcttcattgcaattatcgcgttttaatgcttgcactaaatgactaatagctgaagagtgctctgaagaagccaggaggaagggaaatactgaaaagcgcttcttttgcaccctcagccagcacacctcactcggtttttccaggacagacttctgtaagctcttttttttttctctgtaccttctttattcctgagtgcatggcaatatggcatgcaattacagtgatatatcttccttagctattgtatcaatcactatgctttttgcatttggtgcagacaataaaccctggaattcagcttcctcttaaaaaaggttagttccgatactttcatatgacttactttgggtcacatgcttatttagattatcattgtcaaaagtatatgtttcctgtagttttttttttccatcttgtttctgtaatgttattggaggcagatgatacacattatcccagtctagaagcacctcattcccttgatgcttcatatgttacttttaagtaatataattaccctggtcatgtatgtgtaacccaaatttcctatttgcagctgtttcttttcaagatgataacaggcatacagttggtccatccaagtctcttccattgccacagggtccaaaacactcgagtccaatacttcaggtaccatttgcatgattttgacttcctagtgatgcccatgccttagattttgacatcatagtgatgcccatgctttggaatttttgtcccatagtaacaattatgataatttgatgggattactggttctcagacaatttttggttatatgcccatgccttagatcttcatatacaactgattttttaggaggaaaaagcctgctccatttgtcattaaaaaaggaaccagtttgtcaatctcagagaggttgatacaacgatccttacagttgcagaccctcaataaagtaccagttgcaagtgagaatatatctcagctagcacgtcacatgagtaaaattaaaataagacatgctagcattctaaaaacatactgctaaaattcaaaatgagatagacataaagtctaaaagccaactcccatggactcgtgtgattaggccattctactctggaggcaccagctgttgccctgttggtatgcatggttcatcttaatatcctatcatcagctggcgtgttttatacacaatcaaattgcttatttcatttggtagcattgtgtatttatgatgtgtgttaaatgtgttagctaaagtgacatggcacttgctttacatatttcttatgtcaactgaaatcaagcaccactctggatgcttgagtatgcattttgtccctaattacatgtggggtttatattattctttcagcaccactctggatgcttgagtatgcattttgtccctaattacatgtggggtttatattattctttcattgtgttggtaacgctgattcctgatctttcactcgacaggtttcttcagataaccctacatctcatgatcggaagataatgtcaagtggacaaaaggtcttttgcttttacagggatatatatgctgctatgtcgtttgaaattacgtttgaccttatcttatggctgctgcaggccttcacagggtctattattgaacatgatgataatatttcaacccttcaaccttcaaagagtgctgctttgcagaatgta

SEQ ID NO: 29591 - DNA, 1696 bp, Oryza sativa
agtggaattgtatgtgacacctgacatgcatcaactgacaaattctttgaagcatcgattcgatgtgtacataacgtgacccatatttgtatgcacgcgtgctgattcattacagatgtgaagtagtactaattcctggtgtatatgcagctagaaaaattaactgacagtagaagcagatggctgaacaaatgctgatgcttttcacaagaaatggtgatactgatgagatctcaagctgctgaactgcctcagtactcggcagctagtagctagcccaggttaaatgtttttgtgtggatgatggaattgtggtaaaaggaacatccccatcaaaaggaccaagcttttctttcaaacaaatcaacatggaattagatcgaacaaaaagaaaaacaaatgtgtccattggttggttggttaatcctgtgacgactaagccaccagttaattaaccagagcagcatgcagatcagctgggggtcggacgaaataatgaaagaactcgttgattaattacagatcgatggatggacattattattagctaattaatggcaggaactacttgtgctgtaaacgagtgccatgacgtggtcagtagtagccgccgccgccggcgatcgccggtgcagctcaacaagatcatcctcgccgtcgccgtcgtcgtcttccctgcagcttggtcgcagtgatgagcaccagatgctgtctctgacatttttgaccagcaagaagggaggaagaagctgccctctgcatgtcagttccacctggttaagatcaagatcaaccacacgtacatgattttttttttattttctcacacaatatatacatgcatgtacatgtgctacaacaggaacaaactaatatatagagctaattaatgaacatgcgcatgaacacatgtgcaagtactagtaattaattaatctctttaattatattcttccatagttcattggcatgcatgtggcatatgaacgtaaacatgcagatcaacgaagctcacacatatatattattacaagctactccgctatgtttcaggttataaaatgttttaactttggtgtttgactaagtttataaataaatatagtaatatttacattaccaaattagttttattacattagtaattaaatatatttttataataaattcatcttgggtaaaaaaatgttactatttttttctataaatttagtcaaatttgatgcagtttgacttttaccaaaattaaaatatcttataagctgaaacggagggagtactattctatatataccctttggcattaattgcacatcgcatatgcatatatatagtagtatatagcacgcatgtcgccttcacgttgtgatagtttggagaagccaatcagctattgagccactacacttctaggcaaaaatccaagggaacaaacaaataaaccagtagcgaaaacaaattattacatcctctccgtccaaaaaacaacaaaaaattataggcacctctaattcactaatcaaaatttatctaaaaatagtatatttctaataaagcagagcacaaccaattaattagatgaagatatcctatctcatgccctcccacaatattaagtggcataattgcctcaaccttccttttattctatgcatgctattatttaggaataaagtacacatggcatattgatacg

SEQ ID NO: 29592 - DNA, 943 bp, Oryza sativa
tctggagttccatttccccactgctgccattgccattgccattgccattgccatgacaagcactctgcatcacctccacaccggtcaagacagtaatgttcctcccaatgaactcatcatcagaatcccctttgggagcctgattgcgaaagaaccttgtgacgcagaacttgccggaacccaggttgacaagttgaggatccctgcattgcttccattcctccggcggttcaaactccttgcaagtaccaactaattgtggctgcgaatccatcgatgagagatcagcagcagccagttcatgggtgcttgaacaaatgccaacccagagcttgacctcaggtacatactcaaccttgccaatgaagggtagcatccattttcccaggtgactccacgtgaggctcctcctgtccatacaataggttccaacacctttgacagagatgcagatcttcgagccataatcaaccacaacataagatctgatctccagccatcggcccaagtatgttctgtcataaacatacggcggtggcgggagaagctggcatgtccatgatttcatgatgcgacttccacgatagtggcagtagacgaacgcctcgaactgattggttcccgacactccagctctgctcatcttatccatgatgtagaagttgccgccgtcgaattcaccggattcttcttcagggcaggggatgaggatggagatgggcacctgcttgggtccgtgaagacgaggcagcataaccacgcggctcctgtctgcctcgaagagaaaacagcgtcccgactggtccgcacagatcaccctgcgatcaagaaacggcaggcaatccatcctccaatcttcgccgaaacctgcacgtgtagcttcgccgaaacctgctgcgaagttgaagatggggcttggaagttgaatcctgttctccactct

SEQ ID NO: 29593 - DNA, 34992 bp, Oryza sativa
  unsure (1)..(34992): unsure at all n locations
agaataaatatttgaatttagagtcgagcctttggtataaatacttcagaatgtctatggaggcggaaattaaggaatttaagttatggaaaaagggatatggctaaaagaacaagtgttagccaaaagaaaataaatcgagatgtttataaaattgggaaggtgttaaatggaagatgttgaacaagatagatgtctgaattcagaatatttgtaagaataggatttcaaacgaatttaaataaagagatctagaaggggttgattaagaatttaggttaaggggtgtcatagatgtaggaactttgaaatttatgtgtaggtaggataaaaaaaatataggtcataggaattaattaggaaaaaaagctgtgctaatataataggattttagaggaataaattgagctgtttataacattgcaaagaaatttaaatgggagaatttgaatatgaaataaaactcaatgaaatctaggctagatataataaataggaaaataaaaggctttctgtcagttagttttgtaacagtcacaaaagttattaacttgattattgtttaccaaacaaaactaaacatcatatcaatatctcatggataaataactttagtaattgtcacaaaagttacgaaagataccaaatctcttttacagccctagaccaaaaattacataatgctagcagatagagttgaacgaaagatccaaattattcagaacactctctcgatcgcaccgctggcaagtttagactcaatacttgatcatccggagctggacttcccccatgctgccatttgcatcaccactagcatcatccggcacaacatccacaccagtcaagacaacaaagggatcatcaattatttgatcacgatagtagcccgcaaaatgcctgagtgtagaagaaccttgcgatgcagaacctgccggagcccaggctgacaaggtgagagttccatccaagctctcactagctctggcctctggaagcagtcatccatggcggagagatcagtagcagccaagtgattggtcttgtcagagaggccaaaccatagcttgagctcaggtacatactcaaccttgccatagaatggcaatgtccactgacctacatgcctccaagtatgcttcactgtgtccatgcagtaagtgccagcaccctccaccgaaatgcagatctcagatccaccactgaccaccgcgtacgagttgatcgtggtgcgtgtgttggagaatttggggtctctgacgaaaggcggtggaggtagaggtttgcaggtggacgaaacactgcggacagagctctgcgttcggtagaaaacagcctcgaactgatcgctgtgcgacggtgaacttctcggcgactccggtttaacgaccctctccatgatgaagagggtgccatcaccatcatcatcatcaacattggtgctgggaacgaatagggagatggggcatcccttggggtgatagaggtcaggcatagtaacaagaagatcaaacaacattcatcctggtcgatgcagagcacctcacgacctcttagcgggaagcagctaatttcccagtgatgggccacacttgaagcttggaagttgaacattgggcttggaagttggatccaatccatgctgccgcttatggctgcggaggcatcagccgcgacaactttggaatctgatatgttgaagaaattctggagcgtaaggtcgatgcagcgcagcgatttggatccagggaagcggttgtccacgatcagattcagaaacctccgtgagagggccattgtactcttgtcggagtgtaacttcaaaatcaatcgaaattcgagctaatcagaatcaaaaactaaacaggaaagatcttttttaccaacaaggaggatgaaatcgtcaaaatcaaaaaaaaaaacaggaaagattcgtatttgtttaccgagggaggaaggaacggcggcatccgcgagacttggtagggttaggtcttggcaagcctgattcaggctgccatttgggcccatttctcggcccataataatacttgagtaaaaaaggaaaattgcggcagaaaagacatgtagtacatcgtcatgaacttcagagaaaacctgagactttgctttcaacatcttttgatttgaactctgttgagcttgctgaccgcttttctcattctgagtcgcagttccagctgtacttttactacttactgattctagtagtgcaatcagtttgtgcaggttgcaactgattcaatgatgatggagtttgtagcataggctcatgttttttgcagccatcggggagctcaagtgattgttacaacttacaagcattggttgtatcaacttacaaaagataatccctcagtttctaggagtatattgcatccaaggtagtccttgataagactcttctcacacttgaaaattgttgcatccttctagcatcgcctccagtttatcacttcactcgcatgaccagcattcgatgcttaggcgttgcctctctctcattcagttggtttagtttgatgtttggtacattgatctgtctttactcttctggttctggcaagtaagtactcaggatgcaagcaactggagcttgcatgacaactgcctcgcctgaacttgtttaagatcaatggcactgaaatttgaagctagcaatacaattgtgttctgttctgtgtaacacttgattcctttggaatatactgtaggaattttgcaggactttcacatgaactacaagagttcctgatatgtttcaaaagatgtctcaccgtatgcgcatcctaaagtggagtagtaatgacagcgtgatagacggcatcgaaaacgattcgatgcttgctgctgctgttcgtccgtgcagaactaaagtgtttttgtcaaagatgctatgtgagagatgatgatgacgactcgatgagttattaggagcattggtcacgttggattgtcaacgaagcattagtactcactagcatttcgattcaaaactagtaacagtagttaccataacataacagattataagagcaaggctaataatacagccgacctgctggctataaggttctttatagacttttctcaacctacccatataatagttagctcttcacaattaatacagagtccacttgtctctctcaaagagtttcttggttcttgcatccaagccggctgttagttcacagcccgcttctcctctctctcctctcttctttcctccaactcagcatttagccggcttatagcctactattatacttgctctatatcagctataaacattttttttcttttacatgaagctataaaaaaacaagagtagtgggctacatatttataatcagctatagcacggactttaagacataatgtgtgtatgatagatgtcaccagatattaatagtgtactactagtataaataactaatgtacgaactgactatatatatatatatatatatatatatatatatatatatatatatatatatatatatatatatatatatatatatatatatatatatatatatgaagttagtaatttgatgtattagtattgaactagttcgggcatcaccaatgtatatggcaaagtgatccatataaatggaacccacataaatagtttatccatatggcaatgtccacaatgtatatagatacaaggtatcattaggagaagagagaggagtagagatagataatataatttattccatatggatagtccatatgtatatgggtatcttttgctatttttctatatggactagttgcacaatggtaataggtggttgaatagaatattctcgtggatgcccttctaaagaggagaagtcgagaagacttggactttgattcggagatcactgattcatcgatccaggccatggtcgtacaacaaaaggcacagaggaggtagtgaattagtgatgcaaatgtaggagtagcatgagaaaaacgagacgagtgagagtctgagagacagagaatcgcgtggggccctggctgctggctgctggccacgagtaaagcagaggccttgtcgccacgcgcttggactcgcccgcctgcgtggactcgatcctgtcaggcccaaccaagatgggccccccacctcgctttcagtggccccgccttgtcagtgccactgccaccacgagcgggccggcccagcatgtgctacgcctgctatgcgaagtaggacgggcccacctgccagtgccgtgcaagccccgttcttttcttcaactaaacttcagctccttccgttgacacggttttcaaatttaacgcacggttcttttaaaatatatatatataagttttttcaaaaaaatcaaataaatttatttctaaaatttgtactccctctattccaaattgatctacatatttcataggtacaccaagaccaagaaaaactaataactctctcatactatatttactttagcaacaaactcaatgcatgcaccattcccactatttcttagccaatagcaaatcaagatattgcatgtgggttataaatacttgtgtgcatggatgcatgtattaatgtccatttactccaatacacaaataacgaatagacttaataaatgaacacaaatatgtagatcatttaggaataatctcaaaaatattatatgtaaattaatttagaatggagggagtaataattaatactcaattataattatttgtgtgctgaggctcagcaccggcgttggactcggtggccgtcggcgtcggctcgtgttgatcgcatctcatcttccccgtgacgacctcccgatgcagtcaattactcggtcaaagtcgacttcttcagtgctcccccacaggaagggatagagggattgattgatccattcattctcctctctccatcgatgggaaagccggtcgacgagtgatcaagtcctcgcaacactaagtatcgcaacaaaatgtcccaggtaagcactgcagcaatagcagtggtactagctactgtagcgcagtattgagagcacactagtagaggcagctttctggagtactccctccatctggaaaaaaaaaaacaaatctaaaactaaatgttttttggaaaaaaaacgattctagaactagatatgacacattctagtattagattcgttgtaatagaatgtgtcatatccagtataagtttttttttattttatgagactttttatgggacggacagagcacctgccattctctctagtcaacgaaacacacgagcaccgaaagtgacacaagggggttgcagcatatgccatgccaatactactattccccttttatttcctgttcccttggtttgcactgcaagaccgcaccactcaagacttcctcatcagctagtacctaccgtaggaatcaacaagaagagaagatgatgataagggagaggaggcaaagtgggcgcccaccagcactcacgacgcggccatccaattccaaccaagtcttgtttgttccaacacccccaacacacggccgcgtctccatccccatccccatccccatccccatccccctcccccgaccacgcaatcaactgctgccaaatcaccaatcgattactggacgagcatatacaacaaaacaatgatctctcagctttctgcttttccacaccaacgttgccaaattaaacacgttgcagcatgccttcatctatatccatctatgatacattcattgataaatatttatatcaaagatcagacaatacatacgccatttgttcgttcgttcgatcgccatttttttttatctcgagctacagagcttacacaaatttatccgggggaataggctgctggttaatacaaggtagggggtaactctactactactgctctacttctggctgggtggctggctacgtagataaatatttacatcagagagttgggaggagttgagaggggcaatagcaataatgataaatcttggccctaaatctttctgccaagagaagaaaaaggaacaaaaggataaacaataggcagtctacatctcatactagctaaagccatagggtttgcattgcatcagccatcagataagcaaaagggggggcaggggtgatcaccaacacatcagggggtttacttgactgggacccgcagaatggcatctctctctcaagactccatgcgatctacctcttgtatcatctcgcttcactgaacctgcacaaacgccaaaaacagcaactgaaaggtgaatcgctttcggagcaagctcttcatagcaaacaacaatatcacgtgaccatgcttgcagatcaagaataagtaaaagccaggcagaggcaatggaaagagaataaaagttcacagaaaccgaattttactatcctacggctacacttccaatctacgacttcctttcttgttttcaagttttatcgacaattgaataaattaatccagataaggcaatttagcaggcatacctagttatctgatttgttgggcatcggcagatgacctttctcattttctgaagagtcatctttccttggggcatttgatttcgaattcatcttctggacctcctccttggtgtaaatataaatcttccgcacaatgctgcagaattctctgctcataaaatgaaccagctagaatcagtattaggaaggaaagcttaacaaaacatcaagcaggtacccaagatagaagccttactcccatgggtcgtctccaacaagcatcatatcaccctcattatcagtataaacaatttgccagtttttgtttgaagacaccaattcaccatcgaattcaaacatcttgtctagctcagctttgagttcatcatagttactgaactttgaaagatccacagatctgccaagtgcaacgccttgcttatggacctgcatgaagaatcaatgacatgatgttattacatagtgcagaccaatagtcaaacttgacacactcatgctgcactgaataatattgctcatgatttttttttgggacaagaaatagcaaaattgggtttaccataccacaaaggggataaaactgagattttgcaagaaatttacaaaacgagaacttcagcatgtcaactacgagaagaaaaaacttcatgtgctgaataaaagaacaatatgtgctttaacaccaccagaatcaattcactctgatatgactggatagtttgttctcaacagctagcataatctagacaacaaacattcagtaattcttaagtaaaagaaaattgtgcaacagaaaagacatgcacattgtcatgaccatcaagaaaacaatactatacctttgtacaactcctcgtcgaagcaacctgagtcttgctttgaacatcttttgaactctgttgagcttgctgaccgcttttctcattctcagtcgccgttccagctgtgcttactgatacctcaggaatgcaatcagtttgtacaggttgcaactgattcaatgatgatggagtttgaagcataggctcatgtgttgcagccatcggggagctcaagtgattgttaggagcattggttgtatcaactttaaacccaaaaatcttaaacccactgccttctgttttttccaactcaactggagctattgatgcatgcggtctaatcactcttggctgttcaggtcgggcaaatgactgatttaaccaacttgatgagttctgttcgaatctgaaattctgtggtcggtctctcgaattaccatacacagtactctggccattccagaaatgtaactccttactgtctgtgtgcatctgtgtgcttgattcaacagttagggaaggctgtggagatacatagtagtatgggtcagagaagtgccgagcagaaccttgatcctgaaactggttcttgaaagaagtaagacggttaggagcctcatcaaaattctgcataaagaagcctggggaatcaccaaaagattgagagccagaacggacatccttaaagtcagtttcacgccttcccaactgcatccaattatccatagggggtctctgctgaaatgtcaaggggtgggcttttgcagcatttggggatggagaccacatcattggcttatgagcagtgacatcagagtcattactctcagtaaggttgctcctcaaggtcatttgttcttgaccttgcaagaccgtactgttttgacttcgttgtgcttgagcaggatcagtgtcaaccttagtagcagctgcaaatggcaccaacagttttcagaggattaattgaacacgcattatcatcacccttcctcttaagatctataagattgtgtagttaccttctttcgtaagaataggagattcaggagatgctggaggagcatttggcctaggtcttttaaccctagaaagaggaagggggttaacaggaggtgatgaagcaggctctattttccaaggagagactctatctggccgcggaatagttgatggttcatcccaccgcacctacattattgaaaaactcctcccatcaatacataacttctccagccacataaaatgccagtagtaaacaagaacctaccttcagggatctccaacttgattcaggccacactgggtcgagattctcactgccaattatagtaccagtaaacctacataatggaaataagtttaatcaagcaatcacttggaataatccacataaaaccatatttacatagaatatcaagacaacagatacctctgctctggtgcctcttctccttcaaacctcatcctgaacctcatcccaacagagtaattgtttttgacggactccatatactgatcatatggtataatgaactctgaagggctcgtcctatcatcatcattcagagaagtttaattagatgggatcacagtggcaggaacagcttcgatatgttacagatcatgcaactatgcaagaatagcctaacagccagataaaacaatagatttgtagtggacatctcaacatacctaggtttgtagtagacggtgaacatactcttcgtgttgatagcatgccatgcagtagcaaggactcccaggtgcatgctttggctagatatgactgaagaaggcacattggacagctgcctcatagctcgtctaacaccaacacggagttcaccattctctcctctgcgtagagcacagcaaagttaacacttgatcaaggaattgaaatgctgggcagagagggtaccacaacagacctgaggaaaatgaaagcatccccagcaacaagccttttggaactgacaaacacactccaaccactctgaaggagatgcctcctcggttgccctgatgatattcaacagcaataacacaataatcatcatcatcgtcaacatcaagtacagaaagaaaaaacttttgcgattcattgaaagatttgatgtgtaacattgccagaaatgcttgaatggtacagtggtctaatcaattgacaaagaactaacagcaattacaactagtggtctgcagagccgcaggtgtatgcaagacggtgtaaaaatggcatgaaccatggtaagcaaaggggcacacaacttaccgcgaaagatgtgacggaagcgccagtccatgctgtgcagatccttggccacgagctcctgtgtgggtggcgactgggtcatatcctgacaagcaagcagatcaggtcagctagtagcacagatcaattacaacttaaacacacttcaaatgaagaacattaataggatcatctactccagggttaaaagacacacataccaggggagggaggcactcatcagcgtggcggcggagtacagagaagccgccgtgcgtgctggtgtcagacgcggtgagcgtcttgcagaaggacctcaccggcggccttgcctgcacagggccggacgtaggagtcgtcttctccaccgccatctcattttgctgcaggaacaaacagagaaagaaattaaacaaattcaaacagagaaagaaattaaacaacttcaccgagacggcaaaaattactcatcctccgaagaattcacgcgggaaatttacctcgggctccggcatgagcatgacctgcgcgtagacctcgtcggtgtcttgctccgcctacaaaattccccaacaaaaaaaaataacaaagcaacagagtcaaaatcgaagcagaacaaacaaacaaacagatgaagcagagaggggtcgcgtcggtgagctccggaattgaagagcaagcaaatcaaaggggaagtaggaagcacaccttgagctcgacgttgaggacacggcaaagcagcttggagggcagatcgtagaggcgcatctggctgtcggcaacctggttcatggacgcctccacctgcagcaacccagcacaatcaatcaaatcaaaaaaccaaaatcagcgctcgaaaaagcaacctctcaagccgaaaattgccgaatcagaaggggaagcttcaccccacctgctcgatgtgcccctgcgggaagtagaagacgaggtcgcccacccgcggcacggtgacgagcggccccgcgcaggcgtgccacagctcgtcgtagagcggatcccctgcaccaccaccaaaaccattaacaacctcgaaacccaaccccaacgaagctcgcaagcgaggagagctgtgttgaccagatctgaccgcgcggggcgggtcgcgcgcgcgcgtacctgtggaggagccctgcggcgggggagggggagccatggcggccggcggcatctcggatcggggcggcggcggcgcggaaaccctagcggagacggaggaggaagaggaggaggcagcgaggaaggcaaggaaagggaggtggggaatactagacgagcaagcagtagaaatgtttttgtggagaggagaagaggagagaaagaggaggggggatggggtagccggattggtggtggtctctttgtagggagtacaccaaaaaaccacacgctaaaacattagtattaaaaagaagttaaaccaattaaataaatcaagagaaataaaccgggccgcggcgtgtggctgtgaaccgaaccgggccggtttggttcgtggtgggccctgtccgcgtgggtgcgggctgtctggctggctgaccaggctgcagcggcagcgggcgcagcggggtggtggatgcagcaccgtctctcgcctcacaccctcacctacggacagcttttctttttttctttttttttcttttttttttggcttggacgatgccccattgcttcgcgcacctactgctgtgcgtgctacgtgcacacacgctgctccccttgctggagtatataggatattttctttttcttttactactatcttgtctctcttctctgttgcgtaacacacgggcaagcagtggtgtgtcaccctaacatgtatgccacaggaggagataagtgatactagtatgctgagatcaagttaacaaggacttgttcaccgaatcaaccatacgaaaatttaagcacattttagtgttggttttgtttactttcatgccttttgccaaattttattatagttttaagagaaaaaacttatagaacttttaaaatttgataaagcgataaacggttaaagtgtgtttagccctaagcagtactacaatagaaatagtacttttataataaatggaggcatcaaaaaattagtccacgataattgtccggtggagtagctcaaaagacttcttaattagttgtagtattgcgcgcttaaacacagagttactgcaccaggattcgtgtgtacaaccatgatggaaaactccactctaccgcattattgaaggtgcgttttatctttgtagagttaaattttgtcaagccgctggtattgatggctactgagacatgaagaatcggtatcagtaaaactattggcagcagtggtgttaaaacagagcactagtactaaaagcaagaacaagtttaatagtatagccaactattagctctaaattatttatagccaattcatataatagttgcttactatactattaatatccggtcccacctatcatacacacattacgtattggagtccgtgatactacttctctctctttacctttttaaaatatgtttatagctggtttatggtctactattgtatctgctctaataggtcactaactgctacagaacccaaacagtttcctcctaatttcgagtttaccaaaagggggagatatttcgtggcgcgtgatgatgtggacggtgatgacccgagagaccaagctgcacccccgttccctgtttttctctcccccacttgctccgttccatcgctcgctgccgctgctcgtgttttcctgctaattcttcttttttctctcgagtattttacatcacgggctccatgtttccgtcgcccattggaccgcaggtgataagcaagtgatctccctttcctttattttcttttcgatcattttcacaatttcattattctagtgctagtattggtctttttcttttcaattcacgcttacactctgctgtacactcaacaccacgctcacataccgacgaatatgcgctaaaacacatgcaaacaaacagaacaaacagacatagagtagctgtgactctctattctcaccgtaattccgttgaaaacacacccgcatgttatgtgatttttgttaaacactagtagaatttaaatttacgacgagtgaaatcatacgcatacgatttacacaaacgtcatccaagattttgtatacatcatactatctccgtcctaatataagtgtgtttgtaagttttcatatctaacgtttaatcgtccgtcttatttgaaaaattataaacttttcttaaaaaatcagtcacacataaagtatattaatgttttatcatctaataacaataaaaatattaattatattttttaaaataaaacgaataatcaaacattaaatatggaaacccaccgttacccttatactgaaacggtacatgagacgggataaaaaaattttcgtgtttggaaggggcttagggtgggagcaagtgggttggatttccggcgaagcaaagcacgtctagatttggaaatgtggaaagcggggttgggaatgagagccccccggccgtgtgatggatcctttcgtctcgcccggaaaaggcaaggcaaaacgagcccttgaacgggttgcccaacccctctgccggcgccttctttttctggaaaaaaaaaaagaatgtcccccccccccccagctttattaacttgtttgatggaataattcgagtattaacaaccacgtaacttggctcgtagaaactactgattgctcttgatagaaagaacattacccctggtttccgtttacaggtttacttgctgatcgttgttgctttgatgttgaccgctaattattttgaattattaaattgattggaaagaaaattgtatggctgtatttagcacgcagacaaaatttgatgataatataaaatatttcagaatatttatgaattccttgtaaatttgaaatggtcaaagctccacgattcagagacttatatgaacaaacaagcatggagcattttccagaaacgcagattttcatatatataaaaaaaagaacctgtacgcgttgattattttataagaaagagaaacgaattctcgtactcaaagtaagagctaaaaaaaggcagcaataaacacgaccaacgctttggtgtttgctccataacaagaaaccgcaccatggagcgatcaccaccaaatcagaggaaaaagcagcagcatcacattttatttctcgtgttaaagttgtgtcttgcatgagactcagtttctttctctctttactctctcttaaataatatagtgacacataagctaaaattcctatatgacaatgtagttaataccatagacatcatcctacatggaaggttgggactgtcctaatcaaatcgaatccgatccactaattaactatacttaacggcgagaggggggaggggtgcaataattgcggtgcttaacggcgagggagacggagcccggcgtgcggggacggcggggagcagggcctgcgctgtcgcggcatccgacggcaacaacgcgcgcgtctcctgttcctttccaccgcgacggccgcggccgcgggggaacgtgattaaactactaatcccctcccattagccaccataattgattgcacccactaattaataatccctaatcgcgagctggccacgatggctggctcaggctgggcctgcactgtggctaagagcaagtttaataatatagcctactactatcatctatagtcaatgtaatagccaattcatacaatagatacttactatactatcaatagctggtcccacctgtcatacgcacattatatattagaacccgtgctgcagctggctacatatctgtagcccgctactcttctctctcttcttttatctctttaaaatatatttatagctgacttatagactgctattgtacctactctaagctattgcctcttctagtcttctactacgaggaggtacagtagcactataagccgctataaccacgtatcaagaaaaaagaaaataaatagaaaaaaatgggctacagatttatagccagctgcaacacggactttaaaacgttacgtgtgtgtatgatatgggaccggatattaatgttgtagtatatttttatagttaactattatataaataggctattatattagctatagatgatttgaagccaccatttagctatcctattaaacttgctctactagtactacatatgtctcctgctttgcagcccaaaactaaatggagaaaaaatactaaaaagtttatcatcattactgggtcattagagagacgatataattaaataataattaattaactatggtagtggcgctagtatatttgtttagcttatctctctccggtcgtgaagacctagcactactactgtgcatcctgctgctgagtcgtccaaggaatctcatctcatctcgactaataattaattaaccgattagttgtgtatccgaggcggtaattaaataattgaacgctccggaagctaagctaagggcgcctttgatttgcgggaattttggaggatttcaatcctatagaaaaaaaccgaaagtctttgaaacaattgattaaatcctatccaattctttaaaattactatgcaataggtaatcctatatatattttggagaaaagtttgcaagaggtctaaccccttagaacatttcctctgagtctatctctctcatctgattcctgtgtttttttttggtccaattaaacggtcattcgtgtgtttttcttgtgttttgtaatcttttgttctacaattgtatttctgtcagaatcctgtattttttattccgctatttttttactcctacaattcaacggggccctaaaaggctgggctgattagtatgctgctaagagcaaggatactaatatagcccacttcctactattagcctaaactaaagtcaacacatataatagattagctataaggttagctataattttcttcttctatctctatctctcacttatatatttaatgtatttgtcttagagcttgtgttaagttagctcttgtatgagagccaacacatttctcttttgtttacctctctcctttacgtaagtttatagtaggtttatagtatacttgctctaatgatgtgggtttcgtcctcacggcactaattttgaccgcctctcctgtagctggtcgacacggcaagcatgcaggccagccagctgcagctgcttcctgccttccatccctacagagccagctgccgtccatccatggcgagtcactgccgtcgagcagctccagctcacctgatggggatcatccgaaagtgacacgtggacctgcccggcttccacactcggacagatggtgaaattttcacactgcttcttaaaaaaattgaaaaggaaaaaggaaaaggaataggggacaagaactagagtacatatttatataaaaagattgtgcagccttttacaaatcaagataaaggtttagccgtggattgttttacctgtctttagccaatcgaggatgaaggttcaccagattgttataccagtctttagactggcgtttcggttatttctggccgtgattagttaaccccaactttcatctttccatcacatcacttccaaaacttttctacacacataaactcttaatttttttttctaaactaccattttttctcaaacttttaatttttttcagtaactaaacacaacctctattgtttcctgacaaattgtatttttgcaataatatgtaattgttttggttacaaactttgtattagtcggttattacaaattatattttgcagtaatatgtggttattttgactgtaaattttgtataattggttatcaaaaagaaaaaaaaaggatagaaatttcaccttggctatgtaacgtgtgtcaatttcatggaaatctctgtcggtacagctgaaaaataggataagcaggtgtggttttaaaaaagaaaatcatgtccgtttgtttaatctgttaattggtttacgttgacattttgtctgtttttgtctaggtctttgacgtggcaagggcattgctatcagatgtggaaaatgatatgacaataacaaaaataatcaaagaatgtgcgacgaaccatgctgagtttgttggacttaggctccatttattgaaaagaaaacaaatttgtactcatgcgtaattgcaggcatcttaatctccgccatcgcgctgttgggctctgaccgggaacaatactgaatccagtgacatttcattggttttcccttcaattaaattaacaattaaattagtggatgctaatgctgccttgacaatggagatagattagagcatgtacaatagtaggctattagccagctataaacatattttaatgagataaacgatgagagaaaagagcagcggtctatagatctgtagccagctgcagcacatactctaagacacactgtacgtatgataggtgggaccatatattaatagtatgaattggctattatattagttatagatgacttgctcttatataatcctccctaacacggacagcctttctctggctgattaattaattaattcagcgggtatcagaggagatccacatttccagaactttttatttgcatcggcgacgacgctttcttttttgttgttgttgctgttgttgctgctaaatggagtaaatgacactgtcacgctccctgattcctatgcttaattggcatgaccggttgggaatggcgatctctgtctctgctgatggatcgtagtggacatttcacactctgtaattttctgaggctttttcgcgacggcttctcctgtttgtatccaaataactctaatttttaaacaattattgcatcggattttatgaaaacaaggaataaatacaacaagagtatataaagagagaaataatcgtatttggattttttaaagtaagagtattctaatctttctggtttaatattgttattatgtgcggaatatgcgaaaaactagcacttactattttttcggaaatataaaaaatttgagttatgcatctgaattgacacaactttgttttttaaagcttttacgtgacacctcctcggttgatgtatacttacttagtgcttatcaccgtctaacatttggaaatatgagatattttagttatgcacctggattgacacaacattattttctaagtactttcacgatgacttctcggttgatgtgtacttgctaatacttgctatcttagttctaaaatagcgtgtagccaaaacccttatacttgggaatggatgcagcatttgctagctgcaaaactatccttcgataaagaaaaaaaaaatgaaaaacgttaaaaaaagtcactttcatcatttgtaggtttgagctttagatgaagactaggtctaaacctaggaaggttcattcagacagagaagtgtggtgtgttgtgaaaactgcaagtcatggagctatagctcaattaggtcctctctatttcaacgaccagtttctgaccaactgtaacatgaaaggaataaacttggtgttttccttgataaatacacttataaaaaggaaaaataacagctggtagtagttattttttaagtcagctacgactaggaggaatggagacccagatacataatgctgaagtaggagtatatattatggaaaattgaggggtgtttagattcagtgcgtaaagttttgacgtgtcatattgggtattatatagggtatcgtatgggttgttcgggcactaataaaaaaactaatcacaaaatccgcaagtaaatcacgagacgaatttattaagtataattaatctgtcattagcaaatgtttactgtggcaccacattgtcaaatcatagaataattaggtttaaaatatccgtctcttaaattaatcacaatatgtataattagttactttttaggctatatttaatactaaatatcaggtgtttaaatctttgatgtgacgtggtgaaaaattttatggagggatcgcctgaggtggcgactcgaaatctatgaattgaccgcgtggggataattccccggccagtggtcgtcgagcggttaaagtaaaaacggcctcctccccgtgaagtgaaagttcacacgcaagaacacagagacagcaaagaacattcatcagatcacgcgtcttgctggaagggagcactagctcagttctagcgagaggtggcggttagcttttttaactggattacacattaaacatgattaagatatcagtgcatgttcgttttttttttaaaaaaagacttctacataaaaagtttttttttaaaaaaaattgacctagcaatttaggaaccctgctaacagaaaatgagaaagttgtagctacatgaacaaacaagccggccttactacagtctacagtagtactgtagttgtatagtacagtagtgctccaatactccatacgtctgcatcagataagttcacggaagcaccagctaaaagaaaatctcacaggtggttgtcaatttgcagcgataagtttggatctattcttgattccaaaatggctttgatttgctctcaaaatactccaaataccataggagtactacttagtaggagtacgtagtactactaatcagtatagacagtaatagtgttttgtcataattaaccggagcctaatgatcacgagctcagcagcgcccaagcacatccatccatccatcgattcgagcagagacgcaggcatcgcagacttgcagtcgtagcagagagtgagtgagagagagagagatgggccccatctggcatgggccatggaggcccactactgagttgcactgacacacccacaccccctctctgcgacaaggccagtcacctcgtcgaccacccatccatcgtacggtccgaaaagcccatcggcctcgagattcgcgccgcgttggtggatcggggccgtccatccggatgggtcgtggtgggccgtacaccatccaaaagcaaaagaaagtctaagcgacgcccgaggaggagtcacgggtgggagagaggcggaggaggccctggcccacacacgctgcagctcaccgccacgccgtcctcgcttagcttgggccggtgggtgggcccccctcctcgctcgcttcactgcgctgctgtgctgccttggcccattgcgctgtgcctcgtgtaccatcgctactgtactgcagcaaaaaccttcttcgactatccgaacgtttttcttttcctctttaaaaaagcagagaaaacatatgaggcagggctattttcgactatctgataaagtgataggggttaacttttactcccttatttttattctactagcaaacatgcccgtgcgttgcaacgggtgaaaaaacgtaatgataatatacgttgttcatgcataaccatgtcgatgacaattagaaaattagaaaattggaacagcttaaatgtaatagcccaacctccatgatggcaaccttacgatatttgctttacctaaaataattggattattcatataacaacatgcatataatctaaaatattcttttaatctcattcttgcaaccaatcaaatcatacactgtctcgtatggtcaagtctacacaaaatagagtcactatgcactcttctctaaataacaattagaatatatttattttctaagattatttatatataatatgttatcaagaataatagctatacttcacaaaaatattatgataattgcctacaaagatgtgcaggctctctaatataggagaatagataacgaaacaaaagtcgtgtaggagatggaaaaaagtcgatggagcctatccgaccaagtgtccatcaatttagcctttttttctaatagttttttgcttttttacagacgatggaaatattttttttctcgcgtgttttttacggactacggaactttttttctagcgcgttttcttttgcgatttttttctgacattttttccttcacgcgttttttaaaccgtttttattttctcgcgcattttttattttttaatatatggtagaaacttctctttttaaatagttatattagattagattagagataaagaagagatataaacggactactaaaatgataaatataaattagactttttttcaccgcgcttttttccgcccttttttttatcgtgcatttttttacgaatggttttttttcaccactttattatagtgtcggacctttctaggtataataggattcgattttttttaccgcgtcacatataattcctttttctttggaatcggacagttttttttaaaaaaaaatgctttttttactgattcgtttcgtttttttgccccgtattatttttggatcggatagatttgtttttttttgtcctttttttcgctcttttttttggatcggacatttttttctcctttttttttgatcagacgtttttttatatgtgtttttttgctcggttttttttgcccggttcatattttttggatcggacatcttttttttggatcggacatttttttttctcccggttttttcgctcggttttttcgctcagtttttttgacggacgatggaagcacctcttattttttaagtagtagagattaggtttttttggaaccagcccagttgagatcaacacttgcatttacggttaattattctttcattggtagtttggtagacgacatactcgtcgatagtgaggtatccgtggagacttcatcaatctcgagatatgatggtccagtctttcgaaggtgtttataaggataggatgtgtgtatgtacgtctccacatgggtgagcgtacacatgttgtgggcacttgtatttgtgttgtgttttctagaagaaaagtacttattgttttagctttgtcacgagtcaaacattactaatgtttaccatcaattcttagaagtttgtatagtttaatattgtaaaatttatgtttttagattaactatgagaaatatatttgtaaccatgagttattcacatgttaattttttttaggaatcgattgttaaagttagaaaaatttgacttaaaaaaaagggtgaatagctaatacggtcctgaagcgaacaatttagtccatgaggttttaaatcgtctgaacaagtcatccaaattaattatttaggttaacataatccttcgacccacaaaatatgccacgtaagtatgccaagtcattctcccatgaaactgtgtgaaatggctattcaccctaaaaaacaactaaaacgtaaagtagtatgaaaaaggagtaatctgcaccactgatgagctttaatatctgtgctgacgtactaagtactagagtaactttttaatctgcaacactgatcagctttaatatccgtgcagttttttttttcccagtgagcatatatcagcacatctccattactatctcaatagcataatgcccccaatgcaaagaaagagaagtactaccagtactaggaacgtactactccatgtcaatggcaatgcggcaatgcccttctccggactgcctgcctttcactgtggagttccgtctttctgccgccttcgcctgcactgcaatgcagaacagcagaagtgccaaagcaatggaaagctgaccgcaaaacaaacagcagccaaaccactctctcttcatttcttcttctgccatgagaggcccacaggcctgccttgcatcgcattgcagcaggcccagccaatgcaagctgcaggatatgatgcaggcaaaatagtgaactactcctactaggttaggttgcagtaaaagctctctcaattactagtactatgctactctaaaaacttcggccgtgtttagttcaaactttcaactttttcatcacataaaaacttacacacacaaacttccaacttttccatcacatcgttccaatttcaatcaatttttcaattttggcgcgaactaaatatagccactgcttactacacattgcaacccttggtcagagttttagagataagcaagagaaagacaggcaagggaaaaaaaaagatgctcaacgtttgttcaggttcacaatttcatttcacattggattcttgtcaacatactagtagtaggctcctctcctcatgctcaacaacacaagttacacatgcagacatgctaagctaagcataggaagagtactcctaggtttccaatgaaattttcccatgccaaaggagatttacagagccaatttgggggagttttagattctgaaaagcaactttcagattgtgagaagttgggaaaactattctacaactatgatttctcagaatccgcagctgccaaaaactctccaaacaggcccttacattttacacaaaatgtgactgtgcatgatacatggccatcaaaatgctgttggacaggcgagcatgtgaactgaagagaaaaatgccatcaaaatggtgtttggaccccgacactcctgcagcaagtcatgggcaaggggtggagccgatgtactgctagtacatgatagaattgatggatcggtcaatgcagaagcacatcatcataccaccaccactgcaggtctgcaatagatccaagaaaaagacagctttctctctacaaagacaccacaatattcacatcttccttgcctacctcctccaaatcatgtaagggcaaagaagcatcacatgacaatgaggctcactcaaccaccagcatgtagctgcaacacacaacataactgacaactgaactagtaagacctaccagatttccttcctacattggcctctgaaaactgttagctcccctcccatgtgggccatttagcatgggctcttccaagggaatacactgaaagctacactagtttgtgcatccagggttttgagttttgaccctccagcatgattcagaaactgtgccatggatgaagaacatccagagattagtactttacgaagaagcgttcgacggagatcataagctgtggagctgggtgagcatggggactagttcatcactggatggccgatcggctggtaaatctgagagacagatgatagcaaccctaacagccatcaccatctcatcttcttccccttcctctcctaagacactactatccagtgcgtcttttgcgtcaccagattgttgcatgtgccgaagccatctagctaatccaccgcgcccggtttctcccgagaaaaaatgatctgttgggtctctcccagttagcaacacgccaaggatcatgccaaaactgtagacatcgctcttatctgtgtatctgcacaatcaaatattttgaatttaaaagggggcagtaagacctaataagcagaacctctatgaaatggaaaaactttaactggaactaacgctggatccgttggaaacaacaaaaatatatggtggaaataatatccaccttgacaaagataaagcactaaccaggcccttcttgggcattgaatgaatcaggtctggttacaaagcacttgtcgagaaattaactttcaaaaatatagtaatgacgtatctaggtttggctaaaagagaacagaaaaagaatatagaatcagaacgccaatcctgaaagtatttattctctgatggggatatgggaggtcagaatgaaaaagaacaatttaaaatttgggggcagaccaaataccacatgcatgcacgtaggaatatatgaaaagcataaggatcaaaggcatttcaaaagggacaaatgcaggttctctaataaagcaaagattcttgtgttacaaaaagcaaaagtcggatacctacattaagccatggggccgttctttatctatatgctttatgtcttctgtttgagccttttcattaattaatggcttagaagactactcattatcagaaaacgacttgtgaaacaaaatgcaacagagatgcatataagaaaaaaaaaaggacagtattaacaaggtaaggattgatactgctggttgggaaagaaagccaaatgtggaaaaaagaatgcatctgcagatgtaagctataatcaaagagtctctgaatggttgttttgccaaaacaaatgtactattgtttgcgattgtagaaccaactaatctgatgtatcactccatgctggttatcaaaattattatatctaaggtacccaatgcaagtaagcaaacatccatatacactagatagttctgcaaatatgaaataccatgagttgtttgtttcatatcctcacagaggttcatggcagatatcaagaggcatttatacctcctagttttaattagtctatagacctctcactgcctaacgataggaggaatctctaaataacctaaggaagtataagcttatggctacctcccaaggaccataaaaattccaatgccataacgatcattttgaaaaaatacaaccagattttactaaagattttctcaggtctatcttttacagcgcgagcataatataaacaaatgagaagatatgaatattagcttgcattcaagaataatgctatgtcgaagcttgtaagcaggtgaactgaaaataccaaaattaagaatgatttatgtttaagtttcccctcaatagttcaaatgtgcaaaccacatagaccgatctaaacacattcagttatattgtcaagaataaactaaaaattgatgaaattattcagagaataaacttgcttgttagactaaacaatatgatcagaaatcgtgaacgtatggattttacctgctgctttggtagcactctggggcagaataaaggctgctggccagttctggatcagctgaacctgatgcaattagccttgaaacgccgcaatctgccaatctcggttcgaaatcttcatctagcatcacattcgacggcttgaggctgcaatgcagtatccggggggtgcactcaaaatgcaagtacctcaatcccttggccactccaatcgcaatcctgttccttgcatcccaattgaggttcacctgcagagacctcaccctcttcatcacatcctcaaggctgcccccgggcacgaaatcgtacgccagcgatagccggtcggcttcccggacatacgccttcaatcccatcacattctggtgcctcacccgagctagcaactccagctgcctctgcaccctcctcatgtcagacttggaaacattgggcatcgacgacggcgaggcctcagggcggctagcctcgagccgcttgacggcgacggtgacatcgttgtcaagaaccagcttgtaatacttgccgttggggccatgggcgagcggctgcgcggaggggagcgcggagtggaggttcttgggggaaatctgcggggtgaaggagacggggcccctgacgattgccggggcgtacttggcgtggaggatggcgacgcggatggcgtagaggaaggcgagggagaggaggaagccagtgagggagccgaagaggacgccgagcacgatgcggcggaggcgggcggcgccgccggcctccgcgtggggaatcttggattgcggcgggggaggcggtggcgcgggctgggtggcggtggtggtggtggacatgggctccgagtggagcggctgggagcaagccagcgagaggaagaagacgaggaggagcaggaggaggagggttttggtagggttcttgctcgccatcatctccatggaaagaggagaagcgattgctcctttgggagatagaatgctcaaggaacaggatcaaatgggtgagctcgagttcctccactggttgaagatgccattttctgctcgcgtcttgttcatgctactcatccatggaaactgacaagaaactgcagctgcaaagcagggcagcttcagcaagacttcatcttcggcaaactttttcgactttgcacacaggagcttcgcaagatagcagaaaaaaaagggcttccgaattcgagagcagcacggtatatgaactcgaaagaagtatagtaggctgtacctgacgagaaaacgctgacagaaacaacaaaaaaccgcctcctttctcctcctccacaacacaacacaaaaggcgtgagactgagagcgagctcgctcacgctctcctcacctctcaccaagaaactcaaccaaagcggcaaagctcctaattagcttcgtaaccactcccagcaacctcaaacctcctagtgagagaaagaaacctcgctgcacaatctctccctcctagacagagaaaacctcttcttcttcagagttgagagagcaccaaagctggaagaaacggaacataacaagctcgcagctggtactagaagcaagtttcactcggagagcagaggagaggagaggagaggagaggagcaacagcagcagctagcgtgggcattggtgcgggagccgaaatcaaatccaaaagccgagacttttcaccacgcacccaaaccaaaccgcggcacgctgaccgggccagacattctctcccctttttcttttaccacctcctccgcttcgatccggagggtggagctagtgcttacattatcggttgatcactaaattttgatcctcatcagtattacggttttcgataaattttaatcgattttaataaatttcgattaaatttactgtttaatcttcgaaattctaatcaaaacttaattccgagccgtatcaaaatatcaaaatttcgtaaaattcgaccgatttttactgaaattatgaacttgggtagagcaggagcagcagcagcagcaaagggggtggctttagcggagagcgaccggagaggagagagcagctgagcaggggctcgtgttggtagccgtgcacgtacggtacccaacactgtttccaatctttctttttttcttttttacctctgtccctcctcaaagtgagaactatctcgatctcctcccctccacgctcactctgctgctgctactgctgcgagggtagcatagcagtaacttcttttttccataggagtgtttgctcggtgtatgtaggctgtggattgtggaaaagttgggggttaggagaaaattagtagtttgaaaaaaatttagtaatttatatgtgtagaaaagttttcgatgtgatgtgatatgagaaaagtcgagaatttaggaaattaaatagggccgtagtccagttttagtttcacccgctgtgaagaacactgcaaaaaatgcacgcattttgctctcttctggttcaaatatgagatttttaggtcctatttaaaccaaaatttcttagaaccggatatttctaactctataaatctatagttaccttaatacggagtaacatttagaaaattatttttatttctattttagaagaaatataaaattttaaaacgctatattataacacacaaactttaaatccaacgtgaattaagatctggagttatatcaaacaagattttagtttgcattcagtgcttaacgaatattatcaggaggcggttgcaacggtagtagtacttgttacagtcaaattttaattttaaaatatatttaaattgattttagctattttacaccacggtttattttctagacatttactttaattgataatagataaatatatctataaattattttttattcttttacttatttttcactgcttttcagccatacacctacgggcatacaacaacattcagccatactacaattgttgttgggtctttcttttcccttttcttttggcacctttgcttttctttctaggggctgccgcgaaaaaaaaaaacagcggaggagacgagatgagtaattaccacaaccaaacaggggcccgtactttgatgactcccctttttcccgccgctcgcgtttgccccgtttcgggccacgcgtcctctccctgacatgtggggacactcccctccccacgtgccaggaggtgggcccaccgcctgtcgcctcgccccccgtgttcttctcgcaggccgcggctagacccaatacacaaggaccggcccatttattccccaaaggcccagaaatttcttctgatgccactgacacggcccacgaagccgcagcgttcatgcgtagaagaacccactcaccagctggaggagcagcattccacctccagattgattgccgtgttcatgcgtagccaccgtccctaaatccaaatcggtgctagggtttagggttctcggaatcgagccatcgatttgaatccaaccttcgcccaaatcagtttgggtaagagcccgttcccaatttcctctcgaattgaatccatccatcctcacatctgcagcatgggctcaaatgcggcggaatttggtcaccgggatctggatttggggacggaatgctcgcgtttgaatcggattccgtctcacaggtggtgtgctcgcggaggattctgaggcggcggcggcggggaggggatgggcggcgacgccgaggcggcggcggggagggaggcgatcgcggcgaagatgcgcggggaggactacgccggcgcgaggacgctgctgctcgagacgctccagaccaaccctaggctggacgacgccttcgagatgctctccgtgctcgaggtcctctgcgccgccgccgagacgcgggcgcgccgccccggcctcggccgcgggcgcggcgtggattggtacaggatcctccaggtcctcccccgcgacgacgctgccaagatcgacgcgcagtacaggagcatcgtgcgccaggtggagccggtcagggacgacctgcccggcgccgaggctgccctccggctcgtcaacgatgcgtacgccgtgctgtctgatccggcgaagaaggtgcggtatgattctacggtggcaaatgttgagctgtggtgcgaagacattttacaaacgaaagggatttgcgctgctgatagatcaactcatgattatccgaatgcagaactgggtagattaagcagccttgaggcagactgtaatgcggtggctggcatctcaaacaatgtgccttcatatgctcaacagactgacagatcatgtttggatgtgggcgattgttcaaatgttgctagctcttccaaaactaagaggactgattcatgctttctagctgatgatggttttcagttacctgatgagaaccatgttgacaagaagcaaaagagtgtgtgcgaaaaggatgtgcattgtgtgtcatcgccacatgtagatttggatgacaggtttactgatccattggataacagagaagacgagctttgctctattacacaatatgacgttcataactttgagaatgatagggagatagtgaatttcgctgctggtcagatttgggcagcatatgactgggagaagttccctcgcagatatgcacggattaacaagattgtggctgacaaagagcacttatatgtttcatggttcaaaccatccccacaatcccatgacgagaacaggtggtttagtgcaagcttgccatttgtttgtggaatttttattgcggatgaatgtaaaatatcggtaacttgtccaactatgttatgtcatcagatatcttctgacaattggaatcatcatcttaaagtttatccccaggaaggggaggtatgggcaatctacagtgattgggacattgggtggtgcaatgaccctgggatgcggaagaaaagcaccttttatgttgtagaaattcttaacagttatttaaaaggctcaggctgcactgtcgcacaattggtaaaggtagatggatatagaagcgttttccagaggcacgtgaggagtgggagagagcagttattacaagtccacattcataatctgctcatgttttctcacaggattccttcatttagatttacttgtgatgttggaacggtgtttgagcttgaacattctgctgttccagaaaacttgcaatatgaaaatacatcagcaagtgttgctcctttgtaccctcttcaaggtttacatgatgactcaaatggttttcatgaagttgctgccacacacttatcaaatccttcaaccagcaaaatggatttaggtaacccccaacaaggaatgatgaactacaataataagttatcacctgagcattttgtggaggggcagatctgggctgtatatgatgctccggatagaatgccaaggttgtatgtcagagtaatccgtgtggtatcccatactgcagtttctgtgttgaagctggaacctcaccctatgctcaatgaagaaatacattgggttgaagatggtctaccagttgcttgtggggtgtttcgagctggtagtgagactgcttgcaaagagatatcagaattctctcatccggtggagtgtgactggagcgcaaagaggtctttctaccgaattttcccaaagaaaggagaaatatgggcaatgtacaaaaactggaagatagccttcagtaatgctgacatcgacaaatgtgaacctcgcatggttgagatcctctctgattactcagatgaaattggagtcaatgtatgcaggctgactcgggtaaaaggctgtttaacctttttccagagagtaatagtggaagatttccatttgacaaagttgatttcaaggtctgaaatgctaagcttttcccatcgtgttcctgcttatgtagttattgaaattaaagaccgtgatataccaaaagggtcatggcatctggaaccaaatgcccttcctctcaggaatatagattaatatatatgggaagtagcaaaaaatgtttagagttttagataattgtaatgaccagatcttcttctttcaccctgttattaatagaatcatttgcctctatctgtgtctgtcatgattatcttgtctgttaaaagagctgtttgttcagatgttcctgcattttgtatcctggcacagtggacatttcttctgcattttaatttagtaatcacagatcagaactgattggtcttagaacttggaaatgagctgacaaaatgacaccaaacagtcatttgacataactggtttccaatttactatacatgtttgtattgttattgagcaaatcttccgatataactgaaatcgcattcctcctgaatgcaaatattgaagcattttcttgtatctgggtgccaccgaattcttgaatctgaactgagtaattgatattgtatttttttggtgaactgactctgtatttgtaccctgcagcatcatctttcccttcgcatgccatcaactgcgcatttcccgtgccactgttcttgtgttatttctaatggctactaacaggctgaccagtggggagatatctttctttgaggactaacccttctgtagttctattcttctggcttcttctgggtgaaaaaccgatggatgaaaaatccttcttgcataaatgattggatgaaaaatgtcggtggtgtgctggactctgctaatgttgcattttttgcctaagaaagcaaagacacaaccaccaattgataagaggcctgtcgatgttccctgtgcatgagggcatccaacatatctttgtagacagttctgctaggaacaataaaatatgtctaactggtttgttaaacttagagaaacaaatatcgttttctgcagacttgtttaccttattgcttattaaggaggtcagctcaattatttgatttgttgtgttatcgaacaagcattgttcgagtgcaacaggtcctttttcgatagtactttttgtttaagataaaaggaagattttattgatttcagatgattacatcaagttaatagaaccatactaaagaacattccctttgagctgacctgttatttccattagttacctgtaggctataagctttgttgtgtacctgtgcctgttttacttaaatcaaatgatattcttctatgcttattgcttaaatctttttactgttacttgtatttctaactttgcgataaaatcgttaagcataaaaggcactgaattttgtatcatgggtttcttgctcaatttcaacctagtacggttgttccttctattcaaaggaaattgtagattaaaatagacaataacatatagttctccttttgctatcaagacttttatggagtttaactgtagtctgtactgtcgtcttggaagtatgctactagttattgttgtccacatacgtccacatacgcttatggattcaacttactatttccctccattatttttgtccagcaagtactaacatgctgttctgctaaactgatgacgttgaattcttgacatgaagtatttgtttttcttgtgctcgagtgcaactggctttaaatatttctttacatgcaaacctgaagtttcctacttccaactgccttgagagatttaagaaagacagaggtagttgaattcatggtgctctatgtgtttccttgtgctcaaacgcaactgttttttgaagctttgcatgatacatgcaactctgaagtttcctggcttcgaactgtggagatatacacttatgaattacagagagaaatggatttatgatgattgaagaggcgtgtactaacgtgcaagtttacaggtcaattgcttcatgtactatccattccaggcgttggaaacatgtcactctggaagctacaagttgtgggtaagctcgaagtggaaatgattgttcaagctaatgttgaaacctgagagggcaatcttggtcactagcgtgctcagaaagagcagaatgtttgaagatatcatgccccttgtttttaacattcggtacttctaagcatttctctttggtacttcagatatatatggtgatttgttccatacatttctaatgtgcaaccaaaagttttcaaagctgttaggtgtcatgtcagattgtccttaaaaaatggatgttaagcacagtatacatcaagaaaataaagggggatttaatacgtgtgtctgtcaatgaggatcatccacaaagattcgatgagctttagatcccttcttttagaatcctttagcctctcattagacgtttttgaaaaatatcttgattcaaatgctttgagccggtttggattgggctcatgtagctctctgtttgactgtcaagcaataccagagccatttggattgttgagatctgtctatcaacaatgataacaacctaattaagagcaccaaaccacagacttccttgttgattcaaacaataccgcactttcgatgcaggtggacactgaatgcatgccagtgatgatcttgtttttttggtttaattctagtgtttatgagaggtgtaatagttgacagttcctctttgcctactctacagaagagccctaaattttgttctttcttgttctgactttttttcatagttttaaggatatactcaaggacaataaaacatagccggaggtatacctaaacagcaccctgattcttccattagattgctccaatcccttttcttttcacctttttttatcaataccaactccgttgattgcatttttaatctggcatgctagaaggtgccaagaacttgaactattttgccttacatgatagtagaataaacacaaaagtttgtctgcaagaaaataaatataccaaatcctaacagaaatgcttgcatagaaacaacgtttgttgaatatttaactgttgtaatgcttacctttgaattggagcctactgcaagtaacctctactgcggtggtttgttgtttctaacacgaagtggacagggtgaaaaaaaggctcagggatccaatacaaaagtgggccacttactagtggaaattgccaccagtctccatgacaactgacattatatattgccattcaaccaaatgaaaatggaggaccttggaacagtagattcccattgtcatgctgccactaatctgattgtgtcacttgtgcgattgatggagttcaccttccatcttatgcacctaatcttatattcaggtacatattaaaatattttcccatcagttagtacttagtggggtctcttaatcaccataacctgttgctgctctttctctctcctctcatcaggacaagtataaaaagcgaagcttttctcaactcccattcagacaagagagaagctccactcttctccaccccaagagaattgaagccaagcatggagaatggaggggaagaagatgacagagcaagccgatgcaagaggattaccagagaatcagatgcaaccaagaatggtgcagcgaccaagctgcnnnnnnnnnnnnnnnnnnnnnnnnnnnnnnnnnnnnnnnnnnnnnnnnnnnnnnnnnnnnnnnnnnnnn

SEQ ID NO: 29594 - DNA, 1855 bp, Oryza sativa
tgcacccctgagtgagaagcagaaatgcatatcctaattctgccaagaagtagtggtgtagcaggaaatccaaccggaacaacagcaacctaaaagtatggaacatgccacattagttaaaactgcaaaacttttttttaataacacaaaaaagagttacagggtgtaactcaaatagtacaaaactttggactattttgagacaaatttgcattagagatttactaaacggacaagattgttttatcaggtttttaatagatttgtggtgcacttgaaaaaaactcacattttgcttcaggcactctcttgagaatgcaggcattttagcaggattgtagaccatgaaaggcatgacaggtgagtcattatctccaagaacctcaaagcccattttctgaagctctgaacggaagaaattgctgttatctctaatctgagcaatcttcttggcccctgtttacaacaacattgcatcatgaatttcctcaaaacaggagaaattatgagtcaatttgttcaaattttggaagcagatatatacctctgtcagttccatcctccccaagaataaccttcattgcagagatgacctgctggactgcaggaggtgacatggatgtgccatagatatgtgaaggacatgtaagcttgagatgctgaataatctcctggtaaacatgaaaaaataatccaaggatcagttttattatcaactcttttgtcttctcagacaagaactggtaagtgaatctgcttaattaattcatacttttgatgctgcaatgtaacctccactcgatccaaatgactttgagagtgtgcccatcatgatgtcaacatcagccggatccactcctagtagctcacacacacctcttcctgttttcccaacagctccaatactgtgtgcctcgtccatgtatgtgtaaacctattcatatgttttactagtcaataccatatagtacatccctaccagtttgaacaactcttaaaagtttcagaaaaaaaaatccagtaataacatacccagaagaagagttctttttttcttttgttgatatctatcggtagtactataatggcagtaaaatactaccagttgagaccaccgtaaaagttttgggtaccttcacgatgctctttagtatttatcgtcgatagaaatgatcttagattttgatttatgagctctactaccggtacaaaaaaaaaatctactaccagtagttgacgttgtagtataaataaatatgattcattggattagaaaaaaatggtctagattgttcttctacccgcaaagagcattataatgcctcaaaagtttccccttttctctttttctgaaagatggtactactgttcttttcttactagtatggttcagaatgaaactaagaaacataagaagaattcagaaatttagtagtaagtggaattaatttctccaattaaccttgtacttcttgcagacagatatgatctcagggagtttgcatagctccccttccatgctatatatcccctcaacaatcaccaggatcttcttccatgccctgtgtgttctaggctgtccacctgaaatctgctctctcagtagtttttccaggtgagcaggatctgcaaaagaaattaatgaaatttggtgagatgaattgttcagctaataactaattacttgcaaatgcaattgacagttgtttgtgagcttactgttgtgttcgaacacccgaatcgtagctcctgaagctctagctccactgactatagagttatggttcagtgaatcactgattatcagtccaccctgaaataattacagtacattaatcagctccaggatgcacga

SEQ ID NO: 29595 - DNA, 5767 bp, Oryza sativa
actagtggatcccccaaaaaatttaagtaattattaattttttccctatcatttgattcattgttaaatatattttcatgtaggcatataattttacatattttataaaagtttttgaataagacgaacggtcaaacatgtgctaaaaagtcaacggtgtcaaacatttcgaaacggagggagtatatatcaatagaaaaaaagaacaaatattctgcatgcatgccgggaaatgtatatagtggaagtggagagagaaaacaatactatacccagctcatgcatatataacataaacaccatatatatgttgctattgtatacttacttattactcaatgatcagttatttaatctcaatgtaatgcagtggaaatatattttgtgaattcgtgaaatggttcaaaaaaatattggaagccgtctaagttattttttttttgcaactaaatgttatatactaaagggtggtgctgttgtacaaaacatgtccaaaattaatttcatgatctagctcttttatgtttggatgatacaaagtttacaaacagcagaataaacgtatttagcattggtttcatactttcatttgtgggatgctactagctacatgtattttttccatggtaaatattaattaatttgtaccgctaaaaattgacctacacataaatgttgtcgtcacaaacgagttgaagccagaaacacctaaaattaagttttttttttcctttggagggagcaaatattttttttcttcaaaatttgccaaagctatatgaaaattcagccataaggcctcttcagggaactgatctaattatggtccaaattacctaccgaatctaagagatcgaattaatgaacttgcatgatgcatatggatacaaatatacagaacagcatgatggtattttggtaactatatactacatgcatgctgatatgggcctgtgacctattgcttttgtctagtaccaaatcaaagagatcccaaccttagctcaatgtggtactttcgattaggtataatgttcctttcatgatcccccctaattgccaacctatatatgcggcaactcagcacaagagaatactagctaccttgcagtgcaaattcaacaactgctcactattcactattgatcactcgatcgctgcttcttccaatcattttatgcgacaatcaacaagcaaattaaatatcatcatcattaatattttatttagagaaaattatataatcaaggtgtagtaattaattaattaatagtgaaagaaaaggaaagtatatatgcatgcttaatttgtagctgaagaaaggtgttgactaattccggattattgtacctgaagatgagattgtgtgagtcctagcttgccggccaagtacttcatcaccacttccaccttcatgttgctatccctgtgaaaaatgtgcaagtatatatattcattcattatcttaatgtgtgttttatgtaactaggacctttgaaaattccatataagacattataaatcaagagaaaaactttatttgattggtacctagctagactgacctatatagaaacttaaagactactagttagctagatatatatgccttgcagaaacaagctacacagtgatgatagctacacatgaatgagcaattttatggtccttgaggaggtatcatgaggtaccactttttttattgtaaatttggtatctattggtacctaaataccatgaggtaccaaattttacactaaatttttggtacctcatggtacctcctcaagaaccgtaaaattactcacacatgaatatatatgcaaactaaatggacatggattgttatgcatttaatttaagtttgtactttgaaattaaaggagagaattaagcatgattttttttgaagatatacataattaacttacttgattctaaggtagctctttggtatctggggcaaaatgggctctcgaaatctgcaaacatgaaaacaagattagacattattaagagctaaatggttacaaacacaagataaatttagatatataaaagctagcttgtgcagataaacaatatctacacatatatctgtattgggcttatttgcattgttgtcatgaggtgcatatactagctactttaatttgcatgtatgcatataaccaatcttatatggaatggatcaacatgttaatgatcacaagtttacatgcaatttttttttgaggaagtttacatgtaattttttttaaaataatggaaatggattacatctcttacatgtaaataaataaataaataaataaataaataaatatatatatatatatatatatgtatgtatgtatgtatatacacttactgatcaggggatgcctgaagtgtcagccacaagccggcagcatcagcagccgccgctcttcgcggcgggctgatgaccctcatcacgccggggagatcgccggagctcctcaacggccgcgcgaacgggaagaacgacggcggcggacaccggccgccgccgtggccgtactggtggtggtggtggtggtggtagctcctcaagatcggcagcgggaacagcggcggcctcccgttgtactgcttggcggcgaacacgtccagctccggcgccgtgggcgtagacgacgacggcgccgccgccgccgccggagcggtggcggtcggcgccgcggcggcgaggccgagctggagccagtccttgtcgccgtcgtcgtcgtctcctgcaccgccgccacgagagctcgtgccggcggccgcgtcgtcttcgggcggcgccatggctagctggtggtggtggtggtgacgtctacgcgccggcgcggcggcggcggcggcgtcgagctgggtggcgatgcagtattggggagtacaggacgacgacgagttgccgccgcccctcttgctgctgctgctgctgtcatggtggaacaggcggctcctagctggcaccatggcggcggcggcggcggcggcgacgacgacgacaacgacaacctgctgctgctgctgacctcgatcctgcagctagatgcacgtctcatgtctctcacgcactcatccgattacaccacgacgagctccaccatctccatccatggccgcaatcctttagtaattaacaagaactcaagaagtgcaaagaaagaaactagctagctacacgccatggatgagacagacatcctccatggctgtagctatagcttcaaaggcaggaaattaaagattggagcaaattggagagagagataatctaggagagatcgatgaaaggggttgtgagatgagatgtgatgaatccttttctctcctgtaggggagcaaactcgaaggagaagagacaaggagaagaggaggagagctagctagctgatggaggcctcactttccctttgctctcaaatgaacttggagcctagcttctcacccttatgccaagggatgcaatacaaattaatactagctagctagctactttctagttgtagagagagatgcaccagcttgaggagagataaactaattatgtgattaaattagagataagcaaagattgtgaatagctgtcatcagtgatgaattatatatatatatatatttggtttttaattaattaattaattatgtataatgtgtgattttgtgagatggaaggattaagggtggtgcagtgcatgcaggccataatattgcattaatttggttgccatttgctgtcgatcttgtggtagaatctatgtgcagtacagacgctggacaggagaactacctacgcaaacaaacgcacgtagccaatattattataggctacacgagcaggcaacattgagagagaaaacgacttgagaaagaattaaggagagagagagagagagaggagcaaggtgaagtatgttctaagttgaggtgacagaatggcaactggtgatcagctgaggctgaggtctccctgtgttgttatactgatctttctgagaagaagtaatatataattagttagtaattcttagatacatgtccaaggattctatatttagtccaaaggaaagctttttaaccaccaaaaaggttagctattttgtgctgactattccgtaagcatgttttcttcgtacatattcggttaagcttaattaattatttttttaaggtcaagagagaactttattaatgattaaatagagggttacattcttgatttaacaagtctaggcttaattaattattagttaattaatcagctcaacagtgactcaggagcaaaggctacctaactttgtatggagatgtcctagcctgtttcttttcatgttccaaattatgcgaggtttttttaagataatggaaaatgatgcgaggttttaattatattgatatagtaattgggaaagaaataaaactatagttgtataaaaggctataatcagaaggataaaaaaaaagaaacacaacaccacatatcgataacgcaagcaaacacaccatcaaaaaagcaatataatgaagacacaaacatacaacccaatgtcatctctaagacagtcggcacacccacgggctcctagacatcactaggatgaaagaaaggttgtagatgaaaagggcgatataggatccactctccctcacatagatccgtcatcatctaggaacgctgcccaactgttttaagggtggaatggtggattacacaatcgagtgatctcctaggcgatgtttcaaggaacaggaaggatgtgctgccactactatacccatttaacgattaacaatgtattttttttgcaaaaacttttaataacaaagttgttttaaaagttcatataacttatttttcaatttttaactaatacttaattaactattccctccggttctataataattgacgttttggacaagattgagatcaaacttttataactttgatcatcaataactaagaatatttagttcaaagaaactagaacaatatatatatatttgtctttcaaaattaaacactataataaaagtaaacacgtatttatttattatatatattataatagaaaaataaggtcaaaggtatgttttgtagaccgtgtcattattcaaaacgttaattaaaatgaaaccggagggagtatgtactaattcattgctctgtttttttaatactaagaggtaatggttcccaacccttactcttccatatgttttataatacacagccttagagctgttttgtgcttactcttccatatgttttattggaaaacattcagttaagcttacttaatcaattaattactagttaattaatcagctcaacagtgacacaggagcgaggcatcaggtatacctacctttctgtggaagatatatgtgttgttatgctcctattaagttaagacgctatcatgtccctgtttctgatacattgtcatttatcagagattccttaatcgcccaaaccttaaattcctgatgctaggtcagatcaacttatgatctttattactacatccgtcctacaaaaaatttacttttgtgtttctgtgtccaacgtttgatggtccgtcttatttaatttttttttaaaaaaaattagtcacacataaagtattattcatattttatcatctaataataataatagtaatagtaatcatagaaaatttttaaataagacgaagagccaaacattgtattgaaaaactgagaatgaagtctctgtgaaacggagggagta

SEQ ID NO: 29596 - DNA, 2098 bp, Oryza sativa
  unsure (1)..(2098): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactcgactgcgacaaagcagattacaatcaaaatgcagcaactgcgtgatggtttctacaagctaaatctatgttcatcttaaagagttcttttcacagagagagagagagagagaacataccattctttgtcgtcgttccaacctcagcttctccgcgtttgccttctcatattcaccgttctctagatgccgctggtctggccttagccgtgaatcagtaggagggagtttgtcctttgaacatgaccaatcaattcaattaggatcattgagtcttgatatcaagtaaacaattcaaagcttgtggagtattcatgactacacacatacctgaagatcaggagacagttcgttcaatgtgatagcgaacgacgatagattgtatcgcgttggattaggagaaggtttgttcttttcccacagaagtacggcacctttcaattgatcaacgctcttgaccttggaagtatctaaattactataatacatattttcatcccattttcctatcaaaaacgaaggtttgttcccatcatcatcctctacaaagccttgtacctgtggacataaaaagtgtaagcacggtatgaagatatatccaccagaaacacttgtgttcacaagtaaaaacagtgcatagtttcttacagtagcattcagaatgaactacatggaaaaaagggccaaataaatttccacaacatagggaattttcgcatggaaaaatcactactctcattgcaagggcatttcatgctactaccatatcagcatgaaaatggactagtttcatcaaatccatatacaatcaatggactgataattctaacagcaccgatgggcagctcagagtaggaacttgcaaccttgcattgagtttgtggtttaaatttatactactataacgcattaaaataagaacatgcttgtgcaattaatgtatcagatggtacgattgaaggagaccactcagctcttcatgttataagtgacccgttgtccacactccacacatgcaatgtttgacaaggaaataagcgtaatatacagattagtcagaaggtactgtacacagaaaacatggttttctccacatatcaggctaacagtaataaaaatgacagttaaggatgacaaggaaaaaaggaggtgaaacaaaacataccaggtgaggattgcgatcaagaagcgatggctctttgaacttgagtttacatgaatactggcgattcccttttatgtgcatggttccatgatggctgcagtacagcttcccaaggatgagattatgaatagttgttgtcacctaaaatggcactagcactttagcatgagacatacacaactttgttatgaagaacataaaaatcatagattccgttcaggtatcatcctacagaccttactccattggaagatttcaccgtcatcgaattccactgtcagaacaccaatcggatcgacttgaattgactgcccccaaaacttggatttgagattgctgtcgccccagaatttccagcccttgccttcacagtggcaggcaatcagcatggggtgatgactaacctagtgatgaaaatgacgaaaagcaatgtgttgcaattaaatgcttcacactatcaagatattaaattttagttcacagatagaaaaggaggcaagtgtcatgccttgtggaacttacattaattttcagtagatatcagttttgcattatatccttcacataaaattgaaatggaagataaaatatttcctttgcacagaaaaatacaataaagagttagataaccaaccttttctgcaaaga

SEQ ID NO: 29597 - DNA, 25968 bp, Oryza sativa
ttttcttcatgatcacgtctagggattgacattgagctgaagtctaatattattgtaaatgatctctatactctcatcataaaacaagcaaatatcctggaaacgtagaaatacagaaccacatatgtaaaatgatcttaccatctttccgtattgataagcttgatccaaaaggtgtgaatattctaaatcttcaaagcccttttggagggatgagagtggttcattaaagtaaactggaaggcatactcgtgtcaaatccttgccgacactatctttaataattgaccaaaggctgatgcctctctctttctctgtaggctctggtagtttactccgccgtttgatttgtggtaataagtgactagaatcttccatttggatatccaaaagtccctcaccacaactggttgagcttaacattgctgaagatctgtcgtttggttcaatgaagtagtctgcagcatcaaagaaagtagactcatcttcacaagtcaagtcaccaccatcttgcttctcaaattcatcagattctgtagtgctgtattctgcatgacaagcaaacaactacaacattaacaaatgctaatgtcaatttaatgaatgaaagttatagccactgactagtaaacaacatcaggtttttccttctaatacaaggcagaactagtatactcaggcaactaaatgaatcataaacattcaaaaatgcccgatggagtggcgtgaagaaggataaaatcgccagaagactatctgtgcagctaatcatgtgcagaaatagctcagtacgttctatgaaaacataccgctaaaatttccatgtcgagaactggaaaagtcatttcttgtcaacgccccctgtattatacttgcatctttgccttcctgcacaaatatgtgtgtaatacgtaaaattcctgcaggaaaagagagcagagtaacctttcaaggagagtaactttgcagagttagaaaacaagtcccaaagaagatctatgtattgatcagcagcattttaagaactaataagaatatcaagataaatttccacgggcataagaggtttttgttagctgccgattccattccaagttaggcatgtgaaggtttgcactggtcctaaaaatagggcatccaataattaacgcatgcagttccttacctcaaaatggtgcctacaggatccaaacaagcttagctggtcctcgtagcacagcttcagttgtttgcgaaagctggagaactccgtaagcacaatctgctcacactcttgtataagactttcattcagtccctcttgctgcatccgattccgaagcctggcagtcgagaccgaaacatcgctttgcacaaaagttatccttccgctgagtgatcttagcgaataaaaactcctcgccaagatcaaggcctcgatccaggcaacacggtcttcttttgaatctgtcttcaaatgaagtgtctttgtgggggaaaatatgtagaatctcctatcatccgacttgctctcccgaaatgctgacaactacaacataatgtccagttagctttgctatgggagaccttgcacatgaaaatgcagagtgaactttccaacatgtaacgctatccatcagaaataaaatagagcacacacacgcagactaccatccatcgtgttaatcaacagtcaagctaaatgcttattgcagaccaagacaaataaaaataaagatccaaagaccattagtttggcattccaggaagaaaggcatgtgaatcacttccactcccttcaactttaattaaagggtgagggggaaaaggcaagcaaaaggtacatcacatctaacatcaaaatatggagagaaaaaacaacgacaacaaagatttcaagaaaaccaagaaaatacaatcaagatggtgaccactaccttggaccaagcaagtgaagtgggcaagtagagcagttcttggagatccacaaggcccctcctgattcactctaacttacacacaggtcctctatttcaacccctaacccccttactatcttgctctagtatatgtgaccactggaagcaaagcaattgtacatcctttaattgttggggacccatgagcaatggccttgaaaagactcagtgctagtacgactactgcgagttcaacagctagtaaaagacttgtggaaaagcaaccctctccctctggagcagtacaaatcaataatgcaataaaattcaaaaattaaaaaaaaaacattcgctgagcatattctgtaaccacccggatttgttcaacttaatgcacagtattaaccatgcttcattaaggattaattgtgtcacagttggaattaattatatcatctacatttttttaatacgacagcgagggacggataaacttcactgtcttcatcgttctttagagttgccacagaaccctgccatttgtaagaaattctacaggagagcttgaaattttggctaaatccactaaaagttgagggatttttgtgcaaaagatgtgtctggttgtgtgatagagaaaggtgcggccctttttttttttttgggaaatctcgtatcaggaagagaaaaataggaatcatttttgttcatttgtaccttaacctgatactgctaaatttaggcattgttctgtggcattggaccacgaatgagatgattggtcaatcaaaacctcaggtgtttaactgctccaatatgcccccccccccccattcatgtcatgaacaaagcagaaattaattcggaaattttgttccattccaagaacacacaccaagatcatgttgaacaaaataatcgtccaaatgacaaacaaaaaagggaaaaaaaacttcaagaattcgtgaggacaaaagaacatcacgtcatttcgatccagcaaaatgtgacgcaatctcccaactaaccattgcatagtaacgagatttcgacagagaatcttccagtctctttcgccaacgcaaacgaaggaacaattcacacactaacacaatgcaaaatgtgattgatgcttgatcgattcagattcggaaagaggaagaaagagaaaattcctcgcagacacagattcgcaaaccgagaaatgttggggcaaaaaaaaaaaaaaacatgatctgcgagatcgcaggagaggattgggttaccttgaggcagacgacgccgacgggcttgtccggacggcgcgcgccgccgatcctggcggaggcgccgccgatcagcctgacctcgccgccgccgccgccgccgccatcctcgtcggcggcagcggaggcgtccctacgaatcttggagtaggagagcaccccgtcgtggagcgagaaccaccgctcccgccacccgcggccgtagttggtccacttgtggagcaccccggccaccgccaccgccgcgccgcccgcctcgggctccggcgtcggcggcgcgtccggcgccggcagcgccgccgcggagaggcagcagaggccgtggtggttcaggtggtggtggacgcctccgcctccgccgccgctctgcgtcatccgcctccttgattcgacggcggcgacgagaacgaaaaaataaaaagaaaaagagaaaaaaataatgggaaaaaaatggatttcttttttctttttttgggttcgcgaagaggagcgaagcgaagggaagaggagacgcgagttggctttatttagcagcggttggttgctatttatgtgtgggccccacctccctcgcctattttatgccccctccattttttttcttataagtcgcaaaaaagcttggaggagggttgtttttttctttcccaaactttaatttggccatttcttgagttaatttgtatgttttccacggatttttctcctttttgtcctaaatgcatccaagcaactggctttttttcttcacctttcttctagatgtaatcttgtctacgaaatacggattatgtttcagttattataaatatggtttatctctcaacagtttcggcgcataactataataacgacagcgctacgacgatttaactaccgatggctttgtcagataatcataacataagacaaagccaaaagcatatctttttatatgaactaaaattgtgcaagaaatttcattattaaggtttaagttaaaacattatgttactatccatctaaatgaaaaaaaaaagaataggcaagctaatagattgagtggtcgactgaggtttttataaggttgtgctagcacatataattccttattcatttaatggtataaaacatattcatcgacagtaacacatccgtgataattctgtgaatctcaagatatatagatcggtctagtctttggaggtgtttatagaagtaggatatatgcatgtttatatgagcggttgtgttttacattgttttatatatatatatatatatatataataacttagttttatactagaacacaagataagctaattaaaacaagaaagaaataattataattaaggaggggagagagacgttaagcaaggacatggatactgtttaccagatgtaggggagcacaggatgtcatagggatcaggagtggttcacgtgctatgactagatttagtgggccttaatgcatagttaatagtgtaccagctagtggaggtgagtgcaacatccacctctcaacaaactccatcacataatctagaccttaattaacctttggaaccccttaggtttactctatgtttgcaagacaagatagctaactggaaattaataatgttagaaattagtgggagtaccttcaagtttacacaaaagatataaatgatgttgcatatcttatgcatatctatactactttaaaattaacaatataccaccactatcctttatcactaacatttgagcccctcaatatcgataaaatttttgtgctccctaattcatcccttttccatgacaatacacgggcaaactagctagtatatgaagtatgttccggtggcactataggtttatcaaaatatgccagcttttggctatgaaggtatttgacatgatttacaactaaaaattattatattttgggacgagacgacatgtgtttaggtgtattggcaggcatgccgtgtgtgaatgtattgatgacatcgtgagagagaagaagaaaaagtaactcttgggagaagattgctaaaccataccagtgtaaaaccgtgtattcttagcttcaaatccaagagcacggacagataacaagtgatgtaaaagttgatcaaggttgtgcatacacttataaaaagcacatgagctgcacatgatgacatgaacatatatatgcatagaaaatttcacaactcatgctagctccataattcttgcttaggtactatctccttttgtcccttctgttggacatttccacttcaatttggaaggtctataaaaaaaatgatgcaaatgtttatagcaatgccatgaattttactcagattatatatatacacaacaaattgaccatggatgccattctttttagaaccgttccaaaattaaagggacatatacaggaaagtcggagtcatggatgcatggattgatacaaatgagaaataataaacccatattcttagaatcttaatagcattttcaggtatagttatttttcctagaaatccaaatattaacttttgaagggccctagtacagaaattgctatagagcaacaaattaatacaagtcactttctaagcaatgtttgcttacaagataaactttctcgtcatccattaatttttttttaaaaaaaactactagtataatttatatattgacaattataattggtcaaaatcacggtgtgggggcccactcaacgttggcacgtgtgcttgtcccggtgtggcccgcgtgaccaaccagcctctcttctaggcttacgtggcagcacatatcgttgtcttcccaaccgacccgtcactgacaggtggcccaacaccatgggtcccacatggcatatgttaaaatataatttgtgagggataaaatgcctaaggctacacagattttccatttacaatgttattataatttcatacaactgaagttcatcaacttttctaaaagaaaacaatttacgacactttgttgtatgatattcacccttattttagaccgaatcatattcacttttttttgtactccctctgctccatattattataattaaggtgtcctagtttttgtcttaaagttacttttttctaacaaagactaaatttatagaaacatgcaccaacttctacaacatcaatttagttttattaaatcatcgtgaaatatgtctcagtagtgtatttatttgatattgttgatgttaaatatttctctatcctaaccaaagttagagaacttttaagttaggacaaaactaaaacacctaaaatatacaaggaagagatattataatggtaaattgactatttgagaaatatcttttgtatgtcaataaaaacttacaccctcttaaagagaatacaaacatatttgtctacattgcgagtccaagactaaacataaaaaataacacaaacgcatgatacaatcaatttctaacacataaaattcatgatacaagattatatcatcacacattttcatataatagatagagaaaacgatttgccacttttctttatctcattgaagtatgttaaggagacgtactcattaatgtgtgcatactacctagggaatgcgctcgtagtgatgtgtggtgtgttctctatgtaatcaagaaaaagaaagacaagcgtgaggtatatatattaagaaggcacactcgaggatatgtgttaaggaaatgcattcactgatatatatgtgtggtgtgcgtgcgtaatgccatgtgttcatacatgtgtcttccaagcactcgactaaaaccaaaataaattatgaggtcaaaagcgaggtgagcatagcaatattacaaatcccatggctggcgatgtgccacgtagcttaatatcttgttgatctgtggcccccacgcttggacgagaaaacccaacatcgccaggcgcacccaacttgttgtcactttggttctttctttttgcaaggaatgcaatggaaaaccagcctatccccaatctagcactgtacttacatgcagtagtggcaggttgattgccaatgtataaacaatgcgaaatagtgtatttcaattttagcccaatagtgtgttgattgatatcatttccgtggctagtcaaagctcatttttagctatcattttcacgactgttggtcgcgctttattgattgattctctatggcatgttcgatttttgtgatagattaatagcgtacggtgctttatttagtatgaagatatacactttctttttctttagtgaggagataatatacatattttcttaggtgttagtattaactagctagacatatgtgtataaaatggttatcaatgattgttttgtggatcagggttctctttaccacttgggaaggggttacgacatctcgacggtaagcttgattaccgtaataaatcgagaacaactgaaaaaaaataaatgtttatttcaactttttttaaaaaaaaacttagttgggttaccaggcgttatcacaagtcggattactgcggtaacaccagtaacgggtggcaagagaaacttagtgtggacagcattattgttcttgccagcataatgctttgtttataggctttcaattggagaaaaaaaatgtgactattttacatgggccttctttggattctccgagctattaaatagctctctggaatcttgttatttaggagtattaaacgtagattaccgacaaaaccgattccataacccctaggctattttgcgagacgaatctaacgaggtatattaatcccgagggctattaaatagccctccggatccaaacagggccatggacttggtatagtaaaaatgaatcattaagagcagactataagccagctgcaaacatattttaagaagataaataagaagagagaagagcagcgggctacatatttgtagccagctgtagtatggactccaagacgcagtatgtgtatgacaggtgagaccatatattaatagtgtagtgtctaactattgtatgaatgagctataagattggctatagatgaattagagctagtagttggctacactattaaacttgctctgatacggtactactgttaggcagaggtgagtggtcaagtaacgcttattttatttgttcttggatctgatcacagttgacttaatcaattaggggatggtacggatagctgctaatgtagctttgttaaaaaggaattaagtagacttaggttcacatgtcatgaaagaaaatgactagagaagccatgtcagttttgaataattgtccttcttaagatagcctaaaattgaatccgccgctaccgtaattttcttgatcgagttcaacttcagcctcatttaattttgatttcaaaacagtagctctcttgattctatcatcatgaaaaatctatttccttgaacacggtaatttcacagaattttcatatgaattactttagcttctccataaatcctgtaaaattcctttgtaccaaaagagaccttactatttttatataatagaacgaataccagtctttgcttcaaagaaattataaccacttattagttattacaagcaaatgttcttttagcatagatcaactaaacaattccagcaaacaagaaggcaaagaataccttactggtgctaagtggtgatggttcctattagtgatgaaaacggagcggatagtttccgtctgctctggagaaaaacgaatatggatacctttcggatcggataattctcagattgttcggatacggttacgaatatgaatattttctcctagatacggatatggatatggtatcggggtttccgttgaatacggataataattcggatatccggtgaacagtgctattcgaatatccgcagaagccgtgagacatacccaatttctttataaccctatgatgttcaatatacctttttagattttaatagtagttcatctcttaacactagtacacactattaatattatttaaatttttaaaaatatttataaattatactacattttatataaaatgagctaattatatatgttgatatttgtttctattagaagttgagttggttttcgtgttccaagaaaaaaatgtttcagtagtcatgtccaatcatattcgattcttattcgtatttgtttccgtattcgagctatccatatttgttttcttattcggcaaaaaatatgaagacaaatatggtatgagcattatccgctacgtttttatccctagttcctataaatgcaaatacaaatgtattcgagaagtctcaaacaccaaactaaaacattgtttttcctcacaaccaactcaaagaagagaaaaaaaaaaaccatcaagacattgttttgcttgctttcttgctgcacaaaacataggcacaccatcattcagcagtatctttaccacttgatgcaacctgagaccctcatgattttgtttgtttcagctgttgttctctagggtttcccaaaccgctggggctggggttaccgcgccccggcggtaagcacggttaccgcacggtaaccgcaaaaaaccgtacaaaaccgtgcaaaatttatcaaaaattcaaattattttttaaatttatttgaatttaaggaggttaccgcggtatttatattaccatacccccacggtaagcccggtaaccgcggtaaccgcgcggttaccggcggtaaggtaaaccctgttattctcctattgaaaaatcaaaggaaacaaagcatatgtgagaagataggagaagagaggtaaggtaacatggggcctgagttggggggacaatgcataggtgtatgtgttgggatgatatcaatcaaatcatgtcaccttcgatcgatgcaccagatgttccctcagcatccatcacggctgcatgggccttttagacccaagtgaaacaaagaatcatacattagagcatcatcgacatgattgtgtactactccttcagtacaagcaccacatgattttccttttaggaaagtaacataccacttgatattttttttctcggttacctggatgacacatatgtagacaccactatataagggtttttacagtgtggttaataatatctcagtccgagtgagccagatcggagatttgatgccacgtcaggctctctcgttgtcctgtgaagaacacggagccaagttgagccacacgtttttatcagaatttgcaggtctggcctatagttatgccccacaccactagagaaggaagaggaagtataggtacctcgtcgccatccctgtcctccatgccaaggggaggagggcaatgaggcgctatcctcgtggagcacttgggccgagccggtgacggcaatggcatggccgcagacgaggaggaggggtgcaagctcaatgggggtggcgatggcctcgatacgtccgcaacaacagcccgacggtggccgcctcaaaccctcgtcccatttgcagtatgttgtcatcgtcttgtggatctcgcccttgtcgtcgagtggtaaagaaggggaggaggggagaggggtgccaacggggagttgaggtgctaaatggagatttttttttcagtgagcgatggagatcagggatgggtcaatggagcttgctgggctgccgccggcaacctctcgcccacctcgatctgcactgaagaagcacgtcggctcgatggggaaggcggcagggtcgaagaagctcgccgactcatcctaccgtccctgaccaatgttgttgtgcttgtcgtcaacctccactcgcgtgtcagctaagcttttcaccagtccctcacgctaaactgccgagctcgtctatgcatcggttgggagaagtggagaggggaggcatcggttggggaaggagagggatagtaatctggacaggaggcctgtctagattcgtggtactatgaaatgtctaatcagatattaggcttctatattttgggacgagagagtacatgataaatcttaactatttggtggtttagttgtttaggcatagtcattctctcttttttttttgttttagaaacagaagacaaacacatgcgctcactacacgcacactcacccctataaacgcacacacgcacaccctatctctatgagcacctctaaaagactagactgacatatgttgagattcacgaagtcaccactaaagtctcgctatcgatgaatatgtcgcctaccattgaaaaaataattagctctaaatgtgaatacccgtattaagtctaagacttaaatccaagtgggttgattcgaccacagggaacctaaccagttgagtgacgctcacttcgcattcattctcatttaattgaaacaacgctaattaatcttattttctcaccgttcttgtctatcattttctagaaaaaaaatgacatataagttacttgattattgtttcacatgaataagattcattcgcaagaactaacaaccaaccaatttcacttagctttttgttcccaaaaaaatggaacatagagatgactccaagatattatagttgcatcacactcgtttaattttaatgggttgtgtactgttattctcttggttaacacaaaaatatcgagaaccatgatatgagcagggtgtacacattactcgaattaactagttaactgaactttctgacgcgttagcatctctatgtgcttaggaccaataacataggattattacagtacacatcaacgttgttcgttaccagtaattaatcacattgcacgaataaagaggtatacgctgacgtcaccaaccgtacaaaggcatgcttgcacgcgaggcttgcaaatgatgatgaattttgtttcattgtcacgatgatcacttaactctatagtactactttaatttgagtgtttttcgtcgcaagctttaagatcaaaagccactactcatattgttgcaaaaacacactattccaatatagtattatacgaattcctgagctctcgaataagtaggttcacagtcgttttcagattttaagttgggaaaaagttgcgacgctttaacgtcaagtcgcattcatccaaattctgcctaataatttctagtcattgatcattgaccggtcaacaacaatctgctgaactggaacatgcaaatgtgcagcctgttctcaggaacatggcctgaaaaaacatctcaactaaccaatgggcaccgttgatctaacaaacattgattggagtacacaagaaagggaagcagcatatggcatcgccaaatgcaatctttggatagttttgtcactgcaagtatcaggaggaattgctacagacttttttaactccctgtcaatattgctgtctgtcacaccatactccatacatgtcccccatacatcagatttagggctcctccaagggcgaaaatacggtgtggatcatcagcctccgcgagcctccctcctggtggcatcatggaggatgtcaatgtcgacgccatcctggggaagcagcacgtaccgcaccaccgatcccctgatgaagcagtttcgcacggatagctgccagagcgaaagcttgagtcagcatgctcaaatgaattctttgtaaagtgttagtgcttgattaatgtagttcttccatatagaacagtgaacacaggtgcgttgttgtatttttaacaatagaaattaacaggtgcaagtggtaaagcaatgagagtatgaagattgtttcagcaagcaaagataacaaaaggatatgaatctttccatcactatcatgacctacaaaacacagtatataacattgatctatagctttgctttcctttgggattacttcaggcatcatgtacttgtaacaactaacaagcaatctttagtaacctatgcagtacaaaagtacacccttcatacaatatcattggatggaactgaaggccaaataaatatctaggtacggatactggttgtccctgtcaagtaatgtgcttgcctggttacaacagtatttgcactggaattaccagtgcatcttaagctcctaattctgcaccagtaaggcatgtcacgaactaggtataccactatatgatctactccccattaattcctaaattcatgtcaatgtagcccaaagtttgttctacaaacatttagacataccgccttttatcattagctggtgactacttcaggacatttactacagaaccattgattggagtcaacacaccactgtgttatggattggctaaggtaagggtctgaagaccaggggatagggcactcgccctctaatagcagcggcaggacttctccctgctgagctgaaagactcattgattagaactctaaggcttagcgctaacttcagatattaattgattatagggtatatggggtccctttatatataggaggatagacttgacatccaaggaactaatctctagtactacagaaaccaatccaatatctatctataactttctaataaacatcatctctttcctaactagatactctcctatctttatttgactattcctaaattatcatgcctaaactgctgcatgggcctggcccatgcccaaaacaacagagagtaacaagtgatctaatgaagagtaatatctactatggtttataaagatggttattattatcttccttatgcatactcttggttgtgggatactgggatcctataactgacattttgggcctcactgtatgcccaaagaagaatcagctgctgccataatttgaattttagaactttttttttggagttgattttagggtattttcaacttagtttctttttcaacattggcttttaagttgctaagaagacatataaaagtttacccacaaatcaatttttggatatagtcagctcttggccaactgacggagctcctagttactaacggagagtgttacctgatccatatccatatcgtacttcttttacttatgcaactacatgtcagacgtgcaaccattctgaattgtgatacagcattcagcactaactaaacatgtaaggatcatgctaaaggtactcctttaacagattaataaatcaacagatgacaagtacatgctatgcaaacagaagagaagaaatctgaaatcatgtagaatgaggtgattttgaatgtatccattaatctgacacagaccaatcacaagaagcatcatgatctgcaacactgaatggcatggaagatgtagcacaggcattggggctccttcagaggatagtattctgacaagcccggggttagcaccgtgcatgaaccaatatctatgtataaatccttttgaaagaaggcagtgcgaccccacctccatgaactacattttaatgaatagccccttgaagttcttcaatactactaagtcaaaatatagctacttttggttatgactctggacaagtacttgtccacattcacagccaaaagtagttacatttcaagacggaggtagtacataatagtaattacaaaaaatgttatagtcctatttgaccattttgaccttatcaaattgactgagttgccacatgtacatgtgtgttgttcaagctaatttggaatagaaaaatgtgtaaacacggtaaaaagaagtgaataattaatcaactgaaaaaccatagcaaatgcacaaacgcacatgcatattgaagtacaaaaccatgaaaacttcctaaatctatcttgaacagagaacaaagcatacagagtcaatatatctacagaagaccaccgtaaagaaccaagaaacactgtgtttgctgcagagtcaatatatctacagaagtacccatgcaaacaagcggctaattgctatccatatttcaccaggacagagacagacagatagatagataaccagagcagcatcgcatcgcatcgcataccatgtgcgggtacttgtcctggtcgacaacccgagtgttctcgagcttgatgttgaggtattggtcgacggagtggagcgtgccgcggatggccaggtcgttcttgagctccaccgtcacctccttccccacgagctccttgaagtaggagaagaacagctgcacagcaaccaaatcaacagaacaaaaaataaaaatcaacacaaactaacagaacaaaaaaaatgaagtgggaagagaagaaatcaacgagcagttgaacaaaaaaaactaaaaaaaatattctaccatactggccgcagaaccctccccgccttagctccgaagaatctgcagacgcaagaggcaggattagcacccagtggacgggatccccaaacatttttgaggggcaaataaaaacaaaacttctagtcctattattaaggtttaaggctatcaaattaagagaaaatcagcttctcccagatctagaagagaagatacagttaacgcaggcaagcaaattggacacaaaagcgggtgggttggagagagagagggagatgaatgagaaaagaggatgcggatgctcaccaagaagcagcaggacgacggcggcgagcgcctctccccctcccctggtagcgagatggagatcggcgcaggcgcaaggagcggagaggatagaccggaccgccggagatggaagcgcggcagccggatcgggaggaggcaaaaccctagaagagcgcgagaaggcggaggaggaggagttgggttgggttgggttgggtgttgggtatgagataggaccaaaccatattattatgggccgggttagggtgaaaggcccatatagctttatttattaggaaaaaagtatactctgactccctcaactatcacccgagtatgattcatgtcctccaacttccaactattaaaaccggtgcaaacaaataaacaatatccctcggtggttttggaagtggttttggctgacgtggcggtcttgaccgagtctttatccaacatggcgcttacgtggcattagaacaaaaacaaaattaaaaaatgtggcgcttacgtggcattagaataaaaacaaaaaaaatatgtgggacccatatgtcattcacacaaaaaagtgggactcactgacatgagagaccacatgtcatcctccctctccttcccttcttcctcctatctctctctctcgggactcaggagcggcggtggtggcagtggccgatggggacgaggcggaggggagcgttggtggcggtggtggcaggcagcgccagcgatgacggtgaggacgaggtggtggggagcggcgacggtggcggtggagaacgcggctatggcccgcggccactaggagggaggaaggggtatgagaggggagccgcccccgtggggggtcggagtcagcgtcaccggcggctggctagcgcggcggcagcggcacgagctcctccctgaagcacgaagcacgccctcctcctcctcctcatcctcctcctctgctctcctccgccacaatcgtccccgtaaaccacctcttccgccttctcctcctcctcccgaccgctaccgtcgccgctcccctccgcctcgtccccaccgccaccgccgtcgctccccaccgccgtcaccgccgccaccgctcccctccgcctcgtccccattggccactgccaccatgagagagagataagggagggagagaggagagagagggggggaggatgacatgtgggtcccacatgtcagtgggtctcactttttgtgtgaatggcatatgggtcccacatgttttttttgtttttattctaatgccacgtaagcgccacgttggacaaagactcgttcaagaccgccacgtaggcaccacgtcagccaaaaccaccaaggggcattttttacaccggttttgatagtttaaggagtcaatatacccggttttgtggttggaggatatgaattatactcgggcaatagttgagggagtcaaagtatattttccctatttattatctcatgtgatttttttctcacacaaataaaaagggagtgagacagggatgcaagtggagcgggtaaacgggatttttccccctccgcttatctcacttctaatttatttttttttccaaaattaacatgtgggatttatttctgacacttatcctacttttaatttattttgcccctaaagaaaaagggagtgagacagggatgcaagagaagctggtaaatgggattatttttcctccccttatcccacttctaatttattttctttctaaaattatcgtgcgggatttatttccttcgcttatcctacttttaatttattttttttccaaattatcatgtgggaaatgaagtaacgagcgggttttattcgtgtagttggattagttgcatctctagagcgagatgaactaaggttacatacccaacttttggattttttatatatactagcaaaaatgcatgtgcgttgcaacgggtgaataaattctaataataatatacgtttttttatgcataattatgtcaatgataatatttgtattttaatgagcggcttgtttttttataaacggcgtattactttctaacagtttcttcttagcatgtttttttttattttttttactgacaacaaaaaccatattttcctccctttttgcttttcttttctcacgcgttttttgcttttttcttaacgttctttttttgcttttttttccaatagatgagaatatatgacgaaataaaagccgtgtaatagatggtaaaaaatcgatggatcctatccgactcaagcgtccatcaatttagcgttttttttctgacagttttttcagagcgatttattttttaatagacagttttttttcttgcgcggttttttcaaataatttcttagaaatggcgcattttttcttacatttttttccttgcatgttttttttaaaaaaaattaccgacgatggaaataatatttctcgcacggttttttatggaagatggaaaacctttttagcattttttttgtgcttttttctcacgcacttttttgaaccgtttttatttttctcgtgcattttctctttttaaatagttagattagattagagatagagaagagatatatactgataagaaatcggaatttgtttcgccctttccatttttttctcgcgtgcatttttattttttacgaaccattttttcgccactttcttagggaatcggacgaattttttttagatgttttttcagattttttcgcctttattggaatcagactttatttttctgtttttaaaggaatcggatctggcctttatttttcaccacttttttttgccttttataggaatcggatctacggtttttttcgccacttaggggaaacaaaattttattgttattgtttttctttttttcccttttttttgcagtttttctttttctttttatatgcacctttatgccctagttctctcccttttattattttttcttaaaaaaaagacctcaagtatcttattgcaagattataggaactcaaatgtaaatataaaaattatagggactcacatagaaaagtacaaacccaaaaattaaaattatataaaaatggaatgctctcgaccggtaggttccgtttttgcaaatagatcttcaatccggcacatcaatttttttcaccaagatatatgggatatcacggtatagattgaaactgagaggtgtgtgcctgggatctcggactcaaacttttttttttgttttgacgggagtcggacctgagagggagttggacttttttttatttttttcttttttttgacggacgaagaaaacatctcttatttttttaagtagtagagaagagatagagatagagaagagataatatatatatagtagtatataaatttataatttaacatagaagaatttaataggatgtaacaagatgattattaatacaagcagaattagtgtagtctattcgttgctccgacttcaagagagacgtgcatcttaacaaagctggagcccaaccgatggtttccttggatggtttttattgctccaaataattctagccccgtcccccgtgcttctctgtcttcttgaaacaaaaggtcgtcacattgttttacaagtgctcaggtgtacgttggattgcgttgttgcacccgactacccgagagtagtcataccaaaatttgaatatcataacagtgctccattccatcgactaggatttgccagccttgagcactataaattgtcctcaaacgttatcatggattatgtactaacataacatgaaaggatcaggaaaaatatctttgatcaaaatttacacctcagcacttcttccattaccagttcgcaagtacatacgcaaacaatgttcccttccgcaaccaaacgaaacctcatggtatatttgagattaattcggtataaaatgaatgtccattcgttctcagcgagctaaaattcctcagcccaaatgcatacagaacttgaggaccgatggcaaaggcaccaacaagtagtaaaagaaaaaaaaagcctacaatgagaatgccgggtgcttccttctttccaggagcaggggacttcaaaaacaaacaccgagctcttcctttcctagctgcaaattagtgtccgggacaaggactggaagctggatcaactttactacaggccggatgaccagtagccaatgctcttgtaccctcttaaaatctgaaatccgggtcgacgtccattgcccacgaaaatttcgcaatgagtgatttgttgaaaatctgtcaaggcgaacagtactgtcagttaatgtaatcggttcaatcatttgatttgatcatatgccaaatgaaaattttactttgttcaggatgcaatgacgacagactattatcatttcaaatatccgggatttcaaatcaaatgtttttttgtatgcacagttatagtttagttgaacagaatcccacccccaatataaaatgaagtgtaatctcgataagaacaatgaggatgtgcctgtcaactttgcataggccaattcatatggaaagaaaaatagagttgtcctaaagcactgttaccttctcgatgggtacttcatggcgtttgcaccatgcaacagtaattctgggatcaaggtaattgatctttgaagttcctagtgccactgtctttaaatcctctttaatcttcttatccatctccatcttctctatcttggtttcaatctgagatatcttcttttcaaacctgcaagcaaatttggtgagatttctcaacattgtttttttgtatatatacaaaatagagatctatctgtgattgagattattacgcttcaggggccaaatttctttttggtttcccatctttgtcattgcctagattctttcctttccttactttgctcaagtctgccttcaattcatccctttgggcctggagaaaagaaaaaaaacaagagagtttaccagaaaaggacaaaagaatgaaatggtacaatgttgggctaatcatttgcagtagaaattcaaccttcaattcatcaatcttctcattcaatctagtcatctgggaatcatgtgattttgagacactacgctgatggttacagattatagcaacctgagtaaacaagaagtatggttgagatcaaaacaggtcaaatataagttttttctatttcttaaagagaaacacaatagacctctttgttggctcgttgataaaccgcaattttttcaagaagagttccatcttctgtttctttgtgcaactgtaaaatcagcaccaatagacatacgttcagaaaacaactattgtgaaataacacgttacacacttgagcttcaagtaaacagaacggaacaacatatatactactaaaatgtcttaaaccattacaaacttcaatcaatcacttcatacagcagtgaaagtttaagaaaaagatgtgaagatctatctgaacttacaatatcatccaaggtgattgaagcattatatgtacggaacacttttgcggtaagcccaggcatcaagtcctttagatgagcatttagcctggttgtatcgagtttgtcaaagagatcttgtcctggtttcttgcctagaataaagattaagaaaacagaagtgattccactagtgcaaggtgaggatcggagggaaagaaagagttgcagggcagagttaccagcacggaattcctcaattgccttgtatacaagcagttcaacctctacagtattgaagtatcttatagaatctttaccaaggaagtcgaactgtaaaggttatggaacatcagatatcatctaaatcaagttacacatgcagaatttattaataatgaagaccaatacctgcagtttatttggaggaacacaagtaacattatcaaccttcagtgtacagcaaccaacagtttcagcctcatcttcatcctgaaaagaatttgaagtagtggctaagtatacaaactatgtatgtcactgtaattcaaagctatttaataaactatatgtatgtcattgttgaagattgtattctaacaaaaatctatgcgcattatgttgaccattatgcaaaattatgatgagcagccacacagctaatcctagatacagtcttgaaccaaaacgctatgttgcatagtgtaaatatccattcagaagagatgtcagaacagaaggcacatattccttttttttttgttattggttggttggtgggggagattactgtgcaatctgcaccgatagcagaagaaatatatcccaattcataaatgtcagtcagagagctcaggttagaaagtaccttctcattgcctgccctaagggctaacttatctataaggtatgttgccactgcaatttgtttctttgtcttatctttgcttctgaaatcctttgtgtaagtgtcacgaattttgtgtacgtgatgctgcaatgaccaagcagaaaaaaattatttgtacatgcaaactcaacatctccatgacacaaacaatgaaccctctcaccttcaattttcgagacttctcatacttctctttgtcactttggccctttaatgcactgcttgctgccaagaaaacatacttgaaatctttttggcttattggatcattccaaaaggccaaccatgtaactgtgttgtcgtgtttgacttctttccaactgcagtacacatgaccaaataaagagtgagcacatactagcaaccccttcacaaatataaattacacatcaaaggtaatgggaaaatttccagcgtacctttctccaggtatgggacattcggggatcggagccccttttccgatatttattgtaatatcgcttggtttaatgcggcgcttcagttttcccatctaaaacgatgtaataaaaaagcatcaaaatgatgtcgcttacttaaaacagcacgacgagtatatgtatccatatatataccttcggatgctctccgcgccccctgaacaagccaggtggttctactctgaaattgccaacctgaaaggaacaaagtactttaacccagagtaattttatgcgaaatgaacctagtatgcacagcagatagaagatgacacagctgtcatgtatgttaaaaaaaaaataagaacatcgaggcaacattacatgtcatgaagcaaactaagtataacacatggtatgcattgttgacatctggtgcaaaattattcacaaaattgaacgctagggtaaaacaaaacaattgctagattataataaaaaaaacatttacctaacaataacagaagaatggggaacaagagaaatatctacaattactagccataactttctgtaactacatttttgcagcacaaagaaaaataccttctctttaacaccatctacaatagcccacatgtacttctcctcttgtttcaatttctcttccttcaatgctttcttctcctgcagaagaagaattttaaagattgttcacttccgtagacaactttttatagattaccagcacaaaaactaaattcattctgctgaataagtcaaaacaaaacatgcagtacctcagatgtcatctgcttcttcttctccttctctcttaggtgccattcatagatcggggtgaaatcacaaagctcaaatttcttgatgacatggtttttaccaagaatttttctccaatcagtgaagaagttgtcaatgaatgtttgcttggatgcataatcagtgtctttcatcacagcaaacatggtggcaacctgtaacagagataattagtagaggaacaattatctggtagcaagatatggattcaggagaacctgattaaaatgtcactcatggtacaaatcaaaagatgaaaagtaaagtaaaaatcagctaatgttatatatctcacctcttcttgttctggcgtcagatcaacaggttgcccgttgtaaagcatcttgacaccatgaggcttgtatggaggggggaaaataacaccactgtgcaccaaggtagtccatttctgtccaccaccagatccaggagggaccttcattgtctttgagaactgagaatttttcattgttttctttgttttcattttcattttcattttcttgttgtccttctttaaagatgaaggactcttctttacgatattctttgcaggtggcttgctttttgaagactcacccattttcagtctttgtgaaagaggtacattgtcattgtcatccgccttgggttctcttttgacacttgcagacgcagaaacatctgaaggcctcgccttcttgagagctgaacttgtttgattattattgtcaattggccttttaattgaatttcgtgatgtgctcgcgtcattgttagacatcttgctggaagaacttgcttttatacttgcagacaggaccttgtcctttgaacttgagatacttgcagatgcattgccagtaactttcgaaaatcgggcagccaatggcttctcatcctctgaatcatcagaaacattacctccccttttcagagcagcattagttggcaacctgctggccagtggtttatcgtcctctgaatcatcaccaggttgctcaattttaggtgtagttttcagtacaatagccttatttgcactactcgaaggcgtttttgttgagtttatcttgagactcaatggtttatcatcatctgaatcatttgctgtcccacttcctacagcaggtttcttcaaatttctatcctcgacctttctccttaatccgattggcttatggtcatcttctgagtcatccgacttatcttccacgaaaggtcttttcaatttactcttatccactgagttactattatggctactatgttctttggaactgttcggctgacctgatcccaaaggtcgagggtttggactgcttgactgcggcctctgttgcaaaggcctcgaaacaccagtcagcccattcttctgttgattggaagcaacagccttagggctcctaataggtccggcattccctgatgagccctcctgctttgtgggggtgggcctgttcttcacagaggtgctcgacctcttgaaggagatcggaccttcctcgtcgtcgttgtcaaacataacaggatcgacaacagccatcgatccctaggggcggcggctggcagacggaacaaatatgctgagtcaaccacacctgcaaacaaagtaaactcatgtaagcaacctgaagatagcattccaccgttccagcacaatgcacaagtgcactataatggatcaaccaaagcaatctatgcgcaaatctaatcaacagaattcctgcttcaaagtaaaccatctccagaacagagttcccatcgcatcccaacccacgcaatcacccctttgagtcatccacaccgatgcacccgccacaaacacagccaattccagctcaggacgaggtttcctccctttgtgacatcaataccgcaatcaacactacggacgagaccaaccaaccaaaccaccgctcccccctcagatcggccgcccggacaagacgaaaccgcccgttcatccccctccccaccccgatccaccgcaccatccccccatcgcccccaccgccgcaagccctagggaggagacccccgccccgatcacgagcccttcccaacccaacgcgaggcaaacaaggaagcaaggagcgggatagagagagagaggaggggagatacccacctaggcgccgcggcggcgacgtcccgctccccggggagcggtgcggcggcggcggcggcggcggcggcgaggcggggagctagggttagggctgagcttatctgtgtctctctctcctcgcctctcctcccgctctcgtatttctatcgctcgctctcacctcgcctcgcccgcgccgctgcctccgactcctctccctccctctctcgccttgcgttttttttctctttcctttccttttttttcccctttctgccttgtatttttttccctctccttacagagagagacgggttgcgtcgcggacaggagaggcgtgtgggccccactggcagagacccgcgtgggtcccgcgcgcagtgaggtaaacgggtcgtggcgggccccagctggcagcgctcggaacgctacgtgtgggccccacgcgcagtgagagaggagcataggtcgcgtggggcccacgtggcagagggggtgcgtcgtgggccgggcgtgaggggcacgggccgtgtggggcccacgtggaagtgcgtggcttgggcttgcggcgacggaacggaacggaaggggaagccgacgtcatacgcggcacggggggatgggcccgcatgt

SEQ ID NO: 29598 - DNA, 24856 bp, Oryza sativa
  unsure (1)..(24856): unsure at all n locations
ggggggttggaaagcggtggggatgaaccggtaaaattacgtttgttggaacggaaagtttgtggatcatgtgtgtacttgaatcaatggagtgtgtggattagtgttcataattattgtgctttgtgctttattactactcctactttgaattagcctttttaggcaagggcatgtacaatagttatcaatagtggtctcttagcgttgctaattagaaatacttgttgacatggaagaaagagaaaggggagagacaaaacatcgttgttatgcatgacaacgactcttaatcactataatatggaagtatggttatataatatggaaatatggttgtatgagggtaaaaagatagaaagaatattaataaaaggaatattttttgagttaatgattagagcctttgtcgtctcaactattgtaaagatatggtctcttaataatcttgtattgtttaagagaccatactcatctctaccattgaacatgccctaatatgagctctctatattaattaatgtcactagagactaccatcctacaatagtagagacaatatgtaacgtcccgccttcccccaggccgggccgaccaacacatgtcttttctgcacactttgtcctcactcgtgtgcacccgggaagaatttcccggtcggtcacccatcccaaattgctctaggccaagcatgcttaaccctggagttctttggagattggattccggaaaagaagttgcaacttgttgatatgagtattctattaatcctattaagccctaggccgggatgttacacaataagatttgtaaatcattaatgcactaaatatttttttactatacttctttccttttatacaccatcatgcagcaaactttccgttaataaatgctaagagtcgactctaagcagttgtcatgcgtaggaacgatgtttctcctttcttccctctctttcttccacgtcaccaaatttacttacatgagcatgactaggggtgggcagaaaaagaccgaaccgaaaagatcgagaccgagaccgagaaattcagtaatcaattcggtcctaggtagtgaaagaccgaattttgttcggtcaattcggttagtctcctcgggtaaccgaatagaccgaaaaaaccgaattatcaaaaaatgtctaaatacaacctacaatccactatatttaataggattaaactctaattttcacatccctacttcttctaggcatgcaacctaataagagtctttactcataagtgcttacgaatttttttgtgatttttgtgttgaaaatttccattatttctttgcatatatgaaaatgttgttgaatttcggtcaggaccgagaccgaaaagaccaagaccgaatttgtcggtcctgatattttttcactgaaattcggtcttcacttttcaaagaccgaaaagaccgaaagaccaaagaccgagaccgaaattttcggttagaccgaatgcccacctctatgcatgacaacgaagagagcccgctattagacactatattgtacatgcccttagcactcaacctaacaatacatgtttacattcttcacattcctaaatttctaatgtttggtttacttgtcaggcaaactagctatttttagcagattgcttttatcatttagtattaagtgtattgcaattgaaagcgagacttggctctccttcgaaaacgaagttttacaaattgagacgaattggctcctgaaagttagattattttattccaaatatcagacatggcttaatcaaatgcatgtgcaactaaactaaatctagcatgccattacgtagacttagttagggcttcagtgccaaatacatgattggttacaaatttggcaagtatatgcgttcgagtaaaagaaacacaaccaaatttcaaaatatattttcatcggaaacttggatggtacttaaacatgaaattatgggatatttagattgctacaaaataacctttttcgaaatttggaataacaaaaattttagtaattggtaatattgtcaagttttggtagggtttcttttttggatgtgtttagcttggtacccacatataggctaccaaatttttgttacatttggaggctgccagattttattgtgatgttaccaaatttatgtgggtgttaccaatgttcgataataaaataaatacattcatatgtttttttattttttaaataatattgtctaaaatgacatcaatgtggacaagctctatgttaatttatatcgcccttaaccgttaattgaaaaatgcctagttttagagtatcacctaaaaaatccatccaaaaatatctttggaaccctaaataaaatttgaagtgtgaaaatattcatctttctaagagatgatttattattgaattcctacaactaaaatattgggaccatgtaaaactaatactaaagttctatagaaaagttgctttaacaaatcatatcaatctatttttaaacttttttaaaaaataattaattaatcatatgctaaacttacttcgttttaagtatctttttcccttctaggatgctatcaagctacctttcttcaaccccatatttgactatgttaaaaaacacaaaaaaaaatccaatgtatcaccgacgtgttgcccccatgccccacatgtcaccctctaattgtacaccattttacattgcattttttttatacgagtgagttcattatctcaaaaaaatatgagtgagttaaagttttcatatatatcatcatggtttgagtttgaccatatcccaaaaggaagaaaacaaaaagaagacgatccaattgccaactcctatgtacacgtcacaaaatcgtttaatatcgcttcccttggagctgagcctcgttggtatcgaaacatcgacgtaggagcctcgggatcaaattaacaaaaccttagtgctggacaagtgcaatgactaatatgcccttactagcacctagtatcattttctttttttttaaagaacaatatcatttttgataaaacatttgcatcaccggagtaagcgctcttggaccttacagtgaatttagaggtattatttcttcaatagtatttgctaacgaaatattaaattcttactcataaattttttttcaagggtttcattatatgtctcggcttaggcttagccaaccaaatgcataaactaggaaactcaatttcttttttttaaactcttggagagcttttgtttctcatcaaacatgttttcataacatggttgataatttcataagatcatttgatgggctagatggttgtgaaaatttggatttgacatatgaaggacttcctagaaaaaaaaccctcaaaattagttcaatttatgtaaaatttcaaactttttcccaaaaggaggcccaatgagaacttgtatagtcctatcagacatggatgctgcttaaaaatttagcagagttagtcttggttgggaacctttccctccaacacgaaaatggagcagctcattaacacataattaattaagtactccctccgtattttaatgtatgacgccgttgactttttgaccaacgtttgactattcgttttattcaaattttttgtgcaaatatgaaaatatttatgtcatgcttaaaaaacatttgatgatgaattaagtcacaacgaaataaatgataattacataaattttttgaataagacgaacggtcaaacgttagataaaaaattaacggtgtcatacattaaaatatggaggtagtattaactaaaaccaacttgaaaaatagattagtatgattttaaaatagttttcctatatatatatattttaaaatatataccatttagtagtttaaaaaacgtgcacgtgaaaaaagagtagaagagatgggaaaacaaagaacgaaaaaaaaaccttaacattttctaaaaacctgatgaaaaatctgcaattttctcaaaactcatccaagggcaaaatagtcaaatcatcactattataattctcattaatctttctcttccacagttccactcctccctcactctctcccacagttagcatctcgccattcctccgatccccacctccaccaatggcgctctccatctccacgccgccgacctcctcctccctcctgccggcctccctccaggtacgccctcccgctccgccgcctcctcctctctccgacgagctctcatttgcccggttcggccgctcctcgcgcccgtttcacccgttcttggtcaccgccgccgcttcttcctcttcaggtcggcaggtggagctcgtcggcggcgatgtcggccaggcctgtggcctttagcctccggaggccggttcttgcggcccgtgtagccgccggcggcaacgcaccgtcttcctccgtggacggtaaggatgctggccttgtgcttgtcagttgtctccttcatggcttcctgtgtgatttgagttactgattttggtcagcttggttgtagaggtggtcactgagctcgatgccgtggccagcttcagcgagatcgtgccggataccgtcgtgttcgatgacttcgagaagtaatactagtagttgcttctttgctgttatcccaccattgaatttagttggccgatccaacttaatggaatgatagttcataggctgctctgttgattgggttcaggtttgcgccgaccgccgccacggtgagctcgtcgctgctgctcggtatcgctggcctcccggatacaaagttcaaggtgaggtgctgttgaaatgtgaagccaatcaaagcactggaagtggaagagagacagttgactaattttcagacttttgtttcttatagagtgctatagatacagcgttggcagacggtgaatgtaacacaatggagaagcccgaggaccggatgtcctgtttcctaaccaaggtttgcatactgcatttcagtttcaatgtaagcagtctgtttgttggataagttgagcatggaggaatttggcaggccctggcaaatgttggagctgaaatggctcatctagtccctggtcgggtgtcgactgaaatagatgctcggttggcttatgatacccaaggaattatccagagggtatgagcttcttccttctgtttgttgtttcatgctgcttgcctgaaatatttatccttaggggaaaagaatcctccgtgaattgtgatctgcagttgcagtcccatgaaaataatttgatatgcgtatgttcaggtgcatgagcttttgaagctatacagtgatcatgatgtcttatctgaacgcctgctgttcaaaattccggctacatggcaagtaagtagaatgcaacacagtagttggcaagttgcctggttgtacctgctgccatttcccatctttgtaatcgatgtgttctccactagggtatagaggcctcgaggttgcttgaatctgaagggattcaaacacatttaacatttgtgtacaggtatgtacatatgctttgcctaatttgatcatggccctatttcttatagtgggcaatggtatagatgctgggtgtatggcaatacttatcttttttgtggggttagagaactgccttcaatttgtttagtcttaagatacttcagtaagtataagggaactaataaagattgtttcttattatcatgcatcacttattaatgatggctcaattgcattgtaagtatacattttgcttttatgtcagcagaagaagaggttttctattgaatttacctggtgaattgtaattactcaattaggcctgactagttactgttgataacaagcttatctataaaggacttgcactattgcaggtgcataaaagccataaacttactcttgcaatttacataagatggtattgttggagagagcagactgcaggatgtgtagctcacctagtagttagtaactgagaactcgtaatcatttttttttgtgtgcctgatcattcttcttcagttttgcccaagcagcagctgcagcacaagccggtgcatctgttgtacagatctttgtgggacgtgttcgggtaaattcatcagacccttaccttcatgggtttatgctaattcaaaaaaattatgctgaccacaaattatgcaggattgggcaaggactcactctggcgacccagagattgatgaagctttgaagaaaggagaagatgctgggcttgctttggttagcactaaattaccttttaatttatgattgttcctacagaattctatcaatatgaactaaagtagccacattttgataatcatgataactgactatttgagctcaactaaaatatatttagttgattagaggttgtgtacttaactatatcaggtaatatgaactatgcttgggttgattctaggacttggcatattttagactccatttggttctcatcatcaacaattttgagcaaaccatgtgttaatctggcatgttgcccatgttatagtgtaattgataaaactcatataactgaataatcagtgacaattatcaaggttttcattaataaagggactatgaatgaagaacattatacttatcaagcgttcacgtcttctcaattcgatactgaactaaatttccgtttactctctacatgttttacattccttactttttctgcagttgcataagtatttagttctccatataattctatattgtaatgcaggcgaagaaagtgtatgcctacattcacaaaaatgggtataaaacaaagttgatggctgctgccatacgcaacaagcaagatgtgtttagcctcctggggtatttttcttattacagatcaagattgatcgcaatggatgttagtttgtacagaactaatatttctgaaatgtaggattgactacatcattgcacctctgaagatattgcagtctttggaagaatctgtcactgatactgacgtgaagtatggttatgtcccaaggctgactcctgctcttggcaaaacgtacaacttcactgaagaggaggtttgctcacttatcctggattttgtgcagagtcttatatcatgcattctgtagctccaccaaactactcgctataagagactcctattaggggtgtgatgttttatctaaaatatataggatcttcacttgtcatgtgctttaacactactagagatgaaataaggaaggaaaataatatttggactgtttagatcacccttaaaaggtcatgtcaaagctcgtagtaggtgtaatcatgattcaccaaacagttactagaacaatacaaacaagtcattgacatcctataagaagaggaaaaataaaacaagagaagataagtgattatattttttatatggcaccttcatgctaactgttcatatttcaaatgataccacgaatgcagcttgtgaagtgggaccaattgagtctagcagctgcaatggggccagctgcggaagaactacttgcttctgggttggaaggatatgtgaaccaagcacgccgagtggaggaactcttcgggaagatctggcctcctccgaatgtttgaacacattctatgatgaggaccagaccatgccacagtcttctattccaaagaataataacaacagccacggacagtgctggccagcatttgctcgttcccttcaaagaatacttctcttagcctgtctgtgtttgtactttgtagttctctagctatctagcaaatctcacgatgacatgtcaagaacatctttgttttcttttcgcaaagattggatacggattttctcgagtatttcattagcccgtgagatgtgtaccatgaaatgtcacccaaatgctctgctggattgttctgaagtctgaactgaatcttcagagttgcagttacttatcactacgtttttttataaaaagatgggtgccatcagctagtactgtgaattcccattttcagtaaaatgaagaaatgctgatgaaaaaaatgctggtcaaacttgctctcacttttcagagtaatcctctgtttcttttctttcatggacctgacatccctatcattccaaatgccaattacctaatactactaggatgctggatatgggttctggttggatgctggttagctcaggaatcacactgctggcatgagcttactagtttttgaaatacagctatcatgaacatacgtatgtattttatgccatataggcagatattgtaaacgtttcagtagttcgagcaagatcagttggacaggccgggggttcacgcccatccagtgatgatgaagttatcatttaatttaaaaaaatatcaaaataacataatactctctccatatataaaagaaaagagtctcggatgtatttcttttgtcaccgactatcccgtatgtgactaagaccaaagactttaagcatacatgcaactaatgagtattaagatagcaacttaattcccatcaacaatttaatataacactgtaaaacaacaatttaatatagcaccataaaacgaatagacagtctctttgatgcatggagattacaaatatgtttagaaaaataaaatatgcttaagattttgggataaagggagtaaagagtaaagtgcatttttgtcctattttccactgcaaactacaaaataagttattattttacccgcaggccgcaaccgaaacatagaccatgcttcctccaaatgtagttttaacataagtttttgtcccctaaaacccttacttttagagtgggtccgtattaatgaatgacatagtggtcttttaacctcttgctgaatactccatctgacctaaaataaatgcaataatgtaatttgaattacactgttgcacttattttgggacgaacagagtatgtctttgactatctaatactccctccatcgtataatataagggattattcccttatgtgcaagattaaggatatcaccaaaatactagaatacccttattaaatgaaatttgcttataggtgaatgggtagttgggagttaaaataggtagaaattaaaattagagttgatggatgtgacaccaaaatcccttatattaatggacaactagaagaggcttttaggcaccatcttttcgcttatacttatgcttatgcttatcagtcaaaatttgaattttcaaccttaaatttgaatctgattttgaagtttttcatcgaagtttatttttcaatctttgcttttaggtcgctaagaacacgtatataaaagttttattcacaaattacttctcgtttacaaatatgccgtttacaatggggcctaaagtctagagtactatagtcttacaagtacaaaggaagaatagttttgatcgatgtgacagtggtttccactagaatgaacttcaattaaaagttggcatctgcatggagtgaactgaagaaaaaccagttcaaacgaaactgtaaaaaacatgtcccaaggtgcttctggtccggttttgtatttttcacccaaaccgtctatagttcagggtgaaaaatagatcgagtaaagatcaataattaaaaatgaactttacacccataaaaactaatgaggtgtcccttgtttgctctatggcttgataaggtatggaaaagagaaaacaagagtagaacttagtgatttgaaagccgatgccaaaaaaaaaaaaacccctcaaaatcaactctaaaattaagtttgaaaattcaaattttggctatggttgataaactaaaaacaaccaaatggtgaagtactaatgtttttaaaaactattttattgtgtttataattttgtaatatttcatatattaacaaatctacaaaactccatgagtataattgattattattttaaaataaaatggcgtgttaggttttcactttacatggttttacatgttgcgtaagttacttgcgagaaagtgtttgaggttagataaatatctattattaaaaggaaaaaccttttaggttatcttttaaaagacgatgaagtgccgtatatgatgaaaacactcctgtcattagtatttctagcaataaaataaaaaccgtacaacaatataactctagcttcaccaataaccataaatcttcatcgaatgcccttgcattgagggtaacatatcatatgaccagttcacttgagagaaataaatacttaggtgcaatgtattgagaatttagctagttcgtaccaatatacaaacacatggcggcttctatatccgtgattgttaacactattatattgttatatagcactgccatacaacaatatatgagcaagttcatatcgcccttagatcattgtgattggctggattacatggacccgtacaaaagtgcattggttcgcccctagtgttatacagttacaactacaccatcgtagcacgtgtaaaacatcacacgatataaaagttcacgtggaaaaaaacaggagacgccagtttaaaaacaactaatatttcactgctgcaacagttactaaaaacccatcaataatgaaaccaaaccttaggtggactagagtgattaacttaatttggaagtaaataaaggctcctccaaaacttccttttttttcttttacattcctccatgtaaaaatggtttctctttcctctacacccttttgctcttccattcttttgcccttcactcctctctcatcttttcaccctttttccacattttttttcacttcaaaaccccacacaactgacacaagagagagagaaccaaaccaaaaacccctcctttttcttccttctcctgcagcgagagagaggatggcggcggcggcggcggttgcggcggtggtggtcgcggccgtggtggcggcggcggcgtccgcggcggcccccgcgtcggccggcgagcccacgcgcgacgtgcggtgggaggtcggctacatgacggtggcgccgctcggcgtctcgcagaaggtttggtggcgcgccatggcgtgcgctctgttcttgatttcttccgagaaatttgggccgccttgtctgatattttcttcttctttttttttgttttctctccgacatgttcttcttcttctctgtctccgttgattctgcgcgagtttctcgggtggtttcaaatcgaaaaacgtctctctctctctctctctctctctctctctcttgcgtggttttgaggtttgtttgatgatgaatctggggctaaaaaatgcttcctaatttttttttcgccggtttgcgtgggcggtttcgatcgcaccgatctcgtctcgtcgtggcggtttctgttccatgttcttgcaggggttgtaaatacgcgttgatcgatctgtcctaataaaagacgacgtaacctcatttcctccgaaaaaaataaatcggatcccgcaaactttgcaattttatcgttgataaaaggaaaaaagatcaacattgcgtacaaaagagaggggaataatgatatcatcttttctgggttggatttctgactctgtttctcgttgattttgatccttttgagtttttgttcatctgcgaaacaggtttgttgttgaaaattgatccatttcgagataaaacagaacacatttacacacaccagatttgagatttacagatagaaaatctggaaaaggatttgcggacacaattcttgtgcaagaatttaggggtgtcatgctcttgtttagttacagtcttatatttttttcttaccatatcaatatgaaacattgcgctatcttatgcgtattgttttaaaaaaatctagtgtaagaattgttttctgatggcatgaatgcaaatacttgtttttttttttttgcaggtgatcgcgataaacaaccagttcccgggcccactcctgaacgtgacaaccaactggaacgtgagggtgaacgtccaaaacaacctggatgagcccctcctcctcacctggtatttactaatcctgcatttcaattgcatagatccaaaattgactaagctggactagaaattttcgttaagatatttttatataaaaaaatcatgtattaatgaaaatttgcaccataattttcagtttctgtttctggtgaatttaaacagcacattcatagtgggattttagctgtacatttccattctgtgggggcctcttgggcttcacattaggcatgcatgctgcatttcggggaatttatgggcttaattagttgtgtcatgtagccaaatattcttatgctatattgagaatttgagataggataggcacaccactgtacttatccactggtttgcccattttctcaagttcatccgtgcaaaatgatcagtttcatcaacagttcattatgttgacaacttaatacattattatgtcaataatgcatttctaataagaataaatttcacttcaatacatgtgttcttcttgaattactgtactactagatcgattactagctaataaaatttgctgtacacaatctgtgttgcactttgcaactgaaaacaaggttagaaatgtgaagccatacataatagtaacatgcaaaatgccaaacactagagggtccttctgcaaaatttccttttaaaagtgagcctaaggctttgcctgcaatgggtgggtgggagtcattggcgccaaattttctctgcattggagtcttggagagctcagagctcacctccctcttggccatggcagggatggcatccagatgaggatgaactcatggcaggacggcgtcgccggcaccaactgcccgatccctcccgggtggaactggacctaccagttccagctcaaggaccagatcggcagcttcttctacttcccttcgcttggtctccagcgagccgccggcgggttcggcccggtcaccgtcaacaaccgcgccgtcgtgccggtccccttcgcccagcccgacggcgacatcaccttgttcatcggtgattggtacaccaagagccacgtcgtaagctccgagctctccctctgtctgtctgtctgtctgtctgtctgtctgcgattacattttagtttacagtgtcagtgttcataaatcgtcgaggagaatgatattaagttgctttcttgatatctcaactgtatactattttttcttggtttatgttgcaagcatggttatatgtagtaatgtagaatgatacttagatctgtactctctgaaaagtaagagaattcttgtgttcatcatttaagaattgtgaagtacagtgattttttgatctatggataagctatatggtgcattatatttgaagaaagtttttatctgttcttctttgaatgtgagaaggtatctctgcccaatgtaggaattgaggaaaatgctagatgatggtaaggatctcgggataccggatggaattctgatcaatgggaaaggcccttacagctatgacaacacattgattccagaaggccttcaacatgaaactgttggagttgagccaggtaagcacacttagttttcttttccccatcatatttgccttatcattagttttctgcatgacctattaagcctgattcagtttttacagtgatgcaattgcgaaacattatagatatgtagtcaaaatttggaaaaagtaaataatcatacttcctcagatgaaaaaagacatcatatcaattaccacctccatttcatattataagttgccttgaatttttttcctagtcaaacttctttaggtttgaccaagtttatttaatagaaaaatttggcaacatctacaatatcaaattagtttcattaaatgtaacattgaatatattttgatactatgtttgttttgtgttgaaaatattgctatatttttctacaaactttgtcaaacttaaaaaaaaattactaggaaaaaaaatcaaaacaacttataatatgaaatggagggagtagtaatcataaatagttgaagatcagctttcatcaattctgttattttgtagcagcaaaggacagaattttctgtctgaaatgtcttgctgcatttacatacagatatcaggatgtgaataaatgtctatcactgatcagttatcaggattactgcaaaaatctttcagtcatgccaattttaatgatctgaagatttctgactagaacaatatttcatatacttgttacaggcaaaacttatcgcttccgtgttcacaatgtcggcacctcaactagcctcaacttcagaatccagaatcacaatatgcgcctagtagaggccgaaggaacctacacttatcagcagaattacaccaatcttgacatccatgttggacagtcatactctttcttggtgaccatggaccaaaatgcaagcactgactactacattgtggcgagcccaaggttcgtcacgaacgagtctcgctggcacgatgtcaacggtgtggctgtcctgcagtactcaaactccaaaggaagagcttctggtccccttcctgatggtccaaatgatttctattacaagtcctattccatggaccaagccaggtctatcaagtgagtattaaccactagtactgttgtgctctgtactaacaaatatccttgcattattagtaactatgatgctgttgattaatgatagttttcttgattgtaagaatcatctagtttcaaggttgtcatttccagtgactacatctcaagatgacatgttctccattgataaccattgcaattgtatttttcagaatgaatacaactgctggtgctgcacgtccaaatccacagggatcattccgctacgactctatcaacatcactcagaccttcgttctcaagaacgagttacctttgctcatcaatggaaagcgtcgaaggacgataaacggggtctcatactctccaccagagactccactgaggcttgctgatctccacaacttgactggagtgtacaagactgacttccccacaatgccaggcaatgctccaccaaaaatggcttcatccacgctgaacgcatcgtacaagggcttcctcgagatcgtctttcagaacaatgacactggtgttcagacctaccatctggatggttactcattctttgttgttgggtatgtgatggaaaaccaaaacagtttcttttaccatgtgatcatgtgttatgaatttctggttagtcatgtaaaatgacacagtcctgcatcaccattttgtgaatttcaggatggataatggtgattggactccagattgcaggagtaggtacaacaaatgggatgccatctctcgcagcactactcaggtacacaacttcatgaaggacaatctgatcatatgtcaaatttgtatacttacaaaacatgtgcatccttgagtattctgaacaatgcaaatttgcaacatttttcataggttttccctggagggtggactgcggttctagtctcgctcgacaatgttggcatctggaatctccggtctgagaagctggataactggtacaatgggcaggaggtctatgtgaaagtggctgatccactgggatacaacatcactgaaatgatcatgccagataatgcattgtactgtggtctactgaaagacttgcaaaagtaagtttcaccggatcatttctgttttctctttgtttcactgatagtagtacattctgtttttggccacttaccttgtgttctggaaaaccttgcaggccacagattcaccaggtaaacagcaagtcatcggctcaagctgcagatcgatggggcgcgcgagttcttgcaatggtgttgctgatcattgcagctgtggtttccatttaaatttgttggaatcagatgaggatatcttttagttaggctctgtgggtgatagaaaatcatattgttctttgagtacagaacaacttgaggaagctgtctgtgcaaagtgcaaaacttggattctagaaatgaaaaacctgtcaattttcctacggtttttgttctggctttcacctgagattgcattgctcatgtgcagtaagcaggttttacctccatgtgatctaaagcctaaattgtccgcagtactgttgtaagtcaggaagtacttcattatctaattagttttttaaaaatataatacatcaggaaaattccattaggaatgcattcgcgcacacatacacacaaagatcccactggtttactggactcctcgtagattcaacagaaatagctcaattctagtgctccctcggtcttaaaatatagttatttttaatattttaaacttgtcttatatcagaatactacttcctccacccaactacaactgattttaatttatctaattttaccctcgactccttaaccagcccctcatataatgagggatactatgatattttccttttatccttagtcccaaaaaatgaagattagaagctcttatattttgggaagtcaaaaaagatggagggagtaaaaatcaatagaaattcttggctaaacaagctttcagtctcttcgaagacgtctttcaattttctcgttattctgaggtgtagggtccccatcttattattcaatttcctaagaatgcatcatataagcttaatataagaggacttttatggtataatatactgctagtatatttactgcaagtatatatgatctaacggtatagattgatttgattttttagttaattagattgcagtataaagtttgaaaaggtaattttgtcttttcttcattattctatcatcaaatcgtgctatcatcacgtgcttcgtcatcaaatggcgctcaggatactcctcccttagtgcacgataagatccagtaccgggtactcccaattagattcaatctgaacaaaaaattactaaagtgttattttattttctatcaaattcctagcatgcccttctatatactgctagtatatactagtaggatattgtaccgtaaaagttctctaatataaggccaccgctattaatagccattaaccggtagggcccatttaaacataaaataattctattcaaacatggcctaagtaaattcacttggtactaggccctattagacccgtgagagagtaaatgcaaccaatactataattcattatgttgttccattcatgttattatgaacaaaatgccaagaaattatggagaagtgaatgggagagatgagcttgactccttttaagttgaggttgaagttaacccaacttaatgtcttgcccaaatacgatggcacttatattaccaatatggctctttgcctcccacgagaaattgatcatatcctaggcctagccatctatatgccacggggacaataatatggatggtaaataatcaatttgtgatcctaaagggtatcagtagtagcgtttcaaatcataggatgaaagtgactccaccttatatcgatgagtttgcttaggtttgctgtggtgcgcatggtgagaccatcaaatacttaaaatgtaaaaacaatatatacataggtatgccaataggtgatggcaaaagtgttcacgagaatttccaaaggtacaactaatgtggttgatttttttttaactattgtgatgcgaaagttcaaggtatctatatttttttcacatgatcgagcgatgttatttcgtacttgagatacttttgcatgggaagagatgtagtttagttgaaacaaacgatcggatttacttcaagatctagtctaccagatgttttagtaccgttgctgctactaagaaagcagtacatcgtattttctataactaagtacattttgttacttatttactgaggttgatgagctctactaataggcgagcacctggtgaaaaatgctggttgttgacgagatcttactcatataagttagtgttcaaatacataaatgcaaagttgaatcatacacatgtgtgagagtttttatgtgtgaatacaaaggtagcttgttgaaataattttgatattttgtttcaaccaaactctatctcctcctcttttatacatttccttatcacacaataacataggagtactatctattgagttacatgcactgatcagttcaacccaaaagcttaagttgatggagaaatacagacaattcactttatattccaacgctatgatttgtttcaattttgaaaatggcatgaaaggctaatctagcaataaacaaagccaagaaaaaagaagaaaaaaaacccatggtaattgcgctcacccaaaccccaacacatccgccgcgtctagggcttcctcgcgctcgccgccggccgccgccgtgaacatgggctccggcgacaaggccatgttacgaccccgatcgccggcggcgctgctcgccggagatccgatagaataggagtagagacgggaggaagaagagaacacgagaagcagaggaggggaatcttttcttttttcttcgatagttttggacgcggtatccccctcacacacgcgacacatactcctcaggtcccaccacttagtggcttacaggttacataaataaattacgcaatcttattgagaaaacgcctttcctctgtacgttttccacctctgctctgattcagcacagcgattgttgctcatcagacaaccgctgtgacaggccaccacctccaagcaccaccgccgcgacaaggacaaggaccccgaccgcgagcgcccctcctcctctcgccaccaccaccaccaccaccaccgcgacgacaaggacggcgagcgtgaccgcgaccgcgatcgccaccacagggagaaggagcgcgatcgcgaggagcgcaaggcgcgggagcgcgacaaggagaaggagcgggcgcggcggcgcgaggagtcgtcgcggtcgaggaggcatggggcgtaggaggaggaggagggagagggggaagatgaggaccgccaccgcaagcgccgccgccggtcctcgcaccaccaccaccaccgcggcgacgcggagccggaggcggcggctgccatggaggaggaggaggtggtggtggtggtggatgaggaggagtccgagaggcggcgtcagaagatgattgaggaggagaagaagcggctcgacgaggagatggagctccgccgccgccgtgtcaaggagtggcaggagcagaagcggttggaggaggaggaggcgaagcgccgcgagcaggaggcggcggccggtgctggcactcctgccgcggccgctggggccgacggcgattccaatgccgggaagaagtggactctggatggtgaggagtctgatgaggagggatacaaggaggatagccaaaatgcagaagatgacggtggcatcactgccgatttgccgagtgaggtgaatgatgcaaatgttgctgctcctatggaggaggatgagattgatccgctcgatgcattcatgagctccatggtgttgccggaggtcgcaaagctggagacggctgtggcatcaatggagagcatgcctgcttccaacatgggtgataagaatggtaaaagtgcaaaggatgctgtgagtaatggtgataagaaagggcaaaagaaggcaatggggagaattatgcaaggggatgattcggactctgattatgatgacgacgacgacgatgagggtggatcgaaagatgaggatgatgaggagttcatgaaacgtgtcaagaagacgaaggtagaaaagctggctattgttgaccattccaaaattgagtaccagccattccggaagaatttgtacattgaggtgaaggatatcacaatgatgacaggagaggaagtggctacctacaggaaaaatctggagctcaaggtacatgggaaagatgtgcccaagccaataaaaacatgggtgcagagtgggctgaccagcaagctccttgacaccatcaagaagcttggttttgagaagccgatgcctatacaggcacaggcattaccaatcataatgagtgggcgtgattgtataggaattgcaaagactggatcgggcaagactctagcgtttgtcctgccaatgctcaggcatgtcaaagaccagccgcctgttgtgcctggagatggccctattgggctcattatggctcctaccagagagctcgtggtgcagatacattcagacattaagaagttcgcgaagtcgcttggcatcaactgtgtagctatctatggaggttcaggtgttgcccagcagatcagtgaactaaagaggggcgctgaaattgttgtttgtacaccgggcaggatgatcgatatcctttgcaccagcagtggaaagattactaaccttcggagagttacattcttggtgatggatgaagctgataggatgtttgatatgggctttgagcctcagattactcggatagttcagaatacccgcccagataggcagactgttcttttctcagccatttttccacggcaggtggagatactggcacgtaaggtgctgacaaagcctgttgagatccaggtgggtgggaggagtgtcgtcaacaaagatatcacacaactggttgaggtgcggccagaaaatgagaggttcttgaggctgttggagttgcttggagagtggtttgatagaggcaaaattcttgtttttgtccactcacaagataaatgtgattctctacttaaagacttgtttcagcgtggatatccatgcttatctttacatggtgggaaagatcagactgaccgtgaatcaactcttgctgatttcaagagcaacgtatgcaacttgctgattcctggttgtgaattagatgtgaagtagcttgagctggttgtgaattatgatgtccctaaccattatgaggactatgttcatcgtgttggacgaactggtcatgctggtaggaagggctttgctgtgacttttatttctgacgaagaggagcggtatgcaccagatcttgccaaggctctggagctttctgaacaggctgttccacaggaccttaaaggcctagctgatcgtttcatggcaaaagtgaagcaaggaacagaacaggcccatggaacagggtatggtggaagtggtttcaagttcaatgaagaagaggatgaagctcggagatctgcaaagaaggctcaggcaagggaatatggatatgaggaggataagtcagattcggattctgatgaggaaggaggggttcgtaaggcggggggtgaccttgcagcacaagctattgctgctgcccaagctgccgctactttggctgcagccaaggctgctagtaatgccaatcagcaagtacaaagcaccaatgcagggtccttactttctatacctgtcgtagccaatgctccaaataatgaggccacggcacgtgcacttcaggctgcattgaacattcagcaaaatttagcacggatacaggcacatgtagtcccagaacattatgaggttgaacttgacattaatgatttcccacaaaatgcacgctggaagatcactcacaaagagactttgggtcctattcaggattggactgaagctgcaatcactacaagggggacatttattcctcaaggaaaaattgttggtgcaaatgagcgcaagctgtacctgttcatagagggacccactgaattatctgtcaagaaggcgaaatcagaattgaaacgtgtccttgaggattgtgccaatcatgctctgaaccttcctggttctgcccaaactggaaagtactctgttatttgagctgcggattgctaacagaacagctaattcagagatgcagggttttcttgtgaaggtatgcgagaagagaaaaaactcatagtccatatatcaaatatttatctgcccttgtatgagcacagtaaacaaaatgttgcttatcagctcattacttcattttaccatggcaatagtagttctataacattgaaggtcgcaactttaaaaatatatcataagtatatcggtgctctttagtgctaattatagatcacccggtttccttatttaccactgtatccgtctttcatactgacagcttgacctcttgcatagctatatgttatgcttgtactgttgatctataacaaattccttatagaatgtgttttataccataggttcgaaccacacaaaattgatatgatacttgaacattctgaaccatgcaaaattctgatattctcaatgtgaccaggtctttcttggaaggtggactgcgattcttgtcttccttgatgacggcgttatctgcaacatccgtgctgagaagctggataagtggcaggttagggtgttctatgtgaaagttgctgatccactaggttacagcatcactgaatgatcatgccagattgcacactacatattgtagcctaccaaaagacaggcaaagtatgtttaagctgaacatctcttctgtttggttggttcagtcatactccctattgttgataactttaccttctgttctaaaaacctttcaggccacatattcaccagccaaaaaaagaagtcatcgtcctaggagcttgatggagaaccaggctcctcacaactgcgttgctgataattgcagttaaatttgttgaaatccaaggatttgttaggctttttaggagtgccaatcactcataacagggattaaagtgagatcgttgttcgttgagttatacagaacaatgaaaagctgtttgagcaaaggccattaacttgatgcaaaaaatgaaattcggctagctttacctgcttttgatttcattggcttatatcatttgaggtagcaagttaatgtctagactctagaaagcaggttttccataactgaatgattcattatgtgataaaaacataattagctggcactgttgtttttcattcaagagattactcctacaggattcacattgtcgcacacaaacaaaaatcaacactgacaacttacaaaaatgtataattaagctattctgaccgtgcttacacatgccagcatttttttttcgggaatacgcaaggagcgcattttttccattaagagaaataaaagttatttacaaagataaaaggaaaacaagcaggggaccgatacaggacgctatggaaaactataggaatatctcgcgctaaatttggctaccacgacctcgtaaaggccaaacagcggggatcccgtgattagctgacttctaaagcatggcctcctccgccattgctttcaccacttcggtccaagacctttgttgttgattgaagattcggttgttccgttccttccaaattgtctaagccaccagtgtcacgacagtgtcgaagcctcgacgatgccgctccccaatcttcatttggctctcacagagccaattgtggaaggatggctcattgacaggtaagcagttcggcctccttatcgcctgaagcgtccaccaccataattgtctcgattcagggcatgctaccaagatgtgatcaatgctttcctcctactgatcgcaacgaacacaacgatccgggtgtggcaaccctcgactgcgcagacggtcagcagtccagcatctgttcattgcgaccaaccacaagaagaagcggcatcgaggcggagcgagtgacttccaaattggggtggaaaggaaggtgacacgaccaaaaaacaaggccttataggcagattttgagctgtattggcccgaactctcccatttccagatgattgaatcaggagtagtaggatcaagatccaccatttggacaagcgaccaaagctttagatattctagaataggttggatcccaagtgctcctcggatgtctttgatccattggcgacctgttagtgcctcagccaccgtccgacaccggcgcacgcgtggtggaattttatcatagatgttcggagcaaaggaccgaatgcaaccctcttgcaaccagctatcttcccagaagaggatagtttgtccgtctcttaattgacagatggtagaggctgcaacgaagttcctttccttttgcgaccccggaatggctagcccctgccaaggtttgcttgaggaggtccgttgcaaccatgtccacctggaacgaagagctatacccataagctccagattcggtacacccaaaccgccgtagttacacatgccagcatcgatcacctttgttggatttagagtttacacggacaaagataagatgatacataaaatatgatcagttctcctatagcttacagtttcatcatcattcaaacatctatccattagcctgctcattgtgcccaatggatcttcttggcctattcaaaatgaaagaaaggtaacgacattcacatattaagttttcaagttccaaccaagaaaggagataagagtgcaattaatcagttaaccttttggttatagaagtgttcctctttgtcacctttaaatatcttaagtttgcagatgaataaaaacctgtatgattctcaaggaaatctaatatatatgcaagaactaacacatgcagaagatataatctggcacaagcagaattcattttcttttttcttttttcttttttcaaatttcactaacttgcaacttcatattggggataaagataagcataatgctgatcgaatcaaactcacctgtatatatatttatgactcttgaaacaggcgtttctccatgcctctgctcctgtccaagaacctgacagtggagatgtgctggactctctccttgtcctcaccctgtatacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 29599 - DNA, 732 bp, Oryza sativa
tcctgcagccctgctgagtcatccacacctgcaaacaaagtaaactcatgtgagcaacctgaagatagcattccaccgttacgacacaatgcagaagtgcactatatgggatcaaccaaggcaatctatgcgcaaatataatcacacatgaattcctgcttcaaaggaaaccatctcagaacagagttcccatcgaatgccaacccacgcaatcacccttttgagtcatccacaccgatgcaccgccacaaacacgaacaattacagctcaggacgaggtttcctccctttgagacatcaataccacgctcaacactacggacgataccaaccaaccataccaccgctccgcccttaaataggccgcccggacaagacgaaaccgcacagacatcctcctatttgttgtacctactcctgcaatctggagtccaatcaccattatccatcctgaaattcacaaaatggtgatgcaggactgtgtcattttacatgactaaccagaaattcataacacatgatcacatggtaaaagaaactgttttggttttccatcacatacccaacaacaaagaatgagtaaccatccagatggtaggtctgaacaccagtgtcattgttctgaaagacgatctctaggaagcccttgtacgatgcgttcagcgtggatgaagccattttctggtggagcattgcctggcattgtggggaaagtaagtcttgtacactcca

SEQ ID NO: 29600 - DNA, 1678 bp, Oryza sativa
  unsure (1)..(1678): unsure at all n locations
atgtaacacgggcacacggcacaacaatagcatgatcgtgtaataccattttcatattgttgcacaaaagttaagaatataaaaggtgccagatgcagaaaattcattcaccagagtcttcatccacacttggcttgcatgtgggaagaaaatatttgatctgataggtttagcatcaatgggcaaatacatggacatccgtgttttaagtgaacataggtctgagtggatcgtatttactcacaaattagacacaaacacttttacacgtaagaaggtacatctataagcttctatgaacttcataatgtgtcgtgtcatgtacaaaaggtctactggcatttggtttatctatttctatccagattttcatttcatttatccacaataccaaaccatttgttaattatagtgataccatttacaggaaagaaaagaatatattaagtatgtcagtcctctaattaacatattacattagattaaagcctattgggagatggcacaaaaaaatgtttgggcatcactaatagcatacaccatttctgtagaccataagaaggatgtagcaacacatggttgacatgtcttatgcgtttccaaaataaatatgttatttaagcataccctatatttgcatctgtgcctcattaaagatgaatcaccaataagatcgtaagaaggatggaagagtatacatattattgtgttaataatagcttaactagtgattaaaaaagaaacagtattttaatagcaaagtataaaaaggctataaggctatgtgtgaataaggttcactttttggggggaggtaaattaagaaggattgtaacaaagtaccatcttgctaccagcaatgttggatggcagatcagactgatggcatgccatagagtctgcatcagctgaaaggtcaccaccttcagcagcaactgcatgttcacttccattggaagtgctactaacactactgatactactggccatgctgctgtaattgctgttcttctgtctccttagtcttagaaaattagagttcactccaagtccacgagatgatccaaggcaagagctgataccgaatcacaacacaagatggaaaaaaatcatggacaaaacaaaattagcaatcaggatatattaagaacataaaggataggcattaataagtgcaacttatcttctagttacaacacaatagcatggtcaatgagtgccattatattttcatgacattttttttagtataatgaaccatgggtagtaaaaatatattacgctgtatatagctttcatatgtgcttgatagacagtgatctttgcattgcacaatggaactactctaaatataataagttcatatttgcagttcattggatatttattttcatttggtatgctgaaataagcaccaagctctggccaaaaacatcggatgttggttcacataagtcatgttcctgctccagctgcaaactcaacttaagaaaaatgaatggtaaagagtctgaatactgattcacttgatcagctctagttttggctacaaacattaggacaaagcagaatataactttaataatcaggtaaacatagttagccaagagccaacgnnnnnnnnnnnnnnnnnnnnnnnnnnnnnnnnnnnnnnnnnnnnnnnnnnnnnnnnnnnnnn

SEQ ID NO: 29601 - DNA, 1175 bp, Oryza sativa
acacgattggtgtatccactagaaatctcttgtatgagctttctgaaactttcttctccttgtgcacttttgtctgatatctttgatataaagcaaactcctcaggatcaaaatgtgaccttctcattttaatttcaagctttcttcttttctggggaactcttacagtatttttgttcacagagctttgctttgagctactagatttatctggagcatgtgtagacacaatgatactggttttgttctgctttgtctgattggtgactgaatagaagttcagatggccattgcaggcttttactgctaaaccagcaatatctccatggcactccattgtcatggccagcttttctgcaatagagtttggagaaatatctgctactactttattgtgattagcatccttctccttaggcaatgcacgtctgatttctgccactatttgaaagcttatattacatgtgtacaataaatcttgtactgcttctcctactttcttgtcttgtgatgctcctcctactttcttttttagttgtggtttaacagtctttacaacagctttagggagttgaacatcagaacctaatgtaccaacttggaaggacatacccactgcctcattaattttgctagacaggcaactgatgaactcatcttcttcaaataaatttggacatttggctgcttgaaaatcatttgttaatgtcttggatatttttgagaccggcatattcataggttcagcgagtgaatgttttgtagggctagttttattctgtggacttccaacctgtggatcaagctcaccatcaaggaacctgtgaaatgaagcgtgaagacatgacacaggacaatttagtgactaaagctaaacgacatatgttaacaatttcacaggtgcatatgcaaaatataaaacaaaaggtgtgtacctttgcatctttttaagtacacgaccttgctccttcgaacaaatgaaatcatttgccttcaagcgtattgtatattgaggacagcaagtacgttccatctcaagtttgtaaagaaaacaaccagatctcctccacccacggtcaagaagagctgtaaacagtagccataattttcaatcatgataaattatgccagcagaagaactactttttaaaaaactatgaatatccaatatctca

SEQ ID NO: 29602 - DNA, 675 bp, Oryza sativa
tcatcagattggaaatccttattgctttcttttatgcagttttccaagttttgagcaaaagcttccatgttaagttttattgttgggatttcatcagtatcttcatcaaaatcttcaatatcattctctaaaagttctcggcattcttcctctcttggacttgctggctcctcaattattggatttgtgttgttagcatgaacatcccttgcatggatactcccctcgagctgaagcagaggagttgaatgtggtgtgggcattgtaccattctggaaatcaaattgattgctcatattcaccaaccttttgtcctgaggagaaggaagtgcaagtcttgcacttcatttaaaaaagtcaaacaaaatataagaattaataaggaacaaaataacaaataaagaaatatgcaaaatgaaggctcccagataaggtcaactggaagcgcaagatatatcaggcatgcgcgcacacacaaacaaaacaagaaagatagtggaaagaggaaatacgtgaacacaaaattcccaggtaagataagtgaaagcagcaaaaatattttgttgcagacagaaacgtacataaagtgccatgggggtgtactagaatcatgtactgatttttctcctagaatattttcccttttattcttcaaaagcactattttgcactctt

SEQ ID NO: 29603 - DNA, 317 bp, Oryza sativa
gaatcatgaataattaaggcaataaggagtaaataacataatttataactataaggaattattaacagagtttcatggttttcacaggtatgagttacattatcagatgattacttttggaaaggtacttcattagcatctaaggagtttggtttcttcattagcatctaccgacacatttgttctcttttgtttgagtaaagataaattatcataacaaatgcaggtgttctgtaccaaaagcaagccgaattgcaatgcatgtccaatgaggagtgaatgcaggcattttgcaagtgcctttgcaaggtattatg

SEQ ID NO: 29604 - DNA, 535 bp, Oryza sativa
tgaataggtgctacagtttggtggttaaatacctccaaagatgagagaccaactggagaaaatctttgttcaggtatatccatagctgtcgacggactatctgtgaatgtggcatccccacagtcaggaccggggatcaccagagaatgtgattcagcagtacctggaggctatataaattgtaggtaggttagaacattgcaattctgagccacaatggatgcaacaatcatgttctatttctgttcaaggaaaatgcaattattgtgctcgaaattgtttagatctgccgagcagaatttcctaatattttctgttcatgaatagtttgacaactgtctaaattagaaggcaaacaacatgaggttgtgcagtagaagaaaattcctccacaggctttaggcgaaatcgcaagcaacatgtttcaaggcatgtaagctgtgaggaattctataaatggtcgttctttgcaatttatacacttaaaagggcagtaatgaagccacctgttataatctagactcttaaaacaagc

SEQ ID NO: 29605 - DNA, 9471 bp, Oryza sativa
gaagaatcggaaacggcagtcagtcgatcgtgacgtgaattcatccataacaccatctaacaaccttaaaagaagaaacatcaagaaatgctcaccctctgaaacaccggacagtgcaggagccggcataaagctccgacgcctggatcccctccccgtcagcctcctgtggaacaccaggatacttatcggcacctgcgtgcatcctgcaggaaggttgtaggatggccgtacggggggcccaccatgctgctcatcggcgctgctcccggaacccgccaccagggctgcctgtggaaaggagccctcgtgcatggcgttcagcaacgccgtcgacgacagggaggatcccgggaacaatgtcaatggcgggcagctccggcctgccacggccgtcccaacacccaaatttggggtgcccctcccaactgacacgccggaggtccagctctcctggttctcagcaggattcccctgcaggttgagccctgagggatccatggctgcttcttccacaacctacacgaagactaagatgaaattgcacacaaagcgaaatacaaacgacagcaaccaatgaaaatggaacgagaaaaacctccccaaaacccagaaaaagaaggggaaaaatatagccaaggcgcgaacctaacgtggattgccggggttcaactgaacccctaaattttttttcgattcgaaccgaaacggaggcagatggaaggaggttggccgcgtcgatcgatcccccaccaaacctcctcgccggctgtgcgcacgccggcgccaggccacactggccacggaggaggaggctacgggcggaatcgggaaggggaggacgccgtacacaccgccgcctgcgccttctcgccgaggcgacgcctacctgcagctcgcactgaccattggaaagggaaagagagtgtggaggatcaaggatgaagacacggatgcgtgaagagagaaatatcagatggaggtaagacgggttctcgtctttcgccattttctaggtagaagatgttacatgcgaaccgcgccatgcagtcgttaagtggggatgaaaatggatcggatatatatatatatatatcaataaaaccgttataatttttaaaactttagcagcacgaaaccaatcaacaatacaaatataatattttaaaaatatattggattcggattatccgaattaaaaactattatgggcgtttgtctcaaacgtgaagataaagataggcacttaatctcggtagggaaaactctattggaggcctacaaatagggttaatttatctttctaagagatgcggctaccctaatcaagtgaaacgggtctgaggacgttcgttggcacctcatccttagagattaaaagcccacttaggaagacttaaatatcaaatacggataaaaaagatcctagcatcgctcgtagagttgtttggttgttaaccatactttatcatagtttgtcatgcctagagggatggtaaatagatgtttctagcaacaaaacttacagtggcaagtagaattgatccgataaatcatgtgccactgcggatagtccgataacacatggtgttggacaatctaatcaaacatagagaaaacaggaaggaactcacctattacatgtatagatctgaacagttcgacaataccaagcgtcacacaatctgaccataagggacaatccggttttatacagagaatatgaaacctatatgaggtatgacactttgcacactgttggtatttcttacgatcacagataaatccgcaagtacacggaatatactgatgtagcacttcactcgggattattctcatgcatcgatttccacagggaacgtgtgtgctaactccagtttaggttcatccaaggacacgaagctatagataggcaaaggatagagaggtttcaccggtgaataacaatgtctacgaaaagcttaactttaatcctaataaggtacttcggacactggccagctcgctgctcccagatatcgctctactgcgcacccggacagggaggacttcagtgatattgaggactgtcaccacctctacacccacctcacacctactgtgggatgcggagcaaacaccggaaatcaactacctagacaccacgtctacgcagttaataactattttagtgtttataactcactaaagcaatcactatagtttagttgattatagtgaacgatgatcccatctgaataggaactaactaagaaataattctcaccgagtaaaactaaactactcaaaagatatttcaattataataagagtaataaacagagcagaatgaaataggaagaggattaccaacaactccagaattcctcccacttcttctactctactctttccctaatctagtatacaataaagtacaatagagcctcttgtaattcaactcatgcttcaagtatgtgtttacaagtgaggatgagaggggtatttatagggggagaagtgtcttgggagtgtggagatgctccaagcaaccaaagagcatcttctctcttctcatgccaagtgtcccttctgatgacggtttctaccggtattaacgccataaccgtcatagggagagcgttatccaccgaatgcaacctggttctgggccagcggcctccacagtggttcggccgaactcagggttcagccgaacctgggacggcaccgtttgctccgaatttcggcctggacactcattttggccccctcattctattggtatggatagaaggcccatttggaggtgtttaattgggtttctgggtccaaaactccatatgttcggatacacgtttgattctcctcctccttcatgtatatttcttctcaacttaggtagtttgtcacctgcaaacgaatatacaccaacactcgtgaaaattgttagaaataaaccttaccactatgttggatgttttacttttatgatttatgcaggttttgacggcgttaatttggtacttcataaccgtcaacacacactaattttaaactataactaagtggtgatcaaaagatttaagcatgcatagtatgatcgccaaaaatctcaatcatgaaaccataagtgcaaagtagagaaacacaccgatttgtttacagaattcgaatccaaccaatcatgaaaccataaggaggtctgaagagccgggtttcgattaagccttttcctcttcaagctactacctctgatagtgtcttggtctcttcaagcaaccaccaaggacaagtttgtattccaagcgacccacttgattccaagctcggatgccccgcaactcccctctgatgaagcttgctctaccaagcgtccaccaagatgcagcttggtttccattattaccttttcccttccgagacgacttatcaacctgccgcgacgagaaaatgatgagaatgagtagcgactgacagctccgttcaccttgacttgctcaactccgttgaggtctctgcaaccgtcgctaggtatcctcgatcgccgtatatcttggctttctccactagatcctcggagttcacctcgatatacaccagcaaagtcaccttctcgaggtcgcggagcgcacacttccactccatcctcggggttgtcgtcaccaagaaccaccaccttcaagtgtcgtcggccccaagctaccttcgagtagagaaagtggaaggggagagtggcgccagtggtggatggtgagagagtagcgactgtggtgccgaccggcggggggcggagggagagtagtgtcatccgtgcagtaagggagtgggtaaggataattttatattatgctctgatttttgaagcgttcggtgcaaaatattggagtttcctataaattatcaaaacacaaggactaaaataaaaaaataatagggactgacatgccaaatcaaagacaccacttgaactatttgcactgtaaaaaaggagggtggtctcaggctatgtggcatgttctctctcctgtagagaaatggttagccatgtcttgcacaaatggccttaggccaatagtagtgggtcactcgtttgttttgcctcacgtgccatctcagcccaattcataagatactccaccatcagtgcaaagagtccagaaaagcctaatgtctaagaaaaacaatgcaagcgtcaacggggaaaaatgaaaaatggagctccacaatgcaaagaaaattgagcgatgtagcgggtgtcagcggggcatgttgttagggatacgagagacataatgggggcgcgcatgctacggacgagaaggagaatatcatatgtggcacctcaaagctgaataccatgtaggagcactatgactgctcttacaagcacattttctcagaggtgactagggatcggtcgcccaatccaaatctccaaaaatcgggcgctgacgtagtgccacccatatatgcaaaaccactttaaaataattttttttaaattatttatccaaatcataattcgattgcaccattaaattcattgcaattaaatcttcaaaataagaccacacatggatatattccgacgaaaataagcttattattgaatttttttaaatgttacatgatgttccaccaggtatatcggaattgctttactaagtagatcgaaaatgtttcaatcgtttaaattgagcgttgtttcacattatataaaaacaatgtttcagcaaatagcgaaaaaatgtttcagttaactgcaacatttgatccatacatagtgaaacattataagtacactaggtgaaacatttttagtggaacaaaaaaatgaaatgaattcccttaatagatagtttccaaaatatgtgggtgatttgttgcaatggaatatttcagttcactgcaacattagatctatatatagtgaaacattgtgagtgcactagatgaaacatttttggtggaacaaaaaaaccaaattccctaaatagagtatttctaaaatatgtgggtgatttgttgcaatggagtatatggtggagacacgtggtgggaacaggaggagtcacgtgcgagtcaggaggggggggagcgcccgatccagctccccccacgccggtcacccgacacgcaacattttcgcattttctctgtgcacctcaatcttatcttcaaccacgattgccactgaactcgtcaaatctatcataaatggacgagagttttctgacatattagaacactagatatttaggtcttgtttagattccaacttttttcttcaaacttttaatttttccgtcacatcgaactttcctacacacacaaacttctaacttttccgtcacgtcgttccaatttcttcaaacttccaattttaacgtgaaactaaacacaaacttatatggtcttaccgttgtttttttatacaaagttcagtcgtgtcgccgccgccgccgctgcaccatatcttctcgtacgattggtctttccacccaacattggcagaacccaccccctagacaaatagcaatccactatgctcacaaccagcgatgggacgcaactcacagttgaggcagggaaaacctacaagaaggttagtgaaagaaatgaattgggcatctaatgtgataaaagagggtcaagcctagaaatcgggaagaagttagcgctctgcagggttgtctattcctctttggcgcaacaaagctttattgctccacagtagtgtcgaactgtcgattgaattcattcgctgccgaaatcatccagaaataccagtgacaagacaatgaaaaacactagtgacaagacaatgaatgcaacataatttctgaacttatcacggcaacacggtgggacacacgatgagaagccccaagtgcatccccaaggacctcgggggccccatgtgtgttggcagttgccgtcccgcgcgatcaaataaaaactgccttccgattccgacggggtctcgcttacccactgcagcagagcgtgggaccaatccccgtgaccgagcgtggatggatcccacgcgtctgtcacaccgtctcgctggcctctccgtcgccggcacgcgggtcgccgctcccaaagcgggtcacgccaaaggcgaccaccgtctccatctccccttcccgagcatcccccgggtccatcatgactcggaatgtgtgctgcattttttgtcccggcacttttttcccctaggatgtgtttaggccgagttcagggtatttttaattcacgacaaaattagaagtttggttaaaattgaaacaatgtaatgaaaaagttagaaaattttaaactttttctttaaactttcaacttttccatcacatcaaaactttcctacacacaaatttctaacttttctatcacatcgtttcaatttcaaccaaactttcaattttagcgtgaactaaacacacctttagttcacattaaaattgaaagtttggttgaaattggaacgatgtgatgaaaaagttagaagtttatgtgtgtataaaagttttgatatgatagaaatattgaaagtttgaaaaaaaaattggaactaaaatcggccctactcggaatagaacggtatcgtcttttttcagctctgtgaatctgtctattgatggccacagcagccagtagcaccgctctgcagtcctggctcttacgtgtcagtgtgttcgtccgtctggttgtcatgccaggcacagtagtggcaaggtgtggcatatggcagctgcggtgaggttgataggtttcgtggccttcgtgtgcctcgggcgcggagccgagcgaacaccggtggtgaatgtggaggaaatggcagaggaaagcgggaatctccccgcatgagacgagccgggccgacggagccaagcgaacaccggtggtgaatgtggaggaaatggcagaggaaagcggggagggaatctccccgcatgagacgagccgggccgacggagccaagcgaacaccggtggttaatgtggaggaaatcacggaggaaagcgggaatctccccgcatgagacgagccgggccgtgccgtgccgctggcatggtgacggaggtgtcgtgacggcatctggtggcgagtcgtggtgtcagcacggccaacgcatgccgtttggcttttgcaacgcgccggtggtgctccccacctaccgtctagtttggagctgtgcaacgagaggcttccagcttcctgctcccagtacgatgtacctgaaactttgtgcttgtgagttgacacagtacaagcaaattttggaacaagcggtgttgctgcttcccgtaaccaggaacagcatgcgggatgaagccacagtgaaatgctgtttaacagttggacactctgtaaatcacatattcttctcatttcaacgcctgcggtcctcgagttttttcatcaagaaacagatgtgctatttttatgtagaatcatgtgcagaaaccaaacgacttgtgctatacccttcggccaacagtttatggaatacggacttcaatgacagataacgaatcggccggaaaaatgtgtcattccagcctccaacctgaacccaccagaattcgactgcgaagcgattagcataaacatgttattgtacctctaaatggtcgcattgctcccttgggacagaattgcaggccaactacagggaataaaccatgcgatcagatagctccttccctacaactttcacgtatttgctcaattgcctttctagctgttcgaggtgcctcctctcgattcgtccaacgactcccagaagatcctgaaagcgaaagtaaaaaaaccaatgttgcagtacatgagcaaactaaatagcagtattaaaaagcatcaattaatgcattctgcataaatcaacagccttgaacatattgtcggatagataaggtaacacaatgagagcaaagaaatataattcctacacaattattatgcagtttcaatatatgcagcatatatagttgttagcatgttctgtacaaaggacttgcaaaaggatgggcaatttaataacagcatgacaagattaaaaaggaaaattgcagactgcctgattacacgcctccgttgcaattcttttgggttgtaggtcaaattttatgtatatgcagtttgtagtaccttatatttaactcgagaaccattcagatccatcatgacattttcaaaatcaattatgctggaacaatcctccattacatcagtgttggattctgatcgaaccatctcttcatcaaccatcatgtctgagtcatcataggacaaatcttcatcatcctcatcgatgggagactcacaattgtcattttttgataactcagtatcaagatgagaattctgtggctgaggcatctcatcttgtatttgggcaaaatcagataggacagaatacaggctcttatctagtaaacgtttggcactgtcatagcacacccacctgcacaaaggacatgaatatcagagatgtatggatagtttagcagccaaagaaagacaaaatagtcatccttccaaaactttatcataaacgctttgtttcaataagcaaaacaaactatcgcctagaatttgaaagcctgcggtttgaatatttgggttggaaacataaaattagctatgttcgtgataatctttttgagcaggagaaattactgtattttttcatagcatgtagttgaattgtaaaccgtgatttacagaaaactcgtgcaaattaattatacccttaagactgcctgttaggatgagatggactctttttgggaacctcagttcagacttgaacaaaatccttcgaatttgaatcagaatcctcaaagatgcagttaggagatacatcctagctactccttccgtcctaaaatataacaacttctagccttcaaaactagtcccaaaatataataacttctccacctacattctcttctcaatcaataacaaccttccaccattcaaattcactacccacctcctcaaacattacaacctccccctatttaattccaccaattttcttaacacctgtgtccaatcctaaaactccttatattttgggtcagaggtagtattatttttcaactaagactaatacacagaacacaaccgtgttgcttctctatagagcctgtgctgttgcatttgcatcataaaataatacatggatgtgtcaaaaattaagagaagcgtcttactcgaaacggactggacagagaagttctgatggtcgatacgcagctttgtatctcatcttattgcaggaatgtatgtaataaccaagataataatattgaaggttggggcagtgctcctgtgttgtcttgacccaatctatctccttcagagctgtatactttccaagagataggaaagcaaagtcaggatcccagaacaaatacttgcttgacaggcacttaggaaggatatcaactacaccaactgccacaagttttccat

SEQ ID NO: 29606 - DNA, 21984 bp, Oryza sativa
tgccatgatggattggtatttggtgttgccagacagagaggaatgaggaaaccagagactcaagatctatccgttttccccctgttcgatgcatgtacccatccactgaaaaagcttcatttgcgaggaaaatgatgtcatgttgaacttcactgatatcagagtgacaagagatgtcatgttgaacttcactgatatcagagtaccttgtcacgagggcatatcagagagaatatcagacaaaactgctgcttataagcaccaattattcacagattggaatactagatgtgatacatcactgtcaatccgtacgcagaattgatactacaaaaagcatcctactcagactatactatgatttctaagaatgcatagctataacgtccacttattcgagcagtaatcgccagcaaaatggaacagcatcccttgatctccaaaaggcatccctcttctattgctagaccttggaacttcagaggggaaataagcgtcgcctactctgaaatctgacactgggttgctacatccaccaaaagttggtgtcgacagcaacatagaattaccagcactgaaacaaggatccggtgagaactcggagccatatcctgaaagagacagatttgccctgaaatgatttgagaggttttcccgacttgttgctgtcaaactgaaccttgaatgatagccatcagctgaacacaactcattttgagcaaaagagtctgttggcaaccggaacaaaccagcaaggcccaccggcactttcacgtcatcccgtggtatgatcctgctgcgatactctgctggttctggtagcgccaatatttcctggctaggaaacgttgacatgcaaagtgaaagctctgtgtctctgactggcgaatcatccgttgcgtagtgatactctggtgctggaagtgctaacatttccaggctaggtggacttggtttgctcagcttttctctaagggacatcttggcacgttgaagggcctccaaaacacctcccacaccatcacttgaaggttgatgcatctgtgtgtcaatctggttatcagtgtggttgtgaaagcatgatgagctccattcagagactttgctttaggggtgtcacttgatcggctagcaactgatggtgtgttgatgtagtgctcataagagcaagcatttacatggtagcctggaccaccgtctgagctttcatctactccatcttcattatgtcttgcattttggacactttcgtagtttctttgtagtgaagaggacaacttctctatattattcccacttccttcaataatttcagtgaaacttttgtctaccaactcatccttcctaatctgtgggccactatcaacagaaacaactgttgaagtagcttccccaaaatcatgatcacactcagtaactttgcaatgcttaatagcattttcttctggtgcattttggggcactccggaaacagaatcagttgacaaacattcagagggactgtcattggcaaagagatttttgtcacttggccctcccacttcagaaacttctttatccttgatctgagcagctttgtccctctgctcacaagccttttcaatttgatttagcttattgcatagctcaacatcaccctggaaatcagaacacaaatgcacaagtgaaaataacaataattttagatattttaatttttatcaagtcaactgcaagttcaacagctttgagaaaaacaaagttaaggaaaattgcttggtttactatattgacagcaagtataccatcagataaaaacattgacagcaagtatctctaacaaaagaaattatatggttatcggcatattggcatccatctaagaagctaaaataaccactgaaccaccaaatacatgctattttgttaaacagatcttatgcctatatgaaacagcattttgtgattaagaaggacagcgcataccgcagttgaatcacgggaattgttgaatttcctttcccactccctctgagcatattcttcttcctcgtattgctcaattaactctgcctgcttttcaagaactctctccatctccccatccttctcatactcaacagtatatggattgtcatcatctccatctcttccattgccacaggaaccctgcccatcttggctcacctcaccatcaatatcaggctgctcatcagtacagacagtacaatctgatctctcgtgcccctcctcagtactttccatggcattgtccttcccctcgtctccttcagtgtgaagcctgaaaatgcagtacagctacatttatgtcagcttagcaatgcgcagacagggatgaacaattatcgcaaatttgggtaatttcccggtgtatggacctcagctccttcctcttgaccttccggcacgattgccctgggtggtacttgggcgacgaatccgcggccaccaagtaaaagtagcctctcctatggctatgcctcggcctaagatgcctgcctttcagttgctgctgctgctgctgccgccgcctctgcgactcgtggctcgcggcgcggcccttccacgacagccccccggccgccgccgcagtagcagtgcctccaaactctgaccccgacagcgcatcctccgcgtccccacgagccttgctgccgctctcggcggactcgaggccgtcctcatcgtcggaacctgaaccggaatccgccacatcggagaagcgggcgaggccctgggactcgaggatggcgagcacctcccccgcggcacgctccgccttccggcgctgcgccgtcaccgcccgcacctgctcctccagctccgccacctgcagcagcagcagcgacaccgtgagccggagagaaaatgcggtcgatagggagagtgactgcagctcacgcacccgcttggtgagctggtcggcgcgctccttggcggcgcgggagacggagcgctcggagaggaggcgcgcgcggaggaagtcgattgtcatcgccgtcgtcgcgtccgccgccgccgccatctcgaacccctcctctccgctgccttctcgtcgcagctcagggtgccgctcgtgccgccccgccggcgccgggaagcccctacaccgctcgacgccggaccgcgccaccccgacctcaccgcggcggtcggaggacgaggaggagaggcatggcggccggaggaggggagaggagcggcggaggtcccgggaggccacgccggcgcccccccggggaaggggggggggggagggccgcgtcacgccagatccgccctgtcgggctcccgctagccgccggtcggaggaggaggatgggtggagccccgctcgtcgccggcgccgcgcggctaccgctccgctcggtgccggcgcacacctcgcttcctccaccggggagagaaaaaggaacgatgcgactatgcgaggcgagagatggagttgaagagaaaattgatatttagccattttcaaaaaacggtttcgctgaagtgccatgctgaaaacgtttttcgttaaaatgtcaatataaagcgcgcactcaccgtcactttaccattttagctattttgtgcattttcgatgaaatgcggcttaatgagaccaaattgcccttgctcaccagctgaaagaggatcgatccagttcatgggagaaagaggacgagcgcggcgaggtggtccgcgtggccgaaatagaggaggtggcaagcgaaagcaaagcagcggtggcgacgacggcaacgccgcagcgaagggagacgcacggcctccatgccaacgacaacgatgccttgtcctccggcgtctccaccgctcgatgccggactcgtgcagccgcgatctgttggcggggacctccacaccccacttcctcgtcgacacgacgagcatctgcgtgatcctcgttagcgggttatcaccggggcgctagtgcctgcacagcagcgtgccgacgaagaagctgacgacggcgacggccatgatgtcgccgaacccccgacaaagaagctgacgatggctaccgtcggcggctgcccctcgacgccctcctgtgctagcgccgctccatggtccccggtctccatcgccaccgaggggagggccgccgccgccatcctcctccactcccttagtcccttctccgccacccggatgccacgccgccttcgttcgccatgccggacgccgtttctccggagaccggggggacaagcgcccgccctggagggcctcgccgccagagccgggtgcttgtggccatcgccgaccggcgtgccggccatcatccgcgagccaggacggctcgggctctgccccgcttaatccacgtcgcctaggtcaccgtgatgccaaggtgttgtgtcccctgctcgccacgctcacgacacacctgaaggacaatttcgtctcatcatccggtggaggagcgaaaatgattttgaaaatgcataaaatagccaaaatagcaaagtggcgatgagtgcgtgtttcatattggtattttagcgaaacacattttcagaatggcattccagcgaaaaccgctttttgaaaatggctaaatgtccattttctcggagttgaaaaagtaaaagtaaaggagagagagatggtgggacccaccgctacatgtagcttgtactgtggtgctgtaagagcaagtttaatagtatagtccactactagctctaattcatctatagccaatctaatagccaatttataaatagttgcctattatactattaatatatggtcccatctgttatctgtggaggatgtggtttgtatcgttattgatctatgtggcacggaaagaatggtaaaatttggtgacgtagtgtgaatggccttacaatgcccgcctctccggtccgcggcgacaacgcgatgcggtgtgtgtgattctgtgccagaccggccggtgtgcctccttttttgtcgcgcagtgtcactcacaggccaccgtcctgccgtgccgtgacgggcgtgtgcgcggtgtcgttggttgtgtgcgcccccacgcgatcacgtgacgctggtgtgcttttctcccccgtacgtcgctttacccctcggcccgccccgccccgcgcgactccttctccgtgacgactcggcaaaatcgcgcgccgtggtggcgaccgtaaccgacgaaggctcaccgatgcctccaccggcagtgtgccgccgatctgaccacatgagcgcgtgccttgcaacttgcaagccccgcaacgtgcagtacgggtgcgctggtacacaggctccacccgtgtagacgcacttcggctacgggcaagtggtactaaactctacccaactctgttgtgtgtgtttgtgactttgttctcactgggacgagacgggacgtgtgttcggtggatccgaggaggggagaatagctacgacttcacacgttccacaggggggctttgattggttcggatagtcaaggtcaactcgcctgccgcgcacaaaacgaaagctaaactccattgcggccgtagtagactcgttaaacatcttttgacgtcgtacagggcatcatttatttgctgctctctccgccccaaaatataaaaagtttttaaattagacacggttattaaaaatagttgatagaattaaatgggggatgtcataattggttgagaagtgaatgtagatggaaaaagtgaatggtgaaaggtttgattggttggtaagagaatgttggtgataaattttaaatgctagaaggttatattttaagacggaagataggattattacgttatttgcaagttacgttcaaccgtctgcacatctcacgtcaggtacccaagaccccaagactattgcagtccgcagttgacaccttaactattacagtccgatttctccgtagttgtcaattgaaaccttgttctcaaccttgactattgcagtccgatttctccgtagttgccaattgaaaccaaccctcttctcaaccttgactattgtagtctgatttctccgtagttgctaattgaaacctacttctcaagaggcatttaactacttgtctagattttgggacggacggcgtacaagactactccagtaaacatcctcaagcagggagatatttaactatttgttactcttatacccccgtcccaaaaaaaaaagcccaatactagctactaatctggacatatagtttgtctttgctttgtctttttttgagacggagtagtaagtgccaattaaggatttgtcactagactcgtatgtcatagacacatgagggccacatgtcatagacctaagtcttaaacctaagtctagacaagtagaacctaaaatcggatgagacatttcttaatatttagacaagtagtctattcagattgtagtactataaaatattccattggaaggagagagtacatagaacggcgagcaatgacctttggtattaagagcaagtttaatagcatacccaactactggctctaaatcatctatagctaatctaatagcccattcatgcaatagttaactataaaaatatactacaccatcaatacccggtcccacctctcatacacacataacgtcttggagtcagtgttacagctggctacaaatctgtagtccgctttcttctctctcttcttttttcttctcaatatgtggttatagctggcttatagcctgctattatacctgctctaaacccaattgttatccaggcagccggtggacgggtggagaggatgtgatactgtcaagtcacaaacaataagaaccaagagtccaagaagcgtgatacagtatattgcagaaaacctgataactcaacatcatcctaatacctctgtagcaaggaagtgttcatacagtagtattgtagtaagtaggtctagcggggtacagtaatccatcaaacttccagctagtttctactgaaccatttgcgaacacaacatgttgagaaatcgtcattactcaccagacacatgccatagcccaagagtttacagtacaccacacgaatcgcctgattatatggtcatatggtgcttgtcttaacagagatcaaacacaaggaaacatctcgagcgattactctcagattatttgtagccacaggacagcgacttcaatcaccactggcacaccctctgcacccacaatggacacactctataaccttttcttccctgaggtgcttggggaccctacagacacaagtggttgcaaagttgtggtctcgtgtctgtatgcatcggaggcagcaaagacgctcataacctggctgcaaatgtttcagaaaaaaagatggatagcagtgagcaatcagaatgctgatttgtagattcaaggacttctgatatctacgaaagaacataaaaatgagcatagcccaaagagtacataccactcaattgtctcaactttagctttatactaccctaaaaaaaacttaagctacataccacccaaatagttgagcacactaaaatcccgttaatgaagtagtcatgtcattgttaagaacttcagataaagagggattgcacaaatgagaactcaagcctagcagtctctcagagcagctgggttattgcccatcaggatattcataaaaccacaactgttacaagattctagagagaataggtatgcacctgtatttctctgaaaatttgtttttggcccaaacttatttcttcatgctaatcatgtccaaatcagtgacttatatctgtgatccattcagtatgcagacagtgttacgagattatttctttagtagatgtgggcgttctcagtaaagcattatagatgtgctcttggttggttaattgaaatctataggctcattgtgaagcctactagttcctgagtaaacttttgtagaggaaagactaaaaagacgtagcatatccagatgttctaaaaaattttatggctgttttggtgaatcatattttgttctgtttgtacaaggaattggaacatcacattggctgcagtgtgcacaatcaaatagtgtctcagctgttcgaatttgtgttgaatagatttaagagaagattgtgtacgtgagaatcaaaatttcaagattgtagcattttaattttagcaatggtttgaatcttttggctgtatatagtgaagccagattcttttcatgatagcaaaagtttgggttttcagggctatatacccaattttctcttaaagagtgcactttgccgttataaaattcacacgaaatattttacatcttaagacaaattctacaattacataggtttcagtgatcacattgttttctacagtctcatttttcaaatagaaagccaaaccttttttttgtcaacattaccgtgacacagacatagtgttaaacataggtacatctggaatggcattagcatcactcttgctatttttttcatgaggatgacataagttcagatattataatatacaagaattggaacataaactgcatactccaaagtttaaagaccacgtatgcttacctttttccacttcgcgatcagatttttatcagcatgaccttggtccaaacaaaattcatacagctcttttgatatctcctttcttcgatagtaaagatcatatatgtaacggcttttttgatgagaaatacgaaagattggccagagagcttcgcacttcctcttcccatcatgtggatcattctcggctgcatccgaaaatcacattaccttttagcaatcagaaaatcacatcattaccaccctgtggtaggaaataataaataacaatatatatactgggaaaagaaatcgacgaactgttacatattacagatatgtgcataccttccctcatcttggcttccaaatcacgcagagttggttctataagctcccatccttcaggatacttgacacggcttgtctttatcttaggcatgtcgtctcaacgaacaaacctaattacctaaatacctaacagaagtcagaagaccacgaacatgtgaaatacctaaggaaaaagagaaaaacctagcttccagatctcgaatataagataaggttaatgcaaattcgaaagaaagaggatgtgcatgcgtaggaactggtcctcaccggaggcggaagcagcaggaggacggcacccaccgctgctcccctccgcaggatggactgaaatcgacgcaggcggcgcggcgggcgaactagcgaggagacgggagttgaggccgagaagacagacggggagattgacttggcgcaaagagtcagaggggagagtatgcgtagcaggacgccggcaccagggccggccctggccctatgtagccgaccgccgggggcctatgatggtggaggggccaacacctaatactagtagtctagtacctcatccgatgttgagatcaatgatttttattcagaattaaaggtgtgattcttggatgttcgcgcctgagattctgaagttcattatggatgcagattgctatccaaatgttttagttgcctatcgaaatctattaactgtacctatgacggtagcttcaactgaaagaagtttctcaaacttgaagttttgaagaactatttgagatcaactatgtcacaagaaaggttaaatggcttggctatgtgcacaattgagaaggatatcttgaacactattgattttaataccgttattgataattttgcatcaagaaatgtccgaagaagtatcttttcatgggagcaacggatatgatggggttttgttcttcattaagttaatgaataatgatattagttccaagttataaatatattgttatttttatttcttcataattactagacatgttaaatttaatatatggatgtatttgttatcgttttgcaagtaaaattattatctatatatcataaaattttatatatagtttagagggcccatcgcgatgagttcgcttagggacctcaaaatcataggaccggccttggccggtaccgctgctcgcagtggcaggcgatggagataggcggcgacagcgcagaaaggagacagatggagcctggtggatgctgtttttttttttaaaaaaaatatttttggaccttttctaaaacttatttcacatatacaccctccgaaaaactaatcccaaaaataaatccctgtctcgacgccaatgtttatcataaagattacacgttacgtcaccatcacctctggcaccgagaatttagcaactacgtgttgatgaaaaatccacgctcggccgatggcaccgaatgtgtgttgacatgaactaagtcgatgaacgcaatggcataggagccgcaacaccgcttgttccaaaatttgcttgtattgtgtcacaactcgcaagcacaaaatttcaggtacatcgtactggggtctgggagcaggaagctggaagcctctcgttgcatagctccaaactagatggtaggtggagagcaccaacggtatatatgcaccaagttacaaaagccaaacggcatgcgttgggcgtgctaacaccacgccttgccaccagacgccgccacctctctcaccatgccagcggcacacggcacgccccggccgtgggcggagctacagtgatgcctgtgtattcccaggaatacctaatattttttaccaaaaaacaactatatctcagtatatacacatgtatggctctgttcgttctggggagataggggagattgattctcgttttcctcgcgcacgcatttcaaactattagacggtacgttttttgcaaaaaaatttatataggaaagttgttttaaaaaattatattaatctatttttaaaatttaaaatagttaatactcaattaatcatgagctaatgacttaactcgttttgcgtatctcctcaatctcttcgatcccttctgctcaaacacaaccagttgtccccactcttcctgagtccctggctcggctcgcgctcacgcctcacgcagtcacgcgctgctcgcccgctccccaattccccatttccaaaccctaggtggtggcgttcggcggcggcgaggtgaccggcgggagcggcagccggcgtccggcgggcggcgacaggattggcgacgggagctagaccggcggcgcagtgaggcgttcggcggcggcgcggcgaggccacgaggcggcaaccgacggccgaccagcgacggcgggagcgaggccgcgaggggcaaggcgccgcggccagcggctgcggctcaacaggacagcgcccggcggcaagcacaacttcaggtgagcaatcaagagttcaagattcaatcagcctaaattcactcatcatgtgtccatgtctttttaccttagtctctgagtagttttttttttctgtacttctgtagttctatagattgaagagctctcaaaatgaagaagaaatcgattgatttgaagacttcgtgggatagacattcaaagtttaggaaggtagggtcaggttctggttctggatcaacagcacagcccgttagaattgacagcgaagttgttgttccttctgttcagccgattacatatgcaaatgtgagtccagttcagattcagattactgcagttgaggttgtgcctgaggtagaaaattagaggtaacatgtaataatttgtagttttatttctcagattatcagtattgacaaattttgaatcattgattttttttactatgaatttttttttgttagacgggaatacccaactttgaaatcctgactctgctgaggctcgtctcacgcagggagatttccgctttcctccgcgatttcctccacattcaccaccggtgttcgctcggctccgcgcctggcacacgacggccacgaaacctgtcaacctcaccgccgctgccatatgccacgccatgccactattcctggcacgacaaccggatggacgaacacactgacacgccagggacagaactgcagagcggtgctattggctgctgcggccatcaatagacagagtcacatagctgaaaaaagacgatatcgttctactccgagtaggtgagaaaaagtgttggaaaaaaaaaagaaaaaatcgcaacgagaaatgaagggaatgtttaaaaaatgggtttgggatatgatttcccaccccctaaagggtaagttttaatcctagccatccattcatatcactccattttatcctattcctccattcatttccatttcccaatcccacctctcctaacccattttccaaacacacccgaagagataatgcaaggcacacattccgagtcatggtggatcccggaggacgctagggaaggggagagatggtggtcgcctttggcatgacccgctttgggaggtgaagctggtggtcgactctgtgcctgtcggtggcatgggaccgggagtatcatgactagaggcttgaggcagacacaatcgcccacgtggcctggcaccctcgggggacgtcgggcccgagggtgatgtgtgcgcccacctcttggtctccccgaggggggggggtcggaccgcttctgcctcgcccccgagggccgaggcgccccgacccctcgcgggttctactccgcgtgaatgggttaggtgagcacagcggggctcacctaaccgcatttattgcggctcggctaaacgtgtcacgccgcacgaaatacagtgcactccactcgtttatccggtctgtgaccagtcacagaccggtcagatcgcgggttaggtggcgacaggcggtctgacgcacgcttcgccccatcccgtcaagacgagagcttctaggcactcgtccccggctggagctagcgtattacatcccagagatggcacgttagccccggtcgatatatgccaggcttcatcctaaccattacaagcaagatgttgtgtgaagaagggcaaacatgcacgttgctaggctgacgcgtggtgggcaagaatgatcgatttgtgaccggtctgacactggtcatgtcgtcggcagacagccactttcccacgacgcgcctgcccccggcagaagtggaggtaggtatgggccgtcccgtcagaaggatgttcggagggcaaccgtgcaaatctccgtccatttatgaaaagaagaaaagtccagtttggaaagagaggggtgcatgtggtatccccttgaaatataaaaggaggacctggcccattaaaaagggggttggattctttccagattgggtagctagaacaaaggggaggttggctcacactttgtagctccttgatacacagatccaccaaaacacaggagtagggtattacgcttctcagcggcccgaacctgtatacatcgcttgcgtttcgtgctctttcgataggtcgcgatctttccacatacagtgagagcttgggatctcaccctgagcccccggccgaaccggcaaaggggggcctgtgcggtctcccggtgaggagccccgcgctccgtcatctggcgcgccaggtaggggcctctgcgagtgattttcggagctcttgcgctctttcgtgagcaccaagcttttcctgttcagcctcatggctgagcaagcgaaggcgcccaacctctctccgagtgtgagtggcgacgacggggagccgaacccacgccgtcgagctcgtactccgccgccccctccacgccaaagtcctgggcgggagaaggcacccaagagggctgaagggtccgcgacttcgacatccacaggagctgggaaagggcggcgagatggggagcgtcgcctcctcgtctatggtgacggcagcacgccccagggcgcgctccaagctgcgggcgcgctcttacgccacccgcctatcatccctgacccggagtctccagcccaacgatggctggacgacgtggccaaattggtcatgacggcgcggcagcgcctagatgctggtgggcggtcctctgccaccaaggcctctggtgctgctaccaccggctctgcgtcgtcaagacggagggcacgacgagcggcagccgctgttcgccattcggctgccactccttcctcgactccttcgacccaggaggatctgcgtggggagcaggacgcccgcaccagcatcgagcgccggcgtaatgaccgacgtgctgcccacgcaacggagggcgcttcctcgtccagagtgtcacctcgacacggacgtgggaatcagccctccgtgcccccggttggtggtgtcggctgtagagcctttgtggcgagtcttcggaatgtccgttggcccccaaggttccggcccaccatcgccgaaaaatatgatggcagcgtcaaccccgccgagtttctccaggtctacacgaccgggattgaggccgccgggggtgacgacagggtcatggcgaatttctttcccatggccctgaaggggcaggcgcggggttggctaatgaacttgccacctgcatctgtccactcttgggaggatttgtgccaatagttcaccatgaacttccaaggcacatatccgcgccccggtgaggaagcggacttgcacgctgtacagcgaagggacgacgagtcacttcgatcgtacattcagcggttctgtcaagtccgcaataccataccatgcatccctgcacacgcggtaatctacgcgttcagggggggcgtgcggcacaaccgcatgctcgaaaagatcgcctccaaagagccccagactaccgcagagctttttcagctcgcggaccgagtggctcgcaaggaggaggcctggacttggaacccctccagttccggtgtggcagcttcggccgcccccggatccgccgctcagacagggcggcgtgacaggaggaggaagaagaggtcagtccgttccgacgacgagggtcatgtcctcgccgtcgagggcgcttcgcgggccacccgaaaggggaggcctgcgagcgacaagaagaaggaggccagcgctcccagcagggagcgccccaccggcaagtggtgcaccgtccacaacacttcccttcacgacctcgcggactgccgtgcagtcaaaagtttggctgagcggacgaggaagtgggaggaagagaggaggcaggagcgccgagagggcaagtccccggcggttccttccggccatcggcgaagtgaggccaagcagaaggcccccgccgaggacatcgatgatggcgatgatgacctaggtttccaagagcctggggccaccattgccactgtcgatggaggagcgtgtgctcacgtttctcgccagagcctcaaggccatgaagcgagagcttctggccgcggcccctactcatgaggcgacgcgccgggcgcggtggtcggaggttgccctcactttcgaccagaccgaccacccaccgtgcgttgcccggggagggcagattgcgatggtggtttctcccaccatttgcaacgtgaagttggggcgtgtcctcattgatggaggagcagccctcaacatcctttcccccgcagcctttgatgccatcaaggccccggggatggtgctccggccgtcccagccgattatcggtgtgacgccggggcacacttggccgctaggtcatatcgacctcccggtcaccttcggtggacccgcaaatttccgcacggagcgggtgaacttcgatgtggcggacctcagtctgccctacaacgcggtcctggggaggcccgcgttggtgaagttcatggcagcggtccactacgcctacctccagatgaagatgccgggccccgatggccccatctctgtccatggcgacctcaaagtcgcgctcgcttgcatggagcagcgcgcggaccgcctcgccgtcgtgtccaagcccgagggtggcgacgagaggcttggcacatccgcccccgccgccccgaggcagcggatagtcacgggcgatgaggtcccggtcaaggaggttgtcctgggcgacggcccgtccaagaccacacggatcggtggtctcttggacggcaaataggaagacgcgctcgtctccttcctgcgggcaaacgctgacgtattcgcatggagaccggcggatatgcccggggtccccagggaggtgattgagcaccgtctcgccgtacggccgggcgcaaggccggtccggcagaaagtacggcgccaggccccggaacgtcaagccttcatccgtgaggaggtggcgcgacttctggaggccggattcatccgcgaggtcatccatccggagtggctggcaaacccggtggtcgttcccaaggcgaacggcaagcttcggatgtgcatcgactacaccgaccttaacaaggcatgtcctaaggatccttaccccctgcctcgcatagatcagattgtcgactccaccgcggggtgcgaccttttgtgttttctagatgcatactctggttaccatcagattcgcatggctagggaggatgaagaaaaaactgcgttcattacccctgtaggaacctattgttatacttcaatgccctttgggttaaagaatgcaggtcctacttttcaacgtactactcgaatttctttgggtagccagataggacgtaatgttgaggcttatgtcgatgacttggttgtaaaaacgcgcaaccaagagactttactctcagatctagcggaaacttttgagagtctccgctccgcccgcataaaactaaaccccgataagtgcgtgttcggtgtacctgcgggcaagcttctcgggttcttggtctctgcccgaggcatcgaggccaaccccgagaagatacgagctatagagcggatgcgcccccccagtaaacttagggatgtgcaatgtgtcaccggttgcatggccgccttaagtcggttcatatcgaggctgggagagaaggcgctacccttatttaagctcctcaagcgctctgggccgtttgcctggacggaggaagttgaacgtgccctcactcagctgaaggcatacctcagctctcctccggttttagtcgccccggagccaaatgagcccctgctgctctacttagcggcgaccccccaagtagttagtgcagcgttggttgtggagcgcgatgaggacaatcctcatttcgcgcacccccaccctgtgcagacttggcccgggagcgagcagggaggagaggcccccgagccgaacggtggcctaaggcccctgacgaccggagtcggccctctgcccgctcgacagacggtgctgggtgcccccgaccctcaggaaggccccgaggtcactgcgggaaggccgcacctatcgtcctttgaccccgaggctaaccttgtgcgaactcgacccgggagaaagcagggagaagaggcccccgagccgaacggtggcctaaggcccctgacgaccggagtcggcccttcccccgcttgtccgacgacgccaggagcccccgacccccaggacggtcccgaggccactgtgggaaggccgcctctgtcatcctccgaccccgaggtcatcggcacagaagacgggtgcgccccgagaggccacttggacgaagagcgccccggggatacggcccctagcgaagaggatcggccccaccgaaaggtgcagcggcctgtctactttgttagtgaggccctccgggacgccaagacccgataccctcaggcccagaaaatgctttacgctgttctgatggcctcgaggaaactgcgccattattttcaagcgcatcgggttacggtggttacgtcataccccctcggccaaatcttgcataatcgagagggtacaggacgggtggtaaaatgggcgatcgaactttctgagttcgatttgcactttgaaccacgccacgctatcaagagccaggcccttgccgattttgtggcagagtggaccccggctccagagcctgtctcaatccctgaggtcaactcggacccctcgcagccgccacacaccggccactgggtgatgcagtttgacggctccctgtctcttcagggcgccggtgcgggggtcacgttgacctccccgaccggagacgtcttgagatacctggatcgcctcgactttcgagcgaccaataatatggcagagtacgagggactccttgccggactcagagtggcagccggactggggatccgccgcctcctggtgttaggcgactcccagctagtcgttaaccaagtctgtaaggagtaccggtgctctgacccgcagatggacgcttacgtacgccaagtgcggcgtatggagcaccattttgacgggatagagcttcggcatgtgcccagacgggataacatgattgccgacgaactctcacggctcgcgtcctcgcgagcccagaccccaccgggcgcctttgaagaaaggcttacccagccgtcggcgcgacccgaccccctaggggagacgggtgtgcctgaccggcccccgaggcccgtcggagtccaggcctcgggacccgaagggagcgctccaagctcccttagattgattgcttggatctccgagatccaagcatacctcacagataagactctacctgaggaccgcgaagggagtgaacgcgtccaacgcatttccaaacgctacgtgctggtagaagggaccctctatcggcgcgcggctaacggaatcctcctaaagtgcattcctcaggaacaaggcgttgagcttcttgccgatatccatgaaggcgagtgcggagcccattccgcctcgcgcaccttggttggcaaggcctttcgtcaaggattctattggccgactgctctcaatgacgcggtcgacctggtccggcgatgcagagcgtgtcagttccacgccaagcaaatccatcagccggcccaggccctgcagatcataccactttcatggccgttcgctgtctgggggctcgatatcctgggaccgtttaggcgggccccgggcgggtttgagtacctgtatgtcgcgatcgacaagttcactaagtggcccgaggcttatccggtcatcaagatcgataagcactccgcacttaaattcattaagggcatcacggcccggtttggagtacctaaccgtattattacggataacggcacccaattcactagtgaactcttcggcgactactgcgaagacatgggcatcaagctctgcttcgcctcacctgcccaccccagaagcaatggtcaagtggagcgcgccaatgcagaaatcctcaaaggccttaaaaccaagaccttcaatattctcaagaagcacggcgattcatggatcgaggagttgccagcggtgctctgggcgaaccgaaccacaccaagccgagcaaccggggaaacgcctttcttcctcgtctacggcgcagaagcggttctcccatccgagctcaccctgaggtctcctcgggccaccatgtactgcgaggctgatcaagatcagcttcgtagagatgacctcgactacttggaagaacgaaggcggcgtgcggccctccgagccgcacgctaccagcagagcctgcggcgctaccatcagcgccacgtccgggcccgatcactctgcgtcgacgacctcgtcctacgccgcgtccaaacgcgtgctggattgagcaagctctcaccaatgtgggagggtccgtatcgagtggtcggtgtcccccggccgggctccatacggctggccacgggcgacggcactgagctgcctaacccgtggaacatcgagcaccttcgtcgcttctacccctgaggggggggtcgggtgtcaggtttcgggctcgggccaaccccgcacccccccctcgggtgtgcagggctggccgggggctaccacacatgcacattctcattttctcttatttcagtatttcaataaaagcagtttcaatttcctaggggctgtatctgtgccgttttttcctttttgaagaattttgacttgaaataaggtcactcgtgctcaaccttgccctcgggggctcggttcggtcagctaaaatcgccaaacggggcctagaaacgagccgtgccctggggcgtggtgaactccgggggggaatcggcaaaaacccacaatcgggtcacccataaccctcggtcatcacgttcccagcctggccagtctcgacatgcggatctccccaggcactagccccgacccgcgcctttcgagaactgggacttgggcacgggccctaaaatcaagctaagacacaaaagagtaccacggcacagatcatcctcatctcattcgcatagcaaaataaaattaacacaaagaattttatggaaattcaggcctgcgccgggggctgactcggaagtcggaggcgcgcttcgtcggcgaggggggtgtagaaccagtcgctcttccagtcatcccacttcttgcggaggacgcaggggatgtagcggttcaacaccggcccccgcggcaggaagtagcagccaccaaccaccgatggcggcgacaccgactgcacggtgaagaaccaccggaacagccgaagagatgggcgcaccccaatgaacatctcgcacagatgtgcgaagatggccaatgtcatcattgcgttgggggtaaggtgcgccatctggagatcgtagaactccaggacatccatgaagaaagaagaaaatggcggaaccagccctgccattgcaaaggggagaaagaagacggaccgccccgggtagtctggcgccgggcgtccctcgcccagcatgactatctcacggccggtggcagattccggcatgaagcggcgcggcaacccagcctgcttctcgctcgtgatgcgggaaggcggcagcacgctaccatcaagcagtgcggagccccgtgccatggcgccggacgaagagaagatggagagcgagcgcgtgtggcgaaagaagggcgcagggaagaaggagttagggcgcaagcggcgaaggcaaggggaatgatggcgaaaggaaggaaacaaatcccatcctcagtgcctttatacccttgccaacgctgtgcccggttcctcgtttctcgcgcccattatttcgccccctcgtttctcgcgcccacgtttccactaaccccattcgctcgcttgcggcgcgtgaggtggatatgcggttgtggcagtcgagatagatcgtatcgtgcgcgcgttaattacgctcgccgaccgaagcgacgttaccatatctccaggcgaagcaaatcggctcgcccagatttgtgcgctgctcaggtgatgtggcagtcttgaagagaccgcccattattgacagccaagttaccattaccgatgcgcatggtttgagaccgttgggtttctgcccaaccatagagaccggtcccacctgtcaccaggctttaggagtggcgtcacgcccgaccgcttcccttgagaagggcgatcgccctggcataacgccgggggctactgtcggtggcatgggaccgggagtatcatgactagaggcttgaggcagacacaatcgcccacgtggcctggcaccctcgggggacgtcgggcccgagggtgatgtgtgcgcccacctcttggtctccccgagggggggggggggtcggaccgcttctacctcgcccccgagggccgaggcgccccgacccctcgcgggttctactccgcgtgaatgggttaggtgagcacagcggggctcacctaaccgcatttattgcggctcggctaaacgtgtcacgccgcacgaaatacagtgcactccactcgtttatccggtctgtgaccagtcacagaccggtcagatcgcgggttaggtggcgacaggcggtctgacgcacgcttcgccccatcccgtcaagacgagagcttctaggcactcgtccccggctggagctagcgtgttacatcccagagatggcacgttagccccggtcgatatatgccaggcttcatcctaaccattacaagcaagatgttgtgtgaagaagggcaaacatgcacgttgctaggctgacgcgtggtgggcaagaatgatcga

SEQ ID NO: 29607 - DNA, 10122 bp, Oryza sativa
aggttggctcacactttgtagctccttgatacacagatccaccaaaacacaggagtagggtattacgcttctcagcggcccgaacctgtatacatcgcttgcgtttcgtgctctttcgataggtcgcgatctttccacatacagtgagagcttgggatctcaccctgagcccccggccgaaccggcaaaggggggcctgtgcggtctcccggtgaggagccccgcgctccgtcagtgccagtggtcgatgcggacaagcaggtgaaactgctgacgcctccgacgacgagatggacgacgacgcgtacctgttgacgagaaaatcgaacacaccggcttgggagatctgcttagctcatgtgcaggtccaaatcttgattagatgcgagcgtgccagtcagtttgatcctgcaactgacaagatatgcaaatagtagatatgcaaatagtagatcaaaacagccgatcggctgacaagccgatggagtagttccagccgatagccgataatagccgatgccgataccagccgatagcgatagggtttaagcaatcggctatatgtccaacgtagataatgatatgaaggcaatcggctgatgaggatgtaataaaataacaataatataatccgatagaaaccaatcggctagaaacaatatataataagcactgatctgaaggttaaagcatacatcggctggaggtccgatgtcattaaatccacaagattagattaaacagtgaaatctatgttgcgatcggctaaatccaacttatatgtatatgcaatccttatgagccgatgtaacgtccaacttatatgtatatgcaatccttatgagccgatgcaacgtccaacttatatgtatatgcagataactcatcggctgaaaccccgataaaacccttattggcaatcaaaaagcaagctagagattatggttctaagcacgacttagtatatcaaacttaactgatgcagcactaagtatgaaaagaaacacaatatctagacaatcaagccgttgactgattttcagggtggtagatgtctaggctaatctactctagcaaggcgatttagccgataccggcagaaaccctaaagcgagagacagccgatagagctaaattgagatgctaggactagattaacatagacatatgataaatagccaggcaaatatattatccaaaccagagtaacccaagaggtcgaatgtactgatgcagccttgaacgacgccgacgtagacgatacaattgcctggaccgacggaacatgggacttatcccttcgccggagatcgaacaccgatgcagccccacgtcaagtgccaagtcccgccggacgataaaataaagtagaaaaggtaaaaggtggcgatgcgccgaattgtattgatcgtggagatagattacatagaccccgggtgtacatatttatacccatgggttgatacaagtccttgtcggacaagaaagaaactaacctaaagataaaaggaaaacataaattccttatcggacactaaacacaccttcctaaagataaaaggaaactaacaaactattcctaattaatagataaactgccatgccgcatcctctttaaactcggtcacttagggataagcttcctttagtagattgatttccttaagcgaatatagcaggaatccgactattggcgacttgataactcccatcggctgattccgagatgctgcagccgataatgattctaagctgatgacgtctttgccgattaccaaatttcactgttaacagtaccccgagtgctacgggcgggccaccgccaccaactcactgctctcggctggcggcgggattgacattgatgagatatcatcaccaccactgtgcatcggcagtaataaggccgtgtttaaggccaatttggattgctaccctaccaaaatttgccctaccaaaattttggttgggttaaaaccaaacacctctactaaaactctatctatgtcataaatttggctttgcctataaacttatctcttataggtaaattttggcttcaatccaaataaacattttcaactctaccctaccaaaattttggtagtaccaaaacttgcccaagatttgacactaccaaaccaaacatgcccttagttcaccccaactaccccaaacttccaactttccatcacatccaaaactttcctacacacataaacttctgacttttttttcaaactttcaacttttctcaaactttcagcttttttttgaactaaatacggcgtaagctgggtgattcatcaaattttcacctctggccggagggaggagtaggagtacgcaattaatgcaatgtggggtgatcaagaagtaaacagtttaagcaaaggcaaaatggctaagagcaagtaattctcctacatgctttttttactatcttccactatcactgtatcacaggaagaaccgggttacatttactagcgacattacattgcgtgatcaatcggagcaacaatggaacacaacacctccgatccaagaatagcagagagatgccgctacaagcctgtaactgccgcttcagtgaacttcatatgttctagtcggaactcagtcctgtacattatactgcaattatatactagcagtatatagaagggtatatttggtatctgtgaacaactggaaaaggctatttaatcatttgaagttcagattaatttatttcaatcgggagtactccctcggtcaaaaaaaaaaaaaaagacaaactctgatttccgtgtccaacttttgaccgtccgtcttattttaaaaaatatatgaaaaaaattaaaaagataagtcacgcataaagtattaatcatgttttatcatctaacaacaatgaaaataataattataaaaaaatttatataagacggatagtcaaacgttggcacaggaacccatagtttgattttttttttgacggaaggagtacttgtcatggatcttgtcgtccgtgcatttggtagcgtttgttccgaagacatctcgtgtggcggtggcttgaacatgatcctcatatgcacagaaatgatggtgctttctggtcataatgcaaggttaattcagtcgtgaaaaataacgaacggttgaacacttgaatgtgagaatatcatctcatcataattactgagatagtcaatttttttttgctagatactccctccgtccttaaaaaaaacaaactctgggttttcatgtccaactttgactgtccgtcttatatgaaaattttttataattcatattttcattgttgttagatgataaaacataattaatattttatgcgtgacttgtctttttaattttttttataattttttcaaataagacggacgatcgaacgttggacacggaaatcaaggtttgtcttttttttttctgacggaggaagtatatccagttagttctcggtatcactacgttaattacttcaaaatttctcattcaattagtttatgacgggatgatttgccagttctattcctgcatggagaggcggcgagtagggcttgcctcctcctactgcctgccccatccctggcggtgcgccttgccccaggtctgctgccgctgcccggatgccctatactgctgctgctgcttcttaggtgcgcgggaatgacagaagaggagaaaaggaggacagtaaggcggtgtttgggtctatggacttaactttagtctctttatttagacactaatttagagtattaaatatagactacttacaaaactaattacataaatgaaagctaatttgcgaaacaaattttttaagcctaattaatccataattagagaatgtttactgtagcatcacatatactaattatgaattaattagactcaatagattcatctcgcgaattagtccaagattatagatgagttttattaatagtctacgtttaatatttataattagtatccaaacattcaatgtgataaggacttcaaagttttagtcccatctaaacagggcctaaatcgaatcaatcctggtttgcggcggcccggggcgcggcgtgctcacggtggctggcagcagcggcggtagcccatgtgatgaaggaaggggaatggagcggatttctcttgattcgccgtttctttcgaacgacaaaccgactggatttctctcgatcggggtctgaccgaataacagaatgcgaaaatataaaaataccccacgcagaaagatgaaaagacaaatatgccctttttaatttatactgcaaagctaactgggtggaatatcagatgaatcttcaccgttagatcgtttatactgctagtatatacttgcagtatagtgtaccgtaaaagtcctcttgaaagaaacggtgtaagattgcacgaaaagcttattttcatcaaatcaattccaacaaaattatagaaacttaacatatatataacgagctaatttacatccttgcctccttggacctcgccgactaccaccaccgcaccaaccctgcccctgcccggctgccccggcagcgcagctgataggcattgatgagatatcatcgccattgccgtcttcaagcagccccgacgacaccaccctgaccctcatccagcagcagcagcaggatggcaagccccagtcccaagcagcggcagcagggcttatcatcggcagagggcagatgcgggcgtcgacgatgctgatgaacctcatctcgtggggcgtctcccattcctccatccaggagctgcaggatgggcaaggccagccacaacgcaaccgtctaccggcctagggtgagcagcgcgactacttccgcggaagcctggtggacaagaagagcagcaagagaaccagcgccggaattgacgagcacgcatgccaccgtcgccaccaatgagggtgcgtgggccacggacggagagcttggcggcgacgagggtgccggggccgagcttgtggacagggccggtcctgtgattttgagggccctaagcgaactcatcgcgataggccctctaaactatatataaaattttatgatatatagataataattttacttgcaaaacgataacaaatacattcatatatttaatttaacatgtctggtaattatgaagaaataaaaataacaatatatttataacttggaactaatatcattatttattaacttaatgaagaacaaaaccccatcatatctgttactcccatgaaaagatacttcttcgggcatttcttgatgcaaaatcatcaataacggtattaaaatcaatagtgttcaagatatccttctcaattgagcacatagccaagccatttaacctttcttgtgacatagttgatctcaaatagttcttcaaaacttcaagtttgagaaacttctttcagctgaagctaccgtcataggtacagttaatagatttcgataggcaactaaaacatttggatagcaatctgcatccataacgaacttcagaatttcaggcgcgaacatcgaagaatcacacctttaattctgaataaaaatcattgatctcaacatcggatgaggtactagactactagtattaggtgttggcccctccaccatcatgggcccccggcggtcgcctcggctgcatagggccagggccgttgtggaaacagatggcatggatgacggccttcgtggagaggatggagctgcagaccaaccgattagcaggagcatgtcctcgctgttgatttcattggtgcgacccgagaccaccgcctagccgtgtgagcagttttattggttacctcgttccacacgcggtcggctgacaagtgagccccacaagttgactcaacagtcaacagggtcaaacatgtcatgtaggacaaaactgtccgaaaagttgatttgtaacggttttaagagttgggagacagattatacctggttttgtggctgagggatacaattacattagggatatgagttaagggatacaaaatgaacttatggagtaggtatatggagtcatggaatcatgggccaaccaataaccaaggcctactaaggacactaggacagtacgtagctacctctccactgctctgctcatttgcttggcttttggctggaagtatacgagtgagccacgtgctctgctttccttctactacatcctttctaaaatatataagcatttttagctatgaatctaaacaactgtgtttctagatttatagccaaaaattaatatattttgggacagagagagtagtagagtattttacatagcatgcacgtccagataaagcacggtcggtgtgcggatgacatgctataccgttgcaacggtatttcggtatatagcagtctttttttttaaaaaaatatatttgattggtttggtgtcactaaaattttaaaacttaacggttcaatcgatgtatatatccgatccgctttcatccctagactgcatggcgcggttcgcaggtaacatcttctagttctatcagctagaaaatggcgaaagacgagaacccgtcttacctccatctgatatttctctcttctcgcatccgtgtcttcatccttgatcctccactctctcttcccctttcccatggtcagtgcgagctgcaggtaggcgtcgcctctgcgagaaggcgcaggcggcggtgtgcacggcgtcctccccttcccgattccgcccgtaccctcctcctccgtggcctgtgcggcctggcgccggcgtgcgcacggccggcgaggaggtttggtgggggatcgatcgacgcggccaacctccttccatctgcctccgtctcggttcgaatcgaaaaaaaaattaggggttcagttgaaccccggcaatccacgttaggttcgcgcctggctatatttttcctcttattttctgggttttggggaggtttttctcgttcccttttcattggttgccttgtcgtttgtatttcgatttgtatgcaatttctcttcttcgtttaggttgtggaagaagcagccaggatccctcagggctcaacctgcaggggaatcctgctgagaaccaggagagctggacctccggcgtgtcagttgggaggggcaccccaaatttgggtgttgggacggccgtggcaggccggagctgcccgtcatcaacattgttcccggggtcctccctgtcgtcgacggcgttgctgaataccatgcacgagggctcctttccacagacagccttggtggcgggttccgtgagcagcgccgatgagcagcatggtgcgccccccgtacggccatcctacaaccttcctgcaggatgcacgcaggtgccgataagtattctggtgttccacaggaggctgacggggaggggatccaggtgccggtcgccgcaatctcgtagctttatgcctgctcctgcactgtccggtgtctcagagggtgagcatttcttgatgtttcttcttttaaggttgttatatggtgttatggatgaatttactgtcacgatcgactgactgccgtttccgattcttcagcagatggagcttatgggccgattcctcaaagtgatttcttgtcgcttcgaggtccatctgaagtttttcctggtgatatggcaatgaatcattcagaaccggccacttcatatgggtacaattcagagtatgcacctatgcatcttcagccaaatggcttatacactgaagcttccaacactgaaagtgaaagagaagctagccaactgcaacaatcagcggaagctgttatctgtgacagcctcagtaagttggaatcggctatggagaaaattcagggtcaaaatcctcaagaatcaagtggcttagttgcagagggttccgctgatgataacattcacaagtaccatcagaaagctaaaagggccaggacacaaatcactcacagtgacaaaatagacttaccaacacaagctgtatctgcatgcaaggaaaaaacaataactcagatagagatgcagattgcagatgctgagagaactgaagcactcaagggtgaggatgccccagcacaaaagctgaagactcgaaggagaaagcacaggcccaaggtaatccgtgaggacaggccagccaaaaagcaaatggccacaacatcagaagaaaaacctctcaatcagaaacccaaaagaaaatatgtgcggaagaatagaaaccccagttctttggagaagtgcgcagaaccttttagtgaccattcaatttctagagaatccagaactaccgttagaagcagcattgcatcagttcgaagaaggctgcaatttgagttcggggagcacggggtgcagagggaccaatcatcaatgaccaattcatggtaccaaaaccaggagaaacctgttaatgctgagagttctttgtgctcagtgactaaatcgtccgtgcaggttgaacatggacaggaattacacatggaaaattcaccagaagggttgttttttggcatcaactccaaactgaacaaaattttagatgagtacatacatttgccagaagccgcaccaaaaccttcagagcaaatcccactggctgcttctggtcatgttagcgaggaactagcaaggaaacaatatgatgtgagacacactcatgatcctgattctacaagttataatatagaaaggagtggtctgatcacaacgaaagggcacaaaaaggacctagacctgaactattctaacacaaatggttttcagatgtattgttcggctagtttgttaccagaaatggactccacaaagggcagtatgactaaggtatcaaaaatggacaagaacaaaaaacgacattatggaggtgagtcctccctagctggcacacagagctccattatcatgagaactgcagctgagatgctagcagtttaccaagcttgtggtattaaaaagaagcgatcggcccgagtccgcaggaattcctttctttctgttatggatcttgagaagaatacttcacaagaatcaacaagattgccgcggtcatgcatggaagccctgtacgagagttcctacataaaatttatgaccaagaaacgttcacagaaggcacggctcaactctcccaattccattcaaccaaatatagatcagaaaaacaggttttcatctgaaaccattttttctggtgggttcaatggattgaaaagatcagaggaaactttccagaaaactttacctcagattccagatgataagaggatcaaccttgacattcattgcgaagtaccagtagaaaactcaccaaatacatcaacgccaccatatatggattaccttcaaggagttacatcaaagtttagatactttgatttgaacactgagcaggtgcataaaactgagatgcatttgtatcaaaccatgccctctctttcttctttaggagcaacaaattatttgccgaatgctctagtcccatatgttggtggggcggtggttccttatcagacacaatttcatttagtcaagaagcaacgccctcgagctaaggttgacttggattttgaaacaacgagagtttggaaccttctgatgggtaaagcagctgaccctgtagatggaactgatgttgataaagagagatggtggaaacaagaaagagaagtttttcaaggtcgtgctaattcattcatagcacgtatgcgcctagttcaaggtacttttagtgctggagtaaatccttttttgaagcccatagtatgctgagctcgttttccgcgagcctactttttaccctgtctattactgtgtagactatctcaggagcttgtcagccatatagaattttctttagaaacaaagggcaaagctcccgccagccatatagaactccttgaaatgttgtcaggttatttgatccattattaaaccacctaatttaaagaatttgtttaaatgcgctgtatatgatcttacaacttggtggaggaggaattacaaaagcatctcttatgctgaagtagctccactgctcaacatggggaaattagcatgcaaaggaacttttgagataatcgtatgtatgtgcttagataatcaaacatatatactttcttttat

SEQ ID NO: 29608 - DNA, 479 bp, Oryza sativa
agtatgcctttgagccacttttcatctagcagagcctggatctgtcgattacagtagtggaatggaatcttcaaaatctggtgttgatgctagtggcagtggaatttacagctcaatttcaggtggtggctctgatagtggagcaagtgcaagtgctttactggaaggatctgataacgacaatgctgcaagtcttcattgctgttatggctggactgaggactggcgatggtagtatgtatctggacagattctaagggagagttgttggacagtttaatatttccttttggtggtattagtagtcgccaagacacgaaagttctccaaagccttttcatccaaattctgcagcacggttgccaaataatgtcatctgcacctgagtctagcaatacaagaccgagagatgtaataataacccgtattggaggtttccttgaacttgaaatccagggtacttaacacttctaccataa

SEQ ID NO: 29609 - DNA, 2344 bp, Oryza sativa
catctctcccaatcgacagagaaaggagatgtagcttagagactactagagaggacaactaattctcatgtagctttcaccacaggaaaaataagggcttagatgatgctgaaaccgttgtctgtatgtatattaggcaggtagatgagggtcacattgacgagctctctagcccgattttgccttgttagtggattgaagagaatgctaatttcttgggctgaggatgtaattacgtgcgcatcgacacctctcccagggccaggaccaagttgtaatattgtagagctaactggtttataatttggtggtatttgttattgatgggttggcttaaccattggttccaagaaaatcaattggtacagatcgatgacgctgtatttaaaccctccatatctaattgtaagttgtcttatgcttctcaacctttttctaaaatgtaagttattagagcacttatttttctcaaatgaatgctatttgtgattgtgaaccatcttttgcagtatagtataaatgaaagataacaaaattgtttgcaatattactttattagtcctcatgcataaatttaaagtggctatttagattttagaatcagagggagtaagcaagaagcttacgcttacgctagagctgggatagggcttagtttggaccaaccttttttccccccgatttaatggaagcagcatacacacggacacgatgccacgtatacatacaaatgcaaagaaaaacaggacacctctggctgaacctactataatttcttcgaacaaaggaagaaatcgcctccaagccgctgctgaaagaacagaagaaccgacagcagtattgctccacatggtatggcaatgtcccatgcgaggctgaagagatcatcgcgagggttttcatacctggaagatggtctcaagctgggtacaaaatgtaaaatcatgtatggctcttccaatgtaaaatcccggggaaagtaccttcactttggaattggagcctgcgccgtttaaaataacctgagggagcaattaagaacccgtcgagtattaatcccccatgtgacaccatgatcccggctaatgcaccaagaagggagcgtccaaaagcggcacgggggcacccaggcaagctgcctatgatacctgtacagcaaactcttctatatatgatctgttcgttcgacagatgaaccgtttggacggctgcgatgatcaggacggcgtatacgtgacgatgtgacctaacctatagcgagctatgtatgtatttcggcgcgagctttgatgtagcagcggccggcatacattaccaaaaacattttcccaggcagccaaaatgactctatgcaggcgatcaaacacgctgattgcaactgaaggcatgcaaaaatatgatattttttcagacggacatccgactatcgagaaaaatagattttcgcaggcgggtcaattaagacacccacctttgaaaatgttagcgtcaaatttaaaattccacatcaaatttgatattaggtttttcaattaaaatattacaattattattgagataatacatacatacatacatacatacatatatatatatatatacatatatatatatatatatatatatatatatgcgcaaactttgggtgagtgtttgtgcgggctgcatggggtgggggtgggtggggtgtacgtgaggggagcgttttagttatagcgcaccctggatgcggtttagcgcatccctacatacatacatatatatatatatatatatatatacacacacacacacacacacacacacacacacacacacacacacacacacacacacacacacacacacacacacagagagagatacacacatgtcccttcggttccggccattaatatttacaacaattaatatcagggactatacattaatctcgagaagaaggcttcgcaccagacatctgcttagtgtgctttgtactggcaaaagtcatggtcaaaccttgtgccgacccaaaaaaaagtccgaggttcgaccctggccctagcccgacaacgacataaaagtccaggcctgagcctcagtgggctttctttggcttttctcattttctttcttgggccaaaccatgtgactgactgggccggaggccaccaccgcctggcacttcacctggacgtaggggtgtaagtgagtacgcggtttattttagtgggtaatggggttagctacttacacctctagctaaacaccgtccgtaccttgttcgtttaaccaacaacgcacggatcaatgacgatggccttgaattaagctgccggaccgtaagcatggttaccatgac

SEQ ID NO: 29610 - DNA, 16923 bp, Oryza sativa
cacataaaatactatttatgttttatcatataataacaacaaaaatattaatcataatttttttttaaataagacgaatggtcaagtgttgaacatgaacaatggctgcacttatttttggacggagggagtatcttagtaatagtttatactccctccatccacttttgatagacatattttcaaatctgaaaaatttacttttgataggcatattttcaaatctgaaaaatttacttttgatatgcatatttcaatccaaccatctatcataatgactttctcggatttaatgcgtgactctccattcttccacacagaattggatacatgggtatcgacaaatgtaaatattaatgaatcgtttgtttacgaggaataattagtaagagtagcatgtttaaatggatgataagtagaattacttattcttgattattgtgctaagataaaatataactatcaaaagtagatgaagggagtagcttaggttagtgacgaacaatatttgtgcagcagtgcaggtgccaaccaaataaacctcacaaaaaaaagtactactagctagccgctactaccgcatttgttgtgatatactaatcggtgattagactcacgcccacaagatgatatgatgtgaggaaggtgagacacattcttctttgagagccgccgcttaatcattacacagatcgttcgattgaccgctgatagaccggtactactcctaagcacccaaaatctggttagtaattcaatgacgcgactaaattaacttgattaatcatttaatgtactgatcatgacgtgcaagtccaaaacactgaattgtccctagtacggtcgtaccaaaagctgaaatttgctcagcttcaatatactccctccgtctcataatagctgtatttagatccaaactttaaatctaaactttcaactttttttcatcacatcaacctgtcatatacacataacttttcagtcacatcgtattaatttcaacctaaactttcaactttgaaaggaactaaacacagccaatataataaattttgggtagatataacatactccctccgtccttaaaaaaaagacaatccctatatccccgaggcaagcttagtattaacgtaaaattaccaaagtgccctccttaactgcattcgtcgataacactgccattctctgcacacatcagtactactactaaaactccagtactttggaggaaaggcaaaaaaaaattgagttgcatttgcctcaaaaaaagattacattccgccggaagaaaggaaacaacctgcaagaactataccaagaaaaaagaacagataagaaccaagaatagagggaaaaaattgaaatcaagttcctaaatcagatctgccacatatagccctgcaaactttagccttcacctcctgcatcacaacagcatggccctaccatcgccactgcatccatctcccgccgtcgtcgccgccgcatccatctcccgtcgccgtcgcatccatctccggatgccgtcgccatcgccgccgcatccatctcctgctgctgcatccatctctagacactgtcgccgccgcatccatctccggacgccgaccgccgcatccatctccaggcgttgtctccgccgccatcgccgcatccatctccggacgctgtcgccgctgcatccatctcccaccgccgtctcaacgccgcatccatctctgggcgccgtcgccgccgccatcaccgcatccatctccggacaccggcgccgccgcatccatctcccgccaccgtctccgccgcaccatccaccgccgccgtagccatccgccgccgccgtcgccggggcatcgatccgccaccgccattgtagagaggagcgaaaggaaaggaggggcagatctggagggagagattgcactaaggagaactgaggaggtagagggagagagaaaccaaatgagagggaggggataaggttgccgtgtgaaccggagaaaagaaaagttgaggcgctttgactcggtgactcctcaagaggacccatgcctattgaatgtgtatcgaattttgggcaggaatcggttttttgtgggacaaacaccccactccaggaatcgatttttttggacggagggagtatcctagtacaataaatctaaacatacatccaaccaaaatcctttatattatgggatggagggagcaataagaatcccatcccttctaatacttgatcattaacaacctcatcaagcctcagtcatttgtccaaggcttttattttggaagtgttcagaaattggattcgtgctccaatttgagcgaaaaaaaaatacaaacaactatccgaattttgagtttttacccattaactcttgcggtccttttataatatatagacatataatagcctatgcctccgatcgtggaagctacatgggtagagaacaacatagccattagtccattatacatggtgcaggtcgctttccgtcaggagggctgaagaaagtgttcctatctactgctacatatgcctaacatttaggaaccgattccagcaacaaagctgtgagaagctgagtggaatttaggcagaatctcacccatatgccatatcaaaataattaggaggaaaatacttcatttgattaggtgtgtcagatgcatccttggtatactgagatatttaagtatagggacccacatgttatagattgcgagtaacaaatacttaattattacatctttaaagtagtgaatagttaaatgccccctacaagagagatctgcgttgcggattcatctgcactttcgtttggattcgccgctgcttcaggagagaataccgattcaaaagttgtccactactgcaattaagaaaaatatctcaaccatgtgtgtgtgtgaataccctcgcatttgcatacataccattgtcctgattccaaaaaaaaagaaaaagcaattttacggtccttaagaaggtacactttttctattttaaatttggtgtctcttgatgtaccaaattttacactaaattttttatatctctcaaggaccgtaaaattgctcaagaaaaatagtaaatctgtcatttttgatagcaacattatgtaccatgtcgctgcaaagttttcatttgatattgtaccagccacataccaaaggcatctgaaaattggaatgttttcttttccaaaagataaagaaaaaggcaaacaatatttcagtgctttcatgtcaagaaatgcctgaaaaaggcaggttccatagttttttttttcatgcgatccaaatagttggaaaaaaatggaaaagaaaagcaatatagattattgtagtataagacatcactctgcagatattcatgatccaaattatagctctagagatgaagaaacaaaaatttaaaaattccaactttgaatgtgacatttgtttttagtgtgatttgcctttcgacatgtatagatggaatcctgcattttatgcttgtgtaatgatggatgacatatttagctgtgatgtttgtttgtttaagattcttttataaatatttggactgcaacaaaaaatcaaggtcacatgctcttgaaaacttgaacagaaatcaagtacattgcctacttttgttgataaacttttagaaaaataaattatgttgatcaacttaaagctttgggtgggttgactgaagtgtgtgagaactcaaaactggatgtagatcaagactcttcatcattttctttgatatggaaggctgacacatgtttaaacattttctctattatataccaaccgtcgtttttgtgtaggttttggcttgaccgtcacaaaaattgtatttttttttctgtgagtcctttgtgggaccaacagaaaatgtacacaccctcaggcttgcttcgaagtgtgatagtgacatgtttaaacattttctatactaaaataaagaggcagtcctcctccacctccacgtaagaacttttctctctaaaaaccgttcaccctaaaaagccagatttcaaaaaaatcaacaattataaaaaattcgaacagagcaatgggcccaaataattctactaaactgaattaaaaaatgattctaaaagagcgaatttggtcactcccatcgcaaagaatattgagttgaaaaatgccattgcaaaaagagaggggctgaaaaaaaaaactagtgataaatgtaacaagctcttgaaaatactattgtggtttctttccaatcctgccattagtgcctttttcatagataaatttccaaatatgtcaatgctttttattggggtccacaaatatgccaatgctacgtactctgatcttgccatcacttctattttgcatttctgttctgctatatatatatatatatatcagcatctctagcctaggttaatatgcagtaaatattgggtttagttgcaattttccctaataagaattagcgtggtgttgaaaattaaaaaaaaaggtatagaatcattagagaaacaataaagaaattatcgtcaagtatatagtacagaaaataaaagtacatacaattaatatagatcgaattagctgtaaattatcaggagtccccactagaaaattcatgatggagaagtcatggaaatgattttccaactcaaatattcttcttgctgacgtcgtttagcagcctaaatttcctaaaattaatttggtctgctagcgtattattacagttcacttttgttcgcaacggtcccgggcaaatcatctcgatcattcgatctaaacctatacctttgcttgaaacctgatattccgtagggtggtgctccagaagttgacattgcaagggcaaggtgcttcctttcattaactaaaaactaattaaacatcgaggatatcacaggacagatcttagccatatgtcttatcgggcaaaattatgatgatgttcgccggtaacctgcccatctaatctatccacatagcctttcggaaattcgaatctaaagacacgctcgagcgtgcttagtgctctccaccggagtaggctagctattttcccaagcaaaggttagtttgcatgcgcatacttgaagcataccacattcacgtggggaagacttgtaaggtcttatatatagtcttacaatatttgccatcggaaaccacacgaggaacctgacagatcacataataatatgacaagattaggcttgcaaaagcagaaatgcaatatttgtgagttgtgatccgtttactatcttttgctgttttgcatggtttacacgtctgcagctcctttctgagctatatatattttttaacgactcacaccaaacagcgtgaagtttatattgacagagcaggaaaaaaagttacaagattacaatcttaggaaatcgtaaccaggaaaagaagaaaaaatagccgccacccacacaccgacagctccagcaaacatccttgtgagaaggctagcaccggaccggccgccgctaggccaacaaaggagtacaagtgatcgagggagagaggatgagagagaagatggaacctctctaccccctaggcccttcgatgtggccatcttgtataagctagggcatcgacacaggatgacaaagtctagagcgagcttgcaccatatgtctgggaggtttccgcaagagggttgccaagacgacatctccaggggagaagcaacggaagcaccgccgctgccgtccatcaaggtctcagagagaaccaagactagattttcacccggcagccctgcaagaggagatggaacaacacgacaacgccctcaagaggggaagtgacacccgaaacgccattgttgccgccatacaaaaccaggataggttttcacctgccacccgccgcctgtctatccacaactaatacaccattgctccaccacagtctaaacctctgttggcgcatggataccgctgcaccggttccccagccggtccagcctccgcgtgccgtcacacggccaccctcgtcgcgcgatccacgccggcttccaacacgcgtcctcacgccgcaccgacctcccgccgctgaccatgcatactcgcgccaccaccatggcctccagtcagcgccgccgaagcctcccctgcaagccagtggcgccagccttccactaccgtcggtgctgtccacacaactactgtctccgccgcacctccacagctggctgtcgatgccgacctcccgctgcaccatcaacggcctcccgccgtcaacacctccggccgcaccgccgaactccatcatcaacgactccaaccacaccgtgatgcgccatcctcacgctcccgtcacgccgcacgtggtttgctgggggcgctgggggggcggtgccagatccgccaccccacgccggggaagcagtcggccgccgcgtcccacccatcgcgcgccattacgccagacgtcgccccctctcccaacgcgttccactccacctcccgcatcgaggaggagcaacgccggctcggtttccccgccgccgccttcccagcccgccgcgcggtttccggcagcgggctctagcggcggcaaggcggcgagagaggtgaggagggtggcggcgcggctagggtttcacaggagcgtcgcgggggactttgagctatatatgggcaccgatggatttcattagtcggagcgctggctgctttttttttcagaagtgcacgggtagtccttaaacttattcggatgtgtcatctaggtccctaaattctcaaaatacatctttggtccccgaacttgtcatgagtgttatatagatatatctaaacgggctccaacccactcagtgagatgatgtggcatgtcacagtgatgcttacgtgtcaatgagatctatatgttagtcacatagaaaaattaaaattttgaaaagaggagagaagagaaagtgatgtttttaattttgaaaaaaataaatgaaaaaagagaggagaaaaaaatatgttcttaattttttttctatatgtgactgacataaggttctactaacacgtaggcgccaccatggcatgccacatccgcacacggagcgggttggagtccgtttggatctatatgacacgccggacaatttgagagaccaaaaatgcattttgagagttgagggatttaggtgagacacgcacataagtttacggaccacccgtgaactttactttttttttcaggagaaaaggtatcgcgctatgtaatcaatgattttttatttcctttttatgtaatcaatgaatttattcttgtactgaccaatgctgctgacatatcttcttgatatacactatacagaatttagataatcaaaagatgtgaatatatccaaatcattctgattgatgacgccttattagtttcttttcgcttttgctattcatcatgccataggataaatattcgatttttctaataatataaccaaaatagcaccctctgaatgatgcacatagctggttagcgtaaatatcttgggggtggggggggtgggttaacataggggtgtaaagatttggcatgtcatatcagatattatatagggtgttgtatagggtgttcggacactaataaaaaactaattacagaatttgtcagtaaaccacgagacgaatttattaagcctaattaatccatcattatcaaatgtttattgtagcactacattgtcaaatcatggagcaattagacttaaaagattcgtctcacaaattagtcgcaatctgtgcaattagttattttttagcctatatttaatacttcatgcaggtgttcaatcgttcgatgtgacagggtgtaaaattttgatgtgggatctaaacagaccgttgatgacatgtcaagcgccttctacctcgagttgagtaggaggcgcggcatattgtggcagggaggagtcaccaatggcagtcatattaggccgtgtttagttccaaaataattcttcaaactttcaacttttccatcacatcaaaacttttctacacacacaaacttctaacttttccatcatatctttctaatttcaaccaaacttccaattttggtgtgaactaaacacacccttaaaactcctgtaagttcagaaatttcatgtcacggctatcagatgtgggaatatagacctataggaaaccctggaaggggtgccaacaatacgagtgcagttctcaataaaatatcttgggttacctctagatcataatactaacggtcttatgcaatttcataaaataaaaagaagtaattttactccctataactattttattggatcagttaatcatctaaattgtttttcgttcattcataggatcaagtgctccaataattagtttgagatagtacagccgttcgataaatagaaaaatattgtattcttatagaataattaatactccatccgtatcttagcactatcaatctagagataggtcatgtccaaattcgtagtgtcctatagatttatagtaatagaatacataaagcctaaaccctaaaccgattctagcacagtgctatgaatcgcttgcctcatttcgtgcagttgagaagctcatccaaacatccatatcgaagcggagcctaagcgtgtcaagcgaagcactatagaagtggcagtgctactgcgacgtgcgtgttccccctctaaattcacacgtcaaatcaacgtgaaacacggtgcattctcccctcccaccgtcccaactcccacgtccggctcggctcgggcctctccgtgccagagagtttcactcctcgcggagaaggaaaaaccggaggcgcgcgcgcagtcgtggccggggttgggaagatccgagaggcaaggggcaagggcggcgtgcgggtctgcaggatcaggatcccgaaaagctagcccgcggcgaagtaataataactgctcctctgaatctctccgatcctctcgaaccacgagaagctcagcagtttcggctccgcgcgccgcctgcctctcggtcgacagcacagtaaattccgccggcgcgtggtgcagctttgccggcagcgtgccgctcccacggccatttacttcgcctcctctcctgaggcaggtcggtgtcggtatttatgtatacttgcacagttccacttcccggccagtctcctcactctcgactactcttctttggtttttgctgtgaaggcgcgcggctggagacgggaagaccggggaggacaggaggatggtgccggccggcgaccaggcggaggaggccatcgtggcggacgccgggaaggaggaggcggaggtgcgcgcggccatgggcgtcgagcaggacggcaagttcagcatgacgagcctcctgtggcacggcggctccgtctgggacgcctggttcagctgcgcctccaaccaggtacgaccaaccacgaacgacctcgtcatgcctctcgctcacatttcgtttggaattttgcaggtggcgcaggtgctcctgacgctgccgtactccttctcgcagctcgggatgctctcgggcctgctgctgcaggtgttctacggcctcatgggcagctggaccgcctacctcatcagcgtcctctacgtcgagtaccgcgcccgcaaggagaaggaaggcgtcagcttcaagaaccacgtcatccaggtcggcagggctagctcctctccttgcacatcttcgcgtcagtttcagtttcgtcagtttccgggttttcctgcacacactactgcttaattattttccccgacggaattcgatccctcgtgatcgatctcatgccggtatttcgagcagcgcctgcgtgcgagcgagcgttgcttgtccaacggaaagccgcttttgcatgctctcgcctcctgcaggttccttatctgcaacgcgatcagcatgcatatctgcctccagccagcctagtgcacgcatcagatcaactggcatatggattagactaaacttaatatggattatctaaaaatttactatttttgtgttctcttatgccactgaccagtggttcgaagttcttgatgggctcttgggcccgtactggaaggcggccggcctcgccttcaactgcaccttcctgctcttcggctccgtcatccagctgatcgcctgtgcaaggttgactcgccgagttcttgagacaaacatacatactcttctttttttttttgtaatctttgttcattgagatgtcactgaaattgtaatgcattgcagtaacatatactacatcaacgaccggctggacaagaggacatggacgtacatattcggggcgtgctgctccaccacggtgttcatcccctccttccacaactaccgcatctggtccttccttggcctcggcatgaccacctacaccgcctggtacctcgccatcgccgccgccgtccacggccaggtgagtcctcgatcatcgcccgccgtcgtcggccataaatcaataaatcatcagccggcacatgcttgaccacactgtttataagcatggttgcaatgattatgtatgattcgattcgatggggggctaataacgatgtgtatgattcggcgtggccgctgatcgaattcgactcgatgtcgcaggtcgacggcgtgacgcactcgggcccgagcaagatggtgctctacttcactggcgccaccaacatcctctacactttcggcggacacgccgtcactgtgtaagtgcactaaaagaaccctatgctactgtaaattgtgacgcataaaccatgcaatgcctctgctaattttgtcatgaatggttatcgacaactgggtccagtgtccaagccagaattccggagagccatctatgaaacaatgatgttcgttgttacctaccctagatttagtctggtttctgttttatctttagtctctccctccttggcaaacttgtttaatttacggaaaccagaagggttatcttctagccattggttacaaagaaatggagcatatagccactaaggttggcgatcaccctacagtcctctgctcaagttcctatgatgaccaccaagcatttcaatactcctagtgaacattcctttattcccgttgtccatttcttgtgcttaatctaagatacctgctatgatgatctttgcatcgcgattattaggaataattagaaccagtgagatgttcagacgccctggtattaaatattgagtcctttgtctttaaaattcagctactttttttgtagtggtaaaaatgttctttccaaagggtagatgatatggattggtttcagtccagctagtgcggagttaacatcgaataaaccaatcccgcccaacttcagtgatagcctggtaggacatatatcggatcgtgacaattcattaactgatcggttatggttcacgattccattttatctttccgtgataacctttgattagtgcagtgaaagactactttgagaattccttccctactcccaagtgtcagtttgacattacccttctcgatcgatcacagtttcttgcccaaagcaattcagggctttttgagtgatgagtgatgacagtaattgccattacctgagagtgttaggtgcttgtaatcggcaagtagcttcatttggtcgtatttgtcggtccccctctgcttacttaccatcaccagatgtgtgtccgcgtctgtgcagccgaatgatgtagtgaaagtttggggataatgggagattcctcatgtcccaatctttataaatatcctgactaggataagcactaccttgcccccctgcttgatctcttatcattcaatcaacttaaagtaaagttcttatatatcacttggcatgtgtatgaaaaatgtccgtttagtacgttttgttccaagcggggctaattctgatagcttcatatatgttactagtactgatattattattatttaagataagatgaacaatttcttattttgcataatcaaataatctgtacatgcatgctgaattagagattgtgctgttgatcggttcacgatgaacgaagctgacagtgaacaatcgtgcctgaagttctgaacagttgacgaagtttaattaactttttacgcgtgcagagagatcatgcacgcgatgtggaagccgcagaagttcaagtacatctacctggtggcgacgctgtacgtgttcacgctgacgctgccgtcggcgtcggccatgtactgggcgttcggcgacgcgctgctgacgcactcgaacgccttctcgctgctgccgcggtccgggtggcgcgacgcggcggtgatcctgatgctgatccaccagttcatcacgttcgggttcgcgtgcaccccgctctacttcgtgtgggagaaggcgatcggcatgcacggcacccgcagcgtcctcacccgcgcgctcgcccgcctccccatcgtcgtgcccatctggttcctcgccatcatcttccccttcttcggccccatcaactccgccgtcggcgcgctcctcgtcagcttcaccgtctacatcatcccctccctctcccacatcctcacgtaccgctccgcctccgccagattggtaagtgtgtgcagctacctttgccttttctttacttaccattaaattgcccgagtagattcctcatatatcaatatgaaacatgcactgtttgtctaaaaaaatttaaaaatatccgagtagaaatcgggctgtcagtcggtcaccagtgccaaagtgacacaaccacacattacactacaccaaggcactcttatgctagctaggatgctacacgcatgagcagaacggctgggtattgcatattggcacggattattggtaagcactgtgcagatatggaatggcccccacaagtactgtgatcaaagtaagtgtagccttccactatggcaccaaagcactagtgccacacgcacgaacagcgccgtgacgccgagagcgctctccctgtgctgctccggccaaacaccgacaggctctcggtctctggtgccccccaacaacgacggcgcggccacgcggatcggcgccggtttatttggtcgggtacgcctgctcgatcggtcggcggcgacagggatggccggggctgacgggtcgctgtcgctgttccgcctttctccggctgtgccggcccccggcacgtacgcctggaccgtataccttatcacgcagctcgccggcaggcggcagcacggcgtgaaggtcatatctgcgcaacatcaactgacgtacagcgtgtttgatttttttttttatgcaaacagaatgcggcggagaagccgccgccgttcctgccgagctggagcgggatgttcgtggtgaacgtgttcgtggtggcgtgggtgctggtggtcgggttcggcctcggcggctgggccagcgtcaccaacttcatcaagcagatcgacacgttcgggctcttcgccaagtgctaccagtgcccacccagggcgcacgccggggcgcccctgccggctccgccgcgccactagccaaaaaaaccgagtgccacgccgcgacggcgcgacgccgcgcgcgggccggtgacaaaaggagctagcttccccgcgggcgtcttgcctttgtgtagtaggacagcaggtcagcagcatacatggtaggacagcgcgtgggtcactgactagatttaccgccctgcaggggcttccctatgctgcggagtcttcagttcatgtgtgttgttggcaactttgcgtcgtcctcttttgtttgggagttggatgtgaacttggtcgtaatttgtaggttcttctgttcatgttacatgccaatataaaacgccatatttgttcatgtttcatgcgggtataaaacaccatatgaatatgattggatcatgaaagtaaatgagttattatgctaactaggaaggtggcccgcgcgcatgcacgggcacttatattattgaaaggtaagattactattttttaaaaaattttgtttcatagattaagggtaaattaaagttcggataatgttattttataataatttaagggttatatttttcttaaggtattttaaaaaaccattcacaaacgtttgagtaggagatggattaagtacttacgacttttgaatcatgtgtttttctctctcgagtaaataagaaaggagaaactattgctaattgattattatacagtccatctatatcatatagtgtagtttggctacaaatgaaaaatacgagactaagatactcaaaattcttgtgattaaatcatctcatgaaggcgcatgatatagtaagaaagggagggaagactatgcatggagaaaaaagaagaaagggaaaaatgaaaaaaaaaaagggaggggaagcgtagtacccacgtacgtaggtgtatacatgtgccatgggaggagaggtgggacctcgtagtatttagtttgttctaagatcgatttaatctaacaaattatgatattggacgtacatgttataatatttagataccttgcttttttttcttagaacttctaatatttgctctaatttattagagcaccatgtggcagcttgagagtattttaaggaattttaaaagacttaacacatgtaattagaatattaaccgcgtaatatgtatgtatggggtatatggtaatatttgttccagctttatccatggttatatacatgtaaagagaaattaattatgtggctagcaagccactagatgtctaattaatagcaaataattttgccgcatatttacagttattcatagtagctcttacatattcatcttatgactttgattatccgttgatccccaatttactgatcatcatgactcgcatgaaaaaaatgtactacttagggtttaggacaggtgaaattgatgaattatctgttttatgcgatagctatttgagggtataaacaaatcaattgacttctaaaaagttaaaatgttgtttaaaaaagacaccatttagaaacttggaaaggtgcaaaaaaaatccaaactatggaatcggaaaaaaaagatggcattaaactcccttataacacccttgtcttagtaagaattatattgatattagttagtattgtgctcgtatttataacataatgatttctttcaccggtacaaacaaattgtacaaaatccaaatactacataacaaaatacattataattattctgtaatcaactctcagtttcagcttaaacagagctaaatgttggaaaaaaaccaaacccttggtgcctaattcttctctcgctacatcacacttttaattttctttttatgttattagcaaaattaatcatatccatatatgatttgatatatggcaaagctgtagcgctgcaacggtcatgatcaccttagatgcctcagacatgatgctttgtcatgcgtgcgaaaggcaaaggtgcagacgtgcattatgcagcgggccaaaaaaaactttggacattttatttattagcaaacaatagatctgatgatttaaataatgggtccaccagtcctagtgtaagtgtaaattagttaaaatagattttaaattgttaattaaatgggtacacaatatataatggtatatactttattttaaaacaaaccaaatattatggagtcccacctctcctcgaaacagtgcattatttgagaataataatccgctgtaacaaaaaatagatccgatgatttaaataatgggtccatcagtttaagtgcacatataaattaattaatatagatcttaaattgtttatttgataggtacacaatataattgtgtaaattttattttaaaatagtgcattatttgaaaataatagtacaagtaatgagtacaccggtttaagtggaaattattttacattattagtttaatgggtaacatataatgtgtaaattttattttcaataattgtagagctgtatgacggtagactctttggttgtaaaattatgattatttaaaagaaatatatccattatataatgaaaaaaagaagaaaaaaaggaaaaaaaaaaggaaggaagcatacgtaccatacatggtacacgtttgcatacatatgtgcgggtgaaggaggagaggtgggacaccatattatttggtttgttttaagatcaattttatctaacggtgtataattttggaaccaccaatttaagtgaaaaatcaatggatagatgctttgcttttttcttagaatttctaggattttctctaatttattagagcgccacgtggtggcttgagagcgtttgtaagaagtttaatggacttttagtatataattgatggtgttccatgttcgcgtcgtgttcatttgtactatcgtacacaagacgcgttgtgaatttgtgatagttgaaaggaaatgtatgatgtaggcaaaattttgttagaggacaatcaaatgtgtaatttgctggaagacatcgtaaaacgtgtcatggctaaaagacactctaaaaacctggtaatttgcttgagaacacttttagctcaattgaagagagaaattattaaaaaaagatgaaaatacctctatggtcaaaagattttgagctgagactagagtgaagatgaaatataatgtatactagtgtgctgtaattggggtgatctaaatttagaatttcataattggaaaaagtacgaattaccacccccgaactatcatggtcatccgaattacccccttgaaccacaaaaccggacattcttcacccccaactatgcaatccgcggtggtttcggtctacgtggcagtccattcagcaatttatttattaaaaaaataggtgggccccacctgtcagtttctatctctcctatcgcttctatctcactgtctcactctctctctctgcctcttctccctcggacggcgacgg

SEQ ID NO: 29611 - DNA, 14013 bp, Oryza sativa
ctcgcctccgcccccgccgctcgcctctccgccgcccccgcggcactcgcctctcctctgcccccgctgctcttcaccgccgccgccgcctcgcctagcctcgcctcgcctcggccatcgccgtcctccgcttgctggctcggccgtcgccgtccgaaggagaagagggagagagagtgagacagtgagagataggagagagagatagaaactgacaggtggggtccacctatttttttaataaataaattgctgactagaccgccacgtagaccaaaaccaccacggattaggtcgaggggggtaatttgtccggtttgcatagttgggggtgaagaatgtccggttttgtggttcggggggtaattcggacgaccgcgatagttcccggggggtaattcgtactttttccttcataatttataaagagagaatccattatatgccactgactttgtcacacgtccacgatttgccactgactttgtcacgttctacaatatgccatcgatttttgtttaacttctacgatttaccatcgccgtccggttagtctccgttagtattgtacaaatttgtcgaaatgaccaaaatacccctgagacaaaaactttcaaaattcggatacaaattctaaaatatcagattttaaatttttggccaaattttggatgtttacaatcttatatttataatatgatattttgttaattttatccaatttttggaagtttttgtcctaggggtattttggtcatttggacaaaattgtacagtgctaacggaggctaaccggacggtgatagtaaatcgtagaagttaagcaaaagtcgatggcatattatagaacatgacaaagccagtggtaaatcgtagaggtgtgacaaagtcagtggcatataatggattctctcatttataaattattactctcctatcagtggcattcttgtcttcttcaagaactagcatggtggcccgcgcaaatcgcgcggctagcatcattatattttctctcatttaataatatatatgttttctcaatgtattattcaaatatattaaaatgacaacataattttaaaattttgtattacctttacgaaactactaatgtataatattcatattgtattttatatacatgttagttattaattatttttaatatcaaattttagttatttgtaaattatattcctatatggactctagactcgtcttttaatatttatttgtttttaatttcgaattttcgttatctataaattgtatttctatatagactctaggcacttcttctaatattatttatttttaattctgactttttcttttttctaattgtatttctatgtggaatctaaactcatctttcaatattctttaatttttaatttcgaatttcagttacttctaaattgtattcttatatttactttagattcttcttccaataattttttaatttctaattttagttatttgtaaattgtacttttatacgaactctaaactctacttttaattttattatgtttattccgaattttagttagttttaaattcttatatggactctatactctacatcgaatattccttatttttaattctaaatttctattatttcttaattgtatttctatataaactatatactctacttctaatattccttatttttaattccgaatttctattatttcttaattgtatttctatatggactctatactctacttctaatatttcttatttttaattacaaatttttattgtttctcaattgtatttctatatggactctagtgtcctcttccaatattccttattttttaattccgaattttctattttttttctcaattgtatttctatatggactatagtgtcatcttccaatattccttattttttaattctgaattttaactatttctaaattgtatttctatatggactcagtttttctttttctccaattaatatgagaatttctaggctatgagagcgaacgtggaggctcttttttctatttctttaataagttaatagatttatctctaattaagttaaaagtgtcatctagcaaattcctaattttttagaatatcttttagtcgtgacatgttttttctatgcttatcagcaaattacacaagttttgggtgtgctgtagcaaaatttaccgatgatctatggtgggctgtggccgcccaaatttattttcacgtttgtaagcccatactgtcacgccggaaataacaattcgtttaatcctaaattgggcttttagcccatgtagaacaggagtactagtacaccacaaagagtcctttatggtaacgatttcgtagaattttgtgatttaggcgaccagaaatcagttaatactcggtttgagatggcgatgaggcgatgagatcattgccttttcggtcgaatctagcagagcggcgagcaacccccacccactttgactccgatcctccccgcccccagcgcgatagcccatccgatcccaaattccggcgagatggcggtcagcctgtggcgcgcggtgatgggcgcggccggcggcggcggctcctcgtcgtcgtccgcggccggcggcgacgcggggggcggcgtggagttctggcacggcggggagcgcacggggtggctgaacaagcagggggagtacatcaagacgtggcggcggcggtggttcgtgctcaagcaggggcggctgttctggttcaaggacgccgccgtgacgcgcggctcggtgccccgcggcgtcatccccgtcgccacctgcctcaccgtcaagggcgccgaggacgtcatcaaccgccagttcgccttcgagctctccaccccgaccgacaccatgtacttcatcgccgactccgagaaagagaaggaagagtggatcaattccatcggccgatccattgttcagcactcccgctccgtcaccgacgccgaggtcgtcgactacgacagccgccccaactccaagcccccaccgcagccgaagacgagcgaagagagtgaaccgtcagcgtaagatagcggtgatctctggctctcaatatgcatatctattgtatgattttatctactcaagtagtagtaattgtgaatttttagtttttgttttcttctcttggttaattatatgtatattattgactgctacctgagaataagttcaaggttttgccgtgtggctagttcttttacattatggattagttgcaacagcataattcggttggtgtttacttgtttcatcctgtatgaagttactggcttggatcatcggtgctgcgaaaaattttaagcactcagttctttaattttcattatggggattttcgtttgtcaccaatgggagcctgaaatgtggttcagaacatcagatgcaatcctctgtattgtatagtagtactgaagtttgggctgtattcagctgcatgtttagctttgatcttaatcttgtcatttggagtggatgccccagctttgtgctgacctcttcaatatttgtttgtcatgacctgattgtacctgaaatctgaagtcttaatggttactatactttgcggtatgtcaccttctttttaaaactgtttgagtagaattctagtcagaagtcagaactaattagtatatattcagggcttcatgacttcatgcattggatatgctaacaagcaggctgtttcataatgttttaaacctattgaagcctcaaattttctgataacaatactacttgttgaaggtagaaataaattttactcttgttagtcctaaagatagcagtgatattttgtcatctgatatttgttttcttaatctgaatagctttgattagtttacagcctacaacagagcttgttgacaggtttgtcatgctgaaaactgttcattgatatgtctgcctgttttgatgttaaaagtgagagaagtattatgcatggtagttcgttggaagtccaccgacttggtattatgtcttccgtcttctgcttgttttgatgttcaaagtgagaagtattatgcatgatatactccgtatgtagtttgttggaagtctgctaacttgtgatgttgagcaagattcatccatagggtttgatattttttgggacagaaggagtagttcgaagcaaggttgatttaggccctgtttagcttccaaaatttttttcccaaaaacatcacatcgaatctttggatacatgcatagagcattaaatatagataaaaacaaaaactaattgcacagttatgggagaaatcgcgagacaaagcttttgagcctaattaatccatgattagacataagtgctacagtaacccacatgtgttaatgatggtttaattaggctcaaaagatccgtctcgcggtttcctggcgagttatgaaattagtttttttattcgtgttcgaaaacccattccgatattcggtcaaacgttcgatgtgacacccaaaaattttcatttcgtgaactaaacagggccttaaacagattgaacccacaccaaaagtcctaaacagatgtccccaaaactgaactgcaatgatccttcgttcgtattgatagcagtggaatattgggtggttcaagtctggctatccatgtctccatcactccatcaagtcctttgaaatttgaatttctggatcttgtcttcttcaactttgtcccttaccactcactatggtcctcgatgggcatgtaatgatctttttaatgaaaatgacccgatcagcgagtaaataaattctgagtgaaaatgaagcgaagtaccttactccacattttatcgctggttttctcccatgtacatgtagtctattctaggccaagcggactatttgcacttcttgcatggttacgtcctcctgcggtcctgcctaatatacctccctacctgtcattttgaggtcgattattgcctaaatgaaccgtaccaatatttggtactgcttaattttagtatagtttagcgctatcaaattttggtagaatttgatgcatttggtttaatgccttattaagttttactagtgttttaagagtagaagtttccaaaattaccagactttagtaaacataatatttgcaagagtagagctgagtcggggtatttcaattaggcacaatatattttaaaaacttttatataggactcaaagaggattttggagccaaacctagggctcaagccctaccttccctagggtggcctgctcctccgtccaggaaagcatgtcgttttaaggttgattgaacaaattaacaagtaaaaatgactatattaccatcatttaatcattgcatttgtcacttcaaattatgctgcagataattaattaatcacttatagtagaccatctattgcattgcacacacatgggtaatactagtagtggtactgttgtatagggaaataataggttcaaatgaatcgatggaatatactaggctcagcaagctggtcaagatgctcgaacaacaaattttgtgggatatttttttaacaacagcggctttctgggatggagaaagtaaaaattatactctgagtacaaatgacacgttctttgacagaaagactgttttttcaatggaaaaccttccgcaatggaaaacccggaagcttgggcctctgggcctaaaattccattacgtaaaggctgggaaacacccggaaaaggtcgagctgacctgccttgctaatgctaggtccacctcccggttggcgcccgcgggaaccgtgtgaggtggccgcgtgtaacggcggaactctctcgaacaccgagacgctctcctctcctcctgagtcctgaccgacgcgcgagatccaacgggaagccgaagccgaggagacgaaacgagggcccccgccccgtccccgcgcccgctcgtcctcgtcctctcgctgcgccgcacctgtcctctactgtcatctactccctcgtcggctcgtcgccgtcccccctgccaacctgccagtgccaggggatctcagcaccctcacttcctccccaccgcaaaaaacccccacgaaaccctcgtgctcccttccgtgccccaccacccctgcactgacgcgcctcgtcgccacccgatcgatcgatcgcctcgtgaagcgccccgcgcgcggcccctctctcgactgaaatcggaaatccccaccctttctccaatcttcacctctcccgtacgacatggaagccgccgcgcttggcgtgccgttggtgcaggtccgggctgcggtcgccgcctatggccgcggcgccggcaagggcaagggcaagcggcgcgtcgtaggcgctttccacgcgccgcccggccgccgccggacggcgctcgtcgccgcgctcccggaaccccttcagccgctctcgccagcgcaggacggcgccgtggcactcgcgtcgactgaggtacgtcgcctcgaatttgaaaccattgtacgttgcgattttgagataaacactggttacctccgttgctgcaggctgatggtggggaggaggtccatggggatgtggcttccgcagaaatctcgtctccctctggtggtgagcctcctctgcttggacaatggcgtgacagtagaaatggtgaaaactgaaaacctctggtggcgatggatattgtgatttattgtctatcaacctgttatttcagttcttgggaagacggtgcgtgttagatttgtgctgaagagggaatgcacgttcggccagagcttccaccttgtcggcgacgacccggcgctcggcctctgggatccgtcgaaggcagtgcctttggattggtcagaaggacacgactggactgtggagaaagtgagccttgcatcgtgcgcattgtttgatgtactctccttttgaggtaatcatcaccccttttcttctgtacaggacttgccagccaacaagttgattgagtacaagttcgtgctgcaagatttgtcgggcaagttgcattggcagaatggtcgtaatagaagcgtacagacaggtgaaactgcaaacattctagtcgtatatgaagattggggtaatgcaaatagtcagacagtagaagaggagggtaaagtgtccattgggatggaggagggtaaattgtccgttgggatggaggaggctgtagttccagatgatagtgaaagcagagatgatattattgtagcagatgagctacaggtggatgacaatctagcggtcatgcaaaatgaatctagtgttcgagaggatgacaagaaatcaacagttgggacagttacttctgttcaagctgaattaatgaagctacatgaagctaaccaaccagaggtaatggcttaatgagatatccattgcagataccttcatgtgtttaagtctattttctaccgaaaccccagagacattctatatattctcaactgtcggctgaaaataattagttcagtgtcccctatatgctcgctgattgaaatgtgatcctttttttatctcattagttactctgctttctcatctcaattagcttagaggagtcatgatgcaaagtagtgactggttggatttcatatgagagtttttaaaactatttactgtttactggaacaccatattgtttctatttcctatttcctgataatgtatttagtgtgcaaagaaactgaattatcaagtgtcagatcatccattcattagaagatgtgacataggtgtaaacatggataaaatcaggggctctgaaaaaatataggtggtttttagtgtacaatgtgagctttttagtgcctaaatctcatcaaaatgtcccatgactttggctgttgtctagacatatcatcctatttttatagttagctgttacttgctcactctatgctgctatcatacttatatataatgcaatttctgaatcagttaattgtagatgaaccacaaattcaagaggcgcttcctgaaacagcggacacagaaccagagaacggcggtgtggcaacgtgcgctgacgaccgttatgccgaaagtacagatgatgacggtgttccagtaggaggtacagatgatgacggtgttccagtagaaaatcggtggaccggtgcttttgaacatgagttgctttggggttggaaggccctgcagcagctactcatgagcctgggcttcaagatggatacatcatgaacgagtcataaggtactgcaatacataggtggcaatcttgatgtattctgttccttccatcgatttagtactagtagtaaagactagcagctgctgtctgttggtattgtttgaacgttcagttctgtacatattatttcccagaaccaaacatcaataagctgtcaagtttgttctcagctaatgagcagccacacttcaacactaagaagatgtgtaagggatgtccatcagcagtatatatacttgtcgtgagaattacgaccatgacaagaatcgctcaaaaatcctagtatgatatttgtgctgcacagctctcctctagtgcgttgtaatcgacaataaatccgattctggaacagcctgccattgaaagggcgggcttgagttaaggctgagttcatttcatcgactccagacggtaactttctcattttcttagtctagactgctagtcggtgtgttgtgtaaaataatttatataaagtttttcaaaataaaataaatttatttttaaaaattataatagttgatacataattatgcgctaatgatacgcctatatttttccaagcggagctactgattcgaacagggctgaagaccagcttcacaatggcagacaaagcacagcattttcaattttgaataaatacaacagaccttttcaaggcatagtacagggcattggaacaaaggaaggatctccctatattactatgaatttcctatgaaatggttcgatccatttgaattttggagaaaatataacagaggtggtagccctcgcgtggaaaatctgtgtgtttgactcactctaaattcatgtgctcttttattgtggaccatctttataaaatgatgccttttgcatagagttctatagaggacctaagattttgtaacacccctttagcaacgacaacacaaacatattagtagcttattaggcccaacaaatttcctatatattttaagacatctagctgtggtaactcaaaaaagttgtgaacttttcgtatataccactccaaaagtctccactctccgctgtgaaaaaaggcttgtttgaaatttagaatcttggaattagaaaagatgctgccaaaacctatatgttttaaaaaaaattaaaaaaaaactaaggacaccagctctaccaacttgatactagtaatacggaagagaaataaaaacaccatatcttaagggtataataatgatgtcacgcttggaagaagatggcatatactacctctgtacctaaatataagggttataagggtttttggttggatgtgacacatcctagtacaacgaatctggacagaccgtaggacggagggagtaagaatttgatgagtggaagaaagagaaaaagggggaagatatcgtaatagatggcttaatacacactcatatagtcgaataaataattatacaaatatattgtaacaactaaatagacaacatattatatgagttatcaattcataatatttggcattctaactaccaacaagattttacatttatatttattgtgtaacatactttaataatataacatgttttttaatctttactcatttatttaggaaatataagtggctaaactaaaacaatacaatggggttgtttagattgtagccaaataaaccttatcaaattttggcaatattaccaaaaatttggcaggatttcttacgtatttaccaaagattggcaaaaaaaaaaaactaaatgtagacacatttttggcaactttgctaaaaatggtgtagtttgaaatggcattattttgaatagccgcaatgttaaaattgccaagtattaagaaatcggggagtaacatagcatccaccccatatccccaaatatgaccttattatttctttctcatttagtactcttatcagtgctaatactggtcttcttttgctcctcctttctaaaagcgaggctactaaggaaagtcactccataactttttgccccctctatcgatcatctatatgtaaacaaccgtgtagattaattgcttgatttcactttcacatatctcatctttcttctatctctatcttcttgcctcaaaaagaccaattgtggtcgatgtaagattcaatctaagatgattgagcaccaagtgtgcaagcaagcaatgaatgcacatttttatcatctagaccaacaagcataatactcctctccatctagttttgatcgacacatttggttccagcatggtggcaaaggaggacacaagttcctccatattccattaactttgcaatccgcatgccacttcaattacgtacatgtatgtatgtgataggttgttgcaagcatgcatgcgactacgcattaactatctgagacattgttatgctaaaagcattgtccgcagccaaatcatagatcaatcctacgagttttttttcttaggaaactatcaaaactatatggagggagtattatatattcttggattagagtatgttttatatggtttcttgtggaaagttattacaaaataactaacaacgataatgtaactagggaggcggagtcttgtgcaaaaccatagagttcattatctatcgttatggacatgcatcaggagatagaaattaatcattttgtaaaggaagaagacaaacaagaaaaaaaaaggtttatccattataactggatgatcgatatcaaaagaaagtcatgacgtaacttacattcaccatattagaggatctgcatctcagcgagacatgtgttagctgagtagttgagccatgataaaattatataatgaatagcattgtaagccattgatccattgtagataccgacaacacaggaggccggtgcttattggggcaatggaagaccttacaagtgggacgaaggaagggcgcacaatagagactatgaggaggagactctgagaaggggattgcattaggaaataggataggggataaaagtacaaatgacatttagtattagtgtgttattttttctgaaaaaaattaatttgtcatatatatcgagttttgccaaacattcagtcaatccaaaagcatgtcttcccttccataattagttttttttataagagataccttgaatctaaacacctttcaattaaggggcaattacaaatttaccaatgttttgaatcgttattgcaagactgccactaaaaaattgcaaaaatgccactaaaatagttattcgagtagcatccttacaaaattgaaaaaaccgatggcaaatttgcaaatgccccttcaattaaagaatttcatgtactcccttgatttttaatagttgtcattctaacttctttgatcattaatttttaatttttatagatctgtagtttaataacatgtgaattatgttatgaaagtatttctcacgataaatcccaatacataaatgctagtatgatattaaaacattatgaatttttaaaaaactgatggttaaagatacattagcacaaagctaaaatgaaagtaatttgaaaggggctgtaaattgtacattaactttgcggcagccgtgcttgctagtacaaattataagtaacaaacttttgtgacgtatagtagcctattctctagaaataaaaaagaaagaaagaatagacgggagaggaaaaaactatggatggtttttggacttctccgctactctagaccgcaagggacgcgacttgttcaatggccattcttctctgaaacactagactagagaaccccgcatcccacttcttccaggctccagctcttcttcaccctaacccagatccgcggggacccagccgattcgcccagccacgccaccgagcgctcgtctcgtctcgtctctcgacccaatcccgtcccccggcgcgacgccccgccgcgcgatggccgacggcgccagcagcagcggggccgcctcggcctccggccccggtggcgggggcggcggggagtcggtggtgatcgactacggccggcgccgcacggcctgcggctactgccgatccaccggccagacgagcatctcgcacggtacgatcccggaaaagtccctttgggtgaaagggaggaaaaggaaaaaaaaagaagagataaaatagaggactagcggactggggttctgtctgcgtgcggagttgttctgtcttcggttcgagtcgatgcgtatgattgctagatgaccccgaaacaatcgaatttcaggtgtagatattgccgccgatgaaattggctaagtaccatgtatttagtagcacattacgacaccatgtctcataatttgggttgtggagaatcgattcgttgtttatgccagcttatgctcaggaattttgttagagcctatgcgaatacatgtgtggatggtaatatgcatcgttggacgctagtaacgcaggccacctataatcttgtggcctgggtctgcccatgctctcaaggaagtaacatttggccaccaaactacaggatgtgaagtactgctgatagcctatcaacgctgatcttgaccccctttattttactagcgtatgctactgatcttgtctttattagatatggccttagagcgtttcagatgcctccgttttgcgcttcaccttgtttacatcaatggacatccaattctgtctctgaaatgggatgaaaatcatgctgccgacgtgcttattgtctactctcagtcataggattagtatagaacacataatgttatcaacagctagtagagtcgcctgttgcaatttcatggttattcaaagttgtatctgtgacgtgtcccttatggttatgactacaaatatgttatacgatggtgatagttgtaatatgttgatgcaattattctgttgttaatgtccctacctaaattggtgttatagattctttatgtttcttttggttagtgatggtatttttccttttataattttcaaggtctctaaggaacgggccttcaatatcataggttgtttatataagaataaatttcacaaaaccccaggttttgaaacataattaccacaaaccccaggtttcagggtctactttaagaaaccccataatttgaggtattccatttcacagaaccccacttccgtcaataacacgttgttccctgtcatctcacatgaagggcctgctggttagtcaccattcagctagcctgtcatctcacgttgttccccgcattcatcttcctctactgctctagatctgagcccaatcttaaaaaaaaagatctgagcccatacttgcaccaccgagtagcagaacggggaatgtaggatctccatgttggctcatcacccggagaaatttccctcaccgctctcctactcctcaccattgggatccttaaccacgccttcggcttctcttttgatcttctcaatggaaggcagggaaggggaaggagaaggagaaaattgtggttgacatgcaggacccacctgtcatttgccggaagttatagcagaaccggtgttatgtggtacatatgtctcaaaaagccagggttttatgataaaaacgtaatatctgggcttttgtaatacatgtgcctcaaaacctggcattttgtgaaattgttcatatttatatagatagttcatccttgtttttctccatttttttgttattcttttgaagcctattttaaaaccttttactaggatccttacttattctacttatcttgcaggtctatgggctaacagcctgagagctgatgactatcaaggtactacttttatttaattgcatattttccttctgtat

SEQ ID NO: 29612 - DNA, 965 bp, Oryza sativa
ttttaaaatagagaccactaaaattgaagtggtaccaagtaacaccaccaaaatttttcatctctattctataccaccaagtgggaacaaatctaccgaaaataccaccaccatcagttcatggggtagcagttttaagaaggaccagaatgtgtgccgtcgccgatgattctacatcacttccgctagtacttgctggagatccctccattgcctgtccaccacgtcctcagtcccatccccatggacggcatcaactcgttcccggtgcccctgttctaggttttggccttgaatggccagtgtggccacctatctttatcgccaaccaactcctcgacaatcttgtggtgccatgggtggcgtctcaaccgtcattgtctcattgcgcgggctggtggcggtgtggctatgtgctgaccagaggtgagggaggagctctctgcacacagttagcagccgcaacggtggacggtaacacctatgctactccttgcccaagcttgatgcaagcataaaatctgggtgtgctttgtgcagttaaggcagggggcttctcatggagtaatggtgatctggggtgatggaggttcatgctgagagaaatggaaccatggaggagcagagacaatgaagaagaagattaggggtatttatgtcatttgtcatcaaaattgagttgagacagcttggctgacggtagtacagtttatcttttagagtggtattttttagacaatgacggtagtacagtggtacgagtatttttttagaggttttagcctatctggtggtttttcttggaggtgtacagtttttatggtattacttgctaccgcttaaattttggtggtattgatgtatccctcttatcttattttcagtaaaattgagaaatttgcatatgtgccatcgcaaaaaactggtttcgctagaatgctgttgctcaaatgggctacaataaa

SEQ ID NO: 29613 - DNA, 1385 bp, Oryza sativa
agaatattttccctaagggttaaggaaataaggaatatctgcaactctgtaatacagcctgaacagagagagacaaatgtaaaactttcaagaaaaatatcaactctattaaatcctagcaatttttctaacctaaggttaatacaggcatacaacttaatgagaaaggaaaagtttattccaataaaatatcaagtagtgcaaacctagaaaatcatgagcagtgttcaattggtaacctatcaagaactagtacctggatacgctctgctaagacattattcattcctcgttctcgaatggcatgagaaattctttgtacatctgcacaccttactgcttcccaatcaacagaatctcttcggtcaaaaattctttctttcatctgataattaccacaagcctgtcttcgcaatttatcccagtcaaaattctcactgttctttttacttgtggttcttgatttctttggttttgatgcctgtgctgctgtatctggcaatccattgaaggaagcaaaaccagattttaaggttgaatcatctgctttggttgctgtttctggtatcactccaccagtggcatacagtgattcatggtcctgaaactctgatgcttcataacaactccttttgccacaatgtaataatttgactgcatgggcatccagtttttgtcaagcagctaacatataaataataagagaccttttacagtgtttgcgaggtacttagaggtattgagaagtgaaacaatgtgaaccattgattgaaagaggggcaagtatggaataaaattatcataactaatagtaatagagtaattaactactaaaagatgagcattttgattgaatcgaatacctgggtccaatcaccagaattgttaggtagaaaacaaagtaaatctttcgaacaatttaatgcatcgatcgatctgcagttctgcaccagaaaaaaagagattgacgcctcctttgttcgaccccttggctttgttcttgttctaaggtttgaattggtccactagaaggagacaaagggagaaatatcggcacggttgagggttcaagatgggccggctaggcgcaagcgcatcgggttagatctcctctgctcctatactatttacacaagggaccacctatacatttgtcgataaattttcttctaaaaatttgacagatgtaattataatacaatcgtagtgtaattacactgtaacttgtatgtaattacactgtaacttgcatataactgtagtgtaacttgtatctaagtttcacgtaattttgaatcgttagatctattacaagattttgttctggtgaggaagaaaaaaatcatagcacacacatatgtgaaaggatttgttcacacgacctc

SEQ ID NO: 29614 - DNA, 720 bp, Oryza sativa
  unsure (1)..(720): unsure at all n locations
atgatgaatttgaacttgcaacngttgattggcacatttcgttcatcacaaaaaaggaaggagaggaggggagtttgagataaggaaagagataagatgtttgagaggaaaaaaagagatagagggaggagtttgttgtgtggacgggaaaagaggatcggtactatggattatatagtgtgttttgatttttattcccggttagtaacaccaacctggcgtaaaaagacgttcacaatatcgcttggtttgacccatgactactagggggcaccaatataccgactgaccctggactgtgtagtttcaagtgttatgtaatcacctctggatgagagcactagttaactatttaaggtaacacctctcttgttatcttgactacatcttaactgaaaataggaagaaatctcttcttttaatcaagggtgtaaaacattatccgaccacatgatgagatatgcttctacatatatatgttagcacttctacacctaagagtgacccttattgattggcatgaacctttacccgattctttaaagaaagacattgccaccctaaataggactactgacatttaattgcctgcttttttgcacccttcctcacttttacatagctcaccatccgaaataaattcagaattttgcctaggcataaagcgatatttcctttttttttttaacaagagtctctctttattttaataaaatgttn

SEQ ID NO: 29615 - DNA, 23277 bp, Oryza sativa
  unsure (1)..(23277): unsure at all n locations
ccaccacggctcaaccaccagtcgacccaaaaacttaaaaaaaagggggcccttttgtgggaaaacccccggaaaagaaaggaaaaaaaaaaaantttaatccgaatagttgaaaatgataacaatatttgatcacgttgtaaagttatacataaggacttaccttgtttatccaaaagcttaaactgacgaggaaaaatgcaattgtgattgtaatcatggaatgtgtggatgacatggcatggcaggtttcttgacaaggcggccgtagtggagcacgacggcggcgaggagcggcgcggggcgtggcggttggcgacggtgacgcaggtggaggagacgaagctggtgctggcgatggtgcccatctgggtggcgacgctgccgttcggcatcacggcggcgcaggtgtccaccttcttcatcaagcagggcagcgtgatggaccgccgcatgggcccgcacttcacgctgccgccggcgtccaccttcgccatggccgccatcggcatgatcgtcgccgtggccgtgtacgacaaggtcctggagccgtacctgcgccgcctgaccggcggcgagcgcgggctcagcatcctgaagcgcatcggcgtcggcatcgcgttcaccatcgtggccatggcggtggcggcgacagtggagaggcagcgcctccgcagcgcctcgccggcgtccatgtcggtgttctggctggtgccgcagttcttgctgatgggcatcggcgacgggttcgcgctggtcggtctccaagaatacttctacgaccaggtgccggacagcatgcgcagcctcggcatcggcctctacctcagcgtcatcggcgccggcagcttcctgagcagccagctgatcacggcggtggaccgcgtcacctcgcacggcggcgccgccgccggctggttcggcaaggacctgaacagcagcaggctggacctcttctactggcttctcgcctgcatcggcgtcgccaacctcgtcttctacgtggtcatcgccaccaggtactcgtacaagaccgtcatggccggcggcaaggtcgtcgacgacaaggccggcgacatcgagtgcgccgccgccgcagctgctgctgcctactgatcaatatcaagcagtagctgatcgattagctagctagctagaaaatcatggtaagaaagaaaatggcatcatcatgtattatgatctgctttcgtggtacgtgacaacaacaaaaaaattgtaaggattatgtcgttcgtccatgtatatgcttaatctgcttgtgattgccatctgatcgtgtgatctactgctactgctgatgttgccaagtcctgaactgattcagtgtagcagtgattagtaagttacgcgtgtgcttagtgcaagaggcgaagtgctgagtagatggattacgtgcacttggagttaagagtgcgagattgagatggcccgaaagcctgcttaattcggacccatgggcggagccactacgattcctgcgtattccgaggaatatacttcagtatacgcacatgtacacatattagttagccaagtactcttcctaactgagatgcgtatagatgaaaggtttagaaaagtgaaaaatcttcttaatctttccattatgattgttgaaacaaagttgcacaatagacatgagattgtttacaagcttctcaaattggttatagtactttcagtagtaacagctagtgttcaaataatcttttatgccatgaataatgtgaagaataaattgataaacaggctgggggatcaatacttaaatcattgcttggtcacatttattgagtgtgagatgtttttgaaagtcaaggactgtgatattataaaccgctttcaagctatgaaggaaccaaaatagaaaattagaggtaccatgtaatatttgtagttttatttcttcgattatcggtattgacatactgtgaaccattgatttttttttactatgaactttttttttgttaaacgggaatacccaacttcgaaatcctggctccgccacttcggaccgagtttgcagccttgcgctgtgaggaaaaagtccaatgtatgtccctctaatgattgagtttcgatcacgtccctcaatcacagaaacaggtacaacgcattcctagtcttccaaaagccagtgcaaatatagtccaaaggcagcactgaggtcgtttttagctgacgtggtgcagtggtgcttatgtagcgtattgactaggttttcgtcttacaagacatctacgtaacacttacattcaagaacaaaaaaattttaggacctatgtggggccaacatgttaggggttcttcttcctccaaaacctcccttctttcctctcttccccatctctctccacctctatcctctcttcctaccttgtcggtagggtggtggcaagtagaggccgagatgatggcccaacacaggtagacaagatggtcacatacaatgagatggctaccatcactatcgagtgtcgcctgccttagttattatgacgtaccactttcattcatttcagcgagtcgcgtgtattagatcgattcaatcggtttctagtgcatatcgagatgacatggcatccatggagatggatattacaatgatacgacaagaagagcaagtcacaccgccctggtgtgatactgtggctttatggatgactacgagcaaatggaggacgatgaaccaccctcaccgtgagtcaacaagcccgggtttttttttccttatgccactgccggagcagaaggtgtccgtagcatatcatgcgtagctttggcgtacgaatgcccgaataaacaacaagtatgggtctcgtcggcccaatgaaaagaggaggaagaagaagaagtccaagcattatgtgtcgccgttgtcgtcttcaccatagtcgaggtcgccttcgccagcctacgagatactccctccgtactcgtaaaggaagtcgtttaggataatgtttaagtcaaaccttaggaatataaatcatgaataactctcaggttgttgagtttgaaaatataaaaattatataaatagatttgtcttgaaaaatactttcataaaagtatacatatatcacttttcaataaatatttttatagaaacaagaagtcaaagttttgtttttagagaccgtgtcgctatccaaaacgacttcctttatgagtatggagggagtatctccaaccctcgaacccaacgacccatactagataccaagaagaggggggagaggtagagatagatggggaagagaggagacagggtgaggttggaggaagaagaaccgctgacatgtcggctctacatgagccccatcgggtttttttattaatgtaagtgtcttgtgggatgaagacctaatcactacacaacgtgagagccacattacctagtccctacacaacgtcagtaaaaaccggcttcagtactatctcaggattacattttcactgattttagaagatacagatgtgttgtagccaattttatggttgagcgacaggataaaatggccgttaattagatagagacgtaaaagtagacttttcctgcgcatcaacggctgaaacagcccaaagagtagttacggtgctttggttgggttggactcgctgagtcctggtattgggccatcaagtcgcaatggggaataagttcagtttagacccctcactgttgtccagtctaaaattgataccgaaatggatacaacgtgtccatcaactcccaaaaccaccccaaataagatcacaagatggtttggatgacgatttcaactgatgtggcacctacatgaatggtttgattatcgccatgtcacgccacgccaagtgcagtgcgggtaatagttaagggagtcgaaagcccaataaaaagttggattttggcccaatagtaacaacaggttggatttaggcccattgtgtatgtaagctacagtaataagtactccctcaccaaactgcgtgacgtgttcaagatacagtctctcagttgacccgtgaccgtatgctcaccaaacttttttcttaaaaaaatcgccctgttctgtaagactgtaacggcgagttctgtttttttaaataaagaaaaaactgccgaccagcttggctaggctcgttactagaatcaaaatattgcattataatactcgtattctgaatctgagaatacacagccgtgctacacgtttgtcttaaggacgtgtcattaaaattctgattcgattcctcgtgtgtttggtttggataggtcatatgttaagaaaaaagaaaggctttattaccatgtgggacacatgtcgcagttgttttaaaacggttgggagttttggcttcggactggctttcacacggccgtgaatggacaccaccaaccaaacgatgccgcggaatattccttgcaacgattttcatcagggtcaagtcaattaaatttgtttatcatctgggaaaagtaagctaaagcgaagcaagagcaaaggagattactgctaatttttctgctctcttcatccaaatatatactccaacagtctagaacatatttagtagagctctgacttctaaatttgactccaagagttatgagtagagttgtagagccgccgaaaaccgtcgaaactaagctctatctctttagttcattagagtgttccactcagtttcacttctattttagatggaactaaaactctgtttgactaaagctgtagatgtgccaaacagacccttaaaataagattagatccatttaagaactacgaatataaaaataggatttgaaattagcctatttccatattcatagttctaagctagtccaatcaactactttctctgttttataatataaaatttttattaacgtctatataaatgtatgtgagtacgaagagcgtatattgctatatattgagaacgaaaggagcattacaaattgcactatttttgtagaaaagaaataaactaatctccgcaccaagacaaaagggagggagcaaccagcctcgctggaacggtagcgtccttatcctcctcctgctattgattattttgcgttcccccgtcgccgcggtcccattccgacctgttatcgcgtacggataccggccaccactcgcggatcttctatggcatcttcacttcaagagtatcatgtgcaatctttttcgattaaacagaagaggcacaaccgcacacatcaaatgcacatccacaagtatgacctcaacatgataagatcaaatataaacaaagaccaatagtatatatccttaatcccactaaatttctattaaaaacacatttaatgtgtaatattcgtgagtatagatttaaaatctagcgagtgagagttatgcacccaccattgcaccagtgcaccaccgatgtttcctcaatattatgtacatattggtgaagtgaagaaagtggcggacctaacaaccaagaccttacttttgtgttatactcatgatagtaattcttttaactaaccataacacttttacgatatagacaaatgcaaagcatgattaacgaagggtcgataataatggtgaaactgcattacatctggtagccttatgctcatgatagtattttttaagccaaccatagtgctctagcatctatagagtagtagagtccaatgtaattcgttgctatattgcttagacaatagaggtaacaccatgtacgaacaagattactatatcctgacactagcatatcacaattctttagatccaccactcccgataccggtaaatcataatttctgggatccacgactagttggtattaccttcatcctaaaataaaagagattttggttggatgtgatacctctagtactcgtgatactaggatgtgtcctgtacatccaaatttttttatatttaggatagaagaagtaagcagcgttaatagtaccaactacattagtaatatcacataaagtttcagtcatatggtgggttagtgatactattatccattgatttttataatagataagtatattataaactgtaagtagtagcacggtatataaatagatggtactggtacgagattaggtgctactaataagagtgtgttcttcgcagagcacagcacgggtggttttgtggtgtactatggccggcacagagaatcccagatggcattgcaggctggaacacctccgagtgggagtggcccatgaaaggtagtgcttcgtcgatcttatctccggtgactcatttccgcatgtgaagtggcgcgacgctccagcttatcaattgtatttcggatgtgttttttcacataacccctcctgttattcagtttctgctctgcacttccctaatatagaaattgaaaattaaggcccaagtttgcttcaagtttgtatcgtagacacacttccaactttccaagacattttacacaagagaattagagatgatattgatctaagcttgcaagaacatttactagtttgatttggaatatgtcggcatctttcatttaccaaaacaaggttgtgttcgccagtgtgagttcctaactccacattcttcattttctgtgtgcacgtttttcaaattgctaaatgatatactttttttaaaaaaaactatacgaaaattactttaaaaatcatattaatctatttttttaaaaaaaataatactaaattaatcatgcgctaataagtcgtttcgttttgtacgcaaggaattagagcatgtttaatagtatatcgaacgactaacttcaaatcatctatagtcaatttagtagccaatttatacaatagatacctataaacatatacaacactagtaatatctggtcctacctgtcaaacacacattatattttataatctaggtacaaatttatagcccgctgctcttctctcttcttatttatctactcgatatgtgttaatagttggcttatagtatgctgttgtactggctcttaggtcccatctgaagctactgaacacaacctaagtgtgatctaagcttgcataaacatttaccagtttgctttggaatatgttagcacctttcatttaccaacacaactaagtgtaatcggggtcatcgttttcttctaggatattgggttgtacataactttgtatttcaatgtacgtaagagagaaaaaatccattaagtagttttatgtgctatgcatatctttgtattttcctctggataactaagggctcaaattatgaacatgaattatttgtgtcctattttcggaaacttcatgtagctaatttttttcttaaaaaaatatagttttaaaatctagtaaactaggagttggttcagattctcatcagaaatttttagaatcaagctcatggagccttcatactccacaattttggggaaatgtagtggtcacacaaaaaaaaagagaaatatggcgataagaatctcctaattctatcacaatataagggcccctttagaagttgtacacttatcatcacaccacacacccctatctatcgtcaacttggtggtttctcagtgggcaggggagcagaggggcacacagtttagattttgtccctataagagcagacttctattagccgcgtacagatagatagacacaacagcaacaacaacaagcgaattcttcttgcagatagggaaaaaaaaacgaaagcgagagatgaggagcagctcggctctgttcttggcctttgttcttctcgccgtcttcctcgcggcgctccccttcgccgaatccagcggcaggcaccaccaccaccaccactcccatctccatggcagaggtacgagcaaaagcagaggaatcgaaagatatttgctttcttggagcgacttcttgcttgggtcaggagctaaattgaaggagaaatatttgggcttcttttcaggggaaggcgagagaggaggagaagcacggtcgctggcggcgaagggggcggcggcggcgtggccgtgctgcgacaactgcggcgggtgcaccaagtcgatcccgccgcagtgccagtgcatggacgcgaggccggcggggtgccacccggcgtgcaagagctgcgtcaagtccagcctcagcgtctccccgccggtctaccagtgcatggaccgcatccccaacctctgccagcgccgctgcaccgccgccgcccgctgacctcccccgccgcccatctgacccgacccaccggccaccgccaccgaccggccttacttaattaagagtggtttttgtttgtccctttttttttttggaaaagctgaagaagtgaagaagcagtagtacctactgtactggaggtgattggagggagcagctggtttcaggtttatgtgctggaatcagcctccagttttcatctcctcgctctgctaactacggagtaattgtgtagagattactcgccgagctatatgtacaaacggcctgtgtgatgagacgaaattgtaatggtaaattttttttcaccttcatatgttggatatgagtgaaattgttgctagcgaaatgatgatggatgcgtgcttggttcatattttccgttgctgtttgtctggctctgatgctttctctcctcttctgtattaatctcaattggattacaaggatgcctgtaaaagcttatgacatgctgttggttgattttgtctacttatgtcgataagggttaggagaggacgccaaaccctaaatctaattgcccgatcaagtgcgcactgtaaggagtacgtgaggttctctgctgtttcttttcatcaacaggaaatcagaacgagaaaagcaaatgaacaaaagacaaaactagaagaatcattgatggcttcaaacataggtcggtagattgattttataattaggagaggtgattgtttataggctaaagcttaagatcttgtaatctagaactctaacatgatgagggtaatacagcatgaacctggacgcgatccggcatgctgttccggggtgtatgaacctggacacgattggggacgaacggtcggtgaaatttgggaactgcacatcagaaggcttgtgttgctgtcaaccgaattaatcaggacgattgccatgaacaacatccacgatagtgagcttgcactttgcttagtggaggacggtctgggcctctggggattcgcatttccacaaggatatgcgttgccatgattttcactaggccgcttgtttaggcacgaaaggatgggaaagtgaggaatatgctcggcaagaagccaagaaccaatctccaatagtgcaaatttggggtgactttacatgtttgaattcaacattgcagtcgcgcaagtttgcaataccactatctgaatccgtggtccaaatctgaagagacctgcagtctgcacggtctctagagcaacattgccagtactaaagaagaaagagttccactaaattgctcatgtggtgatgttttggacttagctaaaaatatgtcgacaattttttgggctgatctcagtcggcttctctgtgcgtccgattgctctgcacgagttttcggttgtgcttgccggaccgttcgatttcttctcaaaatcatctcctataaagtaaggactgcatatgcttttgctttttaacttttccaatgtaagatttaaatttacatctcacttacacaccacttacatatgtaattactatgtaattttaagacttacatatgtaattttaaaatttacattgtaaatccattaaatttacatatctaatttagtaacttacaatgtaaatacatgctgactattttttgataaaaaatatggcgctataaatatagctactcccgatgttttttattgattcatcatgtggtggtgtcgtggtgatgttgaacagttgaaggaacagagggagaagaatctgagacaaaggacggcaagagagagacacacgtgctgaaaagaacaggaaaaagagttgtccaggcccaagtgtgcttctctcgtactagagtgaggcccaggaagtagcttacccgtcgcagcctatcaatgtgggcctcttttgtctccaaaccagtagactacggcccatgcaggcccatcttgccgcctaccgaaaagaattttttttatttataattttttttattaaaagttttacaaaaataattttccattttgaaaattgacggaagtagttgcctaccgctctctgggagggcgatttttaagggcggcgaaaatgacgtggcagccggccgttcgctctcgggcgacggccgtcaacgaaatttgcaggcggcccccttgccgccctccgctagggcgattttatactgtgcggggggccgcctgcaaatgggcggcgaggggggcatggaattttgcaggcggcccccttgccgccctccgctagggcgattttgtactgtgcggggggccgcctacaaatgggcggcgagggggcatggaattttgcaggcggcccccttgccgccctgggggagggcgattttttgcctccccctataaagcccagtccctcctctgttaaatttcattatattcactaaaaatccaaaaaaaacgaaagagagagaggggagggcagcagaaggggagcggcgaagccctgctggttcgctcacttcatcacaggtatgctcccatacatcttttgcatttgtactaatatgttatgtttgagtatatatgttgcgttttagttttagttccatatattttagcacatctgtagcacagagcacatatgtgtagatccagagcatagaatataatagtatgaattgagacatagacagtagtgttaattgtaagatgtagttagtttgatctggagaatgtaacgtaattttagaaatttagagaacaatattgtagagaatgtaacttagggcgtagtacagaaatgcaaggttaacgcagttattgttttcatcaggcacaatgtcaagtaaggtcacatttcagatagttcacggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtatcagttgtagtgagtcgtgcaacagaaggttatttttgggaactaatgccgatggacagcactgatgcttggagacggtatgtggaaatggcttttgaacggtcatggcccctcgttatatttgtgttggtacaagagaaagatataaatgtttcaatgcaaaccgaagatgtagagggtcctatcaatgcaggggatgttgttggaccatcgatgcaaaatgaggaaaatcaaccaagggaggagcaggccatgggcatggcggatgagggggagagagtcggtataattgttgatgaaatggagagggaagattcggataatgaggaagcggacgacgacgcatcatccgatgaggaaggtgatgtaatggccactgattgggcaaatgaggacttctctggactttactttttattactactgttaaatacttgtacgaaactgatggtccttgtccagcaggattcgcagccgggatcttcggtactggggcctcttcgtctcacgccggtaggactggtcctactagccagttctacgacgacgacttgcacggtgcacaccaccacgacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcattcatatggtgctagaacaacttatgctcacgacaacacactttcggcgcttcacggtagtgtcagatccagtagcgcgcacagtccacaacagcacacatgaaaagcggcagctcgagttatcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacaccacacacgaaaatggaagcctattcattggtaatacgtaatctagatttaagattatgtagaacattcttcactacaattttacattttggcagcaaaccaaatatgatcaaatgcaattttaccttaccaaatatttggtagtgccaaaacttgcttatattttggcacaaacaaaatatttgtacggtaacaatccaaatatgccctaaaaataataaaattgtattttaccagtcttggagattttaatcttgtataattttcaatataaaaagatttgataactattgatatttattaaaaaatatagagcacactataaaatcgccctcccccagggcggcaagggggccgcctgcaaaattccatgccccctcgccgcccatttgcaggcggccccctgcacagtacaaaatcgccctagcggagggcggcaagggggccgcctgcaaaattccatgccccccctcgccgctcatttgcaggcggccccccgcacagtataaaatcgccctagcggagggcggcaagggggccgcctgcaaatttcgttgacggccgtcgcccgagagcgaacggccggctgccacgtcattttcgcctcgccctcccagagggcggtaggcgactactcccgtcaattttcaaaatggaaaattatttttgtaaaacttttaataaaaaaaattataaataaaaaaaattcctaccgaaaacgggtggaagcgtcggggattagtaccacctcgcggagtcgaggaggtgcgggtgggagagatggctataagtagagagccccgtgcactattgctccatacttacctggacggggtcaacgggcgatcaagaaggctcgtggcctaggccaatggcccacattgcacttggtgggcgcgttagcttaccatctccccaagtgggagagtggacgtcataatttgtggtagagggggtacgcgtccgcgcggcccctgccaactctcttagattaaatttcggtccttgctattgttggttaagtttaagttctttattgcattcgtatgctttcgcgcggcctctaccaattctcttaaattaaattttggttcttgctactgttggttttggttcttgattgcataggctccttgtatcctgaattttcggttttggtccgttgggtttacgagccatgtcaatctcttaaattaaaattttggatttgggtttgcgctggtaagttttgcatctatcattaaacattgttatttttcgaagagaaggtccaaatcaagcagagttcattacaggaaacaaaacaaaacgaacacagcaaccacttcaggaaaactggggaataccagctaaactaggacagcactagaacacacacaaaaaccaacttctcaaacaaccacttaaactacttctggggataccagctaactaggacagcactagaataccaggcaccagctaacgagggcggaaatactcttcatcctttggagaacgtgattggccaggcttcagttaaaggcttggtggtgtttaccttagctgaagcactgctccccgtccgacaaaccagcgataatcataaagggaagacaattggcatgaaaggaaggctgaaggaacaaggtgctcctgggaacttgaatcatcagcgtcgttgctcaatgtcgttggagctttcaacccagaaactggtagaggagcaatcggactcgtggttagaaattcagatggacaagttctcctgtcatcttggaaattcctaaggcgttgtgtagaggcagaagaagcagagctcctggcttgcacggacaaatcatctacttcctccatttcatattataaaactttctagcattgtccacatttatatagatgttaatgaatttagacatatatgtgtaagatgatgccctctaaaagatggcaaacgagaattcaagtacgatgctgccctgatgtttcattgacaaaagaataggatactagtgtctactcctttctgaatcacgacacagcgagtcatgaatttaatacatcagatacccgtaaattttcatggaaaatgctatgcataacaatcaagtttagcctgcatatgttttcttggaaatatatgccagatatagttatctgaagaaaataaaaagtaacaaataaatggcttctctaatgtaagcccaacacaatcaaacccgagaccattaccggtccaacccaacagattacacctgtctaggattgcaacggcctgtaatacaaggtccattacaaaccgccttattttggcagcccaagctagcacaaaacctctcagaagtcagaacacgagatggaaaccgaaaagaactctgcgttgctccacattagtaccacctcgaaagtttgcgtcgattgcctggtgctctttcggtataagtacagaaccccgagatccgttgctccatacttacctggacggggtcaacgggcgatcaggaaggctcgtggcctaggccaatggcccacattgcacttggtgggcgcgttggcttaccatctccccaagtgggagagtggacgtcataatttgtggtggagggggtacgcgttcgcgcggcccttgccaattttcaaaattaaattttggtcctttgctagcgtttgcttgcaattggaaaactaaacagtccctgctttcgttttttgtcgcttcttgaactcactagaagtaataaatttatgaaaaatttgctcaatttttagaaaaattgtggtgtttagattaagttttctaaaaatatgtggtggtttttgtaatgtggatatgaatagattatgaacgattaaagtaattgttttatttctcgcgcgagcacgaggtgaggctcgattcactttcactataatcgcggccatggcggcgaaggttgggttgttcccctcgtcgtcactcaccaccagcccccacgccatcgcggctgcgccgaccaacgctccccgcccacgcggggctcgtggattggcgtctccaggtcgatccgcggcggcgatggacgccttccacgtgtcgtcgcaggccgccgagccgctcctccgcaccaccggcgccgccgccgccgcggcggcggcggcgacggcgacctccaaccccaggctccgcgtgcggaatcctgaccctaatcctccgcgccctaattatagccgtcgtcgcttcttctatcctggggcaaggtgctggtagtggtcgtggtttttgacgacatggaggtggatgtgcaggtgcggacacatgcgcagggcggcgaggcgccctccagcggtggcgccggagatggcgcggccgggaaggagttctcgtggtcgtccatcatccttccgtaagatagctcccctctccatctctttggtcagtgacatttggggataaaatcggacagtgataggtgataagaggaatgcatttctagtttggttctagcttcccaatgttgagggatagcattggcacctaatttcaattcaagggagagagaatgctttttaactgttcagtagatattgcttgtttcatcgtgttgatgagaacaatcatattaaattagggcagactgtacaatgcattgtaagtaagatgcaatataattctgcactgtcttctcttctctgctttaatgctagataagaacatattataattcaggagatgataggtttgcatagtattttgattacatactgaagacaaatgttatagttggatgtaaaccattggtggttattatattaatacggcttggaatatggataaaaaaacaaaagcataaaggggaaattggaaaatatatcaagctttaactacttgtgggtcaatgtttggaacctaggttcttgttccctgcattgggaggactcctttttggttatgacattggcgcaacctctggagcatgcatatctctgcaagttagtccctattttggttggctatgcaatctgttatagttgtcatgtattgattcactctaatggtgtttattcctccagtctgctgaactcagtggaaccacttggttcagcctgtcatctatacagctagggctcgtggtaattttttagatattttcatgcttaccaaactttttgttttcccaatcaagaacactactgtctttaatgtgattttttgtcatccaatttaggcaagcggttcactctatggtgctcttggtggttcgcttcttgcatatcgcgttgccgattttctaggtgattcgaaaaaaaatgtttttcgttttttttccttactgtataatctttagcaagaaaattgactgctagtctactactaccatccttggttcaggaagaagaatagaactggtcacagctgcagctttatatatttctggtgctctggtcactggatttgcacctgattttgtacttctgatcataggccgtctcctctatggtatcggtattggtttggtgagtaactctgaggcaaccttttttctccccaaaatgcaatgccactgttattgaacaagtaaaagtataaattcatgtagatgaatgtcagaggaccaatagttatatatctttttgagttgggtagcacatgaaaactttaagagaggaaactgaactgcataatctgtatacttggactgcaaatgactcattacttccagatttagtaacagtgtagcttgatgaccacattttggtggaattaattataaaataagtggaaaggaaccatgaacgcgtttgatccttccagatatggcaatattgtgaatgcttgtagttgaaatccatcatttgggacaaggtctttccatatgaactttggacattgttgttactcagtgttgcggcagatatctatacctaattaaaaaaatacataaagcttccggtaaaaatttcgtccgtcaaaacccatgtccgagagactcttttatccccgcacaattagcgaagtcctgtttctgttaaccaaattaacaaatttaagttagaagcccaaacacggtcacgccaaaaagaaggcctgacctgggccttgaagaaggcccgacctggtttgtggcgttggggaaaaagatgaggaaaacagcctaagccagctggtaaaaccatggaaaaaatttgtatataccaaaaataatgaacaccacgtataagtggaagagatatagaaaataataccatctaacataaattattacaataatgggataattttactaatcagacccaataaatttaaccaaacattatcaacacagacatcaaataatctttacacgcatatttctcggtggtctcagctcgggttgggggaggaagaattactaataaaagatacacaaggattccgcatatttcttttcgtacgctgtccataccaatccactgcacacgaatgatggccagccggcgagcttccgagcttcccctgacctttttatcccaagttttgtgaatcactccgattttgagggaaacggaaagaaaatatcgtgtgggtaaaaaaacctcaactaattttgggagatcgagaaagatttggccggatttgatatgatgatcagcttcggtattgtatagatatgggactgtctcccggaggttgaagatgctactaaagcgcgtgggtttggcttggcaacgagagaagatatatgactatgctatctgagcctgtggctccatttgtgggctgggtcgaagagagccgagccgagcagagatatatagaggcagcagactgagctggggcttataaggaaggaatgattttagtgaaccttttgcattataatgtatagtgatttcaatattttaatttattgttcaacttctaatagatgttgtataaaaaaacgcttttacccgttgcaacgcacgggcattttttctagttaatactacaaacagtatatttgtttactgccaactaaaaaaatccgcaaatatctaaactgccgatgctttgttagaaaggtgttaataataactgaagaggaacataaatgcaaatgaacatattcatatcaaactaaaggtttggagataatgaatcattgttgtgtccatgtatattacatcatggggttatgttacatcactgaatcaccatgctttgtgccaagcgacgcacggtgcacctctttatattgcagagacttgtccttcgcgaatacgtgggacattgatatctttaaaggagttgtttattgtattaggaatactggtatatctctcttccaactgctacacacttttaagtatacccatctatcccctgctgactactccctctgtccccctcccccccccccccccccaaaaaaaaaaaaaaaactactgggtttgaatctggacatagcctatgtccagattcaagacccagaagtgggttttcttctaggacggagggtgtacttgactagttgactattaatacaatattttgcagactggataccttgtagggagtcttgaaattgatgtggtaggaggatggcgttatatgtttggttttggtgctccactggcagtaataatggctattggtatgtggaatttaccgccttcaccaagatggcttcttctcagggcagttcaaggaaaggcgtcagtggaagataacaaaaagaaggcaattcaggcattgagatcactgagggggcgctttaggagtgacagggtcttagcagatgagattgatgatacccttctctctattaaggctgcttatgcagaacaagaatctgaagggaacatttggaagatgtttgagggagctagcttgaaggcactcatcattggaggaggactggttctcttccagcaggttttgtcctcatcagcccacttggaagcaacacatctaaatatgaaatctgaccgtgctttgatcatccttttaaatttgaaattatgtgccctaagttcagtgaaagttattatgtccaagttgaggtagaaaaagaagaaagataatgacctgtctattcatttcatcctgctttggtcatttcttgattttttaatagttgactaatgttacttctttgttatatggaactaaagcactgatattaattaaactattatttcagataacaggccagccaagtgttctatactatgcaacttccattcttcaggtacctctgagtttcttttcatacaaggacagacagaataagacttagttctccatatggctgtgtgccctgatacatacaattaaatccattctatcttcaacagactgctgggtttgcagctgcatctgatgctgccaaagtatcaattttgattgggttgttcaaggtaattctatgaagctaaattatttttataatctagtatatatatagggagaattagatatctattttgttatccagatggtaggtggaaaggtatagagcttacacttttttttgaacctctgtgtaatatttctattatttgcagttgttgatgacaggtgttgcagtatttaaagttgacgatcttggaaggcgtccactacttataggaggcattggtggaatagtgagtaattcttacagacttgtttaagttctatggatgcatggaaagtgtcattttcatcaccttggcacctccccagttatttgtactcattgatagtcttgcttgatgtggatactaagaaactggatgcttaaccaagttttgatcaaacatgttctgaataaattatgcttatgctttctattccctggaaatgcaggctgtttcactgttcttattagcagcttactacaagattctgaacagcttcccttttgtcgctgttggtgctttacttctgtatgtcggttcttaccaggtcggtgcctttactttctgtagaaacggtctatgactagtgcaagaaatttatgttgtccttgtgtttgcaggtatcgtttggtccaataagttggctaatggtttctgagatcttcccactccgaacaagaggacgtgggatcagccttgcagtacttacaaatttcggctcaaatgcactggtgacatttgccttttcacccttgcaggtacgttcacccagattgttgtcacctcacatatatatttatctcatgatgtttccccctccaaagccagcgtttttttagcccttcccatttaaactaaaaaataagtttaaaaaaatcagcctcttcttctatctagaatcaacactacgtattttaccagtttctcccccaaaaaatagatgaacaaactaaactcttttgccggcaatgcacgccttgtttggtgcaggaattccttggaccagccaatattttccttctatttggagccatatcgttgctctcccttgtgtttgtcatcctaaaagttccagagactaaaggacttacattggaggagatcgaatccaagctcctgaagtaagctcactggtactcaagttgtatgtgtgtgtgtgttttttttgagggcaagttgctatgtgttcattagatgaggttgatacgtgtcggtgtaaatttgttcagtcgatttatgtgattaatatagtcgtacatgtagtattttgtacatgtaaattcttgtttggactaaaaatattctagagaaatccaaaaaagctgttcttgaagtgctattttttttggtcaacactggactggtgctatttttttttttgccagtgtaacacagttaattaaattattactagcgagacttaatgtggtactccgtagcagaagagtacgcgtatgaagtatgaactaactcaacatcgctgtaaatggggacatgaagttggaacctgtcgctcaggaaacgttaatgtctatcgctataaacccattaagcatttgcctctagactaacttaacattggtggaccaagcttatatcacgatcaacgaatttaataatcaaacaaaaatgctgaaaatataacatcttttgcccatattagaattgaactcagctgtagaatttttgacgtttgttacgtgacaagacgatttgcctgacgtgcttggtatggcgccctggttgtaatattattgtttatgaagttctttccttcggtccttttagctcaatacggtgtttcttttttatttctcttccttgatcatgaagcctaactcaatcgtctaaccaatcagtgattattcccaaaacaagagttgagctttcatggttcactgatgctttgccatcatgatggtaacatcatggcaagcaagaatccaatcattctagagggcagtagacgagctgcaacatcaaacgactgaccaaatgcagcaagccgaacaaaattgccctgctcacacaatggtagaagaaccactcattcagaatccaatcaaagcttggcctgttggaacgatggcatgaaaaatgcaaccctccgatgcgaacgtggccgttacttaggctgaagggcacacgtgtaaaatgttttttctcccacagtgaaatttgttcatagtgtagcttttttttttaatttaagcaactttattagagaaagacagagttaaggagctaaaccctagtacatcgcagaaggatataacacaaacaaagagaccatctctaataaggtagaggctaaccaatctaagaaagcaaacttccagatgaaactaaatagcagtagaggaccagatcgacggagctcagcagccgctacgaccggatccttaggcctccgtagacatgcaccctgcttgatagactggattaaacaaatcttataacttgtcattctctgatttttaagggatttgaggagcatcacattttgtaggttcacatgtcagcgatccacgtcaattttttctgacgtggcaagctaggcctgacgagtgcttgcacacttgcaagactcgagtcatgccgtcgtcttcttctctgcaggacagccaaatctgaaactctgagaccagcaacgaggttgtttagactgaccgatcgatcgacgggagctttgggttccctgcaggaaggacaggaccggtgcaaccaccgggataaattccgtcttctgcaactctgccgttctcaactccgcacgcgttccttgaccagccatggctgcttcttcgctgtcgccgcaatgggcctcacgtgtacctgtccatcatcgatctatcagttcactacccccatttccttcatgatttcatctctccccgtgaataatccgtgatccgatcagcttccaacgccccggatttgatcctgtgtgcaggagatatactctttaaaaatactaggtatagtagattcatttactttcagaaacttcagatttcttggggtaaaaaaagaacaccacagatccagtaggcgagtcatgcgagcacgtaaagtagagaattatcccaaggatcccagcgttgcacgttggcacatgtgaagaatccatgctttccaggcatgaaaatctcgcgaatcaaacaaaacaaatcattttcaggacgtgaaattctttaaaacattcgcgtttagcagaagatacgatcacatagtggagatggacttcgtctagttaggtggtgacaatgatatcactggtagagaaaccatctttggtcggtcgacccatatccacaatagtcccggttccattaaaaaccgggactaaaaatgatttttagtcctggttaataagaggaagatctttagtcccggttgttgttaccaaccgggactaaaaatcatctttactcccggttggtaactccaaccgggacaaaagttcatttttagtcccggttgattccatgtcaggctgtgtcagggccctatgatctttagtctcggttagtaacaccaaccgggtgatgaactactgtaccatatggtaggtgatttnnttncca

SEQ ID NO: 29616 - DNA, 9564 bp, Oryza sativa
  unsure (1)..(9564): unsure at all n locations
cgcgccaggtagatctgcctcctactgcaagtccttcatcatgagatgtgaatctgtgatgaatttttagaaccctgtgatgtaatttttttaagagtttgtgatgtatttggagatgatttgtttgaggatttggagatgttctgtaatatgtgatgatttggatatgagaggggatggtgtgaaatcaatattcaatattaaaagcagaaaaaaaaagaaaaaatatctttagtcccggttggtgttatcaaccggaactaaagattctcccatctttagtcccggttggtaacatcaaccgggactaaagattgatttttagtcccggttatttgaaccgggactaaagatagtcccggattcgtagtcccggttggaaaaccgggactaaaaagcatttctccactagtgtatggatgcattcaagaacaagaggaggtgaaacgtgaaatgcattatatccccatcagctcctggctcatttggatatctaccactaaccggcaagaattgccatgaaaatcaccgggactccaggagactgcagcctcgaggttccgacagttatagcttctgtaagaatctttagagaagtcagattaaaaagttctaaaaaaagtcagataaaaaaataatcttaactgaagtcaaacagtttagaattttatctaagaatatatagttatagaattaaaaaagtgggagccctattggttgccctaataaaccaaagtaaaagctaaaatttttattttaaaaaataattttgatgttgattttaatatatgttcaacgtagttttctatattaatttttgagtgaagtacatgggcggtccctaaacttgtgccagtgtgtcatctagatctctgaactcctaaaatgcatttttagatccctgaacttgctatgtgtgttatataggtccaaacaggttctaacccactcgatgtgctgacgtggcaatgccacggtgacgcctacgtgtcagtggaatccacatgtcaagcatatataaaaaataaaattaaaaaccatattttctcctattaggtagacagaaaaaaagataaaaattttaaggtagagagaggagaaaatatatttttctaattatattttttttctatgtgactgatacgtgggtccaactaacacgtatgaactatcgtggcatgccacatcagcgcatggaaggggttggagctcgtttggacttgtatgacaccccaaaacaagttcaaggatccgaaaatgcattttgagagtttagggacctagatgacacacccacacaagtttagagaccgctcgtgcacttcactcttgatttttaaatcactaagaacatatatataaaagttttacctataaattaatttttatactcttttactagtaataagttaatgtgggcaaaggacatgaaatagaatagtccgtagatattgacgggtgacacgggcttatttattacagcgttcttgctccatctctgtgtctacgtttgggtacgtgtagccactagccatggacgatcgatatatcacttggacagtgaggcatggcactgtttgcacacgctgcgcacgtgccagcgtactcgactgccggtggtcggcgtctacgaaacgacgcaaacaggacacccaagtggtcctcgccgtagacgaaacccagcaaacgtttttttttcctttcctccgtacctgagttaatttttctcttctttttactttttaatttttataactagtactagtttattgcccactgtttgcttgcagctctgtactctatccgtcctgaaatgaacctggacattcattcgtccagattcaaaccctagaaattatctgtttttttcgatggagggggtaggtgacaactagctaggataggttgaggataggcctggcttagagcaaatttaatagtatagccaactactagctctaattcatctatagccaatctaatagctcatatatacaatagttacatattacactattaatacctggtcccacctgtcatacacacaatgcgtcttggagtccgtgctacagctggctacaaatctgtagctcgctgctcttctctctcattatttatctccttaaaatatgtttgtagctggcttatagcctgctattgtacctgctcttagggcgtttacaatgcatctttggaatttttttagtttctaatttttttttccaaaaatgtcacatgtaaaatctttgacacatgcatggcgtattaaatatagataaaaataaaaactaattgcacaatttgcatgaaaatcgcgagacgaatcttttgagcataattagtccatgattagccataaaatgctacaggaactcacatgtgctaatggcggcttaattagacacaaaagattcgtctcgcgattttcaagcgagttatgaaattaattttttcattcgagtccgaaaaccctttccgatatccggtcaaatatccgatgtgacacccaaaaaatttctttttgtgaaagacccttatgctctctcattttttgcaagcacatttttaaattgataaatgatgttctcttctaaagataagataattactttataaaatcatattaatatatttatttagttttttaagctaatatttaattaatcatacactaatctgttgctttgtttcacatggtaggaagaaggttctcaacagtcaaccccttttaaaaaaacacacccaagtactccagcacatacacttcacattctaaaaaatatatctaatacgatattgaaatttatagtactcctattaagatgtattatactcgctctatctcataagggcttttgcctggatgtgaacaatgaatctggacggtttttctgtccaactgtctagattcattgtattatctattcagattcattgtactagaatgtgtcacattcaatccaaaatcattatatttagagatagaggaagtactacctctatcccaaaatatactccctccgtttcaggttataagtcgtttgactttggttaaagttgaactattttaagttcgaccaaatttatacacaaatatagtaatatttacattactaaattagttttattaaattgataattaaatatatttttataataaaattatcttgggtcgaaaatattactattttttctataaatttggtcaaactgaagcagtttgactttgaccaaagtcaaaacgacttataacctgaaacgaagagagtagctatttctagcacaacatcttatcccaaaatgaaactatttcttcatctacctcctctcaaccaatcacaaccattctctttcacctaatttatcttttcaatcaatcacacaatttcttcaatcattcttacttacttccttaatacccgtgccaaccttaaaattatttatattttggatggaggaaatattctcttcgtcccattttaagtgcaactataagtttttgtgcccaactttaatcaactatcttatttaaaaattttctataattagtatttttattgttgtgagatgataaaatatggacagtactttactactttatatgtgacttatgtcttttaaatttttcaaaaaaatttcaaataaaactgacggtcaaaattgtacacgaaaaatcatggctgcaattaaaataagggagtatcttatattagatttgtctatttgaaaacaaaaaagatcacgaatagtatgcgaagccccgatcgatctcaattggctgtccttgttctgtctgcttctcatttctgaagggaaggaaaagaaaaaacaagtggaaaaggggcccagagtgtgcacgcactccctgcaggctctagcacaagcttagctagcaacgtgaaatctttgtaggcagttgaagcttatatgtgctgagctcctaccctccaatgccgtccatctccatgtccctctcgccgacgtcgccgtgcacctcgcatcgtcgccgtcaccgtcgccgacgaccagaccagcaacagtgccagcgacggcggctgctgcccaactccaacaactaaactgttcaactccttcagctactacttcacttgggttaatttgtacattgctctctgccatggcggcgccggcagccgttcttgccgtgctccggtggcggcagcggcggtggctggttgagctggtcgctctcctgcttcttcttgctcgaggtggcgctgccgcggttgaccaattcttgtttcccggcttctccggcgacggcgtggccaccagcggcgcggccgccgtcacctccaccggtctactgcagctcaccaacgagacgaaggaggtgttcggccatggcttctaccccaagccggtcagcttgagaaacgcctccaccggcgcggcggcctccttctccaccaccttcgtgttcgccatcgtgcccaagtatcccgacgcgcatggccacggcctcgccttcgcgctggcgccgtcggtggccgtccccggcgccgtcgccggcaagtacctggggctcttcaacacgtccgacagcacgggccagatcaagaacaagatcgtcgccgtcgagctcgacacggcgcgggacgacgagttcgccgacatcgacgacaaccacgtcggcatcgacgacaacagcctgaaatccgtgaactccagcccggcggggtaccacgacgccgccaccggcggcaagctcgccagcgtcaacctgatcggcggcgagcccctgcaggtgtggatcgagtacgacggcgacagcgcgtggctcgaggtgacggtgtcgccggccggcatgctcaggccggccgccccgctggtgtcttgcaccgtcaacctgtcgtccgccgtggccggcgacacgtacgtcgggttctcggcggcgaacggcgccgccgcgagctcgcactacgtcctcggctggagcttccgcctcggcggcggcggccgcgcgcaggacctcgacctcgccaagctcccgcggctcccgtcgccgagcaaacccaagaagacgttgccgccgctgatcatcttgacaattctcctcctctccgtcgtgatcctgctcctggcggcggcggccgtggcggcgctcgtggtgcgaagccggcggtacgccgaggaagaggaggaatgggagatcgagtacgggccacacaggatcagctacaaggacctccacggcgcgaccaaggggttccgcgacgtcatcggcgccggcggcttcggcagcgtgtaccacggcgtgctgccgaggtccggcgtggaggtcgccgtgaagaaggtgtcgcacgactcgcggcaggggctgcgggagttcgtgtcggagatcgccagcatgagccggctgcgccaccgcaacctggtgcagctgctcggctactgccggcgccgcggcgagctggtgctcgtctacgactacatggcgaacggcagcctcgacaagcacctgttcgccggcggcgagcggccggcgctgagctgggagaagcgcggcaagatcgtccgggacgtcgccgccgggctgctgtacctgcacgaggggtgggagcaggtggtggtgcaccgtgacatcaaggccagcaacgtgctcctcgacgccgacatgaacggcaagctcagcgacttcggcctcgcccggctctacgaccacggcgctaacccgcagacgacgcgcatcgtcggcacgctcggctacctcgcgccggagctgagcaagaccggcaaggccaccacgagcaccgacgtcttcgccttcggcgccttcttgctcgaggtggcgtgcggccggaggcccatggagttcaccgtcgacgacgactcgccggggctcgtcgagctcgtcctcgagcactggaaggccggcgagatcacggcggcgagggaccccaggatcggcgactgtgacgaggacgatctcgaggtcgtcctcaagctcgggcttctctgctcgcaccctgacccgcgccgccggccgagcatgaggcaggtggtgcagatcttggaaggcgccgcgccggcgccggagacgttgccggaggacctagaatgcggcgtggggcagttctacgacgagtcattcgacgagttcgtcaccggcttcccgtccacgtcggagatcaccacgtcgacgacgcagtccaccgacgagcagcagcggctggttggctgtgttcagttgagcactgccgattttctgaagacaacttaaaatgtaaaaatgtcagtgagcaaatacttgcagcattaggtgattgtttgggctttggatcttctggagttagtaacatagggatactgtcaatcattttcagatatgatcatatagaggttttgatcaaagattagtacagcattcagcttagaagttaccttgttgcagtttcagaagaatgtacacctgcaagaaggcaagaaccgtgtaagaaattttgcaagggaagaaaaaaaaatatggatcccctttttttttttgtagctgcatctttcttggggcagtttgctgttgagccagatcagaatattagccaatagactgatcactgatgtcgattctgtcatgcagaaaacatgcgatatataatatgacatattggcaccttgctcaaaaggaaccaaagatattgcagcctgcttctcatcatgggaaaaagacaatgaaaacctaaaaaaatgctgtcctaatgttctgcttttacaacaaaagatgaacatgacaaatattagcaaggtatcaaacaaaaagatgacaacaaatggagacagttcaggccatggttctagggattcttctgattcatacgagaactgaacgggctttcttgtgttccaaacagaggacattagattggttgccgaggaaaaaagaactacttgcaaaatgttgacaactgacaagcaatgccagattgtgtccatggctccatgcaacattagtttacatcctatccaagctaaaactagcatccctactacccaatcgtaatgactccacctataagcacaggtgacggctctcttcctcagagttattcatcatcctcctgagttccccgagaagcaccttggatcattttgtcatcaactcctgcgattaagttcagagcttttaatatcaaatttcaacattaacataagataaactggaagcaaggtaatgtataaggatttaccttcaatgaaggactcgaattcatcatcatcacttggacccattgatgtgatattgttgactggttggttaatctccgtccagtttgactgctctgcctggccagatataagtgcagatctatccacaacccaatcgtcgactatgtcaatgttgtcgactgagacaggatcaaatgctttggtcttgtgttgttgcctatgacagttattaatcagatcgctcaccatcatcaatcatttactagctaatgaaactcggtatatttaacataaggatttgattacctgtgttgtagccttagattgtactgaacaaatgtgagatgatgcattcgctggcgttcaaaaagattcattctttggtcatgaatttgttcgaaagaaatgtgtctccggtcacatcctttagcactgcaggtttgactgagaatgcgaactgctaaacgcgtcaaatttgggcaagctcctccatacgtataccaccattcagctgcaaaatagaatctataaggctcaccaaacaatttccgtaatcatatctaagtgtctaacaataacctatatctgggggaaattaattatgtctatcaaacgaaatagtaacacagctctagttttgtgaaaggtcggtgctgaaaatgcatttcatgtttttaggacaacataatttgtcaattgagtaagctagttcacaacggaaattgtatagtactaaccaggaggtaaagtgtgcctggctcggatagccatttgcctacgaaaatccccagctgcctcactccggtatacattgagctccttttggattttatcttggattttcacatcagaaaccaacctttctacgcagtctagcatacctgagaatatctcacttgatgttccacctcgaacaccatcgaaaaataatgggttcaggaaaaaaccagctaaatgaagtggtcgtggtgcatccttgttccatctccagtcaataatatcccagtaagccatgtagtcgttcttcctcaccagctctttcttgattgctgctttggcctgatacaatccagcgtaaacataccccatagatggcctcttattgctaccgactaacttaagaagatgcacaagtggttcggtgatgcgaaccactgcagcacacgaagaccaaaactgcaaattgccaataagattggtcacttcaaccccaccaggtttctttggcagcaagtagtgaatccattcatctgagctaatcatggcttccaaagaatcctttagattgtacatgttcttcagtgtgacaaagttcatagcagcacgagtttctgcaggaactagcagatctttcccatgaagatgccttttcatcaagttaaatgcaaatgcgctgttatagataaatcccgtaatgacctttgcattacatatgatctcattgattgcccccaccttactgaaatcttcaagcatcccatcgatgcactggaaagagcattgagaccagaacaatgtaggaaaagtttcgcatagcctctttcctgccaccgcatgaatctcagaattgtttgtgattacttggacaacatttttctcaccaacttcctcaaccacattcttcagcaactcatacagcggatctgacgacacgacaatgtcagttgcatcgactgacttcagaaacatagtaccttccgggcaatacacagagaagtttattaatgttctgcctctgtcagtagtccactcatcggccaacaatgtgcaccctgtccgggtccatgatcccttgtagaactccaactgagcagtcacttcatccagcgacttcttcaatatggaaccacggaagtcgtgatacgagaacgcctcaggcttccctcctgctgaggcaacagcttcaagcataggctgaaagtaaacggaatttactgcctccagtgacacaccagcgtcatacaagaacctcccaattgccatataaacctgctccttgttcgagccgggctggtcaaaatgcatcagttgcgatgcagccgaatcaaacgccacgaccatctgatgaaaaggctgggtcagaccagcaggagtagactgaagaggctgctgattctgatgagcaaggggcgccgtggaggcttgcctcgcagccaatttctttctcttcttgctaatactccccttcatctccctggtctccggtggtgtctcctcgagtggaacggagcccaagtcgagcacctcgttgagcgggatcatgtggatggggctctccatctcggcggcatcggccggagccggcggagaggcggaggcggcggcggcgggagccgagttgatgaactacttgcagtagtaaacgaatctaanggccgg

SEQ ID NO: 29617 - DNA, 44020 bp, Oryza sativa
  unsure (1)..(44020): unsure at all n locations
gggcattgacnccccattgannnactgattgcgcatactgcagnactgatcaggccagcgattgcttccgtttcttcttcgccgcgacggcgtcgaggctgtggagcatcgtctcctgcacctcgcggggcaccttggggcagcagcacgcgttgccggggcggttcgcgaggtgctccttgaagcggtggatgccgccgccgaggaagtgcttgtggcagtagacgcacttgagcctcacgcgccccgccgacctcaccatctggcagtgcttccacgccgggtcgtgcttctgcgcgccgatcggcagcaccacctccggccccgccgccaccttcgactccgcctccgacgccatctccgccgcgagcaaccaccctctcctgcatcgcaatacccatcaccacacccacactgttactaccatttccccgccattgccgcaaaaattcctaccatatgagcccaaccaactgcgaattcacacggattttacaccaacaaacttccattgaaacggcacagcccactccgaatcaaaacctcaaaccatttccagagacagagccacataatctcgtatcagaaggtgattttcctctcgagcaataccccccaaaacccacaaacccaaaggaagatggggacacgacaccctctcgcgtcaaatcaaatccctagtaatccccgattagccgacgacgccatcgcagaaaataaaccgaccaaaaccaagcaaaccagggcgaaccagatatgaaggggagagagagtgagattggggagaggcgagactcacccggcttttttttcgtgaaggcgaagcggccgccaccaaatcggaggggaccggagacggagccggaggcgaagcggatgaggaggagaaaaaaccaggaggcgacgcgagagaaaccagaggagagagagagagtgtgtgtggtggttagcctgtgagtgggagtggagccggtccggtcggtccggtggcccgttatacgtggatcccgggggttggggaaccggcccagccggttttggcgcgggtttggtccgggttagggtgaggctctgggctcagacactggaatcgggagttgtgggccgtgaacactttctgggcccgaacgggaatgcaacttacgtgcagcccatatagcagcataattacacaagcactgcatattaattcattcatgtaagattcatcatcgaaatgtcaaaattaaacccattttggccgcacgaaatgacaacatacactgtgtaacaggatatcatcttttactcccaaaaatttcacaagtgcagaacacacccaagacaccacaaacatcttataaagaggctggatgccctgaacttgtgagctgtatcacctaaactaacaatatctgagctaccatcaccttctgaagacaagaatgggtacatcaaatacctgcacacagacaaccaagcaggttgcgatggctataggtatcatgcatccaagaacatttgagtataagaaataacttcgtaagaacaccaagtcagttgcagatggctatagacctatagttgcagcagtatgatatgctatgctatcggtatcaaatggctcagctgagcccaagttccttcttcagcttctccaaagcagcctctatctcagatacgctatcatcaaagctacttgtcgatgtattaacatcttgcttgtttttgcctccagactgtgtgtacggatcatttgcattgtcttccgcatcacttgagtcatcgatcttgagttcgttctccagaaactcaacaaattcttcaccaatggcctgattgaccagaatgtaatagaattaatgggagattaccaccaatgaccataggcatgattagaagttgcagtatttatgtactattgattagtgttcactcccaacagtagatgtttacaataatacagtggaaaagacaggtaaagaacttactgccaactcttcccacaagcttttaggtttctgttctgaattcagaccggcttcccagttctgaaattctgcttgaagatctctaaggaaatcccctgcagatccatgaccacagtataatgtcaaataatggaacatttttagttcaactatctagtaactacacaccctagagttccatttatctactgaagtttcaaaatacaaggattatgatgtgatctaatctaccagttgtttcttagcagaaaggatctctcttgaaacttcattttactcatcactagcacgaaattcctaaccacagaaaccataatatagctcactaatgcagaagagaaggtattccagtaccaaagccatagaatggctcttcttcatcagctgaagtagtgctgctcttcccgtatgtcctggacgaataatatgtgttgctgctagtgctcgcgtacttggaccggctctctgaattcatgagcgtgttgtacgcatgcttgatccgcagaaatttctcttgcgcgttgggctacgttgacacaacatcaaacacaaataatcagtgaaacgcaaggaggtgacaaggtttgggggcggctgtggcacgcacctccttgttgacgtccgggtggaacttgagagcaagccgccggtacgcgcgcttgatctcttcgggcggcgccgacggaggcacgccgagcacgtcgtacggggactccccccggccgcctctgcccgcgccggcgcgggccctcacgctcgcacgccgccggcggcgaggcggcgcgggcgcaggagaggagaggcgcgtggaggggccatcgcgggaggaagctacggcgcggagaacgagaggcgacggcggagcagcgaagcggcggcgtgaggagcggagaggaagagggggatgcggagtggcggcctgaagctgcagcgccatggcgcaacgcaaccggagtccggaggtggatggggttgaaagaaaaaattgcttttgaatggctcgcagcgagccttcaactggagcagacagcatcaccaccgttcagatcacgcggccctggtggagcagtgaggatcggacggccatccttagctcacaataaataggcaaagccatgtgagaactgattaatccccagtcagccagtctacagattaccgacacatattatacaaagattgaattcacagagactcaaaatcaaatcgtggaagagataagtatctttcatcttcgtattttaatagcatcacagattacagatatccaaaaacctcaatacatccaagagctcaggacaggattaaaatgcagagaatttcagcagattgcaaatatgtaggatctttttaaggttaagtctagagaattgcataagcgaaaaactaagcaatcccaacaagtctaggaagacggtccagggcctagcagcaatggtggatccttcttggcgctctcagactctgaatcttctttgggaggtggccttgatgctgcccaagcgcgaagcggcggctcaaacatgctgccaacgacatccggtggtggctgttgaggtgcatcctctccaggaagcacaacaagacccttctccctgagagacgacggctcgttgtaacactccttccagagggagtccacaagctgtcgctcctcacgatgtgcggagagatcgtcggcatccattgtgctgatgccttcgattcggctcttaaggacatctttcagcttgtcttggtcaggtagcacgtttccagcaccggatgtattgtcccgcgccagctcgagaagaccacctaaggcagcctcccggactccagaatcatcactcgatgccaggtgcatcatcagctttggaagaccaagctctgtagcaacactcctatcagccttgttgtcgtgcagtaggtactgtaggagatggagagctttcctggaattaataaagcagaaatgttatgaaaattgcaggtttgcattgcattgtttaactgcagcaaaaaataagtcatgtgaatgagatcaaaaaaaaaatcagtactacaggtaggcgcagccaaatagttacttcacttattggaaaaatgttgtgggctaagtttagaagtaaatatgtgctaggctatgctatcatatatggctaagctatcaaggccacgcatagtcctattgttcaacaagtataaataccatgaagaaagaacatagtgcaatgttagtgtcctactagctcccctgattatcatacaacatacctctgaagtctagcatcatcagaaccaagagcgtctctcagtgcagagtagccatttcccaggcggaatgcagcaactcctggctggttatgacgaattagagctgcaagacagtagtagaaacctctagttagcatatgtaattgaagcaattatgttctaggtcatggcaaagcaccaggtttattacagaagcaaatgacttacatgatattgctccaagagcttttgtgcgtgaattcgtgcttgcatcggaactgaagtttgtcaacagtggctccaggccattagattccatgacaagttgctggctcttggggttattttgcacaatcgtgctcacaacctctgcagcctttgctctgatgccagcatgtgaatttttcaagtaaccaagtaggggatctaatccaccaatagagtgcagatctggtggggtaatgcaatcatgttaaaattctttgcagtcaagagaataacatctacaaatgcagaagtacagtaaccatgattcttaccatttgccatgtcaatggattcaacatgctcctgtaactcatccaacatatctgaaaacaaagtaataattcattgatcagtgaaactgagaaaatctatcaatcccattctagggagggttttatatgttaatgttgaactgttaaggataatatgaaatgaaaagtgaaaactgtaggaaataggcaaaacaaaaacggaattcataattgcattgtccctaaaggaaccttacgtgtgagaatcagccactacaaatttacgttactagttatgtgtacgccagcccccacaataagcatatctaatgcacaataatagaaatatgattacttgcagatgctaccaaaaaaaatacttaacaaaaattactagccatgattttgtaaactttcttcagctagtgtttccgcactcctacaatcccaaaaattctacaagttgtataaatatgaaggaaatgctacaaggtggccaataaataatgaagagtgctgagcgtatatgaaattcattgttcacgtctacaacaagcaggtaattttagaaaatgaaaacactcaaaatgataccttcgatgttctctggagtcacaccttgagactgtagtacatcatctggagttttcatcacttgggtgatctccttcatcctcttaacaacatccattgtattagcttgcattgcctccataaaccatttcttgtcctcctcactgcaacccaaacaaatcatgataacagtgaacaatatgaacatgttttggcatgccacagatcgattgcacattccaaccactgcacataggtatcatttgcgcaaatttctgacatgacagctaacatgtcagtgttaataaaggagtaatttagcaggaaatatgagatgattcatcataatttaacgagcgaatttgcacatgaattagcagtctacaagtgatattgtgctagcgcatgtatacctgcagactacagtagaacaaacaccctatctcaaacctaaactaaactaaacacgcctaattccagagtacctagaagcacatcgatctagcgccccccgccagaacaaccccacagcttaacgcagccccttactcgaactgaaaggagatctcgctcgagcgggagcagcatacctgagcgagcgcggcttggcggtgccgtcgccatgggcgaggctccacttgagcaggccgttccagtcgggccctcctccgtccttggccatctcctcctctaccaactccggcgagggttcacggcgagacagttggttcaggcgtcggtgcgcggcggcgggaaaagacgaagcagcacaagcctcctcctcttcctcgccctcgtcctcccccttttatgggagggagaggtctcctcctctcgtcagtcgaggcgtcgtcgagagagacgggggacgcggcggcggaggagtccggagtgttcctgaacctacgcttcgcctcctcaggtggaaaaggcgtcttgggccgggccgtcttttggttccccacgtcgtcattgggcccacctagtcagatcctttctttggtgggcccggattacgaaaaggaaataagttcatcaaaggtcccttagcttatcaacgaatcatatttttgtccttcaaccgaaaactagatacaacaagtcccttaattgtcaaaaccggtggtcccatggcggtttgaacaacgatttaagctgacgtgacgtctacatggcaaatttgattcggtcttcatttaatgtggcggtcacgtgacactggaagcaaaaatatgataaataattttattttacaattgtggggcccacatgtcggtaagacaaatgataaaaattagtgatccccgttctcctctctatctccagcgacacctcattccccttctcccccttttcactggccgcttcgtcctcgactacttctttctagctgtggcaccggctgctacgagaaggcggcggtgtggaggcttcaacgaccagtcggaagccatgatggcctcgaggtcggtggccatggtgcgctcggccctgaggatggggtcggcagcagggatgaaaattagttggaaaaagtacaccgaaggtcccttaacttgtcatcgagttacaaaatcgtccctcgaccacaaaaccagataccggacgttccctcaactaacaaaaccgttcactttagatcctcctatgattttgacccgttcacttcagatcctcctgtgattttgaccctggttttgtcatacatgacggcttagtcagcgttgaacccaggtgggccccatatgtcagcattaccacatcagccttctctctcttttcttctcttctctcccatcctcatctctctctctctccgttctctgcggcaatgcgaggcgggagaggaggaggccgtcggcgaccggcgacctgcagccggagaccggcgacgcagcgacgggcgacgcggcggcgggggaaggggcggcgcgcgggcgcccgggagaggcgcggcgcgcgggtgtcagggtaaggagcggcacgcgggctcccccgccggccaccacccatgaggcccacgaggcggcggcgggggacgagctgcgggcgggcggcgggataggaggagcacgaggcaacctcctcgtgaaatacatactctccatcacgcgtgacatacgtactgtgcatctgattctgtacatgatggggtagcaaaataactagctctgaaaattttgttcagaacatgtagtggtgcttgtggtcgatcttggtgttgcttctccggcggtggtgggaagagctagagatagaagaagcagtagggtcggggaagccgatgtcgtggacggcgccaacggtgttgaagaagaggcgcttgttgagctcctccaccagcgtcctgtgcagcagctggctccgcatgtccaccatcgacctgttccgactcatcctaccccgccgttgatactcctttacgtcaccctctcgctgccgcggccgtccggcgtgccctcctcctccgtcttcagatgcagaggctggccctctctcgccggccgcgcgccgcccctttccgccggccgcccgcagctcgttccccgccgccgcctcgtgggccgcggccggcgggggagcccgcgcgccgtcccttccctcgccgtcacgtctcccgttggcggccgtcggtcggtgacgccctcctcctctcccgtctcgcattgctgtagagaacggagagagagagatgaggatgggagagaagagaggaaaagagagaaggttgatgtggcaaatgctgacatgtgggtcccacgttgacttagccgccatgtaagataaaaccagggtcaaaaccaccggacaaccgaacaacctaaagtgaacggttttagttgagggatgtccggtatttttgcggttgggggacgattttgtaactcgatgacaagttgagggaccttcggtgtgattttttcaagttagtttcggcgtaaagttaagggttctcaaatgaaccaattccttacgaaaacaataggcccattattgagttagtacattgaggcccaaatttgtagtgaacatctttatgggctgatcaatcgattgttcgcgaccttttggagtcttttggagttttgggcaaggacgcgcgctgggcgctgctggctgtggcacctgggacgttcgtgaaacctgcacgaaagcagctcgccgctcaacgcttttgatgcgatttcgacacgaaaacaacgaagcgtcgggagaaatcggcacgtcccatagtttaagcagatgaactagcgaaccatagaatcgaagatgccgcactttgcagttccgtttcatacaacatcacatagcagaaggtagtgttagcacaagtcacatttcagaagttcaggaacatttttttcccattttctgaacttggaataacatgtacatagatacatagggtttttttccccctgctaaattaacaggatttcacacgcagggcggtagatagatacagctacttcccatcacaaaagcagaacagcaaatgcacatccatcttgctccacaaaaaaaaccaccaaacaagatgcaactgcagagttagcagcaatccctacacaaaaggctaaagctgtactagtaacactactataatgtaggagtagcagcaaccaacacactgtgcgtgctgctgcacggagactgggcgcagcagcactacgcgcagctggacgcctgcctccgcggcggcgcgagcacgaagagcgactcgaggtccggcggctggaagtacccgcccttgggcggctcccgccgctccttccccagctccggcagcgccaccggcctcttcctcggcggcgccgggcactgcggcggcaccaccgggatgcggcactcctccctcctcggcgtctcccacccctgcagctcctcctcctccatcgccgccgccacctcctctccgtgccccatctccacctccattgcctctctcgatcgctactcctaagcaaagatttgaaatggcgaagctatgcaagcaaagcaagcaaccacgcttaagctaatatagaagtgagtgccaccgcggtgggtggtgatgtgcagcaacgaagcgacgaggagagtggagtggagtccagcggcgttgcgggtggcgggaagggacgcgccccgcggaatctactcgtttaccgaatgactagtgggaccaggtcatgtagggacccacttgtcagtgggaaaggtgtgaggtcgctggtggtgggaggggggttgggagagttacgtggcaccgactcgcgaatgcgcgggaaccgcgtcggtcgaaagtggcggaatggtctagagctccgccgcggattctctgtgccaaacccgcacgaacgccgcaggttgagcttgagctttcaggtcactgcacttgggagcctctctttgaagcccaacagttctcaattcctatatactccaacagtagtacggtttaattcaaaaaacaaaaactcggtagctgaaagtactcttgacacaatgctgccgactgtcttttagcttaaagtaactatatgttgctttaaaaaattggctatggcatttattaaaaaaaaagaacaaaaaaactgttagtttagcggcgatcattgcacatctgggacctgcaagtccaactgcctggccctcgaacgctcatacgctacgctcctaccctaccaatggggcaaccacagttttgcatgtccaatatcgtggttgcagtggatccagctttagctcagtagttcaaactcagcctcaaacattgattactcaggacgaaccatggataggctagaaaaatggtctgcaatggaaatatggaatggtagtggagcatatctcttcggaaagtgggctccatctctcctctcgccggagtacgaccaagctgtgggcggcggcgtgacacgtggagcccgtcccgtacgtcgccgggccatgagaaagtggatgccagcgtggcgcgaccgagaagccgcggcctgcaccggcggagcacacgccatgcatgaccggatgatgattaaactgggccacaagcccacgagtactagataagttcactgttttttcagatggaatagttcaatgtgatctggaaaaagattcgaacttttcaaagggggtcctaattcatttgcatttccttcacacagaacaaagctaaaagcaaaactttactttgatgcctaaatcaactaatataggttgctcactttgatgtctaaatcaacattaccaaattttggtagtaacaaattttggcattaccaatgtttgataaggataagggtgtgtttatagttctttggatgtaaaaactttgaaatatgcgaacacacatttgaagtattaaacatagactaataacaaaacaaattacagattcccgcctgtaaactgcgagacgaatttattgcctaattaattcatcattagcaaatgtttactgtagcatcacattgtcaaatgtaatcagacacaaaagaattgtctcgcaatttacatgcaaattgtacaattgttttttttccaacatttaatgctccatgcatgtgtccaaacattagatgtggcatttttggccaaaatttttttggaatctgataaggccaaagaagagtaagttgtgcgaaaagattctagaattatgaaaatttggtaatggaggcaacttttggcattgtttagattgttaccttgccaaaacttggtaaggttagtttcggcaacaaagggaacactgcatcaatgattgttcatgaacgggcttcatgcttttctatttagcaaatggcctttcttgaaaagattaccggaaaagtatacactgcttgcctgataccaaggcctgaaagtgtggcgacaggggtgcacaagaaaaattgctaatcaaatcagttcaacaaagattcaaatgtgtcagcactgcttcttcattctattatttctaccgtaaaccttcacagaccatgaaaatctccctcgaactagatcttgtcgccttgggtctcaataaggacactttcttgaacttctctttgcaaaatttgccaaaacctacaaagttaacagtttaatgaataataagttatacttggtgtcttgttaggatttttttaaaaaagaatagctagcatatagaagatgattgctggtcataacctggtatatcctcattctcaagaaacttaattacaaggctgcctccacgacggagaatgccatcttcatcaggatctggctcagtggagctctgaaacttctctaaaattgcaatgcaatctgaatcttttgctttcatcttaccaactgccaatgaaagagcacgcatgcccagctcgcaagatatagccgcatctttggttgtaattccagaaactactgggcacatgtctgacaatattacagagaatcctcgttcctgtaaaataagggaatcaaataaccaatggcgattacagggcaatacaattggtaatccttgcttcagcctttctaaccataggaaataagatattcagatgaagcgagcttggtagtgggaagattgatgaaaccatgtttcgtagtctatcagcgtgcgtactaaagtaaactcagcttttctcaagttacaaccttatgtggtagtgttcccagttgacaaattgatatttggaggcaaaactgaataaatacacgtttacctccacaactggtggcatcatattttatttagctagtagcagaaccactttatcaggttccatcgtgcctaccgacaaatagggtacataccttttatctttgaaagaaaggaatttcatgggaatttttggtacctagctcttcccaaggaatgaaaaggaggcatgcattttctggtaaaacattagtagcatctgtcatttgtacaaactaatactccctctatcccagaatataaggattgaatggtgaagggttgtgattggtttgataagagaatattggtgaagaagttattatattttgggacaaatctagagaactgaaagttgtaatattttgggacgaggggagtagttcacttgtcgcaagtaccactagtcaccaataatcctcggtgcgaaccttccaagactgttttcctttgcaaagatcatgagtctcaatcgaatacatatggagttcagttagtactaagatttcacaaattagaataaaccaaactagattgcagcctcggatcaaacgaaactaatttgtataacttcgtaccattccttccacgaactaagccagggaaatcggtagtaaaagctgaatcatatcatgatcattagcaagctatcgaacctgtggcgacattgcccgagcttgctgcttcatcagagccatcacatcggcgcaaacggtcctgaccctcgagtcacagtgcgcagatggaaccttcaccttctgctctgcaacaaccgagcatcgaatcaggccaaccattccgtcggcaaaatcagcctcactaacgaacggcaactcgatcgccactgaccttgacatcgacgccgacgatcaccccgcccttctcgagcggacccaggttctggcacgccacctacacaatgcaacaccgagctaaatcgaaatcgcgctgatgagaggagaggaggggatccaacgtcacctggagccacgcgccgggggcgcagccgaggtcgaggacggcggcgccgggggcgatgagcttgtgctgcttctgtatctggatcagctgcgacgggcagagcaagcggctcctcgcgtgagacgggagcagttggcaaaccgtacgagcgagaggggtgaggaggaaggcgctgaccttgaacgcggagcgggcgacgtagccgaggcgctgcgcctcgcggtagaagaagtcggcggtgccgcccgcgccgctcatggcttcctctccggccggcggcggcggcggtgacggtggcgaaggtgaagacgacggaggcggaggggattgctagggttttagcccgtcttcgcggcccaacacacaagtgaaacccaagcagcttgtttgctgggccggacgaggcgagcaaagcgtgacgtggccaccttccccgccgcgcgcactcttggcatgcgcgagcgcgacccctccccctcgaaccgccgcgaccttctcgatgcttcccaaatcctcctcctcgtgaactcgtcgccttcgtcttcgtctcgatctccatggcggactcgagcgcggcccgccccaccgtcctcgtcaccggcgccggcggccgcacaggtgggtactcctccgtcctccctgtggcctccgactgcgatatgaatcccagtagcgcgctctccagtacttctttttttttttgggggggggggggggggggtattggagcaaactgatgacagcggaatttggaatttgcctgttgtgcaaggttcgtgcgatctacagtacatgcttgttatatgatggggaattttggatccagtagagcgttctgaaaaggaattttggtcggaatgggattcatgtaatgtgttgcagtatcttgatcttctctaggataagagactttgtatcgcatggctgctagtcatatgatgagttgaatttgcaaggtttgtaaaattcacctagggcttaggcacgagtggggcttcttgggtactgattaacccattctagtttagctcaatgaactgaatatactatttggacttggaaaactgaaatttagtcgattaattgaagtgggtcaatgggtatccacagagcaacccacgccaaacccggaattcacccaatatgagtgcatgtgcctaagattttttgcaactatatggatgtatactgactgctcgacactatgtagtctgtactaatcctcaagggttactccttgtaacttgtcaggaaacattgtctacaacaagctcaaggaaaggtctgaccagtttgttgtgagaggtttagtgagaacagaggaaagcaaacaaaagattggtggaggcaatgatgtttacattgccgacataagggacagagatcatcttgtgcctgctgttcaaggtgtcgatgcgctcataatcctcacgagtgctgtgccaaagatgaaacctggttttgaccctagcaaaggtgggaggcctgagttttactatgaagatggaatgtatcctgagcaggttggctgattgaaacccctctagttaatatatagaatgtgattgtaaacttctgagctcatgctaatacttgctgtggtctgttaggtggattggattggccaaaagaatcagattgacactggtaaggttgttgcttattcttcttcatcattcatgtatcagtttgtaaatgtttgttaagtgaacattgcttgttttaacagccaaagctgctggagtgaagcatatcgtgcttgtgggatccatgggaggaacaaatcctaaccatccactgaacagcctaggcaatggcaatatactggtaagctgatggagtttgctagttctttttctataataagtcatacagcaaactttttggttcaagctttcaatagaactggtagattgtttccctctatcttaataacatttggatgacctccttcggtcatcccggcaaatagagtggtagattggtagaaaatgatctggccaccttaaatggttagcaagggaaaaccaaaaatacgagtgccaaactgtatgatattatcttacaaatgaactttccacattgctgatatcaccttattggatattccttgatatggccttatttatttgttataggtttggaagcgcaagtcagaacagtatttggcagacagtggagtcccttatacaataataaggtaccacctgcataagacaagaagccatacgtaatagcctgactaattggtccggttggcttaattcgctttgttcttgaaacttaggaaatgtttgattttccaccacaataggcctgatttgctacttcattgtcaatgatactaagccaattcgtatatgtgaaaaatataatatgttgtgtgtatcttccatcacttccatgtaggcctggtggtctgcaagacaaagacgggggagtgagggagttgattgttggcaatgacgatgaacttctccagacagacacgaagtcaattccaagagctgatgttgctgaagtttgtgttcaggtatgatctttgtggtcaatacagtgatagtttatctttgagtttacttagctaagttttccggcgatgaagcattgatgcatcggccatacgtttctactttctgtcaacaagcaccgtgaaaaaatatggatagtcacatggtgaacttaccattctgattgcaaacttttccccttataataggccctgcagtatgaagagacaaagttcaaggcatttgatttggcttcaaagcctgaaggcacaggcacaccaacaaaagacttcaaatcgttgttctcccaggttacagcccgattttgagccatcttgaggagcaatctcatctcggtttccttgtgtattggatatttggatgtatatcttcgtggttagtgaggtgtgaagttgtagtttgctgtaattcgtcatcgtttcctgaaaactcctattgaaatcagtgaattgttcagacaagacacaaattgatattattcaaggacatgatgtctttttaaaatgaaatccttgcgctgttataaacttctggcatggactgtggagtcagcctgcaaagggggcggatcgggccgacccatcccctataccctctgaccctatctatcttggtgcctgagttcgccccgtctctggtggaagtggagccggcccgttaggttcgtggccgacccaccgtagccgcgggccggatgcactaagcgtctgagccaccgtgtccagtgaatggttgactggctgtgttaatgtgttatcagtgaaccattaaagcaagtagctatacgtcaattcaattatacaagattcaaaaataatatgaacaatcattttatattaaactgatatcatttttgtactatactaattttatataagtcagatatcaagtgaaataaggaaacaaaaacacatacactagcatgatatctgaacacatactaacatactagaaatttcggttgtgcgaagcaaatcaacagcactacagcaaaataaataaataatcaaaaaccataccagaacacactgtatacccaatgcaaacattccgaaatgacttaatcttttgcattcaaaagtacaaacatcaatcactgggtactggcacccagttcaattaaaactaagtacatgcatgtactcatatcattcacaaaaatcgatttgaacaacccaaatatccggttcattatattgagatcaaacaaaatgcagccttccaagatcaaagtgggcatcatttggcattccctagcttgcactgttcgttgaatcacccaggtccagattctgcaggttaacatgatggagagatcgaatgatcatggtataataacaggaagaaaatatacaataattgttttaaaaaggtaataacctgcaatatctctcagaaaaagaaatggtgcatttatgttttatgggcaacaactgaatcaaagacatgagcatatgcagacagacagaggaatcaacgcagtaggtgttctaagcatttgagtatttgacatataaaacatgcttgaaaaacagaagtaatctgcagtcactcaatagtattcacaatcagagattaaggaatacaagaatcatctaacaagtgctacacaaattttgcagattttactaattttcttcatttatctagcagtagtgcagtacagtctatttttaggctatcgttttatttcagaaagcagagcattgcaataccagaaatgaggtttattccttttgtacatctagagcttctcatatgttgtacaagagttgaactagctcagattataaatagtataatacaagttcatgatagattactaaccatcaatatccagatcctttgtttgggcattcacaagcttccaccatcctgtccatccatggaatcctccaggtccaggttctatagataaagatgaatacatgatagagacattgaaacttcatattccaattttacagaaagctagcaagtaggacaacaaacccatataggcattgttcaatactggataaatagaaagagaaaagctggaagagatcttgcaagcaatcaagcaaatactgaataaatagacatctttctctttcagaaaattaaatagacagatgataagaagagcacaagcaatttactaaccacaaaattatcactgtagttgatttcatttactgagctcacatttatgttaggacctagcaatcaaaacataaaaataaattagttttagcaagataaatactagaagtaaatgaacgagggcagtcgtgtataccggcagaagctcgaaaccaatcttggaggcagataagcgcctcaactgaatccattgtaaggctacatctgaaatcgctgatcactctagatcctgtgctgaatgcggactcagatgcaactgttgaagcaggccatgctagcacatcctgtgctatgcaagcgagagttggatactttgagtgattggtcttccaccaatttagaatgtcaaatttgttcccaaattcctgaataggattctctttgaggtagatatccaattcagtatcaacttgctcacttcattgttcagagatgtgttgaacccaatcagccataggatcattttcagagatagccatcacatgttcagcttggcgcagtgggttagcattgctatccttgagtttatcagagtactccttaaacaacatgttcattctcttcttaactttgtcaatcctctctttagcattttcaccaaaggcttgcccaagccgaaattccacaaaattgaatttgaatcttgggtcaaaaatgacaggaatgcacagatatttgtaagacttaagccaatacttgtcaaatttgtccttcatcttttgaaccatacttgccacttcagtgtcattgttagagtgttccttgtccaagaccaatttgattttccacatctcatggaaataaaggtttgatgttggatataaagatccagacaccaccatagttgcatcataaagcaccttcaaaattccagagactatggttgatctttcccactgatcaggagagggtgcatatttgtaatttttgtcttgaacagccaatgaagcataagccctcatgaaagggaaggctgcattgagcattagatatgtggagttccaacgagtacatacatccacagtgggatgcaactcgcatgtgatcccttcttgggcaatgatctcctcaaacttttctttgcgagatagggaattatccctgtacttcacactttcacggatgttgcaaacaatagaatcaataaccttcaacccatctttggctatgagattgatgacatgtgttgcacatcggttgtgaagtagcttccctcctgctggtatagttttcttagctttcaaattgcactttaacaacttagccattgaatcattggctgaagcataatccaaagtaacactgaatattttgtctgcgatattccaatcttgaatgcagctgagcatagcattgaacatctgcactccagtatgaggtgtctttactccaaagaactttataatcctcttctgtactctccaatctgtgtcaatgaaatgacatgtcacacacatgtatcccattgtttggttcgaagtccacatatctgcagtcaatgagaacctacaatttgcacccttgaacatgtccttcattgctaacttttgctctttaaaagcagcgatgcaatcattccttatagttgttctcgaaataatcttgaagtaggggttaagactagcagcaaaacttctaaatccatcatactccacaaactggaagggcaactcatgtaatacaatcattcgcatgagctcttttctagaaacttcaggatcaaagctccaattctttaaccttacactattaggagacataagtgtagagtcaagatttcccacaatcttaagagcactaattcgcttcttgcatcttgtcaaatgcttcctcaatgaacttgttcccgctccacgctttgcacggatctctgtatcacagtgcttacattttcctgcaccaacttcattatcaatgagtatcggcacaaactctttccaagcctcagatctgaatttccttgttaaagcttgtattactggattcacatgctcatctacaggaccaacttgttcagagtcactatcaccatcacccatctcaatatcttcaccactgttagtgccaagtccaaaaaatgcgttgggtgtccgcatttcctcacttgaaacaaagcaacgaacaacacaaatgtatcatttgccatctaaaataattttctatcacataatgtatggaaaggaaattttggtgtaaaaatctgcacaacagcatgttgtcagaagcatgcaaaaatgctacttattcagtgtttcgttcagtatatcctgaatattgagaaaatccaggttatatagagacaaagtaaaagaccatctattttacacaaggcagtaggaaactttaaattagcagtaactgaaactttctcctgaatggcatgaaagcaaaatgaaactttttcctggcatacaaatctgggcctagcaaaatggcatgaaagcctagctataacagtcactgaaactttctcctgaatgagacactatatatacaaatcaaaccaaaaccgagcaagacagatgaacaagacagggttcatggaggaaatcatacttgtgctcacgagttagagaaacccagctggaagaaggtggcgatgtggccgggtgtcctccgaaaccctcgccgttgctgccggtggagtgtcctccggagcacctcgccggttggccaccaagcaggtagccgccgcccgccggtgcctccatccgccgccgaaagaaggaactgcatagaagaggaactaaagaatcaagaaccaaagaaaataaaaagaaaatcaagaaccaaagaatccgttgctagttgctatgatgtgaaccacagtaccagtcttggggggagttggagatgggaggaggactgaaggagcacgcccagccgccgccgcctcaacccgcggtggagcacaccgcgaagccgaagctgccgccgccgccacctcgatccgcggtggagctgcgccgacaccgctgccgcctccgctgggagccaccgccgccggctcgatccgccgtggagccgcaccgccgcaggccgggagccctaaagccgccgccgccatttgaacgcgagcaagtggagcgctcgaacaaggccgacccaaaaacccctagggtcaactgactcctggacccattatcacctaagaaaatatgggccggcccgaaaacctattggtgccacaaatttaggttcgggccacggacctaacgggtcgacccgccccacttgcaggctgtgtggagtggtcatgtgtgcattggacagaaatgaagtcggaatatgtcctgtttttcattgcaagtattgtactacagaaggaagaaaaatcattttggcatcgcctcgtgtagataggccttcacacagtcacgcagcccacagcccaaggcccgcacaacgccgggtcatcatgcccatgtcacaagtcaacagtcacgagctactcacattaaggatgaaaatgttttaagacgatatcatttctactgaaacgattcttgctcggtcaaaaaatttcatacatacgaattttgctattttaacagtgatgaaacttatatataactagaatctttgcgggtcaggaaatttttacgtcacagttttcatgtacccttggtggttcgatgcttggaagataggtcaagtgacgtttgctggttccggccggcgacgacgaccttagcgtttgtcccttgcccgaccgcttttcgtctcgatcggcaggggtaccaaccactcaaccagtcgtcactcgtcagaacgcaagccgcagatcgatcaaaaccttgctgcttgagctgcgtgctgtactgcactgcagctcatcgggtcaaagcaaactatctcgctgcggtcacggcggtgatctggcctgatcagatcatattgccgccgtgtccacgccggtcaattcctactccccatgagatgataagatgatgagatgagatgagatgagatgagatgagctaggccgcgcgcgctgcctgcgacgagatggcaacaagtgcgtcgcgccaaatgctcccgttcggctacctcctcctgatactaattactactactccagctagctgcaggcagcatatgtatcagtgacacgtacgccaacttgcaacccgccaggtagagtagaaccagtgacacagcttcgcctggaccaaacatcaaggcaaaatggtactgcttgcacattggagaatttggacacacctacctagtcccacacggattcatcctaaaacaaacaaactttcttcaattcagattcgtaatactgtaatatattgcatcttaaatttatatttcatataaaatttgtttattcaaatttatatttcatactaaatctgtttattttcaaacaaagagaaaacttactagtaatagcacgatagaagaagatagaggaagacaacagcctgcacttgatgacagtttgatcattcgcatataataacagtatcacacaatcgctcatgttacaccattagtcaagtcaacgcgcccccattttcaaaataagatggtgtttgaaactcatgtggataaagattaagtattttacataaaacggggtgctatattaattaaattgtaattattataaacttgaaaaatatgtttatgatattttgaagcagcttttatatagaagttttttacacgaaacgtaccgtttaacagtttaaaaaacatggcacgaatatctaaatttttatccaacttttattagagaaaagaacggggcctagacagttctctctttcacttgatccacaccctgttgccggttattttcccctgaactgcatgccctagtgtctgaacccatgaccctcaagtctcacggcatgcatgtgctctgctctgcatccaggcacaagaataatcatcagtcataagaagcaaacacaagctagctcagggcaaaacacctaacacgtactcccaatcctactactgcaggcgcgacttaaattgcagacaagcaaacaggtcaaccccttaccaatctgtccaggcacgcagcgtccggcggtgctaggctgctagctaattacagtcatcaaggaaccgtgacctaacacaatcttattagtggacacaaaattaagaggccagctgcatgctgcagcctctgcatacatcatcctgcaggagatagccatatggaaagtatcatgaattcatgagagctcgatgatgcgcagccaaagcagatccggcacatggcctgggctcaaggcttgctgcagtgtgcagtagtaaggtttcagagtttcaccgaaacaacaacgttagtcaatgctcgatcgataaacttgcagtctcttgcagagtgcagactcgatccatctctgctttgacgaccatcaacgccctatccgtcagttccagatatgctaacatactactactgatattaattttctaccggacatctcagtgtgatccaagcatcgcaatacaatactctctgtgtgcacggcacgcgacctatgttaatactatgtggaaacagctctgaattgttccgaattaatggtcaccattgacatgctcaatgaagaggtctgaccatcagggatagatcgatcgacgcagtgtgaaatgtatgaagaaatgagaaacacagatgcgtcggtgccaacgcatttgtcagtttcacaacaagttgaatcgaaatgaatgctacctgaacactaatgcattacagctttgatatactcctatagtgttgtactcgtactatatgagtacttgtactacttcctcaaaaggtcgcgtaaaagctatactagctgcgtcttcttcttcgcatttgcttgccgtgatcgggcgggaatttttttatcagtttccctttgttctcatcgtggatcggaaaagcgacggcatgatcgatccacaactactactgctgcgatagtacgtacatgagtcgggttccgaggcgagagaaaggcgaaagtagcacgtacgttctccgcttcttccttttgattggaacttcgcttgcccttctgtttggctttatctactccctctgtcaaaaaaatataaatcatgggtttttttgtccaacgtttgaccatccgtcttatttaaaaaaagtatgaaaaaaattaaaaagacaagtcacgcataaagtattaatcatgttttatcatctaacaataatgaaaatactaattataaaaatattttatataagacgaatagacaaacgttggacacgaagaacgaagaaccatagtttgttttttaggacggagggagtatatcttcgagtcatatcatctactactgcgtcttttatatgggaaatacttccccatctataaatatactctctcaatttcatattataaatcatttgattttttttctaattaaattttattaagtttaaccaaatttatagataaatttaacaacatctaaaaaattaaattaatttcattaaatttaatattaaatatattttgatggtatgtttattttgtgttaaaaatactactatattttttttataaatttaatcaaacttaaagaaatttaactaagaaaaagttaaacaacttataatatgaaacgagtggagtagtatgttcatcctaaaataattttactttttatttatcccatacatatcattacaatatgtgctataataccatttcctttaccaaattctaatgcatttatctcctactttatatatatgcttctaatgtatttatctcgtacttttaaaaactctaatacaacaattgcttggaattaagatgaacttaatttaggatggagggagtagcaatttaattaagatcggatagaatacatctcaatacttttaattaaatttatagtaatatgatgcgtcctacttttagattactgtatgttgggaaaggagtatgcacgtaatcctatagcaaacgagaacgactagtactcttctttcagctacgtcgtctacgtgatgtgatgaaatgaagaagatatgggatggttaggccgcaattcttgtagctagagtcgtcaacttgtcagacaactagtatgtccatatgcatgtttgctcggttacctagaggccaacccccaccttgatctgtccaacaaatagccgaaaagttcagagttagggtttgttcacatccatctactagctccttactgccgtctccttttactgtgctgccacaagtctacaacactacaatcgtcaggtcaaatcgttccaactttgccaaggaaaactccaaaagcaaggtacttaaggccatatttttttcagcttaagattattataatccagattattgagagtaagctgaaagaaacagacaacttattgaagtagcttattataatctggagcccagcttattattatttgataagctcatttaggtgagctttttccagattattaagtgaaaaattacccaccatgccaccccactccctttttagacttgcaaacccaataatctaggctctaataattcaggaaagaaacaactaaccacttattctactataaattataacaatctagcttatagtaatctgagtcaataatctagattataataatcctaaactgaaagaaacagtggcctaaatcctactactgatttggtcccattagccgcggcgaaggcggagttcatatatcaaaagtgaaagaagagttttgtgtgcagtgcagtggcttccgtttattcgaccaacagcacgagattgccatcacatggctagttgatctaccagaagaggagtcctagtagaagatatggcctactcctagtacaacaacaacaccttaacctttcacgaggctgcaaccaaccaccctgggtggctggtgctgtagtagcctagtagagctgaccaacggcggcagcaatgattgacgacgagtaaagtaaatcgccgtacaactctacgtactatgagctcagagttgacttgttttcttgccggtaaaacgcacccaaccctgcatcgcgttgcatctgatcgagtgggcatcaccagcgagctgaggctgcaaatgagatcaaccgaagcgtagatgcaaagcaaccacacatatatatcagactatcagtagtggtacatacatagactgtagtagtagatggagatgggcataataaactcggtggccggatgcgaccaaggaaacggttagagatggtgcgggttttgctcggtcaccagccacatgcgcccgcgtacgtggccgagacagcgcggcgggcgtacgctagctgcgttagtacgtgtgccccgcccccgcgcgtcgccatcgcattcacgcgccgatcgatcgagccacggggggttctcgcgctcgcgcacgtacagtctacttaccaaaccccagccaagacgccccgtcgcgttgcgcccatcgcgccgcgtcgggaggtgcgggcgcgcaccggccgcctgtctcgcgcgcgcgcgcacatcgcgacgtacgttacgttggtgcgatacgtacgtggcccgcggagggcgaccgcgacggctcacttgccgggctctcgctcgatcgggcgccgtcttgtgctggccttggcctgatagctactccagtcgcgacttggtaggtggatttgtacgtactactacttcgttcgtagtggtgtcgtcagcaaagtgcaaaatgcagctactgaaatttacagaggatgcacaaatgcaagggaaaaaaacgtgagcacttttcgtcgcggttgtgattaaaagagagggcgtgtcacgcactcacgtctcacggcacgcacccaccgcgagaggctagcggagaggaagacgtatcccgtttggggtgacccatgcgtacctacctaatccctccgtctaaaaaaactcaattcttaagttgccgtgtacaacatttaactatttatcttatatgaattttttctataattagtatttttattgttgttagatgataaaacatggataatattttttgtgtgacttatttttaatattttttaaaaataatacggacgttcaaacgctagacacgaaaatccaaaaattgagttttttttagagggaggatatgcgagacccatcgaccgtaccatttatatacgcaggcgtgcgtcacgcatacgcagtaaataggcatggaggctcactgctttgaagtgcgggtggaagagggaggagggaggctcgatggatggatgggtgtttgttcaggcgcgcggcgggaccgggcgcggcgcgggcgggcgtgccatgtgtgcggggagatcaattctggtgcggtttcgaggctcgaggtgggggcacaccggcgtggaagggtgggtgtgtacgggcaaagtcaccaaaccgaacaagggctccatcccgcgcacgcggaggaatccgagggcgccgtctgtgcctgtgcccctgcgcgtcctccactgtctacgatgtgcatggggcgcacctcatcgtgttgaaatgcaaggctgcattatccacggtttcaaccgtagcaatgagggtttacccttgtattggctcttccactttacatcccgtacgtgcatgcgctagtagcggtaggtagcaggaataggtggttgatcttataaaatctagatttcaaaaataactaactatgggctttggcatataaaacgatcctgacaaactagcacaatttgatgatcaatagtaggttcgactaatcgacatgtggtgttggattattgagatcaactgctgacgtctagtgagaatggatatggttgctttacattgctaccgtcgaacatgttcttggaatacgagtattttggtcatagttagtaatagaggttgtgtttacttcacactaaaattgaaagtttggtttaaattaaaaggatgtgatggaaaagttggaggtttgtgtgtaggaaagttttgatgtgatgaaaaagttagaagtttaaagaaaaactttagaactaaacacggcgagagttggacagaaatagtgttcaaaataaccttacaaacttcaaatagtattagagttcgctttaatttttttgggacatttaagaaaccttactaatctaatgaaaccatttttttcaaaataaataaataaatgaaacaagcatttttagtgtatggaaccaaaaaaacgggaagcttgtctgtagattacatgctacaggcaattcaggcctcttttagttcccaatttttatcacaaaaagatcacgtcgaaactttagacatatgcatagagcatcaaatatagataaaaataaaaactaattgcacagtttgtatgaaaatcgtgagacgaatcttttgagcctaattagtcaatgattagccataagtgctacaataacccacatgtgataatgacgacttaattaggctcaaaagattcgtctcgcggtttccagtcaagttataaaattagatttttcattcgtgtccaaaaactctttccgacatacagacaaacatctgatgtgacacataaatattttcttttcgcgaactaaacacaccttcagtccgatgctccatccgtgatactgcaaccatgacatcgatggatgagtggcaacccacatctacacagtgcaactgtttacggctgcctgcatgatcaaattagttcttttgccggagctattttgccaatttggcccaccctagatgtttttttatcgatttagagggtgtggtgccaactcacatgtttctatggagtcatagagtaacatctactcctacaaacagagcacgcatgtgctgcaattgaaacacagttctaatcatagttgatgtctatccttgtgcaacagtatatgtgtacatacagtacaattcggtaggtcgtatgtgttagagtaggatgtacgttctctgcttgtagaataaacgaaaactattcgctgattgctgtttacaatgccgtacgaaatgtaggaaatgaagtggatttcgagacaggtacggtgtagaacacaggcgtcggtgaaatgtccaaacgtgcagggacagagtttcctctgttccaagatgtcgcgtttcttctgtttcacctggtggttttcctgccgttttgaacttgaggttttttaaaagtttaaaactcaacaccactgcaaatccaggttgtacagtcggctagaatggattttcgcatatagtttgagtgatcacctataacaaaaggcctataaaaatagtttgattttccacataaatgtccggttcttcgagaggttcgtatgcgaaaaacaattttcacatatgacagtccaaacaacccctcttgtgcggatgtattttagcaaaaaaaaaaaagtaaatttagatccaatttaacttgcagaggatcacaaattccacaaagccctagccacaattgtctttgtagttgttgagtcgaaggcctcgcagcggccaccatgaagaattccattgtggatcgttgtggcattggtcgattgctgttcttttagggcggtttgatttgaagtaaaaacttaccctaccaagatattggcaaattaaacaatagtagcctggtaatatttggtttgctaccaatacttacttatatcacacagatgctaccaaaaatatttagggccaatttggtttgatgtcaaaatatgcactaccaaattgttggcattttgaatagtagtttggctagtgtttggtttgctaccaaaatgtgccaataagacacataagttgctaaagtatttggcattaccaaaatttgcctatgatttggtattgccaatattttgacatggtagcaaaccaaacaagcacttatatttgacaaaaggatgcccttgatttggtattgtcaacattttgctatggtagcaaatcaaaccatcccatagttacctcggcagaagagtgtccttgtggcctattatggcatccattagtcctgtaaagcttgcaccttatccattgtgtcatgtaaagcttgcatgcgtctttgaacttgaagagtgacagcatgatggtcggctggtcgccatagttgggtctaaccttacccagcacagctatgttcaacaaaagcatgctacattgctacttgcacagtgtggtactaccaagatcattcttgagcactcatcattcttttgagtcgcgggctgcatacagttcaatatcacaacatggatggcacaaatgcatgcatacatcgtgtttagttccaaaatttttcttcaaacttctaacttttccatcacatcaaaactttcatacaccacaaacttctaatttttccgtcacatagttacaatttcaactaaacttttaattttgatgtgaaaacacacccatacatacatacattcaagtggtcaaggaaggttcacgaggccgcggcggcagatggggggcttccctccatattttccggcgccttttgttcaaacatggcattggcatcgaaactttaaaccaccaccaccgtatcgtatcgtctagcctgctatgctacgtactcgtcctactaccccagcagagcagcagcagctgatcgatgcggtagaagaggtgaaaccgcgcgcaaagcaaaagcagtggccaaaacgaaaaggagaagccccacacaaacgcaggagaacgtcaagccgtcaacctgcacaggccaccggccatccagagccacagccgcggctggccggccggcagcgagagagaggtgcagtggatggaaatcggaatggcacaacttgcgatggaagcaaagcgaaaggcgagccaatcaacgccccagccgtttgctccgtgtccacgaacacgcgccagtggccgcgccgcttttggtctcccctttccctccgctgccgccgctccgtgtcatcgcggccgtccatttagaacgaaggggatgacacatctgccactggcgtgtggggtccccgctgtttacaccggctgcgcgaaaggctggagcgcgaatgatagggccaaaatctggccgtgccaatgccattggcgaattcgcgttacgtctacgaaaatgtggtgttgaacttcttttttttgttcgagatgacagttacgaattccaaacggatcgttggagattgtcgtgttggtgtttgatgggcaaagatttatgactcgtgggctcataccaggatcctgtacgatcttgcagccgattccgccgtgcatcatgcgatcggatcacaacttcacaagcaatgcaaggcaagaggtaattggccgtggaatccaatacgatccgagttactcaattccggatccactgccctggcttccaacagattaatcaccaccaatcggtgaaaagagaacaaacacttcgcatgcatgcatgcacgcaaagattaatctgctcatgcttttgctttagttcgaaccaagccaaaaaaaaaagaaagaaaaaggagaatgaatagttccaactgccccgcggtgcacgagatgacggccgcagcgaggaggcaaaatcacagctgtggcagtagtacttgtacgtacacacacagtagtagtagtgtactactgctattgctactactaccacgcagcgggtgacacacacacacacaaaaagtcacaaatctctacgttttttttcctcgcgaggcgtagggcgcgcatacgcgacgcgcgccattatttggtccgcctcgtgcctccataaataccgcctccgtcccgtccgcctcctcccccacactccactccactccactctcgccgctcgccgttgccactcgcactcacaatgtcgccggcgccgcgggtgttggtgttggtggtggccacagtggtggcgctgcaggtgtcgccggcggcggggcggatcccgggggcgtacgggggcggggagtggcagagcgcgcacgcaacgttctacgggggcagcgacgcgtcagggacgatgggcggggcgtgcgggtacgggaacctgtacagccaggggtacggggtgaacaacgcggcgctgagcacggcgctgttcaactccgggcagagctgcggcgcgtgcttcgagatcaagtgcgtgaaccagcccgggtgggagtggtgccacccggggagcccctccatcctcatcaccgccaccaacttctgcccgcccaactacgccctcccctccgacaacggcggctggtgcaaccctcctcgcccccacttcgacctcgccatgcccatgttcctccacatcgccgagtaccgcgccggcatcgtccccgtctcctaccgccggtaaatataatctctcaccaccattcttgctgctagtactgcatttcttggtgacgacattcgccttggttagaggagcaggaacagtagtacttctaggcttgttttcttggtccaatggaagcttttgttttgttttgttttcatttcatttcgcgtcttttgagacggcgtggggctgctgctgctgctgcttctgcttctgcagcgttttggactccagccacttctgcttccgcactgctttattactgtagtaaataaatttgatacggtatactccagcgcgtagtggctgcacggccaggtgagtaatattttccgagtgggatggaaatgtgcaccgacggcgcggctttaaaagcggaggagcgtgatagtagcggctagaaacgctgctcactgcccgtaaaaagttggcttggtacgtagctataaatggggtgtcccgtgttcgctttgcccttgtgcatgtactcgtgtaccggcgctacgcaccgtggctcgcattgagccgagcccaaactctgcttagcgcttaatcactgccaattttttttccatacatttgcttgtagtagatctcatgctagtggttacattcccatgctttaattaacagtacagtagaaaggaggagtagatttttgggagcattggcctgaataattgtaccactacaccataaagggacacaaaagatgtacagggaaaaaacagcactgttactgtgcaaatgtgtgtagtgtaagaccactgggcgcactggcagcagcgagaggcccagagaaacatccaacgcgagtcaagcgtgtagttgggaggagtagtagaattccgtagggccaaggcgcacaggcaaaacgcgcacacgcgcttttgacctttttcgctttccgctgtgttgtcctggcccggttgggtggttgggttggtgccgccccgtgatcccgctccgtacccgcgcctccctcgcttcgctctccgcaaccttggcgtggcgtctcgccgtctcccatgccctggcgggaaagacgacggtgtgaggtgatgaggtgaaatggcaggtctgcccctccgttccttctgtggctggtcccctactgcaggggccttcccgtcctttcgtcctgccggcacaacgttactacgcgtgaggaggctgtgtggccccatctctgcatgaacgactgcactctcttcctggtcatatgtccttgcctccttttggctccttgctacctatagttacagcgaaataatatttgctcctactactagtattgttctgttgatcttgattttaatgtgataataatgcgtggttaatgagtgatgaaaatgttggcgtgtgtgtggtttgcagggtgccgtgcaggaagaagggaggggttcggttcacgataaacgggttcaggtacttcaacctggtgctgatcacgaacgtggccggggccggggacatcgtgagggcgagcgtgaaggggacgagcaccgggtggatgcccatgtcgcggaactggggccagaactggcagtccaactccgtcctcgtcggccaggcgctctcgttccgcgtcaccggcagcgaccgccgcacctccacatcctggaacgccgcacccgccggatggcacttcggccagaccttcgagggcaagaacttccgggtctgaattgaatgaagcaaaactgcaatataccctcttatttactcatctagtaattactgtcattatagcgagcaggtgtgttttttaccttggttaagtttgggttcttcttcggttggtggccttgtcaaagtgaggggccgggggaaaacaggtggtaaagactagtactagtgtcaattagggttaaactggtaaattgctagtactgctgttactcatcatcatcatcgctagtggtcactgctagtagtagttgtgctagtgcatgtatggttatggatactgcatcatgttggttggtgatggattttgtccatgttttgccaaggggtttggtttggagttgggggtgatggggaggatttgtgctcaaagagtggctgaagtggctgcaaagctgcagctgaatttgggggtggtgagtgtagcccgcagccgcttgtgccgtgtcatttgtctctatggcacttgatgtttatcatggacttgatttatcattatggtgattggagcttgtaagaagattaattgcctctgttcctctcgctctgtgtgtgtgttttatgtgatgttctggttgagcatttcagctttgtagtgctggaatgatgattcttgccggcttctttccgtgaatgcattctctgtgttctccgtgagttgctcgatgggggagtgccgaaattacgtgaaagggataaaggtgaaagcaaaagtgcgatgcgagtagaccgctttgggaatgattttgcctgttccgttgcctcagttcagatgcaagaatggttcatgattgcgatggcgtgatcggccattccattcctaagcacggcttgcagcatcatgcattcatgctggccttgcaattgccatcggagggctacttcaggattgggagttatcagtctgcatcatcatgggatggaagaaccaaatgcgcaacctctcttccttaaagtcaacatgctggatagccatcatcaggtgtgttggggccgaaatcaatggctttgacagggaggttagcatttgacagtgtggctatagcccatagctatttgataaattgttatccatctcgccggagatttcggcccaaaccacttcagcatgacaccatcagaccactgaacacaacagtagacaccactcagtatgatccaatgatgtgttgatgacaatgtacctatggtgcatgctgatcgatgagctaccaggaaagcttgaacccattgagacagccacgccagatttgtaacatgagctctactttaatgccatgagtttcgacatacaacagcatctagttagctgaagttaagaagctcatgataatgcacaaaaaggacttgttgccaaaagactgatgacaacaaggaatatgcacaacatatttacaaactaccaaataccaactaatgacactcacattctgccttgctaatgggagcggaccaatgctgttggattcggaccaatcttttcccgagtttctcccaagcttttccgacgaggcttaccgctgttcttgctagcatttgcagtaggggcttttttgcctgtacctgtggtggattcttgacgcctctctgctgctggtttcctgtccacatggctggattcttgaagctcttcaagaatagtgaccacagcttccatagaaggcctcatcttagcttcgtacgacaggcactcaagagcaagggtggcaactgtttgtgctccaacgtgagagtattgaccttctagcctggtatccaggacacggaatatcttgcgcttatgtgtgaggtatggtcgggcccattccacaagattgtgttcaccctggggccggttcttgtcaatggcacgacgacctgacatcatctccagcagcaccaccccaaagctataaacatcactcttcgcagttaaatggcctgaaagtattgatacaataaaacaaagctcaaggcatattgtacatgcacttctggtacatcgttctaaaaataacacggtgatgtaaatcactaaatgcacataattgcaacaggtccacagtaaataaaagctcacaacgtatggcaaacaatgatttgtttcccaacatccttccatgtacattttgcaattgagattaaactaaacatcaagccatatatatcattccccaaggagtgcgcatgcagaaaaggtgtatatgaaattcatggaaagcaatacattggagtgttcatatgttcatgcttagatgagttagattctaagctagatcacattcccaaagtcaacaatgcaaagaatgtcataaaatgacatttccgatgtggaggatgcgtaaaaaacaattccacgttattaatatgcttatagctataacaattcatgtaatttactgtagacaactacctggcctgccaatgtatgaattttctaatccaagatcagaaaacatggagaaaactgaataccaaaaactacacttcacaggttacctgttgaaagatattctggagcagcataaccatatgttcccatcaccctcgtggatacatggctcttctcaccaacaggaccatcctttgccaatccaaaatcagatagctttgcagaatagtcctgaacagtaatataatacattcctttcagcagggatacatgcgcactgaagtgaagttggttatcaaagatttactttcacttactgtgtcaagcagaatattggaagtcttgaaatctcgataaataacttttgcctctgaactgtgaaggtaagctagtccttttgcagctccaagtgcaaccttcattcttaggttccatgaaagaggctggaaatgcgaacctcctgcaacatgattcagatagcaatttatgataaaaggaacacgtggcaatagtgtatgcaatatgaaaagaatgcccccagatgagcagtggaacaggtcttgttttaacttactcctaaacagatgattttccaagctcccacgtggcatgaactcatacactagcagtcgatgctcatcctctaagcaatacccaaatagcttcacaaggttgggatggcaaaactgacctaggtaattaacttctgcctacatattgaatatttatacatcaaagttagaaaatatccaagtaacctttcaaaaggataaaaaaaacaagtatatgattgacaaaagctgtatccaatggtatacttaaaacaagcatggatttgaaggcaacacaacatagaatagcagtcatactcaccaaccattctcggtgcccttgcaaactctcctggttgagtcttttcacagcaacagcaattccagtgccaggcttgcaagcagataatgtattctcatcaatccatcctttatagacagatccaaaccctccttcaccaagtacactgtcaggacggaagttccttgtggctatcctgagatcactaaaactgaagatcttcacattggctgactgcagtatctcacattcagttttcgcagttggaggcatggaagctgaagaggctcgactactgcagccactaagcctactcccatctttagcaccactccttgagaacatccctgcatacatttggtacagttataatgagtagaaagcacatgactgcatttagctgtaatctagaagttctctagaaaaaagtcccagtactaatctttcccaggtccatagtatgatagcacagtaataatgtatataatgttctgaatgttcaattctatttttaaaaggaagctttgcacattaattaggaatcaactaaatcaatcatcagttgatccttcgctaaaatttggtatgagtcctgacagatgaaggatttgctatcagccaattgccacgcgcctacatgtagcactactagatatactagatttgctatcagcttacgaatgatgatgtgctctggtttaaaataacaaaatgacgattttgcatagagtagtagccatgaatataatgggaacagggggagttcccacccaaccagaaactggaaacaatcatatgcgctagtaaccttattccatcagaagtacatccgctaccatgcggctctccagaaagctcatatttatctactctatctttagtaataatacatttcttaagtagccgttatgatatgaatcaactaagttcaaatcaaaatgaagcacctgacatagaagtgagctatagtctttgtaattacatagaactttaatgaggcatacacggtcattttcatatattcagattactgaatactaagcaaataatcgatcttgatacaaccaaaaagtgtatgttgtaactggaaaagagaaaaggtttgtgatgttatgtctaaccgcctcaagccatgtaaagtacataatcaattattgacagaacattgctaaatctgggcggcaaaccaaattaaatagacaggacgagtaaaaaacacacacgatccaatctcataccatagcatcaaattcaaactaaataagaatctaagatttttcctcattctatcaataatttatgaactaacaacacataaaaaaaatcaattgcaatagagaaacaactaatctaacagtattgtttttcttaacaagctgtcccataaattcttttgagacattttgcaacaagaacatataatatgtcaactgcaaatattcacaacagaatgccataaaaaggttactatacgcattactagcagacttgcttcaatcaaatgttacctttcgtcgtcaacacaatatattatagacatcgtcatgccaattacgagctgccatggttggaggaatccagtactgggtctatccagtagatggtagtacaacattactacacatggtactagttaacgatatcaagcaatgaatgaagcctggatatccccatcaatacacataagaatgtaccccctcacctaataatttaaggccttagctccaatggcacaaccacctacagagccttacaggcacagcacagccgaagcttgaactaaacttctctaaaaaaaaagtgattgtaaagtcttacgttggcacatagcttaacatattgaggatgccacggtgtagctaaagggttgaaatcatctagtcaaattaacaattggatcatcaggagtatgcctatctaacaagccaaatcatccaaacaagatcgaagtagcttattcacctgtactgtggaaatcaaaatttctagaagaaaataacccgaatgctaatgttcatacgattgcaacacaagctaaattctgcgcagcaacaaagactccacggcttcgaaactccaccggaatcaccataaactaatcgaacatgccatcacatctcgtggcataaacaatccgagtaaaatggaaacggactgaaggaatcatgcatctacgcgattgaagccggcaacccatcgaatcatgaaacaaaacagcaccataaccaggcaaagcaagcacgcacgcaggcagcaagagagagagagagaggaaggatcgcgaagcataccagaggctcccggttgcgggctcccatccttgatccgcgcgccccacccacagcaattccccatccccctccaacaagcgactcgcccgcggcgccgagcccagtcaggatcgaaccaaccctcccgccgtcccgacccggcggcgccgcatggggtgaggggggaggagagctccacctagggttttgggggacaccaagcgcgaggcggaggcggaggcggaggcgttggctatatagcgacgaggacgaggtgcgctcgctggcgagagatgtggcgtgcggcgcgtgaggtgaggcgagcgagtgaggagttaatggcgggggcaagggaagcggccaagcggagagggagagggagcgaggcggcccgcgcagccacgccgctgctgctggctgctgctgcttcccgcgtggcttcttccggggaaaagggtggttggtgacggggagcgtggggaggaggaaaggcgtcgtggtgcttggtgtgtgacgctgccgcgcggggaccaccgggcctccgggtgcgacgattttttatctttttaccgcttcacctctccgagttactgcgcgactctgtgagtgaagttacagtgacgtgagactctgtgggctttggcccggtaggcccactaattttattatgggctcgacttattatgcgtgagcatggcccaaataaaattgtttacacgcctgggaacacctgtaacttgccctccaacttatcaaccgcggcaaaaattaaattttacaacttcattttagagtaaagtttgatgttttttgatcggtgtttattttttaagtatttgcttttaagttgttacaaacacatataaatgttttacgtataacttttttttgttgctaacaagtgttacgacatctaattagttgtaggtgaaatgtacagattattttttgatgttgtcgtaatagatttctgtcggcaaaacgtgcaaatatcaaaggaagttttatgtaagggtggagctaatgtatttccgccaaaaaattgccctatgaagtacctttggtgcaattttaataccaacaatacaacatataacgatctctttcatttggattgcgatattcctttttcctccaaattaaattcctctgttgtaaagtgggctttcatgcctagtgtagtgtatggaaatatcttgatttcttgagcacaaatataaaaagtacgtacatattgtatgtgacaaagtgtacagatcctttgaaacacaaaaatcgggatctcaaaacacatagtatggatttgcgcctttgaatggtctatccaattgttcagtgctacagaacatctatttagcgatgtattaggattcattccccttgaactctgtctttattaataaaagtttatgagttttttttaaaaaaagaatggtctatccaattgttcaaaaggaatttagggagaaaaatatcctaaaaattatgacagtttaatcttagaaaaactgatgtggcacattgtgattcaatcttgatttttataactatccactaattaaatctgacggttgagattcttttgtgtgtaagaatttagcgtatagcatcaaattcgtacatgttgatgggtgagagggtataactacataatatgcctcactattttgtgtggggatactgtaatcccaattgtaagatcggataccgtaataaactggtaaaactagacaaaaactatcaaatatggagtttttgttttaagttttttttaatctaatctgtttctgagctattaacgttaccaaaaccttgttagtacggtaaatcatgttgcacactctgaaccgatcttgcttgatcatgactaaatacgaatattaaaccttcgtgatacaatcatctcattttttaaattcgagtaatttggtatatgatgcatttgttctactccaagtaccttctaaccgatttgaaaatgcttaccttaaactccactactcaacaactactagcgtggttgtttctcttttgacaacccgttcaaacaaaaagagatgggaaaaaaaaaaccggcctacaacctttgggccgggcgtgttgaacccttcggacccaggcagatctccccatctccgggacgggacccggcgcgcacgcgacccgacgcgacgacgcaagcagcagtggtgggtaagggtggactcgactccggccgtcgcgatggcggccgccggctggccgctctcctcctccgtcgccgacctcctccccgcctccctctcgctcaccctcctcctcgcctccctcgtacaccctctccccccctctgcccccttcctcctccgcctcctcgcgctacttatcccttctccccgcccctcccgtgcgcaggtggtcgtcgtggtgctggccgccgccgccttcttcttcgagcacatccgcaagatcggatgcacgcactcgtaagcgattctgtgactccccccaatcctgtcgttgtttttgctcatggcgatctgcgtgcgtgcggttgtttgactggtgtgttgtttctggatctcggccgcctgcaggctggagaggactgaagtctcggccgctttcttcgaggaccccaactcgctcaacaaggtaagcgagggattctgtttacccacttcaaactgagtatccttttcccgctatttgtttccggttgctcggactgtgaatgttgtgcgcgttaggtgtttgttcatttgctcctgtaaactgtgctaggttcgttgcccttcaatttacgaccctgctgagaagtacatttcgttgatcatccccgcttataacgaggagcaccggcttcctgaggctctcacagaaacactcaagtaaggctctgatatgagcatttcctgttcctgttgctccgttgtttggagtatctttgaatgatacagtggctgtgttgttctggtcattgctctgttatgttaatctctgtgttcttttgtttctctggtagctacctgaaacaacgttcagctgtcgagaagtcatttacttacgaggtatgtcagggcagaacatgctaacagctttatttgacacagtaatacatcagggaagaaaacgttaggctgattttgcaagcaaaactaatcaagcgtaaatgagaaagtatgcatttcaccatcatgagatatgttagcgagctggttaatcacttcgccacaatggtgacaccgtggcagtccattagtcttgcaatagtaactgtttctatgtcatatattcactttttacctgagatatatcaatatcttgtttggaatgacatttgaatcactgaatttgttagctaggaaatgcacagtgtgggagccaaacactattgatccaataaagcatttacctaaactggtgtgtcaggttgctcggaccttaaagataggactttgtatctagggtagtgatgttttgttgataccgcttgctctttagatcaattgagaccataagctatgatgcctttgcaatgcttctgaacatatcagccatatctctcaattatatcatgctctttaaacacatattatgtataactcttattaacatttgcactattatatactgcataacaccataaccagatatttggcatattattattgcagaaccttttattcataaatcctgcttaaattagctaacattggaaatcggagaactgatttgcttttactgaatttcataaaggtcttgatcgttgatgatggaagtactgatcatacatcaaaagttgccttcgagtttgtaaggaaacataaaattgataatgttagagttcttctacttgggagaaaccatggtaaaggcgaagcagtcagaaaagtgagtaaatgtaccagtcgatcccccccccccccccaactcccctcactagttcaataaacacacccaccctcacccaaactagttcaatgaaataagcactgattaattctttcccatctgtggaaaaattgtacagggcatgctccattcacgtggtgaactgttactcatgcttgatgctgatggggcaactaaggttactgatttggaaaagcttgaagcccaggtctgtcataagttaaatcaaaacatgttttataaagttttgttatgcatactttgatcgtgattggtaacatcttggaatcatatcgtgctcctaggttcgcgcattggctaaaaaggctgagtccagcctagcaccatctagcagtccatctcagagactatctgatgctgaaattgctgtttttggttcacgtgctcatctggagaagcaggctcttgccacagtaagtgccccccaccccaaaacaaaaaaccttttcaatcgtgcgtttttgttctcttagattttcatgttgtgttgtatttgtgcttttcctggcgtactgcagaggaaatggtatcggaattttcttatgaaaggtttccacctggtagttttattgacagctggtcctgggatcagagacacacaggtatgctttgcaaacataagtcgtaccattaattcatgtggacagttttgctttggtattgtgctatgaactaaattccattttcttattgctaatttagtgtggtttcaagatgtttactcgagctgctgcaaggaaactttttacaaatatcagattgaagaggtacctttgttgttatgttctctaaatattgtcatgcttctgtttatcaaatcctgtcttatttttggcgtgtaaccaggtggtgttttgatgttgagcttgtatacctatgcaagcatctcaggatcccaatggctgaagtatctgtaaactggactgaaatacctggatccaaagtgcgtatgacaagcatcctgcatatggtatttgagctcctgctgatcaaagtaggttatggactgagcatattggaaatctattcatagt

SEQ ID NO: 29618 - DNA, 9592 bp, Oryza sativa
  unsure (1)..(9592): unsure at all n locations
ccgcgcccttgtttgattcccttctactgcaagtcgttcatcatttaatttgcggaaacaaaataaaagaacttaggtattatcagtgtcaaaaaaagcagcggaggtgacggactcatggcacatcagtttatgttgtatgtcatcctagaaatgcttgtgctagctgactagctccaccactccagtcctctgatcctctactgctcctgtatacttcttttcactgaattttcagtgaattggttgttgcttgttagtactccctctgtcccagattataaaaggttttaaatggatttaacacatcataatactacgaatctatacaagctttctgtctaaatttgtaatattatgatatgtcaaatccacttaaaattccttataatctggacgacaggtgctatattggcatgaggaagagcaattcatcatttacgattcaagacaagaaccatcaaaaatgtattaaacctgcttagattaggtcatatatacaatagatttttttgaactagaacaaattatttcattgttcttcagacaaaagaaagaaccggacaaattaatcatggccattagtacacactttatgtaattattttcctttaaaaattatcttggtctgatcaacgtcatccacagaatactatgcaggttggtagtgcttgttgtaaaacagtgtgtaacagtgaaaccgacattttttgcccctgatatgggctacacatgggagagctagacttttattttaagaacaagtaaatttcacaaaactactggtattttggttaaattatcaaaatattatagatttaatatgatgtatcacaaaacgatatatttaacactaaatttatcacagaactacagatttaaagtagaatatcgcaaaactatatatttagtagcaaagttatcacaaactaaaagtttaatatcaatttaatcacaaaacttagacatatataactcaaacatagcattggtgctaaggatttaaaccctacaatctgtagctttatgacaattttattagtaaatttgtagttttgcgatacttggcctttatgataattttattattaaatctctatttttgtgatatatcactttaaatttatagttttgggatgatttagccaaagtatcatcacattacatttactgtaagagaaatgatccccacaagagagagagaaacgaaagtgcaaaccattcctagaataacattacatttgctggaaattaaaattcatccatctttgattgcacattatgtagtataaggtggcatcacatttttagtcatagtaatcaaacatggtaaattgacaaacttcagacctttgggttggagaatttgaaatatttttgacaggtttgaatcaatttccatgagaatttaacaaccagacggcatgtgcccaaaaggttctaaaatacttccccacttcggttcagatgtgaaatttgttcaaaatttatatgaggctcctattagaaatttgatgagggctagagacttacacatgatcccatctcttaaaagtgggttgaagggtgccaatcaatcacggttgtgcgtgtggtgtgagtgtctagtggtatgtgtgcaccctgcatgatggaacaatcccaaatttaaggaaccaccacgcacctaaccctgagcatattgatgttcaaactagtcattaatttttacatagacacgataatctcaagatatatcggtctagttttccagatatgctcatagagatagatgtgagcatttataagggtgagtgtgcgtgtgttgtgatcgtccgcagttatacctgtttctcgaaagaaaaaaaaagatgatcaaaatatttcaattgacaattagtaaatcatcgagttacacattgtgaacattttagtcactaaaacatatgaaagaaatatgaaacatgtaaataccatttgaaatatttctctattttcttagaaaaagtgttcctttcttatatgaaatatcaaattttaacggttaagacatactccgtatattttcttacgcataaaatattttaagggaaaaaaattaaagcttgctaaggagctttattctttgtatgaaacatgcagccatcaatactaggtatctagagagaggagggaaaatgagcatgcagagcgtcctatgagcaccctcgaggcatatcttatattgataaaatcactataggtgtcttgctttctatgagtgctgtcagggttatagataccgcatacccaatagtaatcgactaagctcggcgggcccactacataccaagtcttatacggaatcataccttgtatatagaaggggttccagataagtaaggacaagtaaagttctatatgaaaacgacaaggactagattgtatccatattggtcttcctagtcttatttggacaaggaaacatctatgggtataaatacaagcccctaggaggagaggggacacgccacaaagccacaagatcaacacacaatacacaagccaacacacgccaagacatgccgtcgggtatcaacatcagagattagcctagacaaaccccgtccggtttctacggaggccggcaatagggatctagcagcatatctgatctcggcgagtgcggattcgaggaggaagactaccctgtcgtagtcggttatctagccgccaagtcaacgacaacaagataagttatcccaaatattatacttgtgtaattcaaatgaataaaggagcaacaccggcttcagccaacaggatgtaggggtattacctgtcagataaggggcccgaacctatataaaaatccttgtctctgtctcttttactccaatctcgcatataccctagtaccaatgatccccataccatctaaataccgtagtcgcgatctcaaacgtcgacaagtgcgttgcctaccactaaaaaaataattaaccttaaatacaattgcttatgtgaagtgtaggacttggacctgaatgggccaattccagctaaaggaatctattgagctactctcactttgattgaactctaatttcacgaagagatgtcctctcgtttattatatgttatctaaataattataaacaaactgataagatagattaaataattccttgaggcaagataaaaatatttttgccttctgaaacagatgttgagtgatatatcatgtataaaactatcttttttttataaatgtttagatggtatatatgaaaatagtttcccaaaagaagcctgtgggcgtaaattaggactcggatcctctacattaaaggaaaaaaaatgcaaagaatctacagtacacttgcattaggcatggtttttaccgttggatcttcatcaaacggctagaaacggatgttacactgaactcgaatagtagaaggggaataataatattttgtcaaccggtcaaacccacactgtgcaagcagtttttgctacagtactactatactgttctaacagtggcccttgcattacaggagaggatccacgtcccgtaaattatttcgtcctttttggatatcactgaattatttgcttcatgttttctaaaatatactccctccgtctccaaatatttgacatcgttgacttttttaaatatatttgatcgttcgtcttattaaaaaacttttatgaaatatgtaaaactatatgtatacgtaaaagtatatttaacaataaatcaaatgataggaaaagaattaataattacttaaattttttaaataagacgaacggtcaaacatgtttaaaaaagttaacaacgtcaaatatttagagacggatggagtatttgcttagaaaaacctttccagtagtactcattgcttttttttttttttgaacattgtactcatggcttgaaaacttatttcaaactattgactccatgaaaagtatatgtcatcgagttgcaacttgcgacgtcgtacaactccatttgggaattttgcaggagcgtttacacatggcgaagaacacgacgagcggttggcagttagccgctgactgaaacgcatgcagagacaagcatttcctgcgaaaaatcaacgccgattccggtgggcgatcgatcgatcgacggctgcatctgcgcatccaacttgcttagcttgtatcttcgtaaaacggccacgcgtgagtgagcccgtcaccctgcgagagatgtaaggagggcatgtacaaaagatagttcgacacgacacgatctcttagttaatacttctgcaatagttaaaaaaatataacctcttaactattactacatcaaaataaatttttattacccttattttcttttcttctctccatctccatgtaacaatatttcagttaataaatgctaccaagagttgaaatctaaaccgttgtcatacgtagcaacgctgtttttttttctttttttttcttttcacgtcactaaatttatatgcatatcaatcgaaaatcaaaagagtacgttaataaatatcattgtacatgtctaagaaaaacggacgtgaaaacgtgcacgctttaatttactggccctgcatctcggctagtttccatgcagaacagcggcgctagagacggcgtatgcatgatagatgtatgtatctcttggattgatgacgtttgctggaaatttgggagtcaatgcaaatttttatgttttcaatgtattatatctttgtgatgcatacaatatcttctcagtggactatttaatctccaggatttgatacttcatagatttcactcaaattaatgagtgctggagctattgtgtatgcatggcaaacattaattagaagatcaaggaaaaaaaatatagtgtgaggtattagctatgtgttcaatactccaccactaaataagggagacagattttgactccaaatttgaacgttgtggatagctatgatcccaccaccacatatgtgatgcttcccttcttttcggaggatatgcaacatgataatctatactccctccgtccaaaaataagtgtagttttgcactattcacattcaaggcaaattttcaaatttttcacaattttttcaaggcaaattttgctacaggacatcgcaattgtgtggttttaactcagggacaccgcgaaagtgaagttttgggggaagacatcccataatcgtggatattagccgatggacaccgtgccatttaaattagctcagggacaccgtgaaagtgaagttttgggggaagacatcccataatcgtgaatattagccgatggacaccgtgccgtctaaaggaatcttgccatgctgacgtgacggacggatgcccttttttgacgcggttggacctaaatgcccctgcgccttatctccttaatgtttggccccacatgtcatcctccatgtctggccccacatgtcatcctcaatctctctctctctcatctacaaggagaagactagagcaaggcaggcgacgaccagagctgggcaggcggctgacggcggccggagctggccgcgaagctgagcagagcagtagctcagcggggagcaaagcagagcagcagcacgcacgccctggatcccccgaagcaggaggtggtcaagccgtcgccgccgggccgcatccgcaacagcacgccctcctcccccaacctcctcgtctcgagcgccgacgccgatgccaagaacatgtgctgctactccgcgctgccgagcgcctgcccctcttcccctctctttccaatcctctccagcggctcccacgcgcgtgcgctcctgagcaagatacggcaggcgcgcgacggcacgggccgaggcgacggcggcggcctaaagggagcctggcggcgttgagtggatggggataaaaggctggctcagcgaggaggtgccagggcagcgccgagcagaggaggcggaggtggaggcgctgggtgatcgcggaggcggcgcccgtgtgggccggcttggccgtgcgcgggggcggtgctcgcagcgtggtggtggccccgagcaagacgaagacagcgggtggtggcgaagcagcagtggcgcgcgggtggtgctcgcacgggagatgtggccgcgcgcagtggcagcggccgagcgtggcgacgacttggtgcggcggcggagaggggagagaggtagctagcggcggtggggaatggcctgacgggaaggcctttttttgctgacgtggtgcaggggtatttacgtccgatcgcgtcaaaaaacggcctcccatccgccacgtcagcacggcaagattcctttagacgacacgatgtccatcggcaaatatccacgattatgggatgtcttcccctaaaacttcactttcgcggtgtccctgagctaaaaccacacaattacaatgtcctgtagcaaaatttgtcttttttcaaatgagacggacggtcaaacgttgggcacggatatccacggctgcacttattttgggacggaggtaatattttctttctttcttatataaaaaaacaaaccacataaaggaagtcgtgggcttaaaaatccacatcagtaacacactacataccttgtccacgaatacaaaaaatgattggaggtgtgaggtgagaaaattaaataaagagcggtggctaggagaaatagtttttgtgaatacttatatttgtatggcaaataaatattaaatgctaaaattctttatatatagtctatgaatctttatatgtgtaaataaattccaattattaggtatccttatatatacatatgatgtatttcaacttttttaaatgggaggtgtatttctactttgaacatgatgaattgagaaagttgcaataggggtcaaatctcttagatatttgtcatcccttaattattttccaaggatagtagttggcgatatttggtccaacgtttgtttgtagtaaaaagtaacggcaggagtacaaaaattaattaagtatggttggtaaaagctcattgaattgcatgcggctgatgaaaaaaacgtcaattttgtcacagatattttcacaccttaattactactagtattttacttaagcaagtcatctctaaagcagtgaaagactgaaagtagtgagcactagccactagcttgaagataaacacgccaagttaggccacagattatttttttttaaaaaaaaacacgccaataattagtgtagcaaaaaaaatccttgaattcccattaatgcgtcgccttcaaagattttttttggttagctagactaattatttccattttttcacaagattagactaattcaactaattcttttcatcgattcgcctttcacccaaaatcgatcgagctctcctttccctgattcgattcgttataggcccatcgatcttactaataaaatgattacaaatctaatcaacagcgaccactgactgaagccgcagtaatccggtcagtctgcgagtgagctcacacctcgatcctcgtcctcttcttcgattcctcctctgttctcgctggccgtacgtgtcaagcgtatccagcacacacggctatataaaggctgcacctcgagccccttttcctcccaaccaaccaacctcaaatcaaatcaagaacagctcgtgcttagatcgctctctcgcttgctgttcttccaatccactcctcttgtttgtggcaaagatctgggttctttttttttctttttttgccgggtttttttggagaggttttgtgagcatggagggtttaaggggcggcggccatggcgaggcggcggtggacggcggcgacgagaggtgggtggaggactcgtcggtggattaccaagggcggcctcctctccgcgccgccaccggatcatggaaggccgcaatgttcatcatctgtaagccactttaatttctcgatgaatctttgtccgtacgtgttcatgtgatttcttactgatcgactgagtgacgtgttcgtcgtcttcctcctcgatctcggcgtgaattcgatcgattggttaaatgaagtgattgagttcagcgagaggctgagctacttcgggctagcgacgagcttgatgatctacctgaccaaggttctccaggaggagatgaagttcgccgccaagaatgtcaactactggaccagcgtcaccaccctcatgcccctcgtcggcggcttcctcgccgacggctacctcggccgcttctccactgtcctcttctccactctcatctacctctcggtcagctctctcactagctctaatggcgttcctcgccggcagcgagcgatctctgatgatgatttttgttttgttttctgtcattgcaggggttgattctgctggcgatatcgcagctgtcgccgaggctgaaacccgagcgcaacctgcacctccacgagacgctcttcttcgtggcgatctacctggtgtcggtcggcaccggcgggcacaagccggcgctggagagcttcggcgccgaccagttcgacgacggccacgcggcggagcgggtgcagaagatgtcctacttcaactggtggaactgcgcgctctgcgccggcgtcctgctcggcgtcaccgtcatcgtctacctccaggagaaggtcggctggggcgccgccgccgtcgtgctcgccgccgtcatggccgcctccctcgccgtcttcctcgccggctggcgccactaccggtacagggtccccgagggcagcccgctcacgccgctcgtccgcgtcctcgtcgccgccgcgaggaagaggcacctccacctccccgccgacgccaacgagctctacgaggtgaagccgcagaatatcaagaggcggctgctctgccataccgatcaacttaggtgaccacttcatttcaactcacgttactttccttgccccttcttttctcgcaaaaagacactaatcattgacgcacgtacactgcaccacggctcaaccaccagtcgacccaaaaacttaagctgacgagagaaaaaaattatcgatagtgaaaatgataacaatatttgatcacgttgtaaagttatacataaggacttaccttgtttatccaaaagcttaaactgacgaggaaaaatgcaattgtgattgtaatcatggaatgtgtggatgacatggcatggcaggtttcttgacaaggcggccgtagtggagcacgacggcggcgaggagcggcgcggggcgtggcggttggcgacggtgacgcaggtggaggagacgaagctggtgctggcgatggtgcccatctgggtggcgacgctgccgttcggcatcacggcggcgcaggtgtccaccttcttcatcaagcagggcagcgtgatggaccgccgcatgggcccgcacttcacgctgccgccggcgtccaccttcgccatggccgccatcggcatgatcgtcgccgtggccgtgtacgacaaggtcctggagccgtacctgcgccgcctgaccggcggcgagcgcgggctcagcattctgaagcgcatncgcgtcggcatcgcgttcaccatcgtggnccatgcnngtgccgcaaaaagtgaaaggcagngcttncgnagcgccttgccgcgtt

SEQ ID NO: 29619 - DNA, 4607 bp, Oryza sativa
  unsure (1)..(4607): unsure at all n locations
cgatgtcnaatcgcctatcattggtacattagttcatcaatacgtggctgggacacgtagttggatcaacaagaaagggtatgcatgcatgcgcgcaaaatctggtctgacggacacctcgttcctcctgcacaagtagaaagggatgaagcatctccagtttctactataaatacatcacaatattgacacaaactcaacatccagcaaaaccaagcacacaaacacatacatttgcccaaacttcaaccatggctctcaaatctgcagctcttctcgccattgtcatcaccatgagccttctctcagtggaggtcgccaatggctgtggtgacacgagctgctcaaacccatccccaccaccgccgcccgctgtgccaacaccaacagggggtacatgccccatcaatgtgcttaaccttgcggtgtgcgctaacgtgctcagcttaaatgttccttcctcgcagtgctgcacactgcttcaagggctcgctgacctggatgcagcgctttgcctatgcgctgctcttaaggcgaatatccttggtgttatcaacgtagacgttctagttgatgtcactctcattcttaactcatgcaacaggacatgccctcctggcttcacttgcccactctaagtatatatatatatgcacctcctgaatgtgtttgttttctccgttgttgctgttaccttccagtgagtgctatgtaatatcgcaaagccttatgtgcttatgaataaatgttccctttccattgaaagaatgcatgccttatttgtgcactgttgggttgtttctttgtattgtgttgtacatgttgtgtatgcatttttgttcaactagataaattactaatgtgcttattgtttagcctcgggaagcacatttcatgaaaatatatatggcactagttggactaatttgcacatgaaaatgaaataaatggtaccaatggtttgtttgctaaaagaggattgagcttgcaaaatttcaatggatttctttttgtgcatcctagatctactataaattgtaaattagttccgaactcattttgtttttttagaagttcaaaggactgaaaaatctaacaattagaaaaaaaatgtgcatcccctagtcatgctatcatgatgtggctatatggaaaaacaactgggatgcaattggtgattcgatgttgaacaaccacatcaacaatttagacaagacaatgtcgagaaagctactacctccatcccaaaatatagcaattttttactatgaatctggacacatagctaaaaatgcttacattttgggacggaggatactcgataccgtaattgatggggacgaggctgagccgctgattatgcatgtcacaactgcgatgagacttgtcggcatcgatcaccgtcaccggtgggattcctgtgccacctcacgcaaaaccatgtatatgcgctgccctattctggactgcacaattgaaggacaggagatataggaaatttggcagtacaaaggtcataagcatgagcttaaaatttggccacagtaggaaagataaaatattgtaaactgataaatattccaccttgttttgaattagattttctccgttcatagatggttctcagcctcctaggtgtttgtagaacgaacccagcatagaggtgtgttctctgagcacagacaatgacaaaagtggggtggaaaaattcgcctatgcatggacctaagcgtgatggctatttgtcgatctgtataccagtcagttgttgtcacagctggtcttcggaacacgtgatttgccacacaacattaccaaggagatcaatcagcacactcgcagcccttcactgccgaggagatgaagcaacacgcaattcacgggatgaaacgatgagttaagactacaggctccctaagccaagtcagtcgcagacgtcgttgccattcccatccaactctactagcccttccaaacccccctttatttatgttgtcgctgcagtcgatgttgctattgacaacaaccatctcatagttgccatcgatcacacccagatccagaggccctaagctcgtgtcagccatatctggcaacattgagcacatgctagtcatataaggcccatagtcgctaatgtctatgctcagagagacaaaggaggggctggtgccaagacttaggaagttaaggtgtctatgcttagacatgggatatgaggggtccgatggcggggatggggaaaaggaggtggcaaatgtgagtatagggaggagggtgtggaaccggtgctagaaaaaggggcatgtcggctggacttgggaaagagaggatgcggcagtgggcgagcaaaatgtaggtggtgggtaagagctagagagatggggaatttgggagatagcgacttttagatgggataaatagacaggcacggtttatttatatttatagctggcgagccggcttaaccgttggttcattcttgaaactgcctcattgccggttcaatttcaaaatatgttttttacagaatggaactttactaagcgggcagtcataatgagaatgatcatggaaatgtaatacagtatatatggttcatatcacaaatagttatgaaatactttgctattgtcaaatgatcattatttagggctgtgatgtttcctgattggctgaaattaaattagtgttaacgtattgtatatttttacattattatactacttgaaaaattataataatatatttcatatatacaatacagtttgatgaatcggtgaaatgcttacaacacataatgtctttaatcaagatcaaaacaatagcccttgtatatacactcaaatcaatttatcaaatatgttagttgtagaacaatgtcagagttccttgtaccatgatagaggatacaccatcctgtcataaatatatatttgatgtttagaaaaaaaaatattcggttaaacttttcaaacttgacgcgaccatattttatattagaaaaagattataaaatataaaaagtttatgatatatatattatgatagcggtttcctaacaaatctatgcaaaacatttttttaaataactaactttcaaacttattgatggccaaactttcaaacatttgttgaagccttacgctaaacgttaccaaagaaagtactaatacaattaatcattttaaacagtagcttgcacactgacttaaccagctaaatattaagtttttcataaaactaaagtcaactgctctgatctataacatacgtggatgcgacacgtacgtggctagatgtataggaataatttgcatgcattgcacgcacgtattcgtttatagacacctcattatattctgatcacctcctcctgtgagcacaatgatccacagtttttgaatgctaccatgcttcactagatttgtctataaatatatatatctcaccttagtgaagcaaaacacaaagctgataggtaacatgtaaaagctttgtactcatctaatagagtaaattacatccacggtacatcaacttggcaggtagatgtaatttggtgcaataacttgagaaataatcatttacaacaacttaataggtatgtgcaatttagtataagaattttataagtgatcctataaatacaacaacttgcaagttaggtacgattttcatagaacaaataaaaaggttatgcggcaacttaattatttggagcattttttatataaattcatttttaagtacttattttgacaatatactatcatggatttgtataagtatatttatatttttatcctaataactaataattaaaagtcaattaatccggatatagaaattattatattttggttgatatttgagaaggtgaagaaaactaaaaaagttcttaaagtaaattagatgtaaattgtactacataagttttaaagattaaattcaatattataagataatatccgtatgattattatgtaatggcatattgacatcgagaaaaaaaactcacctagcatatgcttagcctagttgatgcacaaaaatactaaattgttaagttcttgtactaaaacgcacctacttgtcaagttattgcactcgaacgtttaattctcaagttcttgcactatatcgcaccaatctgccaagttgttataccatgggtgcaatttactcacaataatataacaacttttagcattcaggatttatcttaaaacatgacaacttctctaccaacattctcttcccaacttcactaaaaaaattctctttccaaccagtcacaaccttccaccattcactttttccaccgtcatctactttttaaccaatcacagcatcttccaatttaattccacctacttttttaataaccatatccaactgtaaaacttcttatattctgtggcagaggtagtagcaatttgcacacctttcacaagtgtacatacgcaaccatcaaccttttggttcagcatccctagcccttgcaatcaccctaggcctcctcttcttggttactgtcaatggttgtggtgatcagacctgttcaacattnatangngnatnctncntgaacctgggntaacagc

SEQ ID NO: 29620 - DNA, 1171 bp, Oryza sativa
  unsure (1)..(1171): unsure at all n locations
ccccatgatgactnctctgcgggccgngnatnnggccacctttccggccagagccaactcggcctgctgtttgttgccccagaggaggacaacatggagactatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaactgaaccgccgccagccattcaccatccatccagacagccatccagccagccatccagccagccaaccgactatccatcctcaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttcacgaacgggaagtctaacctacatctaactagggaagtgctttgtatttgaggatgtgcggactctggggttctgaattcatgaaacgactgtcaacaatggcgat

SEQ ID NO: 29621 - DNA, 1862 bp, Oryza sativa
  unsure (1)..(1862): unsure at all n locations
tgccccattganagtcacttctcctggtacagaagctcatcaacaagcgatagtgccaagcaaaataggtgtgcttttttcttgatctaccatgtatacatccaagtcacagctggtgacaacaaatgtcatgccctgtcgtgcaaaggtaaaagaatcccctggatttttccatgaaaagttgtagacatcaccaccggaatttatagggatgacatgggtggaggtgatcggaattaagttgaagtggataaaatagatattcagaccatctaccccaatatcaccaagaacctctgtcgatccattgttcaggaagagtttaggaggctgagtggccatgtcgcatgtgagactgaaatcgacatggcggaaacaaccttgtcctatgccaaagggataatcgaagctcaatttgccgcatctctttggacagcgagcgagtgtagaagtggagggtagggatgcattagaaggacttggattggtaccatgatccagtaggaaccttttctccaaccgtctggtcataccctctggatatggggtgatgagatggccataggagaggactggactgagtgcaaagcttctcttgacttgagctatccccaataacacgaatgaaagcaaaggtaacatggtgttgaggtggcccatctaaactctgccaagctgctaccctctcagaagtttaaatataagtgtgtctagagctatgcctttcagcctttgcctctgctcttacagttggccctctatttataacagaatgaaagctagtcaatttcagtgggtagtgacgaaattttctataaaattttcaatattgaggtggggaaggtgtttatacagtatgtggcgccacaagctcttgctacgtgtattggattattcaaactaccgaacgttgaattgtacttatatgctgttggcaaattagtacatgtagtggttggaaagaaggatgagtcactgcatttcttgggacaaaaatatgttaatgtctaccctcttcgttttatattataagatatttcaattttttaagttatatttgtttaaatttaatcaagtttatatatagaaaacactaaaattttcaacataatacaaacatatatattattcaaatatattcaatgctaatatgattagactaatttagtattatagacgttgctaataaatttatctgtaaatttggtcaatttaaaaaatgcgattagtgaaaacatataaaataaaatggagtgagtaaaacattttattatatttggcattggactaatggatttactgttatttactcaatccaggcagtgctatcttgccacccggtgtcaaaagagaagacttcaaacatgtcgatataaaaacaatgacacggagagttactatcaagcaggtgacaccgtgtaacacaaagcttctcttgacttgagctatccccaataacacaaatgaaagcaaaggtaacatggtgttgagatggcccatctaaactctttgccaagctgctaacctctcagaagtctaaatataagggcctgtttggtataactccaactcctaaatataactctaggagttgaatttggagtggagttgaacccnnccgtcctctgtattgagacccccgagaggctcgctgctaggctacgcgcatatgtgcncgatgtgaccccttcttataaaaaactccactactcccccaaaagtgtttcaaaaactatgtgtgtactacccccaacatggttaaaattatccgtttggttcaatactcggcaatatgttaatttttttgcgccgctgtctcctttggaggtttttttccccgatgaccaatttttcttttctcc

SEQ ID NO: 29622 - DNA, 25162 bp, Oryza sativa
  unsure (1)..(25162): unsure at all n locations
tgattagtctcacaataaataattcgacccaattacactgtagttcagttggttgctggggcctgttcaacgtggtgtagcgttgattagtgaagatttaatgtacttttaattactcaacagttttactgtttgctcaataaaatgttttacaaccgcctttatgcaaatagccacaaaccatccttgtatccccttgcacatctgcatcgttggtgtggcttgctgagtatggtggttgtactcagtcttgctattattccccctttcagaagtgtagtgcttctgagctgaagatggagttagaggaccaaggctcagaccccagttgagttttgcctgtggagtggagctgaagccccgctaggatcgagtttttccgctgctgtcgttctgtttcggtgtgaggactaagtgcctcttccgtaagtattttacgctttatttacgtttggaactgtatattacttgtcgttttgtgtaccctgactggtcctggacagggatttaatacgcaaaatagtctggaaatttgggttaaatttctgggcgtgacaaagtggtatcagagccaacttgactgtaggttgagccaaacggtcaaaacctaaggacaagctttctgaaaaccctatttgcaaaatgtctcctctcgcccttcggcatttctttgcgaaacagcttttaaagttctcttccctgtccctccaattcttttagttgtcaaacctggaggacaaaccgccagcgtcatgcctgttcggaagtcaagtcgagcctcgagcttcatgcagcaaggaccaagaagatcagtccagagccgtcgttccgcaaaggtcaagtgaagtttccccagagatgacctaaacccaatctgtcccagaagagtagtttcgttagcttctagatcgtgtgttgtttgcttgtgtgtaggggtatggtttgcgtcattggtggggatgcgaccatactaggttgtttgcttaagcaacttgaatcaataaaaatctactcacaacagaccattagtcaagtggtttaaggtcttatctttagcaacccctctcttccacctctcttccgccctgcagaagatggtcagtgttagagagaagagcaacgacggtgtattaaagtcacagatcgatggttcagttgaaagctgcaaggtatcccaatgccagaagaacccccgctcatgattaacttttggtgtccaagaccagatgatgggtgtattgatgcaggagatgcaaagcttgatgcaaggtcaaatgtagcgaaagtaactccagccgcagtgtgttgaggtcagaatcagtggatcagtccgagacaacaagctaccagctgagtcagagcacctcgctctggtcagattatggttagccaaggtcagatgatggatgtgtcagatgttgatgcagcaaccacagagtccgatgcagcaaatgcaacgacagtgtctccaacaacaggtacaagctcagatgcaagccggaatcaggatcagagctaaagccagtttgttttccaagagcaagcacccgcaaccctaaacagtagaccaccaagcccttagcagaccagcacagccaagccgccactaatcctaggagcaacaagtgatacctacagaaggtatgggtttcaagggcaccgataaagattctattgtttcgctagcaactgcttcaaggctacagaatcagcattagtagggcaatcaatgtcagggaatcagtgatctactttaactacagagagacagctcaattcttcaacagcgactgcagtcaatgtctcaagcatcagacttcaatgtggttatcaacatcagccatgcacctcatgctgctccagctcagtggtctggcaagaaattaatagaagagttgcaccaacagtgagaaggtctcgttcctttcagctaccaagaggattgatggttgtcttaggaacgtcatcagtcaaagttttgttcttatgggagcttcagctcgtaaccaacaaaaggacaagtcaaccatgtcagaatcacaatgggtaaatgtgctactgattagcagttcggtaagcaagagtcaacaattgtgcacaggcctttggtgttcaaataccgtcctcgcgcatagaagttccaatctagtgatatagttggaaaaggaatattgaatagagtaggagtcaagcggttctttccttttcacctttgagtatgcaaaagcaagttaacttgtgtatctgcaagttacaagaaaccaagagtttcccttctaactcatcgcacttttgttgtgctccaaaacctgtttgcgagccagtaaagaaaggattaaccaacggagtgaaaatggttagaccctcaacactcgacatgatgagatctctctaaaggcaacatcagtggtactcaaatgaaaagagggatggaatatttgaaggtgacatcatatagagactcttgggaactctctaaccttggaagctgttacaggatggtaagcggcaattacaccctagtggtgtgattatgaaacaagaatggtttccatagttcaaggcaaccgctataagttccagaaaaaaaaaattctcatgaggtttcccagaagttgaaagagaaattgttccaatacatgggtcagaagtatatggagtcgagtccagaagcatgctagttatgccagccgtagaactgatggggaagtagtcaagagttagaaagatcatatgctaaatgagaatttccttatgtggaatttcctatcagcaactaagggttaagttccaagtcttgtcctggatgaaagtgcatcgtcattgctttattttgattgatcgttgaagttttctattttcaaagtcagggccattcgtaaattcgagaagtgtcgatttttcttcaaggacaatagttcaattattcccggtcacgcgaaagtatgactactctctgtaagagggggtaggtcgcagagatgagttttggttcaccttgttgccgtttcccttaaagattcaacccagtgcagcaagttggttagtacttgaaagagccagctgcaaggcgtcagcagagtaacactgatcccaagttgtctaattaaattcgaaggtacgccggtgaggccaggtcaaccgtttggcttaaagaagtagcatcaggaacagccgcaatccagactaggacagaccaagccagtttcctgaaaatacttgtggtttgaatcaagagcaagtcgagcaaagtcattgtctgtgggttacggaagtcagtttcaaggtttcggaaaaactacaccgatccccggtcagcaaagtgaatcctcagtttatctaattgccagcattagcaattcagtccaaaaaaaaaaatagaagttctatgagcaccagcagttctggtcaaggtcagactaatcagagtcggtccgtcagtttatgggaagcaacagaatagcaagcttatgcaggtttggttcatcgagcaatcggtcagttgaatcagaaagaggcagcatgtgtaagcagatcagtcagaccgcctgccagcaccagctttctttctagccatcccagaatctcgggacgagattcctgtaaggggggtagatttgtaacgccccgattttcgttcgggtttaaaaatcattaaataatgtattttctagaaattaaataaaagttaaatcaatttaatcaagtgaaataatgggagaattaaaattttcccttaaaaatcattggccgggaatatttcgcaatattctttgtgccctaaaatactctccggatttttccgtgaattttcggagttcaagaaataattttaaagtcaccaagttcattaaactaatttaaataaaaagaaaacaaaataaacttccccttcctccctttcgggctcggcccaaaatcctctctccttcccctcccgcggcccggcttgcctccccttttggtgcaagtccgcttttcctccctcccggcctcccctctcactcaggccgacaggtgggacccgtgggccccacctgtcatccccaacctccagcccgggccggcaactgccatggccgcccgagccgcccacgtcgccgcccctccccgcgcgtcttccgattcccgcgcgcgtgtgggcgtggtccaccccacgtcatccccttcctccaccatttcccccacttctcccctccaaaaccggcgccaaactgcccccactcacccacgtcgccggcgcccctttcccccttcaaatccgtcgccaaccggcccccccgtcgactctcgaggctataaaaacgacccccgggctcccctcctccgtttccccctctttcccaagcttccccatgcccgaaaccactccgccaccaccaacctccctccgccgccgccggttgccatctccggccggccacctcagccgccgtagccgtccccgcgccacgccgcttgcgccaccggcctcgccacgcattgtcgcacaccgtccgcaactccgtttccccaaaccacaatcaatacaccgattccatcgctcacccgagcaccgccgccgtttcgccgccttcggcagcctcttgccgccgttcccgtccacctcaagccgcgccgccaccaccactagcttcgctgctccgccggcaagcccggccaccacgccgctcctccattccacccccgagctgcccgctccacggtgaacccgagccacaaccacttttgtgcctccagtcgcacctctgccgtcgccctggccaccgccaagccgtgccgtttccttcaccggctcggccgcttcaagccacagatcggtcgccgctccaaaccaccggaaacccaccggtgctccattcctttcgatccccggtgagcccgccaccgcctaatccgtgccgccggccacctcctcgtcttcgtctcgccgccccattcgctcggtgagaaccgcctccctctccactctctcgccggctctcgcgccgtcgccgctcgccgccggcgtcgtcgccggtggtctaggctcggcggtcgccgccgcctgtgggcgtgcctgcctggtcgtgccgctcggctgcccccggccgtccgatcggccccggccgatccggagcgtcgggtgcgcgcccacgtggccggctgccgccgtggactcggtccacggtgggctttgccgctgacatgtggggcccgcccctttgtgacgcggtccgcgcctcaccccttgctgacgtcagcatagcctttttcctttgtaaaaataaataataattgcgcaataaatcgagtttaattctagaaattcatttaaatggcttaaaacttctaaaattcatacctaattcattcgaactccgaattgagccattcaacttgcaaaattcatctaaaattgagctctacatgtttgtttagtttttatgtactgttttcttggtttttattagagtttttcctcgttttgcgtgccagcgtgtagttcccgtcgtttcggaagatcgcgttcgcaaggataagagttcagaagatccaagtgaagaagcaaggcaagtcacacattccccttgagcatgttgatcccaatttacaaatgttttactgtttgcaaataaatatgcatgttttgctaattacatggggtcagggttttacctatctgctcgcttgtgccatgtttacttgacatctgtcctttgtcaaccatgggtaataaatcgcctagctggtgttactttgatgacctagctagaactatatgcttagccatgcttaattaccactagctcagtcgatgggataattgcagtattagacattctagtatcttgttgagctgtgtgctcgagacatctggccatgcttcatggtcgtaattatccaactaaaatgcgactgaatggtgggctgtgggtgcatggttttgctagtcacacccatggcaattaaggaccggttcgcgggatgccctagaagaacttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcaccttggcacgagaggggactgcccgttgcctgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcgaccagattcaccgtgattagtctcacaattaataaatcgacccaatacactgtagttcaggtgggttggttgggcctgttcaacgtggtgtagcgttgattagtggagatttaatgttactttaattactcaacagttttactgtttgctcaataaaatgttttacaaccgcctttatgcaaatagccacaaaccatccttgtatccccttgcacatctgcatcgttggtgtggcttgctgagtacggtggttgtactcagtcttgctattattccccctttcagaagtgtagtgcttctgagctgaagatggagttagaggaccaaggctcagaccccagttgagttttgcctatggagtggagctgaagccccgctaggatcgcctttttccgctgctgtcgttctgtttcggtgtgaggactaagtgcctcttccgtaagtattttacgctttatttacgtttggaactgtatattacttgtcgttttgtgtaccctggctggtcctggacagggatttaatacgcaaaatagtctggaaatttgggttaaatttctgggcgtgacatttgatggctccgagtgcggaaggccgttgtcggcacctttgtcggaagaggaactaggcggcgatgcctcgtcgggcagtgagacaaccacgtgtggaaagaggacctcattagccagctgtgacgtgtgtggggaggagatcgtcggccggctgctcgcgggttctgtggtgacaccgccccttcccctttcctcaacaaccccatgtgccgctgtctcccaccatggctcctatcgctgccatcgatgtcaagacactgctgcctgctaggtcctactcctcctgttgccggccccaaccatgccctcccatggcggagaccaccgctgagctactggatttgtgtggctgtcgcgttttctcgtcgatccgggaggtggcgttggtaatgaccaggttgagctctgcaaatctcgacaaggggagcgaggtctccatctcctccctttggaccgacagcgatgagaggagccatctcatcgtcggctgcaacggcgatttgatgacccatcccaccaagaggaagaagaagaggtgactgaagaagctaatcaccaagaggaaggagaagaagctcaaggaggattcctcggaggtctcctcccatggcgagctcaagcagccagacaccggcaaggttgtcggcaacgccgccgccaagcagctgtagccatcgccgtcggcggagctgaccatagaggaggcaccatgctgtcctagctcatgagcccctcccccgcgcgtgctgtggccagcgagctcctccccccgtgcacaccgtggtaggcgaaccctcacctacacgtgcgccgcagccggcgagcctctcccctgcggtccgtgcctgcatccttctgcggtccacgcccctcttgcgcttttggtgcctcccctggttgcacgtcccttggtagaggtcgtgctttgtgcggggagagagatgggagaggagagaggtgagtggtggagggggaagaagagaagtgccacttatatgtgggccttgacatatttttttaaattttttcagatgacaaggctgcctcatcagtgaaaccactgtcaaaaaccaccaggggagtcatttttcactagttttacacttggggcaggcaatatacgttttgtggttgagggatcaagacatgaggaaggcaaaataaacttatctcataggtttctggttatgttttgtttcatggcccatgttttggtgtgggccgacacaataaactaatttcctgggtacgcatgcgaattggggttacttttgccattcacatgaagctagtgggaaaaaagcaccagattcatcccacggggagaagagaaacaagaaagtgataaatcgataaaaaaaaagcagatgggagagagtggatgaaaaaacattagttgcacaaatttatcactgaacttgcataaaatttataacgtcaactacaacatccggaagtgcaactagcatagctgcatgtctgcaactacaaattgtagttgaaaaaaaacctctctaaatataaaaaaagggacagaaaaaattgcatgtaaacagaattccaaagaatataatagacatcacaaaaattacatgtcagagcactgtcctctgtccattcttcatactttgatacttgatggttagggaggtcagtgcacccccctaaccgtcattaagagtagttatggagttgacacgtggaggatggggggccgaggggtgccactccaagtttggccgaacaagggaaaccgccttcagtggatgacaggtgagccccttggtcagtgcacgagagtttggtcccactttaagtcggtttggtctgacttgtgggaccattaatccgtgtgctcgcacatgattcgccggacatgtgtttctttgcatgctagctcatttctcatttaatatagtgtataattcctgcatccgtagtatttctgcaatacaggtggaactacattatttataaatgatatacgtataagaaatgctagttctccccttatttattaacatagttgacagtcgaaatcgatacttaaccacaatctacagccaacacttcctcgattggctcgaaatcggggtataggttctgtcaaagagtttcacgatcataagatcgggatggaaacacatttatcccgagtttgatgttgatgacaccggtttgcggcacatctgtaagaagtttttctatgggatggtctatgagaatatagaatttggagaatttgaatgcatgaaaatccaggatagccttgacatctttttgtcttattggcacaacgaagagtaacatgacctttgatgataggaatagatgggctcggaaggttttatccattggtgctaatggttcatcccctaagaaatttaatgcaaaggttatggacataatgtttgaaccaatagtgggattataaagggtttgcgccatgacctctctcatgaggcaaggaatagttaaggacgggaacaaaaatctgaattgcttgagaggaaagttccacctcccttaaccactcatcactcatgacggtagttaattcctacaccatatctttgaggaaaattttctcgagtggtacaggagaactgcacgagactggtggtctcttttggcaagaatagtttgaggtatttccataatcttcaaaaaaaaagttacccacaaacaggaaaggtaattttgaaggctgaatttcttctttgtcctgtttccatggtttgggtgaggattcaacggttgaaatgtggaggatgtatgttccgatttgacggttgatggctcctcatttgtatccttgatttcctggatattgtcgcaacaaacgaaagaggtgttctccaggatacgatataagagtttccttccttttgatgttgttttgtgtgcgaacgaacttccggtggatgtaacgagatacatggcttgcctaaacccaaccaaaaatgttgtaacaacacatgatcgggcagagacaagtctagccatcttgagttaagaagaaaaaccgagcctaggctacaccgatggattccttctcattttgtcggaagcagagaacctccatacgtagagagactacacgcgttagtgggaagacaccaaggcagaacctgctttttaattcctctcattcgccatgtaatattttaaggtatgggtgtaccacttttttgccccctctgtaagaaagaagggaaacgatttccactttaaggtttcttgtgtcatgcccgctattgttaggcatgaatataattgctcaggatcatgcggatgatggtagggattttttctttcgcgcccgatattggtatttcttacaatcacagataaattcgcaagagtattcccaggagtatcgtatttatattttcgctgggaaggcgacagtataaagatatgttctttcttttatatctcttaatcaatgtataattaattcaccatagtctaaacagaggttaggataaataatgatatggtagtggacacacacaagggattcacgtctataaaaatatctagtacggagttttctttaggtaactatgattcatatgtacttttatagtaatcatgtctagtatacacttaacttatccatggttactattttcttaacgacattactagaaatataattcccagcaatggcgcagaaatacttctggtatattatggttatagagttcatccgcgagcgcacggatataccatcgtagcatttcacccgagagtattccaagggtatcgtatttattttatctcgtgggaagatcatattttatctcgtgggaagatcatgtagagagaactggactaataatttatgcattgcttgtgataattatattctaagcaggggttaagataatccaagggtagagtggcatacaagcattaactactcattctcaatatatatattatctaggctaggtggaaagaaaagagaaagataatctattcctatacttctaatatacatagtatacatacatcctatttaactgatatactagctaataccctctttccgatgccctcctagtaagtcgagaaaccacccctgactgccgagttccttacgacagcccgtcatgaccatacaaccggggctaaatacggaggaataccctccccagggaattaacttaggattatatataggcccggaggaataaccgtactgagttgtcaccatcagcggccaaccactcatccgcaatatataaccccaaataatgatatcccgtaatctaagacaccacgcctaaactaccagatactactctaatatcatcgtcatgacatagagtaattgcacaagcaaacattatacccgcaccaaagcatctcctaaataagctagccgtacatacaatataacaagaacataacgtaaagtaggtactcatatacttggaaagtatttcaataccataaatgtatttataagagtattctaataaaagtacaaagcttacaaaagagaagagaaaagctgctagagccatactcgaactcttccgaaggcttccggattctgatttctactctattcctattccaccagctaaatactactaaactaaacttgagagaaatgagagggctattgatttttttgacgtaagagagagctattgcttgaggtgtgtgtgaagtgaagagagtgagctccttatataaaggtagttatgacggttgtggaaggggaattctccggagtgccctccaatcgttattgggatgcaatcctggacgtccactccaaaacctagatccaacggcgccaagattggttcggcctcggccgatcctggggctggcccaatccagcccaatttcggctggtggcctcctctattgctccagtccgcatacttgtgaattttggcccaattcatcgtgttagttctgagttcttggcccatctattcataagtctggttctcgacatcgtcctattgatttatcatctaagttgatgtcgattctcctccactttattgtcattctctgcaaaaggttagtaaacctaatactagtggaaaattattactctaacatatttatgcattgcaagcatcactagttctctcctattttggtagtattgacggtcaaaactgatcgataacgaccgtcaacagttacaacataggacatagttccatgcacccaggtactaccgagagaccactccctgctggtctgccagcgtggttatggcatttacgcactcttatgtcatacccgaacgaggaggaatacaaaggacggacatggctgtcaaacttgctgcctacctcacttttccgtggggcagactcgcatccaacggcatttatatagcctaaaaaccatgcttatgccagtaaataatatcactaactcctcaggactttcaccttaccgatgaacaagttgaagctagagcaacctataaaggtcattggaccattaccgtaacattgatcgactagcctaggatgaagcagatatacaaagcatacactactcttagaacacatactcaataaataaatatataaaccatgagcataaataaataaagaagataattctattaattcagccatagtcttataaaatgaggaaagtactagaaacgtacccagaactccaggaagtctacaggatagaagctcctaaactttattactactagaaactatagagattacaaagtggaagagggaattgctccttgaggtgtgtgttgtgaagtgagaatctccactccttaaatacgcttcagtgacggttgattaaggtggtttgtaggccaccgacctattatatagtaatcgtcaataggagatcatctggagcgtccatgtggaggagggagatgagcgacgccaggcctagttcgcactagagtaaccgccttactccaccgactttggtcggtggataacaagtggttggccgcaatttgagtcggtttgagctgactcgtgggcccctcaagtgtgtttctttgcatgccggcatcatttctcctccacttttgtgtataatttctgcaaccaatttaattcaccaatcctaatacatctacattatttattattggtatacatgtacgaaatgctaattttccctttactcattgtgctagttggcgatcggaattggtacttaacaaccatcaacacccgagaaggattgttgccgaaccatggctacaaagttaggtggagttcatagctagatgaatgaattgcttttgaagaaagaggtggttcacaggactcgcgctttggagcagaaaagttttgaatagattgatgctctatggttggtaataagagaggaataaaataaatgaaaaaatagaggatgaaccaagtttgaagatgatacaacaaccattccttggcaacgccacaagaaatgcttgttggtatttgttacggtgatagataaatttgtaaatgcatgaataccgctatataccttcaccttagagtattccaagggtatcgaatctgcgggaacatgtgtgtatatctaggaactaaattctatccaaaaacaatacctaatggtaggcttaggaaagagaggtttcctttggattaattaactataccaaagataaagataaaaccctatcgattgctttgggcaccggctctcccctagtctgccaagcagagtctggtttgtagcattatgatgtacccaaacatggagagatacaaaggacggacggggctgtcaccacctaccgccaccacactttccgtggagcacacaacaaacaaatgtatcgctaacctagacaccacgcctaagttattgattactactgtagcctcgtgcaggaactttcttcttcatccagagtcctagtactagagcagttaatataatttctaagcgacgaacccgctacgatgggagtatatctcacttaatctactaaattaataccaaaaggaattctcgaacagttactttattaaagaagcattcgtcgaggtacaagcgagcagagaacaccgacaattccgacactcttcagaacatcgcctcattctcactattttcttgacaacaagggaagaatgcaacttgagtcaaagccattgcacccaagatgatatggtagacacttcaaagttcacgggtccaggtatggtctggaatacattgtacgtttgtaccattatacaggaagtccttgcactgttgaaatccatgagcttcactcagcgagtgtaaaggataattgtgggggtattgttaatggttgttaaatttaatattaaactcaatggtaggggtttattactaattgtttccacttgtattggtaaatatatgcatgtaggtgattttcaaagaatttacatcctccatgcaacgaaatatacctccagccaatcatacgcgagcacatggattggagggcccacatgatagtcaaaatcgaccagaaagggtcttatccacagtgcatcgccataaggccccacatgccaacctccttgaagaaggtcgatggctgaaggtggcggcctggttcggctgaaccaaacatggcaccctggccacccccttgcacgtggcagctgcacatttgatggtgatggcggttgtgggtgcactgacctccacaaccgtcattccaacctttattagaggctataaaaggaggaactcattcaatcgcaaaaacacaacaaagtggagtagaactcactttagtagtgttgaaattaggtagagagtgaggagaagttccggaggagtgcctgaattgtcggcgctctcttctcgtttgtacctcggcgaatgcttcttttaataaagtaagtgtttgaggtttccttttggtatttaatttactatattagtgagatatatttccatcattgcaggtttgtcgcctagtatttaagtgctccagcactagaattctagatgaagaagaaagttcttgtgtgaggctggagtagtaatcaataacttagacgttggtctaggttagtggttaccttcgtttgttgtgtgcttcctggaagtgagggaggcagcaggtggtgatagccatgtccattctttgtatccctaaacggtcggtatgtcatagagttatagtgttttacctttaacttaagtattgttaattaaaggaacaagtacgaagtaccccctgaactatgacaacagtatgaattatcccccctgaaccataaaaccggatattttaaaccctgaactatctataccagacgaataacccccctcgacccaatccatagtggttttgtcctatgtggcgtacgcgtggcaatccagtcagcatttttcttttttaaaaatagtggggcccacctgtcatgcactcacacctatcactttcccctcttcctcacaatctctctctcagacgcccgtcgtgagtgcgacccggtggccggcggctggcatggcgggggcgcggtgggcagcgggcgtggcgggggcacagccggttggatcgggcccgccctctacctagggatgcggaggatggcgccggcggcgggcggtgatgactcagccaagggaggccggcggtggatcaggaattggaggagggtgtggtgcaccgatgtggatgacgccggtagcgggcagtgatggcttgggtagggtggtcgacgatgatggcccagctgaggtggaggcgaaccccgtcggcgatggagaagcggtgtcggcgacggcttccaagaggcgtcgccgcgtcggtggcagggagatctggcggggggcggcggcagtggaggagtcggtggcagggagatccggtggcgggcagcgggagaacaggaaacggtggtggggagatccgccatgctcgccgctcgccgcacgccatgcccccgccatgcccatcacctgccgcgcccatcgccggttgctctcggcaacttctgagagagagagagagaagaggggagagagaagagagagaggaagagggggaagaggagtacgacaggtgggtcccatatttttttaataaataaaatgataactagattgccacgcgtatgccacataggacaaaaccgctctagattggttcgaggtggataatttgtccggtattgaaagttgagggtgaacgttgtctaatttttgggtttatgggggtaattcggttgaccatgatagttcagggggcgggggaataattcgtactttttccttaattaaaccatatgcattccctctagccgaagcctaccatttgttgttgtgctcggagaggattttgttgttagatatagacacacgtttcctgtgattcgatacccttgaaatactctaaggtgaagtgctacagaagtattcatggtcttacgtatttatctatgatagtagaaaataccaacaggtggccacaggagggctagaggaggcgctggtgctatggtggggcgcggtggtggagcatgcagctgtaatccacgcatgcgcgcatgatctgtgtgtcttggccctccttattccacacccgggagacaggagatgctgcctccttggtcttctctcaccggccgctggtcctctcctcaccggccgttggcctagagatcacctggaagagaggggagagctagacggagattgcacaaggataagacatcggaggaaaaggaagcatacattaagaaattgcacaaggataagatgaccgaggtagcgacatacttgggacgctctcgcacaaagacataaatgtcttaattcatcattatttatgtagtaatacatcattaataacaaatgaagtctctaataaatctttcttgtttgtagcgaccactatatcttattcgtagtatatacgagggactaatcggttgtagcactcgacccgacacactaaaacaaggaaaccttcatggagttcctcacaattctaaatttaccctctagaatttttaagtaactcaaacaaatattttattagcatagcacacttaggttttaccgcaaacatcacggggcagtaaaggatccggaaaggacaaagctacacgtcaagataggtcggtggtactgacatattccatgaacacaaattctttgaatgattacttgtttataatgaccggtgtaattattatgttcgcagtgcttcaagcaaccctcgagcactaacctatgtgggtattacatgttggagatgcttagggtcaacaggaggtacacaacaaacatcaatcacgtaagtcctaacattgttctctatacagaatatttcatcgcaattcaatttgtaatatttattgtcttttttcctcagacccctgaaatctcttatgtagcaaaccggttcgacaacacaacaattatgaaggtatgcgctgacatttgccactttatccgctgtgattgctgcaacgcactagggcaatcttacgacaatgagagtcagctggcattagaagataaattcaagcccctaagagagtggggaaagaacatatgcagtaaaaatttactatttcgtttgtgttgaaacaatcgctaatttgtaatgtttgggacagaaatgtttaaatgtatagatattgttgggatacgcgtaggctacgatagcataaatcaaaattttatatcacataaaccaggaaccatgcaagtattagatcatatatcgttagcactcgacgcgctgcgcagcggaaaagggcgctaagaagtcgaaggaattctcgcgaagtagcgcgcatcgatgtagaggaagtagtcgatcgcaccgactcgaccttcttcttctcgtgcgttctcctcgccgtactcccacaccaattagcaccgcaaaccagtggcgcctctaccggtatccacacatacagggacggaacgccacgcgcagatgtgctagcacccgcctgcggctagggttttgctcggggagggaagtgacggctagagtttctcacgtgatgcaatgcctccgccggtcacacctctcacgaatatataggatccatcactcgggcctccaaggcccgttggactcctattcggatccctgtccgaattaaactcatattggatctccatccaatccccttattctggcccattaatcgtgcgaccctgtaggttcatgtacactcggctgtaacccgaaaactccttttcagtccacgtgtcaacagcggcccctagcagaacgtattgacccaccgggcatacataaagatcatatcggctgaacctctagtgtatacttgtatgaacccctttgcctcacgatatagattaagctcaaggctagatatgtgccatcctctaatagctcaatcattcactcgaacttgttgatagattatataacttgtgattgactcctcaatcacctgtggcatggccatttacttccataatctacaacatcgaggggcccagagatatctctccataggacgggcaaatcccatcttgattattcatatctcactacatgtttcatagcataaccgaaaactacttttataactaccctattacgaagtagcgtttagcagtccctaagtaagctactacatatgttgggaaccatgataatctcaggtctaaggattcaacaccaacactaaatgagatcactaatgacacaacacatatggctcttgcagtgtctcatgttgggtctatccaacaacatgttcactaacatgtgtccacattattaatttggtatctctataccatgatccatgagacacgatcatcaattaatacatgtgctgatcatctaatcatatttgttccacatatgatatttgatcagggatcctttagaaatagtaacaaacaacataaagagtctcatgaaagaatcacatattcattaaccaataatgagttatctatttcaaggaacaatgtcggataaatatgtaaacatagtatgtgatacaatcatttctatgattgcctctagggcatatcactaacagatatatgtatataaatgttttctgttttatatatggaaagtttgtttatttgtcaatgcaaaaattctaattattatatgctaagaacaataactcagttaggttctatgcatagtatttcagatttagattagaaatagcgggaagtattatatcacataggggacacgatcttcccaaacagccagcgagttattggccgcatgcaataatcgattttcacattgagaagtgtcatgtagatgccatgtggccaaaaccgggttagtactaccttgggattatctttgatctattttttttacgttgagggaggtgttatacccagttttatagttgagggatgctatttgatgagggagacacgtagacttagtccttgatgaaatgaaggcagcaggcaaaaaaaaaaaaacaattacatgaacctgaatatggcccaaattctgattgtattacctctgtaatgctgcacacgaatctgttgttagaaattaatcttgattacctctgtaatgctgccactactcactactggataaaccttttatagtcccggttgggaacccccttagtcccggttttccaaccgggattacaaatccgggatggatatctttagtcccgggtggaataaccgggactaaagagtacagcggcagtcccgattagtttctttttttttattgtttttttctagtgattttctcccaaatccagtgggatgtatatccccaaatcaaactaacatcccaaataccacaaatcaaatacatcacagattatacatctcatatccatgcaatgaattacatattctcaacaaaaaaagaaattatgcatctcaatccatccaacgaatcacaaattcttcatctcaatcaatacaatgaatcacaatttttttttaaaaaagaagacaaatctccggcagagggatgcccggccggcctccatgcatgcgcgcacagctggagagggcgcttccggccaccggccgccgctgccgccatcccctccgctccggatctggcggaggggagcgcgaggccgccgccgcgcccgcccggtcgccaccgctcccacccacccgccatcgcgcccacccagcggccgccgccgacccagagagcaagaggagaggacttggtagggagggggaggagaggggggatccggagaggtgaagcggaggaaggggagaggagaggggaagtgcatacgcggttggatttggatcgagatgaggccgatattaaagagggagagaggaagggaaggggatcgataagtcttggacttggcgcgcgcgcggtttgggaggatttttggtacctgttgggataaacaaacgggactaaagatatatttttagtcccggttgtttataccaaccgggactaaagttaattggggcctaactagatttggtaacttctttgaaccgggactaaaaatgatctttagtcccggttggtcaaacatttttagtcccggttcctattcgaaccgggactattgtggtttttggacgaccgacgaaagatggtttctccagtagtctggacacgaatctgttattataaattaatcttgattacctctgtaatgctgcacacgaatctgttgtttttttaatatcagcatgtttatctagatgcatacgtgtgtgttgcatggcgtggagagctagctgtgtacgttggtgctgcgtggcttagtgagtagtgcgccaataaacagccaggaggtaagagcacaagtttaggagtaggaaatggtcagtttgcatgcatgcactgatcggagactgagttgtgtgaatatgcattagcttagaggtttagttagtggttagttaccgggtatactggctgagaatgtagttagtggaacacgtgctaaccagctcgtgactacatgtgtttctatatacggagtatatatatctataactagcttgtgtttatgagaagaaaaagagaaaaaggcacaagttgtttcggtgccacaaagctctcatgtgtgtttgcctgtgtttgtgtttcttccccgttgcctagtgtagcctgtattcgtgtgagttgctttgtttcctaacatctgtttggtttcattgtatgagacacaaaagctggttcacttttgtaagtaaagtaaaccagttagccacaaagaaattcttcagtgtcacaaagtattcaatggtagctacaataattgtgctaccaaaacccaaaatggtagatttatcatctttcctatgcttttttggcttttgaggtggtgacatttctactgaagctgcactgttctcttatagactgtaaaatgttatgccctgacacccaaaacgagtcctatgcagagcaagtgctaggcttatagcactatagcagaaggaggctttcactaagatgcattaggaatcaggtaaaaatttgagagattgagagcctatttgaaggaccttatgattccaagaaagctggttgtagctatcctctgagaatctgaagaaactaggttttcaaattttcggtttctagttcattttttagattttacgactacaactttttagaatctggacaaaagctagactatttgggaagattctgattctaggagaagttgtagctgctagaatctcgtccaaacaggtgcttgaagggaaagaagaagcttggaggaaatagttatattggcattttaaatatttggtgttttacagtattttcatctccttctcactagaaccggctgggccatgtgatctggaagcagctggagcaatatcagtagattggttttgtaaaaaataatataacaagactagcaccagcatgttttccacagagctgaagcaccgccacttcaccgtctaaaaatataactaacttaatcctctaaattaatattatgcaataaacattcttgagtccatacattaagatgtggtttatactgaaccgagtacaactaccatatacaaacattacaatataaacggtacacatgtatgtaaatttgtgctatgaacacaggaaatgttttaagtacaaagaacgccaaacacaagggacaaaggataaacacttctaccgtggtaggctagcagatgacaagaattctttctccaagctatagcatgaggtttgagagcgttgagatgctacattagctctgtcaacatttactaaagcatgaatcacttggtcaatggctccttgagtcagtagtgattctatctcttggtttctgtctggactaacatgtgatggggtcatcttttctgttcgtaaaagctgcagtgttatctctacttgcctcattgtaggcctttcttcaccttttagctttatgcacatctcagcaagggaggcaacttgtctaatatcttcttcatttgccttgtcaagaaccggaggatctaccaaatctataattggtctggtcttaatctccgaaaggaagtaagtacacaaattttgtttcatccctgacattgttgtaaaaataggttgcattcttagaagaagctccaagagtaccacaccaaagctgtagacatcactcttctcatttagctgcccggtttggtaatattctggatccaagtaaccgaacgtgccctgtacatttgtaacaacatggctttggtcaactggaacagatcttgaagcgccgaaatccgaaactttagcggtataatttgcatccaacagtatattagaggacttcacatcacggtggaagatcgatatagatgctgcagaatgtagatagcatagagctcctgcggcctctgctgcaatccttaagcggtcgccccatgacaatgggaatgtgctacttgaatcatgatgaagaagttcaaataatgaaccgtttgggataaagtcatagactaataaggggacctcagtttcaagacaacatccaaagagtttaacaatatttctgtgatttattagagaaagtatggcaacctcgttgatgaaatcgttgatctcaccttcctttatgactttggctttttttatggctaccacatgttggtttgataagatacctttgtagatagtgccatgtcctccatgccctaggatacgtgtggaatcaaagttatttgttgccctttttagctcttctatggagaaaatctttgtcttctcactagcactttcatctgatgatatcaattgttctaggaggaggccttggttcttttggaaatattttctccgtatttttttatggacatctcttttccatcttctaatgatagctattacaatcgagctaagaatcaacacaccaaatccaatggtaaggccaattataatacctacaatgataacatcgcatttgtaatatcttcatacacccttttgtcagtgtggaattgattattatgagactacctaacaagagactttggtttcttcttggagtgcactgcattcttataacgtcatactctgtatgatcagggcacatggtgcagctgtagtttccttcagtattgtggcaaagttccttgcaaatccgtggtgtttgtaggcattcgtcaatatctgcaaccatatctcagcatgtcaatgtatagtgtaccaatacctgatcaaataactattcagtaaatgtttattcaataaaaatatttgaaacattaaaattagagacttcatatttgtacaagacagaattccacaccagaaaactataagaggatatagtatatatatatatatgtatcccatctggttgaattctaagttggtcaaagagataattacctttacacccatctgggatatatggatttccatcataaccaggcaaacaagtacacctgtagccaacataaccttgcatggtgctgatgaccctggagcaggagctattggtacttacacaagcatatgtcgaagtgttttgctgcgcctgttggcaggtcagattggcaactgcccactgcaccgaggctgattccgttggatccacatacaggttaggccctttaccaaatatgttggatactactccttgagatgaaaatctgaattgcgaaaacatattgaataagatctccacgaaagatgagttgtatttaatgccaacaagcccctcactgacatttatatactgaacaccgatgaagtcattgtactgcagcacagaatttggcttgcctaggcacgagagctgaaacacttccctggcggcacaaccctcttcaaggccaaaaggaaatgggacaacgattgttccacattgtcgagagcaattatgtttttgtggtcttgggttataacctgcgagttacatgaacaaaatttaaattatccgagaccatataacagtcgatacaagcaaataatttcggcaatgtttagtttcaggggtgaaaagttttggcgtgttatactggatatacgaacacacatttaagtattaaatgtaaactaataacaaaacaaattacagattccacgtgtaaactgcgagacaaatttattaagcctaattaatccatcattagcaaatgtttactgtagtaccacattgtcaaatcatagagcaattaggtttaaaagattcgtctcgcaatttacacacaatctatgtaattagttttttttgtctatatttaatactccatacatctgtctaaacattagatttgacagggtgaaaagtttttgcgtgggaactaaacatggccttcatagttgcaaatagaaagcaaacaaatcctcgctcaatttaaaaaaaaaataagtaattttagacttcaacaccgtctttgagatgatactttgaccaacaatattttttttaaaaaaatgatgttttaaataaacaagttacatattatgatagtttatttaatgataaatccactagtaatatcatttttacatgtttgatttttttctattaatagtcaaagttaaaaatatttgatttatcactattctaaaattgcttatattttgggatgaagggattactaatttatgtcatattatacctgacacgctattgtagaaatggccttccaaaccgtcccatcactaccggttcttttagaatcaacaatgtaatcctatgaaccggcagggataggaagtcaggaacaggcatacttaaatatgatgancttctgaagtgaagtcatcacggggcgcgg

SEQ ID NO: 29623 - DNA, 13556 bp, Oryza sativa
  unsure (1)..(13556): unsure at all n locations
catttgaagggggtaaaggggcnccgccaacgtgggtagtgagggcagtttggccccggttttgcagggcanaagtggggcaaatggtgaagcaagggnatgacgtggggtggaccgcgcccacacgcgcgcggnaatcgnaaaacgcncggggagggncggcnacgtggcaggctcgggcgcccatggcagttgcaggcccgggctggaggttgggaatgacaggtggggcccacgggtcccacctgtcggcctgagtgatagggaaggccagtagggaggaaaagcggacttgcgccaaaagggaaggcaagccgggccgcggtaggggaagtagagaggattttgggccgagcccgaaagggaggaaggggaagtttattttgttttctttttatttaaattagtttaatgaacttggtgactttaaaattatttcttgaactccgaaaattcatggaaaaatccggagagtattttagggcacaaagaatattgcgaaatattcccggccaatgatttttaagggaaaattttaattctcccattatttcacttgattaaattgatttaacttttatttaatttctagaaaatacattatttaatgatttttaaacccgaacgaaaatcggggcgttacaaacctcccactgcggcggcgcactctgaccccaacctctagttctctgagacaggcgatgacttttagggtttctagtcaaggtcgccatgaggtggcggcgcggccgccaccaccaccctttagtctcgcatggggagaatcggagaagggaggagaggaagaagaaagggagaagtggggttgacaggtgtgtcccaccattttttatttttactcttgtcgtttacatgtgagaccctttttttattatttttttattttttaatgactgagatgccacatcagcatactcggacaagtcaacatgccatgtcagcaaaaaaaaaagctttcaaaaccactaaaggagttaatttgcactggtttctgggagacgtgttatacccggttttacagttgactgatgcaattcgacgatgggcaagacataagggactcaaaatagacttactccaaaacctattggagtggacgggtgaacccgataatgacccaagagcccgtttaagcaggattagtgatccacgggccactttttgctattgttgtatagctattggatgtatatatccaacggttagtagaatcgactaatggatctgactttttacaggcgattgaccaatagactgtcccgtattattacacaggcaaaatatagttccaataaaatcgcgtgaaaatgctactacctgacaggtaaggtgtggaagcgagacacaaacagatttgtctccaccaatcccctctcaggccattcatttcgatatcgttttctcgaactggaaaccgtcgcgaattgggtcttgcttgcaaattgcagtggtcgattattgcctgcccttgtcatcccctagcagaaacgtagtggtaacgctaacgtcgacgacgaacttaattagctgtactccttccatttcatttctgggtttcaatctgtacatataagtggatttttttaatagagagaatcagagagccccgtatgagtgggtccaatcggaagttagtttgtccggtacattacatgtcacgtactcgcatcctatcccttttttttcccatgcgtcaaccggtcaaacttggtgacgacaagttttgtgataatttggcaagttgattgtcaatacaagtatcaaatgtatggatttgatactgatatttgatagtgttgaatgctagagaacatgggattactatataatgtgaattattatatttaatcttaggagcaagtatacatagcagtatattgacagataagggaatggactagcgataagaaattactggaaacaaattaattgtattcttatattcctgtaactatcatatttatactcttaagcgcgagtaacgcgaactattttttttgattggagaagaaacaataaaagtgttcagcacaaatgatagttatttgtgcggtagtcgatatagccaaaacatgtatcatgaaggcaatggcaatgcgtccttcattctgtctgacctgggctaccaagtagacctcaagacataaggcccacaatgcattttggcctcgaatcagatccataaaaatctaaagacagaaattctttatctttgttgcccaggctccaccaacgcagtccgccgcctcgttttcttcttagttcccacggcgccactaacctttgcaaaaccgtcgacacagctcctcctcatctcggccgctccccttcccccatgggcggcgccgctctctccctctcctactggcagcaccgatgtgcctccccccactggcaacgcatctctccctccccatctccgccgcttcccctccccatctccgtagctcgaccgagttggcagcgactcgacgacggccactccataatcctcctcgcaagatccggcctgagagttgccggatctggccttggaaggcggcagtggtggcacaacgacagcaatcccatgcccccttcacggtaggcgtggcctcgatggcagctgctgccgttcaacgacggcggggcggccttgacgaaggtggttgcagctcgatacgatggcggtaaggggaccgtggcttcatgtttgggacacagcctcaccaacgttatttcgcccttcttctcgcgcgtcacggggatacgtcctgacaggttctaacgaggttcaggtggccaaatgaagctccctgatcttcacaagggctcgctgaacgccgacgtggcttggaatctccgaactggcgacgtgagggcgaacgccacctcaccgcactgtgaatggcatgacgtaatcgcgatcgaggtagccgcgtatggaggagtcgtaattaatgtagccaaaatgaaagtatggatatcgagatagcagaattgcatggcacacaagtgataccggccgtggagtgatcatggacgaatgacatggaccagggtgtgcagcagcgacgaggttggagatgtcaggcgagcgtgtgcatgcggctcaatcctctccggagtccgggagaaatcagtgaagataggtacgatatatatgaggcagtgggatagatgttggatccaatccaatgatttaaattttgcactgtaggactttgagtaagaaaatcttgtaaatgtgtagcacaagtagaccttagaatttacttaaagcacaagatactacgtcctccgtttcacaattaattaatataacactttctagcattactcatatatacatatcatatatacatatagatgttaataaatttagacatataaatgtgtctagattcacattaacttctatacagtggctaagccagaaattatataagattagggctaagaaatgacccgactaatggagtattagttttctgaaaaatttacatggtgaatcaacaaaatttaagcaagtttttggtggcaggtctagggctcaagccctagctgccctaggcctacctccacccctgcttctatatgaatatgagcaacaatataatatgaaacggagggagtagtatatttctcatcaaataaaagttactacttcctccgtctcaaaatataacaatttttaagtgggcgggatatatttagtattacgaatttggacaaacgtctatttagattcgtcgtattaggatatgtctcatccagttaaaaattgctatatattttaggacgtatatccagttagattcgaagtatattttaggacggagatagtaggttatattcttttgaggataattgttatacatgttttcgaattcgtgattaattaataatgtaacaacctaaatgtgcgctaattacatcatcatcaatctagtaacctagtaacacactgtattatctacgattgtactgacaaggcaggatctgcttcgaccttgtcgccgctaatatctccgagctccgccggagatggcggcggctgctgggcggtctcgccggcgtccctctcctgccgcttcttcgccgaaaactccgagacgtatccgatcacgtccgtcaggtcggcgtgcgacgacccgccttcctccatcgccgccctcgccttcgcggcgagctccttggcgcgcgccctcctcgccgtcccctcgtctccgccgtccatcagctcggtcaccgccttgaccacgccgtcgctggtgagctgcacgccctcggcctcggcggggaggaacatggggggcaccgtgacgcccgacctgacgccgacgcggagcacgtcgacgagcagctgctcgctgctgaactggtcggagaagttgggccacgtcagcgccggcacgccgtgggagatggcctccagcgtcgcgttccagccgcagtgggtcaggaacccgcccgccgccgggtgggacaggatggtcacctgcggcgcccacccgcgcaccaggaggcccctgtcgctgacgcgctcctcgtacccctcgccgtcgagccactcgctcacggcggcggccgtcgcctccttgatcgcccacacgaacggccaccccgactcctccaggccgcgggcgagctcgatcgcctgcgtcgcccggaggtgcgtgaggctgccgaagctgacgtacagcacggacgccggcggccgggcgtcgagccacgagacgatccgggcggcgtcgacgacggcgcggttgccacggctggcgctggagtcggcgtcgtccagcctggcggcgcacgtcggcccgatggcccacgccctcaggccgagcgccgacgcgtacgcgtccacgaagacgccctcgacgtcgcggaacgtgttgaggagcaggccgtcagcggtggcctcgccgtcgaccacgtcgcgcgccagcttctccgcgccgggccactggaagaagccgcggcacgtggccgtgttgacgacggcgcgcacggggaagcccggcacctcgaacggctcgagctggtcggcgacgcggtcgtacacgccgtgcttggcgaggcagtggatggcgaggaggaagtagacggaggggcagtgcagcacgaggcgcgggatggcgaggcgttcgcacacggccgccgtccacgggttgcaggcgtcggcgacgacgcagtccgggcggcgaggcagcgcgcgcacgtacgcctcgagcgccgcctccatgttccacacggccttgaagaaagccaggtacatggcgatgtccaccaactggtccatgttctccacgccctccggcaggccgaactccgggccggtgaaggtgatctcggcgagctcgacggcgagccctccccgccgcgctccctcgacggccgccctgttgcgcgcggcgttgaccggcgtggtgaccaccgtgacgcgcgcgccgcggccggcgaggaggcgcgccaggtccaccatagggatgatgtggccctgcgccaccagcggcaccagcaagaagtggagctccttcgccgccgacgccgccgccatcgcctccaactctgtttctcctcgcgcgcgcgcagcaagagcaagaaggtgaggaggcgtagggactagctttgcagtctagaggagtgtgtgttatacacgtcgacacgtcgtcgatgacgtcgacggcccgggttgttgcggggcgcggcggcggaagatgagatcgcggcgacgtggaagccggaaatacacatttattgtcacactctaaaaatcttaaatatataaattgttgtttaattggaatttttagaaattattttaaaagcctacaagctaaaccctaattttctaggaaaattttcaacataaaagtgagctagataaaattttattaaatactatgcttgctcctctattttctagatttttctgggaattatttgagcaagggaagtatttttaataattgaaacaacatttcacaaattgttttattcaaaaaagtttaaaaaaccccttctttagccgttggaccgttttcggcccaactctctctttctctctctccccgcgcgcggcccacgccggcccaagccgccgccgcccgtgcccctctctctcgggacactgacatgtggggcccacatgtcaggcccttctccttcctccggccgccgccgagaccgagcccgagccgccgtcttgcgccgccgtttccgcccaaatccgacccggattcttccaattgattgaggggttttgttcctctcgatctcctctttctttcccctcaagaaacaaagaaatccgttgagtattctctccgaatcgaattcgttttgttttatccctaaaaaccgagttcgatttcttcccgaatcgattcctcccgtttggagctcgatctcttcgatccaatgccatataaagcttctccttgttcttctcttccgtttgccccctttcccgagctctcccgtgcctcctagcgccgccgcgacgtgctccaagttcgccgccgccgccggccgtcttcggcaacgccgccgcgccgtctccgccgtcgccgccgctcgccgttgccgccgataggtgcgccgtggtgagaggaagcccggccgcccctcctctctcgccgccgaccaccggagcccgctcgccgccgtcgacccgaaccgccgccgccttcctcctcgtcgccggccgccgtcgtgcaccgtttgccgtagtggtgagtaccaacgggttcgcctcgttgccctctacgcgtagatgccctccaatcgcccggccgatcgctctagcgccggcgagctcctcaacccgagccggccgccgtgccgacgtcagcatgacgtcatctccagggctgacgtcatcgtttccttttctttttctttttcccgattttctaatagattaaaacttcggaaaatcataattaaataaccgtagatccgttttaggtggttcaagtttctaaatttttctaaaatcaagatctacatgttaaaaatatccacatgtactgtttatgcttgtttttgtactgttttattgattttgtttatttgctttagtttccgacgttccggaggagagcgtttccattgaggaaggttccgaagcatttgtggaagcccaaggcaagtcacacagatcccaaacaaccctttgagcatgttgatcccgtttaaagctattattttattttcaactatgcattgtttttgaatgtcatcgggtggtgaacctttcccaattatttaatggccgaagatgactttattttcctatgggttataatttgattggcatgaaccttatatattggattggttcagctaaatgctatatgtaggtttgcttagccatgcttagaaacattagctaactaaatggggttaaatataaattatattacataattattattattaattagggttatattcaatggtagctcacgatggtaaatcgtgtgatgataattaattgataattaaaacttggataaggtgggttgtgagcatatggttttgatggttgtgctcatgacaattaaggaccggttcgcgagctactgttgtgaaacatttatcgtgccaaccacaagccagcgtgggcaacggctttatcttttgtatagcgtgattcattatagtgcgccagactgagaagtggcgagaagtccatgggggtcgctggggagtccatgccttgtttataagggggtgattataatccaggtacggtgcactgtggtgaattgtgttatgcgaggggtattgtcacgactcctttccgaggtaccgtggtggtattgaggcacatggtgacatgatgtggggttgtgtcttgtgggtacagtggtacacctctgatcagagttttaatctattcgaatagccgtacccgcggttatgggtgagttgagcaatgtttttcgtgattagtctcacactactcattaatggtaattatgtggtaattaatttagttcctggtttggaatggttaattcctggtttggaggtttaatttgttcaaccggggttggttgttcaaatgtgattgggcctatgcaacatgggtatgttgtatggtgtttaattaatattgattaattatacaactgttttactattctcttaaatatttattaaatgctgttttctgcaaatgagctatattgtgccatcctttgttattttgtgcacttgcatatttgttgtgtggcttgttgagtatgttatatgctcattcttgcaatattcattcatcagaagaggagtatctcagtgaaggtgatgatctggaggattaggcttgttctcggttaagttgcctgtggagtggagtcgccatcgctgttccgtagattgttttagttttatttttccgctgcgtagaatgttatttttctttgagaggaactatctacctctgtaataatttattatttgcgaatattaaatagttattcatttgtactctattatcaatattgtcattgtgtgcctcggttgattcctagacgagggtttaacacacatgtaagcgtttggaattttggatagaaattccgggcgtgacaagttggtatcagagccaccttgaccttaggataagccaaatggtaaaccttaagtagccttcaaaatattttgaaaaaaaaatagaactgctcttctctattctcttacaaattaattaagttggcagcacatgcgaggttatgcacaaaacttatttaattcaatttcttttcttttaaaagaaaaaggttgttcttttcaaaatgtttctttttctctttacccaaaattttattgattagtcggcactgtacatttattatggtatcgaattaatcatgttagcactagtactacttatctttcctatggtgacattgtaccgtgcttataatagatcataattatcttagctttattttaaatatttgttaaaaaaaataataatatatttgcccctgtctaaaaagttaaattctaaaaaaaatatttataaaatagctttgtatgtgtcttttcttttatttttcttccttttgggtcaaaaatcagttaagtctagttggtgcagctaacttagaaaaatatgcattaattcttctcttctatgtttctttagatgccgccccattcaccgagaaatttgatcgaggtgttaggattcgtcagggagttgaggttgatggcttttgaggtaggctatgaagttgctcccgagtatcgccaaatttcccatgaccccgacgaggagaagtgtcgtgttcgtgtgacattggctagtgatagtgaagaccttccgtcctttaagttcgaagttggaggaagatcgtactgccatgcttgtcaagaagtagctttggtggccattggagagttgcgacaacactttgaagaagagttggattcatcagctttccagtatcatcctcacaaggctcatggtcaagactatggaacctatacctgtcctgatggtgaagagagtgccactctgatgcatgtggtgcatatgcttagtgctatggatgcagtaagtgtggagcgagacaaagcagctcatgacagggaaaactggaatcaaggcaagatttgcaagttgaagagcaaggtgcaccgtctacagaaggaattagctgaacttaaaggagaaacgccgccgccaatatccaagcttcgcctcactgcaagaaagagaacctgtccgccacctcgtctccagttagcttcgaagattcgcgtgatgggtgaagctatgcccaatcgtgctgaacctgtcatcgacatcataagtgatgaggaagaagaggaagatcataaagaaagggagccagctactccagaggaagaagattcatcgtttcgttccgacgcaaggcggaagtagacgcttagttagaacgttgccatagttcgttgtgttagattgcttgtttaagtttgcttgtgagtgtgtgggtttagttgttgcttacatcattggtgggatgtaacagcatgagtctagttcttttgcttgtcagagtgtaagatagttggtgagatagtgttaatgcaacttaaatgtaatcatacacagttaagagcaatatagaatttaaattaattaaataactccgttctaagggtgtctctctgtcattctttcctgttgtctctgcttatcgtcagatggtgaacacgcgcaccggaagtggaagtggaagtggaagtggagctactaacaatggaggagaacccacgctagctcagattctggctcaacagacacaactgatcaacctgttagtgcagcaggcacagaatcagcaagcaaataatcagaaccagaatccacccccacctccccaaaataagctggcagatttcttacgtgtgagaccccctaccttttcaagcaccaccaatccagtagaagcaggagattggttgcatgcggtggagaagaagttggatttgatccagtgtactgagcaggagaaagtttcttttgcttcgcatcagttgcatggacccgctgctgaatggtgggatcattttcgccaaggcagggcgggaggagaacctattacttggcaggaattcacagctgcttttaagaagacgcatataccgtcaggtgttgtagctctaaagaagagagaatttagagcactcaaccagggatctcgttcggtcactgagtacctccatgattttaaccgtttagctcgctatgctccagaggatgttcgcaccgatgaagagcgtcaggagaagtttttagagggactaaatgatgagttgtcttatgctttgatggctacggatttccgggatttccaacaattggtggacaaggcgattcgtcaggaagacaagtataaccgtatagagcagaagaagcgcagggctgcccaatttaaggcacaacagggcagtaaccaaaggccgcgtctcattactggacctcaagctccatcgtaccctcaaggaggatcttcatctgttgcccgtccccaacgccagttctacaacaacaatactagtaatcgtggcaatgacaaccgcaatatggttgcttgtcctgcagcaactccagttcagaaccagcctgtcaggaaggaacagggaagcaagccagtgatatgctttaattgtggtgatccaggacattatgctgataagtgtcctaagcctcggcgtgtgaagaacgctccagtcccgaacaaccccaatgttccagcaccgaaggcacgtgttaatcatgttgcagcagcagaagctcagaatgcaccagatgttgttttgggtacgtttcctgttaactctatacccgcaactgtgctttttgattccggtgctacacattcctttttgtctaaaagttttgcaagcaaacatgggatggaagttgttagtcttgggagacctttactagttaataccccgggcaatcaggtattttcgacacagtattgtccttccgttactatagaaatagaagaagttcctttcccatcctctcttatcttgctagaatccaaagacctagatgttatcttagggatggattggttatctcgtcacagaggagttatagattgcgccaatcgtaaggtgactttaaccaatagcaatggggaaacagtttctttctttgcatcctctcctaaatctcatggtgtggtcttaaaccaagttgctctacaagagattcctatagtgcaagactacccagacgtgtttcccgaggatttgccaggtatgccacctaagagagacatagagtttcggatagacttggtacctggaaccaaccccatccataagagaccatacagaatggcagctaacgagttagctgaggtgaagaaacaggtggatgatttgcttcagaaaggatacatcagacccagtacttcgccgtggggagcaccagtcatctttgtggagaagaaagatcatactcaaagaatgtgtgtggattatcgagcgttgaatgaggttactatcaagaataaatatcctctacccagaattgatgacctgtttgatcaactcgaaggtgctacagttttctccaagatagatctccattctggatatcatcaacttcgaatccgtgaggaagatataccaaagaccgccttcacaactcggtatggtttgttcgaatgtaccgttatgtcgtttggactcactaatgccccagcctttttcatgaatctgatgaacaaggtgtttatggaatatttggataagtttgtcgtagtgtttattgatgacattcttatttactccaagacgaaggaagaacatgaagagcatcttcgtctagctttagagaaactacgtgagcatcagctttatgccaagttcagtaaatgtgaattttggttgtccgaagtaaagtttcttggtcatgtcatctcgtctggaggagtggcagtagatccaagcaatgtggagtcagtattaagttggaagcaacccaagacggtttcagaaattcgtagtttccttggacttgcagggtattaccgcaggtttattgagaacttttcaaagatcgccagaccaatgactcgtctgcttcagaaggaagtgaagtataagtggacggaggattgtgaacgaagtttccaagaactgaagaaaaggctagtgactgcgcctgtattaattttgcctgatacgaggaaaggtttccaagtgtattgtgatgcatcccgactcggtttgggttgtgtgttgatgcaagaaggaaaggtggttgcctatgcatctaggcaattacgtcctcatgagaataactacccaacgcatgacctggaattggcagctgtggtgcatgcattgaagatttggcgtcattatcttttcggtaaccgtacagagatatatacggatcataaaagtttgaagtacattttcactcaacctgatttgaacatgcgtcagcgaagatggttagagttgattaaagattatgatatggaaatccattatcacccggggaaagcaaatgttgtagccgatgcccttagcaggatgtcacgcccagcaattcactagtaatttccgaacttatttgtgcataaaatcctcgtccaggaatcagccgaggtacacaaactgacaatttaatatacaaatctatcataataatatcggtaatacttacaaaagaaaagaaaacagcaacggaaaaataaaatctagcgaagcttcggctctactcccacaggcagctcagctggggtataagccaaacgtcttctccttctggatcctttatcttcaactgaggtttgatgattattgcaagaatgagcatatgacatactcaacaagccacacagtagatatgcaagtgcacaaagataccaaaggatggcataatataggctcatttgcaaaagcagcatttagcaaaacatttaagagaaataaaacagcggagtaataatcagaaattttaattaacactgaacaagacacccatgctggacaggccccaccattctggg

SEQ ID NO: 29624 - DNA, 2421 bp, Oryza sativa
  unsure (1)..(2421): unsure at all n locations
cagcgaatgattgacagatcgcacaccacnnancaacaagtgtcgagtttcaattgcatgcctaaaaatcgcaaaaccaaatatagagcacctcaacttataaagcagtgtaaattgagtccactgtcttaaaaccaacaatgtattccctgagttcaaaccattgagaggattcaatgtctctattgagaaactcacaaagagccagtcttttttaaccctatcctcaatattgcacaagcacacttctctttcattggtagtatctcttaccttgtggatccttcaaacttcttttggtgccctacccgtgaatgggtgttcagatgatgctacaggtgtcctcgacctccaagaataacatatcctacataatcgtttggaatcaaaacctagtgttcaagatccatgagagaagaacaatcactagattcaaaactccaaatccgtatccaaataacaaaagcagagaagggttcgagagaggcggtgaaaagagctaaaagcactccaacatcatgcttgaagccaagaatattttgaatgaagcgaaagacttaccctagtatagagccagtgagagttgggacttatataggaaaccctaaatctgcccattatggggtgggaggatctttcatcaccctaaatctgcccattatggggtgggaggatctttcatcacacctcggatattctgacttgaaggttatatattcgatcaacatatcaggtctctaatgtctaaaacataatcccattccataaaaaaaaaatactgatcagatattccaattaataattggaaactcagattgaagaaataaatccaaacagagacttgggttacaaggaaaagtgaatatttcgaccatttgatcttcagactactaagtttcagactactaagttggatattataattcataatgttgcctcgacctgagagccaatttctttgcaatatcggattgcctgggatgttggacattctgattcaacgtaagaagtttttgatcgaatgtttgaagttaaacatagatccagttccttgcaaaaacatatagcctgattgatcggattttccaatgttacatcagatgctatgatcactttcaacaaaatacaaacagagcctatactatgatcactttcaacaaaacacaaacagagcctcgagttcaccgtgaaaaaaggaaattatgatgcgttaaatactccgactagtgtcagaaattccgaccataaatcaactcaaacttagagaaaacttgatattgagcactatattctctgtacgttatctagactcaagaaataaatacatacaagaattaccattgtctaggatcatgtcttttcttccatcaaataacccagaaccccattttcctttgaagcactcatgcaacagtagagcattcttaaaaatgtcatcattaatcacaaaaataagttatgaagatgtactttcatttgtggcataaagtttaatggtattttatctaccctcattaaaacagtgttgaaagtgcactggcctgtgcataatattttattggcagtaggatttgacttttaaaccctggtggccaccattaaataacccgtgctttgcttatttatggaccgttttaaaagagtgaaacataaacaaatgctaatacttgatatctcaaaataactttagtacttaaaaagcttttgtattgatatagttttaagtataaatgtttgactgactgaaacaggtaaaatccaatatacaaattgtgcagtacccaatgggaagtaagaaaaaaaaaccaaggcaaaccgagagggagtatccggaaaagctaatctgctcccatcccatgcagtggcgggcctaggatttttaggttgggtattcgaaatgtgaaggagtaatttttttagcatgtatcacatagtactaaactacaaattatgtaacatgaattaggtataatttcatataattatatacttgatttaaactactaattgtacaaatagaaagtactaaaccgtcccataatataagagattttggctatatgcatagccaaaatccctcatattataggacaaaaaggagtatttgacaattgttcaacacataagagtggcaatatgtgaaatatatagatgattgaaaattgtgcagtgtttgaggcaagggactcatgaattactgatttagaattcatgaacaattgttcaagagcaagaccatttttttttttcatattttagacctaaaaatccaacaatatgggaatgggattaatgcctctagatttttgaccaatggcaagccggcctaaatgcctaacagtaccagggtgaccttataactctattgatcaagtacactaacacaatttaaatccgaccaataatgattagcggcattgg

SEQ ID NO: 29625 - DNA, 8314 bp, Oryza sativa
  unsure (1)..(8314): unsure at all n locations
cgcgccattggatgaccatcagctggnacagnacntcatcatcatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctcttacgctccaccggctcgccttgaccgccgccgactggtgtttccgcctgcacggctggcctattatgccgccgttgttgggcgtctacgtcttcaccgaccggcttgccttcgtcgccgccgactggtgtttccgcctgcacggctggcctattatgccgccgttgttgggcgtctacgtcttcaccgaccggcttgcattcgccgccgccgactggtgtttccgcctgcacggctggcctttatgccgccgttgttgggcgtctacgtcttcaccgaccggcttgccttcgccgctgccgactggtgtttccgcctgcacggctggcctttatgccaccgttgttgggcgtctacgtcttcaccgaccggccgcctcgtccgccgccgactggtgcttccgcctgcacggttgacttattatgccgccgttgttgggcgtctacgtcttcaccgaccggccgcctcgaccgccgccgactggtgtttccgcctgcacggctggcctattatgccgccgttgttgggcgtttacgtcttcaccgccggcctgcctccgtcgccgccgattggtgcctccgcctacacggctggcctattatgccgccgctattgggcgtctacgacttcaccgccggcttgcctccgtcgccgccgagtggtgcctccgcctacacggctggcctattatgccgccgctgttgggcgtctacgacttcaccgccggcctgcctccgtcgccgccgactggtgtcttcgcctatatggttggttggtcacaccaccgttgttgggcgtctacgtcttcaccgccggcctgcctctgtcgccgctgattggtgcctccgcctacacggctggcctattatgccgccgctgttgggcgtctacgacttcaccgccggcctgcctccgtcgccgccgattggtgcctccgcctacacggctggcctattatgccgccgctgttgggcgtctacgacttcaccgccggcctgcctccgtcgtcgccgactggtgtcttcgcctatatggttggttggtcacaccaccgttgttgggcgtctacgtcttcaccgtcggcctgcctccgtcgccgccgattggtgcctccgcctacacggctggcctatgatgccgccgctgttaggcgtctacgacttcactgccggcttgcctccgtcgccgccgagtggtgcctccgcctacacggctggcctattatgccgccgctgttgggcgtctatgacttcaccgccggcctgcctccgtcgccgccgactggtgtcctcgcctatacggttggttggtcacaccaccgttcatgggcgtccacgtcttcgccgaccggctggccttcgccgccgccgactggtgtttctgcctacacggctggcctattatgccgccgttgttgggcatctacatcttcatcgccggtcgtctcatctgctgctgactagtgcccttacctctacgtctggtttatacagctaccactactgatggacatcatcgtcttccgccgccgactggtgcttttatcttcaccgccgctgactcgtgttcacttcatcacggcaacacaactttgtcatcatggtggagcgacttcatctttattatcttcggtaccagcaaactctattgctgctacttcacaagttttgctacatcaccaaccatgacgttgttgtgaatctcgacatctcggcatgcgatgccgtgttattttactacaacaagtggctctccaacattcatgatttctacttggacatcttcaacacatatcttcaatcaagcaataactattcgacgacaagatgctacagttctcgactctatgttcagttgttttccaactaatcaaagagtcgggggctacacaaatataaggctcaaaatttgacaaattttatgtcaagctgaagaaatcaattcatcaaccaacgagtcaactccaggagtcattatcttcatctttgattcggagcagacattctacttcaacaacttcaaatatttcggtttagacgagttgggcaacaacatcaactctcctccaattatttgtcttcacggttggcctactacgcaactgccgatagaggatctcatcgttatcatcggctgctacatcgctattgactggatcaccgacatcgtcatcttcatcaacatcttgtcaagcctcttcaacatagcctactctgctgccgttgatgggaaacttcgtcatcatagtcggctatctctgttgccgctaatcatcattaccgtcggatgcgtttgtcgccgccgattattttcttcatcttcatgattggtggatttcgccatcaccgttgatgcgcgtctacgtcttcatcgtcggtttgcttttgtcatcaccgactgctctttcgttgttgttgggcgcctacatcttcactgctagctgacctgactgttgccgactggtttcttcgcctccatggttatgcaacttcattacctttgattggtgtcactgtttttactaccactgacatcttccgttacttctgatgagcaatttcgtcttcatgttggtcatttcatctccatgccgactgcgtcagcaattgccaatagacaattttgactatgacagaaggacaagctatatgctcaggggctcatcaactcaagcgtgaggattatatctccaatttggacttgttccggatacattccacatggattcatagtcatgagtctattttctatgctcaaagactggaccaattattattccccgtaagggctatcaaccgaatacttgcgccagttgggattcaattattatatttattttggagtatcccataagggataatcattcagatcagaagctattcatatgagctacacttggtctatattacccggaagatttattactcgggagcatgttacatgcgtcatcctttaaagggtgtcgaatgcatattttttggcctaggcctaatatgtctgcaacccatattttcaggtatggcctgtcacgttcttttagggacttaggcactttttgcttatgccaaagtgcgcgtgatcaagtgcccaataccttaaaatccttttataccgcagttacttaactttttaggagttggtacaatgcatcttaaaaggtgtcaaacagtaaagctttatatagctgtcccgctgacttttttatatataagtcaaggtgctgtttgggtttttaagcaattgattggatacaatatcattgcttttcgccacgtaagtgtgcatttttattgaccaatattatggcttaggctaattatatattgtggtcattttctaggcggttggtaaatcctttatgagtttatttactcggattttacaccacatatgccatatatttccaggtgtggtgaaaccatgtgtcttttagggactaaagcacgtctgttaaagcagtatgcgcatggcgtatgcccaatactttggaaatttatttattcacaacatacaagcttctttatagctgttttgctatgtgaattttcaataatgtagccaactttaggttacactcatcatattttacaaagcagtcggtatatcacttggatcatattattcagggattcacaccgcatatgctacatattaatattaagtcgcttggttgactacaattatcgaaaccactcggttggttagattatttattccttgattatatgtttggtttgttcaattaaccacatagtcgggggttacacctattaggtgcatctagtcgatgcatctgactttattttttcagccctccacagtcttctgatttggaaaaagtacttgggagatcatggcgaagatgattgaagcactcggctttggagtaatctagttcgagagaagattatctttccgactgtgaaggtctcaggggctactgtggagattatgggtaccccatacccacacggcatggttatccgactagttataggggataacttatatatatgaaatatgtaacagatcatgacttgggtattacgtttccctgtatattatggaacggcctaaagtcctggtttgataagattgtaaagtagatttaggaaaccgataccgtattggttaaggtttctatcttgtaaccctgccccccaacctacataaggagggcagggagcccctctaggggcatgagacaacctgatcgtcagatcaatacacactcggcggattcaaatccccaaacaggagtagggtattacctctcattgagagggcctgaacctgtctaaatcctttgtctccacatccatccacttttaggtctcgtgcgctacccctttttattattgccgaaatcatgtttcgacaccaatgaaagccaccaagaatgcgaaaggtggttggggttgtgggattgaacacaaaaatagctttagcttaatgaagttgtttggaactttgtgcattttatcttgtgaagttatatggaactttggcttaataacttctgttctttttttttatggtaatgatttttaatctggaagaaggataaatgcattttatctttgctaatctacctaaaaaatatgggttaaaaagtgcatgtatttgttgtcgtgcgcggcgtgtcgccgcgcatacccttctagtaaactaagaatggattcgctagaattgtgtcgccatgttctccagcggattacagtccgattttcgtttggacagattgtttttagagttaattggatccatgccattgcaaatatgccaaattaagaaaatgccactactattcgtgagcactcttgagtgccactgcaattctgggaaattgaattcatgccactcctttgtgttttccatccactccctattgacgccgtctctcagcggcgcctcttcgcgttttcacgtgcatggacgcgccgccgccgccgccactccactccatcgacgacgccgacagcggaagccacctcacaggcgtcgactcggcgaccatcgtgctgtcggggcgcgcagcgaggaagccgaggcagccaaggaggaggcggcagagtgggccgcggctgcgccgccgcctccggccggcggcgtcggcgtccctagctgaggacgcgcgcgacgaggtccttgcggcagtggatgaccggcggggcgacgaggagcagccacgtcgctcccctgcagcgtcctcaaccgccgtcatggcataggggccgctccgcacgggattccagtcgacactcacacctgtgccgccaccaaaaccctaagccgctgctgccgctcgcgcctgcgttgccacctgaacccggagctccggctgaggatgcgtgcgacgtggtccttgcggcggtggcggcgacgggctgggttgcgtgacgttgtcatcctcgtcctcctcacctctggatcttcgcacacggaggcggcggctagaaggacaagctatggcgctgcacgctgcagccgctgggtgactacgtcttcggcaagcgcagtgtctgggaggacggtgtcgtcctcttcatggtctccaagccacgctgctcgccctcgccctcgccctcgcatggctgaggggcttccagctccgctcgtcacggatcggcgccgcgaacgtgcggtcggagcgagacggcgtcagcaccgagttggaggccgctgtgctcgaccagccccggtgtcggcttctctttctgtaccttcctcgttggcgccaccccgctgcccttttatagccaccgaccaccacctcaccgagcctgacggcggcggcggcttccacgcacaggaacagggaagttggcaccgtggacggggagtggatggaaaatgtgatgaagtagcatgcatccaatttcttaaaatttcagtggcatccagccgatatcccgaatagtagtggcatttttctaatttggcatatttgcagtggcatggatcgaattaacccttgtttttaagattcatgctatattgtgtgggtgcatgactgcgtggtttaaaagtgcgtttgctgcctatcagctttcaatgagtgattaaaatagggtcttttagataaaaaaaacgttaaatataattatagtacaaatctagtgtaattagagcaactccagcagggcccttaaactattttaggggctggataggaaaaaacgaggtccatcagggcctctactccagcccctagaatgggtggcggggggaggggggggctatgggctcttctctcgtccccaaacactgttcacacagggtccacgcctccaacgacctcccttctcgcagcgcctgttcacgcgtgcacggtgccgccgctcaccctcctccacctccagctgtgcttggcgccgccaccaccggccagatccatcgccgccagactcgggtactgccccgccgcctccaccgctcttcccgcgtaggtggcaacaagtgccctcgccccgctgcctgccaaccggatctgagccgccctccctctacctcatctagcgcggtggcggtagtggcttagcagctcgcactcgaggaggcagcagcggctctggcgtcctgcacggaggaggcaacagcggcttcagcatcccttgcggaggcggtggcagcccgcgggtgaggaggcgacgggggcccatgcgatgggggtggtaggggccacgcatgaggaggtggcagcagtggagaggaggaagacgaggaggaaggaggcagcggtggaggcgaggggtggagtttttattttaggaatttttttcttgaagaaaattttagagaaaaagtaggggttgttaaataggggctattgctggagtaggaggctgaatttgggtgctctgacatggtgcttgcccccaaaaggtatatgtaaggtagtgtaattatatagataagtaagactaaaattgtaaatacacaaaaaatatttgggtgtaatttagggagttaaatgtgtaattttggaacttatattgtaaacacactaaaattacatatatgtaatataggcattgtaaaaatacatggtgaggctgtgtttagttccacgccaaaattgaaagtttgaagaaattttaacgatgtgacggaaaagttggaagtttgtgtgtgtagaaaagttttatgtgatgaaaaatttgaaaatttgaaaaaaaaattggaatctaaacagggcctaactactttttcactaaaaatatagcatgatatttataggcagtcccaactaagaatccatgtgtcgatccacgagatcctatggacgtgatatttcacgatactcccacgcacgatccgcgcgaagcctttttcgtggaaaaattgcctccccctttccttcgcccgttccttcggacggcgtcctccgcagagcatatctcgccgagtcgccgaccccctcctgaccgccgcgctcccaccccgcctccaccgctgacaagctcctgctccctgcgcttcgcatcgccgccgttgcgtgctcctgctcctctccgtttttaataccgtcgcctctgctgctgctgctcaacaccatgcaatcatcgtcacatatttaaggtcctcattcttgaatcaacaccaggcagcaaacatatgatcaaaacatcagtataggttgactagtaggcatgtaatgccagcgctccatcggtcttagtggagagaaagatactttgtcccaaaataagtaaccttccaatttatcgtgctaacatcgtgaatagaagcatacaacccattcaccattcaaatgaaggagtctagtgtgacctggtaaaaaaaaaacaatgggatgtcaacatatacgttggccctatattaacccaccaattagtggattgattaactcaacaattgtatgcaaatcaccacccgtttctatctgcagtatggttaatgatgnnctgcttgcngtcgaagnagtcgtatcaacaagccgtg

SEQ ID NO: 29626 - DNA, 10629 bp, Oryza sativa
  unsure (1)..(10629): unsure at all n locations
tctggcaccaggagtaggttctnctactgcaagnacctcatcatgaagtcatcctttgccacttagaagtagcatgttggattcctttttcttcattggaaatggtagtaatcccaagagaggtcactggcttaacaaaagagaactcgtcacctatgatcagtgtaagtagtgtatgtatgtgtgtcggcatccttcggggcgcttcctgcaatagcccgtaactagaaattcgtcgcgccaaatggcgcgccctttttagcatgttctatgcatatgaacgtagaattttcaaaagattttggtaggattagaccgacttcattaacttgttcatttaacatgtagatttattcaattaaaaatcatcatattttaatctatttatggcatagctattaaaaagtgtttttatgtaagtctacattatttaaaatgtacttattttaaaaaaatattgattatcaagctttatcttcagccaaataagccatggtctttaaaaataagctttacaaaatggattgttttttatgtaagtctacattatttaaaatgtacttattttaaaaatattaattatcaagctttatctttagctaaataagccatggtctttgaaaataagctttacaaaatggacatttttaaataacgaccgtactcgttttttacataaaaaaagaccaaatcgaatttatgataaaaaaaacaccttttcctcgttcaaaatataagcattcaaagtttatatcagaatatagcaagagtatccgtcccttatctcaaccaatcataatatttcttatttaatttttccacttactcacctagtttatatttggtcttcagctaagaactatgtaataatggctatagcttctattgaagtaaactggattttatccattttctaaaaaactcacctagtttattaatacttatacccaattccaaacatttttttagacctacaatgacggggcatttctcaccaaagtagaactaacaaaaaaaaatctactccaaccccgaaaactttatttctagcaattcttcattttgccaaagttatataaatatcgtaaaatattttacatgttaaatataactatatcttttggatccatcaaaacatgacaatttaaaagctgattccggctatcggttggcaaaagtgaagcatttattaactctctttattattttatttgtcgatacttatcaactgcattagtgcaaagagacaggtagagtaatgagttttctagagattctgatgtgcaagggacatcacaagagcttattctgattgacacgtggcaaaattttggtgatgtttagctaatttttcagtctgccacgtggcccaataacaagctagaatcatgaccctgaaatcggtattaaagaaagatttatcgggaagacattcaccttgggagattgcaaaggtcaggctccctgttttatagcgatatatgggagattgggaggtctcgggggcatatgttccaataatgaaagcgggagtgtggatgatcctgtcgcatgtcattagaaacaagggcatattgattggagtcggcatggactgtgtcccacacgacttagtcttttttgtaagtaaagattgactaatttgcatgggtatcccatattaacttgtaatctaaacaaaacttgcaaactgatatgaagaaatgaagctagataaataacatgtctgtgattcaggagtcgggaacattacactttacttcctctgtttttttaactaactaatgtcatgtaatgtaaataaaaatggagtgagtatctagctaggttcgatcatcatagaccaatttatccctgcaggggcgaaagaatgtcatcaagatgctgaaagaaatactcgatgagaggaagaacacacaagagccccatgaaagcgttgacttctttgatgtgatagaggaagttaaggccaagaatcctgatcaaatgaccgagaatgccgtgttggacttgctctttttgcttctatttgcaagcttggaaaccacatcatccggaataactgcaatgcttatatttttgacagataatcccgaagccttgcaagaactaatagtaagtactagtacaagtcatatgaactcctttaataaattcatactagaaaatcaataaggtcagatgttcaatatttccatcattgataccttaggattgagctatcatataggagtatgtgacaaccgatatgttaagacatatttaattaataagaacatatgtatacataagaattatagcaggaatgtgaatttgatatctacgaatgcatatctatgctccttataaaaagagtattggtggtggtggttctgacaccaccagaactcccaattttttatgagacaaaaaaaatagagcaccacaggtcaactacttgtctgaggtcaaaggatccacgtgtcgataacaaatatgtacaacaattaagatatgataataatgggttaatggtaatcttatttaattaaaatgctattggctattgcaacgcatgggctttacccaaaaaaagttaccgtggtaatgctatacatttccaaataatccaggatacgttttcttgaaaattaatgatgtttggtctttttaggaggagcataataacattcggaagagaaaggctgataagaactccgaaatcacgtgggaggaatacaagtctatgaaattcacatctcatgtatatgccttcaatttcttaacttcatttctacataaataattagcaatctacacatgtttatggttaaggccaaatcgtcgtacaatatatgcatacactcatctccttaattatttgtaaccttaattatgtgtaggttatacatgaagctttaaggctggcaagcatcgctccagtgatgtttagagaagccatagaggatgttcatataaaaggtaaaaatgaattgtttttaacaagaattagttatacaagtcataggtaaaagttctatacctcctttccgtattataggtagtttgacaagttcattgaaaaacatagtaactgttacaacatcaaattagttttatttaatcaaccattgacaatattttataatatatttgttttatgttggaatttttgctacatttttataaagtttgttaaatttgatgaaatttgacttataacaaacccaaaatatctcataatatggacggagggaatagtatcaaatttgtcaaaaaaaaaaacattgcagtatgtcttcttatgagatatattggtataatttatacaggttttgctatcccaaaaggatcaaaaattatgatttgtccttacactgttcacttaaaccctgtggtttataaggaccccaacacattcaatccttggagatggaaggtttgtgaaattcataaggagttaatttctatctgatataatacttaaccatgcattaatgtatatctatattcctcctagtgaaaaccaatattgagcaattaaggagccaacttttttgcatgtaaacacatgcaacattgtaatttcaaatgtgagcaggccaaatatttaagtatataggcaggattctcaagtgtagtatagttccatcaaacgggatgtccaacaattaacatgacgagccgctgaattgagttttattacattgagataatgtttgacatacttaattaggtggtttgttcacaacttacatgtttaaatatggtttaagttttgttattgtgctacataatttattagtgtaatctgaatatagcaagctaagatacccaaacaattgctattggctgataaataagagagtttactctactgatcttgctaagtactacacgttattgctagaaataatggagcaaaaagcccactgtttttgttaggcatcaggtcgaaggattaacatggtcatgtggatattttgtctacaaatagaattccaaacatagcttactcacactaacataaaggcttgcatgtgcttagatatcaaaaaataggattaaggagtgcggcctatacagcattaattccctccacaaagttttgatttgttgcatgcatgttgctatatatgtacggaatattcctgaacctgctagtggtgcctccaaggatttcatggcctttgaaggggggctgcgcttgtgtgttggtgctcattttgccaagctgcagatggcggttttcctccactgcctagtcacaagtccaggtaaatttttcactcctattcgtttcattctacattaagtatcaaatcctaactataaatctgaacatgtgaaagatttgattcttttttatggagggtgtacctttttcagaatccatctgagaacttagagatcattttcatctgtattaaaacatgtgtatacagcttttgcaaacattttgttatatatgcaagtaatgagtgtacttaggattaagagaaccacttacctatatatccatggacgcttaagtgcactgcaaaaaaaaaaattgatctttctgtctacgattgtcagttggaaagcaatcaaaggaggaagaatggccctttctcctggactacgatttcctgaaggttttcatatccaacttttcccaaaagcctgaagtacttggtccatttacttcttgctcctacacaataaataatgttcataagcatctatgtttcagatgcaaattgctcaatgctttgatgtaatttcttcacttcgctatatatgtcgtgtgtgtgccgcccaaactataaataaatatataatttatatatgtttgagtcctcgtaagtagtaacaagcaatttgctaatatgttgtcgcatactcgcacagtcttcacctatgtcctcgtatagtaagtactatgtggaaatgcataatgtatgtaaaatgagttcgattcataagaagcatatactccctctgttcaaaaacaaaggtattctagtttatttagcaaatgttaaggtttgagaacaaaatgctatgggctacctttgctaaatgagtactccatgcatgcgtctatataaaccataatcaattcagctttttaatgatatttcaatttcaggtttctacctaagttgcaacatatactcccacccgtttcacaatgtaagactttttagcattacccacattcatttaaatgttaatgaatctaaacacatacatatgtctatattaattaacatctgtatgtatgtgggcaatgctagaaagttcatttaaatgttaatgaatctaaacacatacatatgtctatattaattaacatctgtatgtatgtaggcaatgctagaaagtcttacattgtgaaacggagggagtagtatttatctgaagattcatattgttattgcatatctatagagaaaaaaattctttgtatctactatctccatttcttttttttaaggaaagcggcaagagtattgccgaatatattagaagaagagtaatatgcggtttacatgattacacgattacataattgatgcgacgtaatagcttagaagcatcccaaaaccatatattatggtttgatagggtaaaaatatacatcatggtggttgaaatacaaaactgctttattgaataacttagatgatctggtgtgctgtccgttgcacgtccggttcttctcctctgaagatctttgcattcctttggagccaaatatgccaccacgtcttgacaagaacacccacctttctccttactcncgtcttgttttcattctgcatgatacctgccatccattcttttatggaacataagtctggttattctgaataccttgaacagcagagacaagattccatgtttcttttaggaaatcacattgtcgaaacaagtggtcggtatcttcaaattctcctctacataaggggcaaatccagtcacactcccagtgccgaatcagcatgttttcagctgttagaaccttgtggtgtaggatgagccaacctaagaatttttgttttggaagcgccgacgccttccagttcaacaggaaaaccttgtcttgctgagaaccaatgaattggaagagataaggactttttgccgagtatgtggccacattattccttctccattagattgtgtcttctatttcatttagcaaagtaacactgctcaagagtcctagatcaatgagttcctggatctcttcaaaatttaaaacaacctccgtttcatgttattataagactttctagtattacccacattcatatagatgttaatgagtctaggcacacatatatgtctagattcattaacatatatatgaatataggcaatgctaaaaagtcttataatatgaaacggaggaagtagatttaaggaatcttaataatttcccttttttttcttatgcatattgtttagggcctattttgttttaaaatgaaaattgaattgtttaagatctcacataacaaataaatggatagttggggttgtgatgtttattggaaaagttcaactgctgaaagaaaatctgaaaaccaaataaataaagtacatgtcttggatttgtgcggaccacatctattcctaacattcttgtgcacgacctgcaagcctagcatttggaaggcccgcaggattggttattagcttagtggtagaatgaatcactgatattgcatcattgtgcctgggcaataagttctctcacctatatggatagttgaatgtactcattagcatggcatactcgtcctgtttaaatcagggtttgaaacatgtatttttctttttcctatgggcccatgtgggtggaagcaaataaaaatgagaaacatgttatccgctcccgcttcgcgttgccggtgcaatgctaataatttcccctttttcttatgcttattgttaatggcctcttttgtttgaaatcgataatacattttttttaggatctcacataacaaaaacatggatatttggggttatgatgtttattggaaaagttcaactgttgaaacaaaatctgaaatttgtacatatttatgatttataaaatttaaactgctgggcaaagccctggctgtactttcagtcaaaaaaaaaatctgaaagctaaatgaacaaagtacatgtcttttatttttgtggcccacatctgttcctaacattcttgtgcaagccctggaagactagcatttggaaggccccacataatgggctattagcttagtggtagagtgcagacaccactgatattgcaacgttttgcctgggcaataaggtctctcaccgtcaatgcactcatcagcgtatgacccaaagatatggatcatgtaagacgcattagcatgggcatacaagaaaatttcacaatgcaacttcaccatcccaaattcacccaaaaaaaattcatgctcacaaattgacaaaaaaaaaacagccaaggatgtcgtcgtagtgttggagttatcctccgtagtatcatcggctagcgtcttggggaagaagccgaagctgtgcacaagcatcggcgtcgacgagggagggcggaggccagccgcgacgagatccacttgaggccaggtggcagcgaatccactctcccgagggccagcggtggcggaaccgccatttgttgctgctcttgccgccgatgcatgagggagagagaaaggaggttgcgtcgacacagtcatcatcctctctgccagatccaccgttcacaggccaagccaccacaacccttgctctgttgcctgatccgcctcctaggccccgcctctcctcctcctcgtcgctgagatgccatcgatgctcctcctcatcatgactgagacattttcgccatcgctcctcctcggagccgccaccttttcacctccttgttagagccgtcgttgctcctcctcgtcaaagtcgccgccactgcaaccaagtggtgggtttagcatgagagagagagagataagtggcagggggaggggagagaaatgagtggtaaaggagaggataaggagatggggcttagattttttttatgctggggcatgaaattttcacgtacgaagtattgatttttacaagtggggctataactatagcagctcctgctatttttccaatcggtttataagtgggaattttatggtccacctggagaaatgaaagctaatgttgtaaacactagtacagattcggccatccttgacgagtcatatgtgtcgagcttatatgacctattttggatgacgcatctctaacggttcaaaaagtatcccatttaatacatgactatcagggatgatccgtcactgatataaatcatctttgtcaggtcatcgttctaacacatcacaggtaacctataacgggtcacaaccataccccttcaccgatttaaagtcatctttgtcgggtgaaagttctagcacgtcacggatgacctataatgggtcacaaccatacctcgtcattgatttaaagtcatctttgtcgggtcgtagttctaacacattgttgacggtcgttatcgaccagtttcggctgtcaatattacccaattaatgaggactaactatgcttgcaatgcattattccataaataaaatattctattccactatatgcttggaaaactaaccatgcaggagaagctatcaaaatggaggagaatcgacagtacaataatcgatcaatcaaacagacgttatcgagaatcagacttatggatggatgggccaagaactcagaaatgagctatcattctgacccaaaacattgtgtaccataaagtggggcccacatgacaacatcctgaagaaggttgtgggccaggggagccagccagggttcggctgaacccccaacttgcccaatccagcccattttcggccaggcagttactaccggcatcctatgacggttcgagctaattctacctgaagaaactgccatggacacatggcaagaggagatgaaatatgctctttggatgcttgaccatgtcacttgtcatgaggagagcaaagatgctcctaggattcttggagcatctccactctcccaaggcacctcatgggctataaatatcccttctctcattcattcccacacacacctcaaaaagaagatcaagagctctctcaagtattttttagtatttctagtgttagtggagtaggaaatagaatagtcttcatagtcctcgagtcttcaggagaattcgggtatggctttaataactttcctttcttcttttgtaagacttaatgaattaatagaatattcttctttatacaagtttggtattttattccattcatattacttgagtaccgactttactttatacttgaatcaatatagtcgcgtaactagctttccagataggtgtattggtgtgggtttagtgtccgattattcggatgctctatgtcggttgcaaggatgtagagtagtatttagtaatgtaagcgcggtgcttagattattagataccattaataggggttatatactgcggatgagaggtgggccgctgatggtgacagctcagtacgggtattcctctgcgctggtatataatcctaagttaattccctggggagggtactcctctgtatttagccccggttgtatggtcatgatgggctgtcgtaaggaactcggtagacaggggtggcttcttgaaacaccgagaggacactgggtacggggtattggttacatgactatataatagcaagtatagactaaagatgtatgtatactagaaggacaagaatgatgcttttcttattctttctccacttagcttagactatattttagtgagagtagttcttagttctttcttctctgtgtcaacctaccctttgaactgaactaactcctacatagactttgatggatacaagtaatatatgtattgttagcatagtactctcttatcatatcttcccttgggataaaataaatatgatacattggaatactcccgggtgaaatgctacaatggtatactcgtgagcttgcggatcacatctgtaaccataatataccaggattatttctagtgctacttctgggaattatatttctagtagtgtcgctaggaaataccaacacacagcatgaatgacccataacgggtaacaaccatgccccatcacagataacatgtcatccatgccaggtctaataagataacccatcaaaatgacagcactcatctatgacaaatcttaatgagataatctattctataccactgggtttgtgtgagttcaatgatttgccatcgacattgtatctttctataatataccggccactttatcaattgttctacaatacgccactgggttggacattcttttcaaaaatacccaaaatacccttatgaacatacaaggttaacaattgatttatctcactagaaattccaaaaaaatatgaaaacttttatgtggtctctttacacaacatggaaatttgtataggagtttcaagttttttacacttctttttttaaattataacttatatgctatattgtatataaaaatatttttttattatttgtaatataaaacaactttcacacactan

SEQ ID NO: 29627 - DNA, 3704 bp, Oryza sativa
  unsure (1)..(3704): unsure at all n locations
cccgcctcgcacgcgcacttctcaactctggcntttgctctctctcgcgccccntaccgttgtcgcgcgttgcgcgctcgtactgggttgttaattgtttgttcgcgccccccccacccccccagaacgttgatgacagtggttagnaccnactncatnaccaatggcatatcatagaacaattgctaaagttatcggtatattatagaaagagataatgtcgatggcaaatagttgaactcgaacaaactcgatggtatagatagattctctcaatcttaattaacacccttcacggataatgttaccctgaagggtgacaattacaaacctccacgcatgaggaaaaattcaaatttttgaaattttcaaacaacctcagattatgaaagttgtagatgtcaatgatatttataacttcaaaactgataacatttgaatttgagatagtttacatgcccgaatatctatacctatactaatttggcactttttaggagccctcacgttaataagaaagatccgaccgttgattagattgatcctattatcatgaccgtaaatcatacttaaaattatctcaaataaaatatgtagttttgcaatattatatgctcttttagttatacatacagtatgagctgtttttgtggtccaactatataaaatcaatatgtgtttgactgttattctatgataagcaattggcacctgagattattggttttgatatttggtgattattggcaaagtggttttggagataattggatttgtaggtgatgaatatggactgcttattgtcgtgtcgggttagaccaggcaggtgttgccggtcagaccggaggtatgcgtgcggtcagaccagcttgcccgcggtctaaccagccgactctgtgtcggtttcggtttcgggttgtttcattggatatccgtggatagttcatttttatggcttctagatggatactatgtgtatataatactgttgtttgctaagaatgagtcaaattggagatagctgggtctcggaatatagttttttttgtttgattcatgtgtaggtgtcttgatgcctcgaaagagtattgccgatgatggattaggagtcaacttggagataaggtgatgtctggacggtcacatatcatgcaagatacttgggctaaagatgaatgcacgtggttggtgaagattccatatggcatacgatggagatattgtgtgtgtattggatgcggagtcaaatttggaagtagtccaaatttggtacaattggagtttgtaaagttggtttcttatacaggaaagtttcctagagggatttggacttctggtatgagtttggttcgtggctttaggctgcctacctcatgtataaatagagagggagggtgaggcctcccggtatcgctttagagagcattgagttgtgagaatagtttaggtttcgggtttaatggagattttcgtgaggagtgctgttgctgcactttgtaaacatagagagaagtaataaagttatcatctactttgggtgttcttcaatttgtgtttggtcgggttcggcggtctaacccgcgagacaccggcggttagaccagtgggtacacggcggtcagaccggcatcagtgacaggaagcataggcgatttcgggatggttagaccgggtgatctactccggtcagaccgacgacttccaggcggtcagaccggcggatcaactgccgtcagaccgcgtttcatcgattcaacggtaacttttaattccactcaaagttttggtttttgggtaccgtactacaaccattcaccctttctggttggcttagtagaaaagtaaccagcatagtttggttacaattaaaaattaatattttaacatgacccgtgtaatgcatgggttggtgacaactgcattataagtggtgagagctattttgaaatacataattttgaatttttcaaatgatctcaaatggagacatggcctatatcaaagtcaaagggtttgatgagatctacaactttctaattgaaaatattttcatttaagattgttttcttctccgaataagtgttacaagtgatgtgatctatttcaaaaatattttaatttaatgtgtttttcaaacaaccttggatggagatataccctacactaaagctgtagagctcgacgagatatgcaactttgtagttcaaagcattgtcatttgaagtcacctagcatttcaattttgtgttttatatttggatataaatagttaaaaaataacatctgattaccaatcaacatgtggtatgtaggtgggatggtaagattggtttgcatgtgttgagaggtcttaggtttgaatctcatgtatgacatgtatgcatttaccacttgaaaaataaataatttctaagtagtgatatgtgaccattgttagaatatccatgcaatattttaaaaaaaaataggatcttttaggtttgaatctcatggatgactctcattggtgacggatcaaaactaccacctgtcacggatgagcgtgacggtcttttatttaggtccgataaagatgattgtcatctgtgacggtggccgatccgacacatatgacatttcacaccacttacctttgttttgtgacggtacccctcaccgacataggtgagccttcccgcccgttatagatgagctatcccgtgctattaaaaaaaaagttttctagaagtgtgttgtcctcgctgtacaactaaacttaaaatctgcttctaaaaagtcaaaaaaaaaataaattgaaaatgttctggtatatgaaacactatgagtcatatagtagcacacaaaaaataaactcaaaatttgatctacacatattgaggagaaaaaaaaagataaatctcttgtgaatagtaatgtgaactatttgaaaatcttctttcttctggtttacataaaatttgagatgatttttagtgtggtacatatatgtaatagtgtttcgcatctgagaatgttttttcaccattttttgtggctttttggggtgcgcaccttttaaatttggtagatataccacagcactgtttgggttctctcgatcaacctcaccctcccgttgagcacacgtacgatttgcagaaagtgtttcgaaatggccctctacattgtttgccttcacacgcaaataacttccatcgcagctttcgtgcttgactacgggtgtgttttagttcatttcaaaattagaactttggttgaaatttaaatgatgtgatagaaaagttgaaaatttgtgtgtgtagaaaagttttgatgtgatggaaaagttggaagtttgaagaaatattttgcaactaaatattttgaagaaataacttcatttcacaagttagggcatgtttaggtcatgcatgaaaattttggcgtgtcacatcggatatacacatatatatttgaaatattaaacatggactaataacaaaacaaattacagattccgcctagaaactgcgaggtgaatttattaagcccaaataatctgtcattagcaaatactgtagcatcacgttgttaaatcatggcacaattgcttaaaagattcgtttcgcaatttacacgcaatttgtgtaattagtttttttttccatatttaatactctatacatgtgttcaaatattcgatgtgacatattaaaaaattattg

SEQ ID NO: 29628 - DNA, 1666 bp, Oryza sativa
  unsure (1)..(1666): unsure at all n locations
tggcccctttgttgacctatcagttggnacagnacctcatcagcctttttctaagaagccaattgcttttagaaaggtatgttctgtacgtaaagacttccaaaataccgcgtgatagttttgtcacctccagtgattatgaatatatatataatggtcttgcacatgttcctggaattgcaatggaaataaagtagtttaggccctggtttagttcgcaagagtttttccaaaaatatcgtatcaattctttgacatatgcatagagcattaaatatagattaaaaaattaattacacagctaggaggaaactcacaagataaatcttttgagcctaattaggctgtgttcgggagcactccctagcacgcaaaacggagcaacgtttaacgcgtgattaaataagtattagctatttcctttttaaaaaatggatcaatatgattttttaagcaatttttgtatagaaactttttacaaaaaacacaccgtttagtagtttgaaaagcgtgcgcgcggaaaacgagaaaatagggttgggaacttcctctaccgaacaaagcattagtccataattagctataagtgctacagtacctcacatgtgctaatggcggattaaataggctcaaaagattcgtctcgcggttttcaggcgagttataaaaatagttttttcatccgtataaaaaaaacccttccgatatccgatcaaacatataatttttcttttcgcgaactaaacttaccctgatcgtgtgtctctgagcgtgtttgtttatgccgcatgttgctttcagaaatgtattagtcaaagtcaagagccaagacttttgcatcgtgtccttcatccctctacacggtgtcacctgcttgatggcaactctccgtgtcattgtttttatattgacatgcttgcaaagtcttctctttcgacaccgcgtggcaagatatatagcactgcgtggattgaataaataacagtaaatccattagtcctatatgccatatatatataagaaatgttttactcactccattttattttataagtttttactagtcacactttctaaattgatcaaatttacagataaatttattagcaacgtctataacactaaattattctaatcatattaacattaaatatatttaaataatatatatgtttactttatgttgaaaatattacgaatgttctaatttgccaacatcatataagtacaattcaacgtttggtagtttaataatccaacacacgtagcaagagcttgtggcgctacatactgaaaattttatagaaaattcgtcactgctcactgaaattgactagctctcattctgttataaatagagggccaactgtaagagcagaggcaaaggctagaaggcatagctctagacacacttaggccctgtttggcacagcttcagcttcagctccacccctactagagctggagctcagtcaaacagtttcagctccaccaaaactgggagtggagttgggtggagctctcttacaaaatgtactagagttgtggagcttggtttaggcaggtacacaactccacttcaaattaacctcctagaggttattaaggaagcggagttatcccaaaccaggcccttatatttagacttctgcggagttagcagccn

SEQ ID NO: 29629 - DNA, 6484 bp, Oryza sativa
  unsure (1)..(6484): unsure at all n locations
ctgtggactgattgcacctacgagatggcacagnagttcatcattttagacgcaacgtcttttcccaagctttctcctcaatatcaagagatgttgttaactccttaacgaagtactctgtctattgcttttaactacattacccgaacttctatatgaagaaggtagctttacaataaaacgcacatccacaaataattcacttgtagttcaacgagacaattttaaattgatggtaaaacaacagatgtatatactacttagctagctatagcgataagtacttggaagagagaattccttatatactattggaatttggcctgatccctgatatgccacacaaaattggctcttcccttatatgccattgggtcaaatttgagcaccctcttatgtcacttccatgagttgaccgtgttgactgttaacttgatagtaaaaagacgtatttacccctgagttgttagacatgcagtaccaatatatgacatttttttttaatttggttgacatgtacatgtatatacaacatttcagcatgcattacattgaatatatgaataaatttcagcattatattgattatatgaataattttcagcattatattcattatatgaatactgtatatacaagatttcctgtgttgccacaatctagggttttctatcattgatgaggagaaatattgggcttggccatttgggccatattctcaagtttgggccagaggttattttggtcatttatgcaaaaaaaaaaaaactgacagatcaataggtgctaacatcagtcaacacacggtcaactcacgagagtggcaagaaggtgctcaaatttgactcaattgcatataagggaagagccaattttgtatggcatattagggatcataccaaattccaatggcatataagggattctctctacttgaaaatagatttgaaatagatagagtagttcatttttgccatggaaatattgaccgtcactcgcctattgacctctttcttaaatcatcaactccctgcagcaaagagagcaggatcatatatatcaatatttgacgtatcattggatatatatagatgagaacatatcatatacacctaatcttctagtgcatactctgtacacatcaattagcaaatgtcatgtaaaatgccgtcatctcctgcacccgggctgttaattgccttgcgtgaggccctcagatcccgctgggttctttcctgatgaaagggtgttagtgcattacggtccggattggttgctgttaattctagacagaatgaatgacgacgagcggctccagtttctcctgctcatttggcgtgcatcatggcacctgaggaatgatagtctgttcggctcaggtaagagtccaatccaagcttcggtggtctttctgcagggtctgtgggagtctgttgttcagatcagaagcaatggagctgtggatagtaaaggtaaacggcctgccctgatacacaacagtacattccaagggaaatagatctgtgcaagcagtctgaaaccaaatggcaggctcctccgtcgggttgggccaaaataaacgtcgatggagccttcgtttcacagaccagcaaaggtagtgtggggattgttattcgagaccatgaatgcaatgtccttctctctgcttggagcgtcatgagatattgcacgtcggcagaggaagtggaagctacagcttgccgtgacgtgatggtgttaattaagctggcgaatgaatggatcaagatgccgctgatcctcgaaacggactgtgcaaatgttagcagtgtcctgaaggcgacagaagaagatagatcccagctctggaatatttttcaggaagcaagattagctttagctttgtctcacaagtatcagattgtctccgtaccaattcgtccacggtatggcgtgcccaggccccagggagtgtgtctgagctgctggctctggattgtaatcatgttaacttgaattaataaagctccctgttttccttgaaaaaaaaaagtattacacctatgtgaaatcttatcttcaaatccattatattttagccataacaagaaaaagacaaaaattgtaatagatatttaccttaaaactgtcatattttttgactttttttacgactaaaatataacgaatttgaatatgaaactttgtaaatatgtgtaatcctattaggagtaaatgtccattttttaaagaatttttcgtgacatttgctagttaatgtgcacggagtgtgcacgagatgtttgtgtacataggatatgtactctatgggcctgttcattttgatgtcattttcaaccttaccaaattttggtaaagttgccaaaaaagtggctacatttagtttactaccaaattttggtaactatataagaaatcctgtcaaaattttggccaaaattttggcaactataccaaaatttggcaatgccaaaatttggtaaggttttttttggcatcaaactgaacaggccctatattgattgactggtagtcgtgtacttcacgcgtatgatttccaactgttaaatggtaatgttttttttgtttttttaagaaagttttttaaaaaataatattaaattattttttaaacttttaaagctaatacttaattaatcatacattaattagtagctttgttttgtgtgcctacggaaaacttcccatcaccacctacccaacacaccctttgtgtatactttaaaatagagagagaagatccaacaatgcgatctataaatagccccatccaaagaaagccaacccaaccggccgtttgctgagcacacggttcacctacacatggagggagtacagctactactccctgtggcacaaggggcgaacccttgcattgcacttgttactgccggcatggccgtgttagcaactgcctgctggttggtgatccgtttggtctttgtgaaagggaacaccgatcgtcgcccatgcgaagcagacgggatgaggatggtgccggggtccaggggcctccctatcatcggcgagacgctcgagttcctcgccctgagcccctcccttcagatccccgccttcttccaacgccgttttgatatgtaataaatctatatctatctatatctatatctatacctaattaaaaaataagtaacgcttccggttaattttttcgtccatcattaagagtgggcccacacgctaatccacgatccgaaagcgtggccacgatctcttacgcctgcaaataaaggagaaaagaaaaataaaaagagaaaaccttgtttatggagcagcccatccaaagcagcccagattggattagtgacgaggcagcccatccaaagcagctgcagaccggcccagatagcagccgcagcctaccagcgagcccacagagcggaggagaagcagcccaccagcccagcacagtactgcgcaacactgtagcaaccgaacacgaataaagtttggactcacgccaagcaggaaaaagaagagatcttattacttaaaacatgtagtcaccaatgaattatttaccgacaaaataaattcttttttaaaaataaaaataatcacatgtgtctttctttttttttggaaaaaggaatcaccaacaaattgaatcatgtttatatttggatttttttcgctcatcaattgctcattcgccacaggacacctaatcacatcacttttttttattcattgtataatttcttctattatttagagtgaaagttattctgcgatataccacatttttttctttccttctgattatttaagtgagtggttatgcaattggagtgcagtgaggttgatatgatagctagcaaaaaaatatttcttatattatggctactctttacaatatgaaaaaaagtgcttatcaatatcgagtaccaaaaaaaataacaaagtactgcaattgactcataataatacatgacaaaaaagtaaatattttttgtggtttcaaagtttagtatccatgtcagtggatttagagcaacaaataattatatcatgttagcgtcttatttgcactagaaagattcgattcgactataaagaccccaatgaacctggtgggttttatactcccacacactaattactatttttttcttcccccaatgcaacgcatgggcattttgctagtaaaggaaaacaggtagcacggtatatttataaacgaaaaatattttttgataaatcttttatatatgtgttcttatcaatttaaaagtaaaggctgaaaaatgaactttgataaaaaaaacacctcaatatcaactacaaatttaagcttgaaattcaaattttgggtaataaaaataagcgaaaagatgaggctctaaatatagctatacatgtgtactccattcaaaaatctcaggtgtactttttatcaagattaatgagaaattaacttaccacgtatgtaatgaaaaccaatgattttatggatctacataaccaacgcagatatataaggtgtcataaatgctcgagtggattgataagccttataccgattttaattttgaaccaacaaatatgaggcgttacatattttgtgttctgtactagtgaggacctacggctcaatctgtaattttggtgcaaaataatgaaccatgagatacaatggagtcaccctatccgaaataatccatttttatcccttttatgctagggaaaaatcgttgttccatctattaagggcatcaccaatgtatatggcaaagtgtagtttttacctatggcaatcttcacaatgtatatggatacaaggtatcattaggagaagagagaagagtagagatatataatataatttatttcatatgggtagtccatatccatatggataccttttgttattttttctatatggactagttgcacaatggcaataggtggctgaatggaatattctattgcttatggactacttttacaacacattgtggatacccttagtacgttttatgtcagtaactgactcgatacatcccaaactataaatttttaacatttctataagtgattaagaataaagtgaaaaccaatatgagaaaattaaatgaggggtgtttatattttggtaatgttggattaatttaaatgaaggtgtggtgggagatggatggagtagcttaaattaatgtgggaatttctaaatattttttggaatttatagatttttattttaaaattgggatatgagagcctactatatatataaatattactaaagacaggttaataaggggcatcatatatcactcaacaataccatataatatacaatccctcagtttcaatttagttgccattcgagcattcaattttgtttttcaaaaataattattgttctgatcttcctacccttcataaaaatagtcatacttcctcataacgagttttaaaacatgcttttgggaaagataatgagtacggagtatatagttaatcagggtagcagcgtgtgtaatccaagatggcaggaatgtaatttgctgaacctatctcctaattaatttagtgattgctagaacgataattaaattgaaacagagagagtaatccaaaacatatgcatattaacatccaaatacgctactttctggtatggtccacttttcaaaactaacatgattatggaagacctgattgtttccctcgatccggaggtgaccaactttgtgttccaacaagaagaaaggcttttccagatgtggtatccggactcgttcatcaggatcattggcaccgacagtctgatcaggacacacgggttgttacacaggcatatcaagaacctggccctccggcttttcggccctgaaaatctcaggcgagaaattatccatgatgtgcagaaaacggtggaggctagcctttcctcatggcttaatcagccaagcatcgagctcaaggaggcagtctcaagcgtatgtttgatctgttaatcctaaaatactactacttcaatgtttgaaaatatggtgctgctcattttatttggtcaaaaatttaaaaattgaactatcaacgcctctcaaaatacatagattatttctatagtatattttatttataagtaattttagaatattataattttgtaacatattatcattatattctaatagaaaattaacagtcccaattacaccaaagattcaacagggtgatatatatatagagagagagataactacaaaggtaattatttagctaatacagaacaactcacctcatctataattacctcagcggaaaaaaaatcaaaatcctagctataaagctacctagataagaatatttgcagatccaataccatgatttgatttattttggagacccgaggtatattcaattcaaggtttaatttcacctactatttatttggggatgatattccaggggttccggcaaggatgttaat

SEQ ID NO: 29630 - DNA, 8368 bp, Oryza sativa
acgaggcggacaaagccggcggctcggcttgcacgtggacggtgagctacggtggtcggcagcgaagggggaaaggctgccgaggttccccacggcttggcgcacctaacggcggcgagggaaagcgccggcgacggttgaggaggcgcgacggcacggctggacgatggccggcggcggcggcggcttgctcggcgtggcggcggcgctacggagcacgggagagcacgggaaagggggcaaactaaagagtaggatgaggggatgctttatataggcttggattgaagagatcgaactccaaacgagaggaattgatccgagaagattaaaactcggttttggagataaactcgaaaacgagtttgattcgaacaagatactcaacgatttgttccaaaacttgaggggaaagatagaggagattgagaggaacaaaacccctcaatcaatcggaagaaattgggagagatcggagcggatttggagtggagaagagggcggctcgggcacggcatggcttcggccggccggctgctagagcttgaagaagctcccgacaggtggggcccacctgtcggtggcttgagggagaggggtgaccggctcggcttgagccgactcggccggttttgggccggctcggccgctagggagagaaggaatgttgggccaaaatcggcccaacaacttaagggagggcttttggaactttttaaaaaaaacaatttgtgaaatgatgtttcatttattaaaaatatttcccttgctcaaataattcccagaaaattctagaaaatagaggaacaagtaaagtatttaataaaattttatctaactcaattttatattgagatttagcaaattaaaaaaaaagatcttctcttttaaccttttaaaattaataattgagctccgaaaaatccgagaaaattccagagagtataattaaccatggagaatttaataaaaattaaatccatccatgctttatatttagaaaattttatttcccacatttaacttcacttgtaaattaaagaacatttaatataaaatctattattaatttattaaataatttataaaccctaagacgaaaatcagggtgtgacaagtctaccccccttacaaagaatctcgtcccgagattcggaacggctagaaagaaaaaggcataggtaaactgcagtctatcttattccataactccgataattattctaaggctttaaagaaaactactactgctttgaaactggtcgctgagctgtaacacttgaagacacaaccggcactgcattcgctcctgtgaagacaatgttgttgacttggccttgtggctgttgacgcttcggcttcggacactcttttacgaagtgacctggctcataacaattgaaacacacccgctgctcccttccattactgttattcacttgagactgatcctgctgaactgacactgactgagtagcttgctcatcattgtctttattgcttgcattagtctctgagttgatctcaccagcgatgttcaactgttgcgactgcccttgactagcggaagaaggttcaccaatttggagtggcttgatacgctgcctctggctactatcctgtgcctcctggaaaacaatccttcctctcttacgattgtccatcctgttcttcttgtcttccagtcgaattgctttatcaaccaactcctgaaaatcctcgtagtcatgagagatcaacataactgacagctcatcctttaagccttccaaaaacttctcctgcctttcctcgtcagtacgcacatcttctggagcatagcgagctagacgattgaactcatgaagatattccgtcacggtacgatccttttgcttaagcgcccggaactcacgcttcttcaaagcaacaacacctgcaggtatgtgtgtcttcttgaatgcttcagtgaactccgcccaagtgattggttgtccttctgctctgttcattcggaaatgatcccaccattctgaagcagatccttgcaactgatgtgaagcgaaaacaactttctcctgatccgtgcactggagcaattccaacttcttctcaacagcgtgcagccaatcacctgcttctactgggttggtagtgctagagaaggtaggtggcctcacacgaagaaaatcagctaacttgttctgcggcggcggaggattgacattgttgttcccttgctggttctgcatttgttgcactaacatgttgatcaattgggtctgttgagccagcacttgagcaagagttgggttctcttcattgttattgtttccacttccactggcgcgagtgttcaccatctattgcagattagaaaggatagaaggagaggggttacactaaagataagaccttaactaggttaccactgatctgatgtgtgtagttcgttatattgttcaagttgattaaacaaacaacctagtacagttgcacgctcatcactggactacatcaatgacgggaatgcaaccatacctacacacaaagcaaacaacagcgttctaccctactaactattcttcaaagacactttggcggcataggttctaaactaggttccaaacttcactctatcttgacagctgaacactttgattcgactatcatcttcttattcctcgatccacttgacttgcagaagttgacaacatcgacgtcttcgagtttctccatcaagtttaacaactactcaagttgaaagagggaagagagtagacaatgaaacaatttgcaaagaattctagataaggaagaaaggagaaattttcacaaattatttttttcggaaaaatagtccttcaggtttgaccatttggcttatcctacagtcgagatggctctgataccaacttgtcacgcccagcaattcactagtaatttccgaacttatttgtgcataaaatcctcgtccaggaatcagccgaggtacacaaactgacaatttaatatacaaatctatcataataatatcgttaatacttacaaaagaaaagaaaacagcaacggaaaaataaaatctagcgaagctccggctccactcccacaggcagctcagctggggtataagccaaacgtcttctccttctggatcctttatcttcaactgaggtttgatgattattgcaagaatgagcatatgacatactcaacaagccacacagcaaatatgcaagtgcacaaagataccaaaggatggcataatataggctcatttgcaaaagcagcatttagcaaaacatttaagagaaataaaacagtggagtaattaatcagaaattttaatcaacactgaacagcacacccatgctgcacaggcccaaccatcctgaacaaccatacccggctgaacaaatctaactccaaaccaggagctaagcaaattattagcaagtattaacatccatatttattgtgagaggtgtgagactaatcacgaaaaacattgctcaactcgcccataaccgcgggcacggctattcgaatagttttactctggccagaggtgtaccactgtacccacaagacacaacctcaacatcatgtctaccatgcgtcgcgatactggaaagtacccgaatagaggctgtgacattaccccctgcataacacaactcaccacagtgcaccattcctggatcataatcaccccctctacaaccagaggcatggactccccagcgacccccatggacttctcgccacttcacagtctggcacactataatgaatcatgctatacaagagataaagccgttgcccacgctggcttgtggttggtacggttaatgtttcacaacagtagctcgcgaaccggtccttaattgtcatgagcacaaccatcaaaaccatatgctcacaacccaccttaaccaggttttaattaccaattaattatcataacacgattaaccatcgtgagctaccattaaatataagcataaataataatgtagtatatttgattcatcccattagtgagctaatgtttctaagcattgctaagcaattatatatatatataacatttagctgaaccaaaccaatacataaggttcaagctaatcaatttattacccaaggtatcaaggaataggatattcaatgcaaattggccataacaaaggaataggttcacaccacccggtgacattcgaaaataaatgcacagttgaaataaatagagaatttaaatatagaatcaacatgctcaaaggattgtgtttaggatctgtgtgacttgccttgcaataatcagtcttcaattaatcttcttgaacacttccgacgcactcgcgaaccttcgtaacgacggaaacgacaagctaacacgcaaaacgaagaaaaagactaataaaaaccaaataaacagtacataaaaagtaaacaaacatgtagatcataattttaaatgaattatgagacttgaacggcctcaatctgacttcaaatgaatttattatgaattttacaagattaaatctatttaaagcccatttaaaaagaattaaataaatttaattcaatttatggacaattttaatatatagatctttattttagaaaaatttagcaacttgaaccacctgaaacggatctacggttatttagatatgattttccaaagatttaaactattagaaaaacgggaaaaagaaaaaccgatgacgtcatcacgacgtcatgctgacatcagcaaagcaaggccggccggctagggctagggttggcaagctcgccggagattgggacctcggccgggactttggagcacacctatgcaaagaggacgacgagacgaacccgttggtactcaccaacgcgacgaacgacgacggatgacggccggcgacgaggcggacaaaggcggcggctcggcttgcacgtggacggtgagctacggtggtcggcagcgaagggggagaggctgccgaggttccccacggcttggcgcacctaacggcggcgaggggaagcggcggcgacggctgaggaggcgcggcggcacggctggacgatggccggcggcggcggcggcttgctcggcgtggcggcggcgctacggagcacgggagagcacgggaaagggggcaaactaaagagtaggatgaggggatgctttatataggcttggattgaagagatcgaactccaaacgagaggaattgatccgagaagattaaaactcggttttggagataaactcgaaaacgagtttgattcgaacaagatactcaacgatttgttccaaaacttgaggggaaagatagaggagattgagaggaacaaaacccctcaatcaatcggaagaaattgggagagatcggagcggatttggagtggagaaagggcggctcgagcacggcatggcttcggccggccggctgctagagcttgaaaaagctcccgacaggtggggcccacctgtcggtggcttgagggagaggggtgaccggctcggcttgagccgactcggccggttttggtccggctcggccgctagggagagaaggaatgttgggccaaaatcggcccaacaacttaagggagggcttttggaactttttaaaaaaaacaatttgtgaaatgatgtttcatttattaaaaatatttcccttgctcaaataattcccagaaaattctagaaaatagaggaacaagtaaagtatttaataaaattttatctaactcaattttatattgagatttagcaaattaaaaaaaagatcttctcttttaaccttttaaaattaataattgagctccgaaaaatccgagaaaattccagagagtataattaaccatggagaatttaataaaaattaaatccatccatgctttatatttagaaaattttatttcccacatttaacttcacttgtaaattaaagaacatttaatataaaatctattattaatttattaaataatttataaaccctaagacgaaaatcagggtgtgacacaggaaaagttactgtaatatgtcagaaggtagacgtttaccttgggagttatgccaagaatttgaaagttgaacttgggaatagtcagccaaggtttagtggctactttggaagctaaacctactctgtttgatcaaattagagaagctcaagtgaatgatcctgatatccaggaaataaagaagaacatgagaagaggtaaagccatcggttttgtagaagatgagcaaggaaccgtatggttaggagaaagaatttgcgtcccagataataaggagttgaaggataccatcatgaaagaagctcatgaaactttgtattcgattcaccctggaaacactaagatgtatcaggacttaaagcaacaattctggtgggccagtatgcgacgtgagatagcagaatatgtggctctgtgtgatgtatgtcagcgggtcaaggcagaacatcggaagccagctggtctgttacaaccgttgaagattccagagtggaagtgggaagaaataggaatggattttataaccggtctacacagaacgtcggcaggacatgattctatttgggtagtggttgataggttgacaaaagtcgctcatttcatacctgtcaagacaacctatacgggacataagcttgcagagttatatatggccagagtggtatgtttgcatggtgttcctaaaaagatagtgtcagatagaggtagccagtttacttcgaagttttggcagaaattacaattagaattgggtacccgtttgaatttcagtactgcttatcaccctcaaacagatggtcagacggaaagagtaaaccaaattttagaagatatgttgagagcctgtgttctagattttggtggaagttgggataagaatttgccgtacgcagaattctcatataacaatagttatcaagctagtttgcaaatggctccgtatgaagcattatatggtcgaaaatgtcgtacgccgctcctttgggatcaaaccggtgaacgtcaagtcttcgggacagacatattgcgacaggcagaagaaaaagtgaagattatccaagaaaggttgcgcgttgctcagtcacgtcagaagagctatgctgacaatcgtcgcagagatttggctttcgaagaaggagattatgtataccttcgggttacgccgttacgaggtgttcatcgttttcaaaccaaagggaaattggcaccgcgttttgtgggaccttttaagattgtgagtcgaagaggtgaagtagcttatcagttagagttgcctccgtcaatggcgggaatacatgacgtgttccacgtgtctcagctgaagaaatgtttacgtgtacctacggaggaagccgatcctgatcgtatagagcttcaagaagatttaacttatgttgagaagccagtaagaattttggaagaaagcgagaggaaaaccaggaatcgcgttatacggttctgtaaggttcagtggagtaatcattcagaagaagaagccacctgggagcgagaagatgaattgaagtcagctcatcctcatctattcgctagttcttctgaatctcgaggacgagattccgtttaaggggggtaggtttgtcacaccctaaaaatcttaaatatataaattgttgtttaattggaatttttagaaattattttaaaagcctacaagctaaaccctaattttctaggaaaattttcaacataaaagtgagctagataaaattttattaaatactatgcttgctcctctattttctagatttttctgggaattatttgagcaagggaagtatttttaataattgaaacaacatttcacaaattgttttattcaaaaaagtttaaaaaaccccttctttaaccgttggaccgttttcggcccaactctctctttctctctctccccgcgcgcggcccacgccggcccaagccgccgccgcccgcgcccctctctctcgggacactgacatgtggggcccacatgtcaggcccttctccttcctccggccgacgccgagaccgagcccgagccgccgtcttgcgccgccgtttccgcccaaatccgacccggattcttccaattgattgaggggttttgttcctctcgatctcctctttctttcccctcaagaaacaaagaaatccgttgagtattatctccgaatcgaattcgttttgttttatccctaaaaaccgagttcgatttcttcccgaatcgattcctccagtttggagctcgatctcttcgatccaatgccatataaagcttcttcttgttctcctcttccgtttgccccctttaccgagcttttccgtgccttctagcgcccgcgcgacgtgctccaagttcgcg

SEQ ID NO: 29631 - DNA, 13572 bp, Oryza sativa
  unsure (1)..(13572): unsure at all n locations
agctttccaagattatatgaagacaaaaatagttgtggcttttaatatgattaaaanaacttcttatgtcctaaatataacggattttgaaggatagtgctagaaagtatcacatctctctaaaatcccttatattatgggacggagggagtagaacttatgatttaatcattaatttttaacgcagagtcttgtttcgttattttcttaatgcaataatttcgtaacttggaatcaataaagggagtatctgaaaaacttgtcacaagtttcttgagtcaaaaacattcagatgtaactataatatcatgaaagtgtaattatactgtaactgcattataactacattgaaattacaatataatttatataacggtttggttagctagcactaaaatcttacgtgtgatatgtgtgaaaatttctttctagcaagtttttcctttcatgcagaaatttcgaggcaatccaatggtcacaaatctgaaagttttgggagcaaaaaaattgcaaaagtttttaagcaaatccaatcaataaaacatattaacccgtactccctccgccccaaaaaagaactcaattctagagtttgaattttgttccaaaaacataaacttctaccatcctaactaccttcagcacctaaaacgataagttttatctcttaaatactctttatctaaatatcatcattactactttttttcaataactagaaaggaaatccgcgcagttgcgcgggtaatttatttgttgtttataaaaagaatgctaaaaaaagttatatctcaccatatttactataaggatcgtagattaccttaattatactcataaaaaaagaaaaaaaacactttattctgcttacatatatggtcgcctatggccactacttattttcattgtcggtgtctttttaatagatagaattgcatttgtacctaaaaataaacataatagatcattaataaaatgagaagtccttcttcacttcgtaccaaaataaaatgctcatgtatgacttgtgtccaaatgcatgtataaatatttaaaaatatcatttttaccaattaatagataaaaccattaaaattagatataaatgctcgtctaatagatgaagcatagtataggcgctatggctttctactatgatggcttgaaacgatgtacccatcttccttaggaacagtatgaagcacaattttaacatttaagttcattgttagtacactcataaaggattgcatggtaagaaagccagtcgagcaatattgccaacagagccatctcaactcagcaatactatcatacttattgttcatacattgcaccctttacggaatgattaagagaaaatccaatagcttacgtcctgagaaccacatggaataatatttactcaagctataattcttcataaacatatgagttaatatgggtcttattattgttttcctttattgtagatcttactcatccatgcatgttcaacgtttaatatacgataaaataatctatgctgtcattttttttaattgttaagacaatttcgatgagaatgacatgaaaagagaaagaatatgttccatgtgatatttttttaataaaaatgtagttaacatatttttatttttatttaaaaaaaaatgaacaatcaaggttcgtaaataaatattgctgatcgccaaatctgtgaaaaattgctgatcttaatttgcttcttccaattgtccttttgattgatggattgacctgttggaataaataggctaggcccaatttaattcattaaaatctcaagaggccacaagtaatgttagagagaataatactgtcttgaaaatttagatagaagaacctcaacttaaatagggtgatattggagattccctgttgaccggttgaggtgatggttggactgccacacgcatgcgcgcgcgccgagtcggcctcggccgtgggcgtagcgaggcgaggcggccgaccgagccgagcctgccagctgctcttccgttttgtaacatacgagaataaagtcaccattaacgaatgaaattcattgtgttgtaacctccacaacaaaagagaggtttatttgttgtaaccttcacaacaaatgaaatttattttgtggtaaccttcacaacaaatgagatttatttgtgtggtaatggagatctctctctaaatataacacaagacagaggctctcaaagagtgtgtcttcctacgttccttggcgatactctccttgtgttcctacgttgtctctctgtttccccagttctgttcatctcgcgcgcacgggtgatcggaacgagcaggtgcctccgaaactccgtcggcttgagaacctgcacgggtagacgggcgatcaagtttttgggtagcacttcaagcgcgactgctttgcatcatcttcaccaacatgtcgacaaccggcgacaacaacaacactggagacaaggagaaggagcctctcgtcaacaccaacggaggcaatactgcctcaaactccagcagagggccattctcgggatataacgtttcactattaccgttcgttcttcgtttcctacaactgtcggtcgcagtattattgcgttctcttatctatgttgatgcttattctatattaagcatgctcatgttgtacacatctagcactgtcactagatctactcaaattacaaatgtcatgtttattgtcttaatattttagactaaaatatgccgaattacgaccaaatttccaacaatccaaaaacttgataggtctttttcggtagttggctttgttgcatcactaaaaccacatgctttcgatggttcaaattataaaaggtggaaagcacgtgcacttttgtggttgacggtgatgcaatgtttctttgtttcacggggcaaaccgagtgaaccgccgctctcccctgaggaagaggctaagttcgaggttgcggattgcttgttccgtggagcattgatcagtgtgctcgccgacagtattgtggacgtgtatatgcacatgccttcaaggaaggacatgtgggatgctcttcaggccaagttcagggtttccgatgccgggagcgagctgtatgttatggagcagttctatgactacaacatggtcgacgaccgttctgtagtggaacaggttcatgaaattcagatgctggcaaaggaacttgagaacagcaactgcgagttgctgggttgctggacaagtttgtggcgggtggcattattgccaaattgccaccttcttggtcggactttgctacttctctaaaacacaagaggcaagagttcagtgttactgatctcattggctctttgggtgttgaggagaaggcaagggcaaaggacaaccggggcaaaaaaaagaacgatggaggttctagtgccaatttggtgcagaagaagaaccctcacgcatctcacaacaacaagaagaaagtcaaacctgacgtcaaacctaaggctacaaccaattttaagaagaaaggccagggaaaggcaaaagtagatttctttgtgtgtggcaagcctgggcattgggccaaggattgtcttgatcgcaaagacaagaagtctgccaacatgatcattagcgagggcggaggaacatcggggtatggtaaatttttacctacagttctctgtctgtcactcacctgattggtgggttgatactggtgctaatattcatgtgtgtgccgatatttccctgttttcttcttatcatgtcaggagaggttcctccttgttgatgggaaacggatcgcttgcggctgttcatgatgttggtacagtcgatctgaagtttacttcgggaaaaatcgtgcagctgaagaacatgcagcatgtcctttcaataaagaagaatctagttagcggctctctactgtgtaaaggtggttttagacttgtgtttgaatccaataaatgtgtcgtatctaaatatggaacatttattggaaaaggttatgactgcggaggcttgttccgcttttccatggatgatatgtgtaataaagttgtgaaccatgtaagcgatgatgatgatgagtccaatgtgtggcattcgcgacattgtcacgtgaattttggttgtatgacacgcttagccaacatgagtttaattccaaaattcactttagtcaaaggctctaagtgtcatacttgtgttcaatcgaaacaacctcgcaaacctcacagggcatctgaggtgaggaatttggcaccactagaacttgttcattccgatctgtgcgaaatgaacggcgtgttgactaaagggggaaagaaatatttcatgagagtgatagataattgcactagattctgctatatgtacctattgaaaacaaaggatgaagcattacattactttaagatcgataaggctgaggtagaaaaccatctggaaaggaaaatcaaacggttgaggtctgataggggtggagagtatttttccaatgagtttaattctttttgcgaagagtatgaaattattcatgagaggacgcctccctattcaccccagtcaaacggggtagctgaaagaaagaaccgcactctaactgagatggtaaatgccatgttagacactgcaggattttccaaggaatggtggggtgaggcaatattgactgtgtgtcatgtcctgaatagaattcctactagcataaggaagtaacaccattcaaggaatgggaaaggaagaaattaaatctctctcacctgcacacatggggttgtttggtcaaggtaaatgtacctatagccaaaaagtgtaaacttggacaaaagaccgtagattgtgtgttccttggttatgctatccacagtgtgggatataggttcttaatagtaaattctagagtacccaacatgcgtgttggtacaattactgagtccagagatgccacattttttgagaatgaatttcctatgaaaaatgcacttagcacttctagtcaagaacctattttatctcctgagcactttgtgccgatagaacacattgatcaaatgcttgaggaaaatcctgaggaggataacattgtagcaactcgaaagagtaagagacaaaggactgcaaagtcttttggagatgactacattgtatatcttgtggatgatactccaagaaccattgaagaggcatattcatctcttgacgctgactattggaaggaagcggtatgcagtgagatggactcaattatgtctaatggtacttgggaagtcgccgagcgtccatatgggtgcaagcctgtaggatgcaaatgggttttcaagaaaaagcttaggtctgatggtacaattgaaaagtataaggcaagacttgtggcaaagggttatacccaaaaagaaggcgatgactttttcgacacttattcaccagttgctcgcttgaccacgattcgagtactacttgctctggcagcctcttatggtctactcgtccatcagatggatgttaaagacagctttcctcaatggagagttggaggacgagatctatatggatcaaccagatgggtatgtactagaaggtcaggagggaatggtgtgcaagctgttgaagtccttgtatggtctcatacaagagcttaagcaatggcatgagaagtttgacaatacacttacatctgctggctttattgtgaacgaagctgacaaatgtgtgtactatcgctacggtgggggagagggagtgatcttatgtttatatgttgatgacatattgatctttgggaccagtctcaatgtgattggggaggtcaaggactttctgtccaaaagctttgaaatgaaggatttggaagtggctgatgttattcttaacattaaactactgagaggagatgagggtaggattacacttgtgcaatctcactatatggataaggtcctgagtcgctttggttatagtgactgcaaggcagctcctactccttatcatcctagtgtgctattaaggaaaaaccaaagaataggaaaggatcaattgagatactcccagatcattggttcattgatgtacttagctagtgcaacgaggcctgacatctcatttgttgtgagcaagttgagccggtttatttcaaatccgggagatgatcattggcatgctcttgaaagagtaatgcgtgctatctaaaagggacaatgagctatggaattcactacgccgggtacccaaaagtactagagggctatagtgattcaaactgggtatgtgttcacacttggagggggcgttgtttcctagaagtcttgcaagcagaccatcttaacgaggtcaacaatggaagcagaactcacagctttagatactaccacagttgaggccgaatggcttcgtgagcgcctgatggacctgccagtggttgaaaaaccagtaccagcaatcctgatgaactatgataatcaaacagtgattattaaagtgaacagttggaaggacaacatgaagtcatccaggcatgttaaaagaagattgaaatctgtcagaaagcagaaaaactccggagtgatagcattggactacgtctagacggctaaaaatctggcagatcagtttaccaagggactaccacgtaatgtgatagactgtccatcgagggagatgggcttgagacccacttagagttgcacaatagtggaaacatgtccattgtgatcggagatcccgtgaatttggatggcaaaacaaactattgtgtagctgagagaagacaccctaaaataagcttatcttcatgatgcaaatctggcagatcagtttaccaaggggctaccacgtaatgtgatagactgtccatcgagggagatgggcttgagacccacttagagttgcacaatagtggaaacatgtccattgtgatcggagatcccgtgaatttggatggcaaaacaaactattatgtagctgagagaagacaccctaaaataagcttatcttcatgatgcacttctcttctaatctgtatggtaggatggtatacaccttaatgtgatccgagtggcttttcataaagcagagatgttggcctacagaacatcttagaaggaacatacatatatgagtccgactgctagtcacagtctatgagatctgggtgatctctagatactcatgaaaaggccaggagtatgacttatatgctccaaacagaggggatgcaaacaacagcccagtaccagttaaggctttagtgaaacctgaatcgcacaagactgacatttcaaggcatagtccattgttcagttgtgatatggtgtagctcttttcctaggtggaagttcaacttaacagtctccatcgaaacactggtataactagacattgttcagttgtgatctggtaatggagatctctctctatatataacacaaggcggaggctgtcaaagagtgtgtcttcctcctaatattgttccttggcgatactctccttctgttcctacactgtctctctgtttccccggttctgttcatctcgcgtgcacgggtgatcggaacaagcaggtgcctccgaaactccgttcgctttagaacctgtacgggtaggcgggcgatcaagtttttgggtagcgcttcaagcgcgactgctctgcattaacttcaccaacatgtcgacaaccggcgacaacaacaacactggagacaaggagaaggagcctctcgtcaacaccaacggaggcaatactgcctcaaactctagcggagggccattctcggggtataacgtttcactattatcgttcgttcttcattttctacatctgtcggtcgcaatattattgcgttctcttatctatgttggtgcttattctatattaagcatgctcatgttgtacacatctagcactgtcactagatctactcaaattacaaatgtcatatttattgtcttaatattttagattaaaatataccgaattatgaccaaatttccaacatgacctagaggactccaaccatggcgaaaaaggtggacactgaaccacgccagcttgctgtgtcgtagaagaagttgggtatggcaaaattagcgtgtgaccgtgtgatcaacggcttaacgcaccctcttttctggagatacgagatatatacggagatataaaaagtttgaaaagttaattcaaagtggacctttgctttaggatacgtgatggaatagatggaatttttttccacgtagagtaggatacggtgtaaaatgtatcggatggttgaaaataaaataaaactgatggttgatatctttttgtcactacatctaatctaatctaatggtataaattatcaggcccaccgatttaaatgaaaactgatggttgatatctttttgtcactacatctaatctaatggtctaaattctcgggcccaccgatttaaatgaaaatcgacggtgagattacgcattgccatgtggcggtctaggagcgtttgtagaagtgtcatgtggcggtgttgacgaccaaatttggtaagttgtgaaccaggttcgacattaggatcgaggcggattcgataaagagatggttttaaaaaacaaagtatgcatcggctgcgaaggcatcggctgagatggatcggatagaggacagctgatacagccgatagaagtgatgcagccaattccgatgaagatggtttcaaggttgtttctagaatcgatcaaagtgcttcacagggattgccacgatgaagataagctctcagataggcaattgtatctgttaattaggatatttcgtgtaaatttcttagagatatgtttgggcaaaagtctaccgcaaagacttatggtatcttagagtttgttagaggtaagctttgtgatctttgtgactcatagtctgatccgctatgctataaacgtttataatctttgtgttaatgtatatttcgatctaagtgatttatactgtctcggcattacgaccgatctatcgcaatcacttggtttaaatatatatcgacagaaggattgtatatcattaatatctacagccgatcaagtagatttagtcttatcttatttttctataactgtcgatcgatctcaatatgacatcggcttaaagataaataatatgtcatcggcggctggccgatcggctatcgtttatggatttaaccaaggttttcttgtctttctttcttcttgattgtaggatcaaatcaactggcacgctcacgaacctaaaggcaagattggacctgcactgaaattaagcagatcttccaggccagtgtgtatttttcgtatcaacgggcggcttaagagcgtttgtagaaagtttaatggacttttagtatataatagatgaggggcattttggtcgcttttactcttcactaatttcaccttgggatgctagagatggtctttttttgttgagacaggagtacttcttcagctagcaggtttgccagaatccaataggtataggtggacctcttattagctgacgcgtgtgcgagggaaccgacgctcgtctggacggccacatggggccgattatagatggccaaatgggcctcccggcacggtacgacccaggtatgagtgggcccgtgctgaggtcaatcgggctgccacgggccaacctacacgcaggaccgggccgtgcttgcccacaagctataccaaaggcccacgtatggcccgataagacacgagccgtgcggccgtgccgagcctggccgaaggacgacaacccatcgagcttctccatagaataagtctatttttcctccctcatctatttgggctatgccttatatggctagaataagtctattttgcataatctatgctctttgggccatgtcttatatgtctaaattaagtctattttagatctctgaactatttttctttgacagtgctgtgccggaccagcccaccgtgccaaggcatcaaccaggcacggcccaactatcaggccgggccagcacgggcccaacaccagtcgtgttgtgtcgtacatgggccaggccaaatggccatgccatgggccagggcgtcgggcctatggccatctatagggccgatagttggggtcccgtccagaagatgtggcttttttcttccggaaagagaagcgagaggggcatagggcagagcattagcagcatgtcctctcctcatctgatattgttggtgatgcttgccaaacaaattccagagatttggaatttcagcaagattcattcatttgtcaaggaggatgtgctccatctgctatgagcttactttttttttttagagaagagtaattttttacccggcctttacatccaaccggatatatacaacattttttcaatcgggaacttagcccatcaaacaggaaacttagccctcaaataacttaatctgaaattcactccaatggagatttgaacttagaaccttggggatgcactcctatggagatttgatacatgccctttcacatgctatgcctttggaacgaaccggagacaaaatgtattgatccgaatgatataaatcaagtgaaagacccaaaaaatgtcctagtaaaagctatcatttcattgaacagagggaggaaattgaaatcaaagaaaaaacacaaaggaaaacaggataaagaaacatacagttcaacaactgattataaaatcaaacccccaaataaccattcagtggtatatatttcaggtagttcccaaaattatttctagcaatttcaagaaaattaatgcggcatgcccctttatcctcttcaagtcaaagcaagcaatcgcccatcttcagcttcatgtagcagcagtcaacaatttaacatgcatttcctcatagtcatagcgtagtggatttaacagctggtgacatgttgttttttgattgattgagcacaggctaaccatccacttcttttacctgtgggaatgattttcacctgttctctttagcttatgtcctaattcctgacttacaaatgcagaggatatgtcatgacatctagagcttgtcctctttacattacaggcattcagtctaaattaaaattcaatccaaaatcaaaattcagtctacaccactattaatctagtgccaacttaagaaattcaaaacgacctgggatgagaatcgcaaacatattgcaggttgattcataaaagtcggatcaccaacatcttccacttcctcatctcgcaacattttgaagtccacaatacatacataaacagcagatgcaagattctactacagacaatgccatagaactcaagaaacatccatgccagttgcttgcttgttcagtgggtgaaggtgtagaagacggtgccgacgtagacggcgagcgcggtggtgacgaggccgacgagccctgcggcggccttggcggcggcgcggttggtggcgcagccgagcgtgccgaggcggatctgcacgaccatgaccatggacaccatgaggaagacgcagccgacgacggagccgacggcggaggcgagcatcccgaggcggaggaggcgcgcgtcgatgtgggcgtgcagcgtgtcgtgcgggtccttggagttgatgaggttgagcgccagcttgagcccctgcgccacgaggctggagaagaggaaggaggagaaggccaccacctccagcaccaggagggaccgcgccaccccctgcccggcgtcgcacgacgcgtcgccggcgaggctccggagctcccccgggtccgccagggagaggcccacgaacacggccaccgtgaacagcgagttcacgttcaccaccccgtccagcgccgtcacgtgcacgctcgtcgtgttcgccgacagcgccgccggcagcttccactcgtacccgcggtgcccgccgccgccgccgccgttgctctgctcgtcagatctggtccgtgataagcatcattggatcagcactgaatcgagttcttggcgcatcttatttcaagaaatggagttcttggtcgaatcgaacaacgcaaagaggggattacttactcatccatggcgttgatgcgaagaggggattgatttgctttgctggttgggaaagaagagatcgatgttttgaggaaaaaaaaagaagggggacagtcgaatcgaaatcctgatgccttgtgccgaccatcaacatgggaacatattagcttttctagatactccctctcgctttgcattttttttttcccttccattctggagtacaagacattggccctgttattttctcctaggaaaactgcataatctttaaacggtacacgcaaaactgcacacgcttttcaaactattaaacggtatgtttcgtgcaaaaattttctatatgaaagttatttaaaatttaagattaatctatttttcaagtttgtaataattaaaacttaatcacacattattataacattattttgcgtgaaacacttaatttttatcttcatcttcattttcaggagattcaaacaccaccattgtaaacttcatttatttaattttaaattttttcattaaatatttatgaattcatagaaatgtaaattcctattttattttatatttttactcacttaaaataatctcctcatagaggaaacactaatggtaatatatggtgctgaaattgtgggtatggtgtatgactctattaaggttcaaatcaccaaaatttgtcacaggacattaaaacaaatatgtaattaggtgtgttaaatgattatagtgtgggtaaaggttgtgtttacaggtaactagctgtgcggcccgcgcaattgcgcggctagcacccaaacaaaattatatattttttaagtatgattttacttaaaatttattaaatagctatcccattgttttcagactttgaaagaccaaacattatcatcctcgtgtttctaattatatagtttttaaaagtcacaccagttgctacctctcatgtcatctctttatttatttgcttgctcgatctaccactatttctattcattctccttggaaatatttaaaaattggattttatagtttttagaatttattgtcacgttggattttgtttttataatttctagatgtcccatcaaatgtagccattatacttctctacggcccgtccattgtctcttctctttattgtcattgagattttaaaaatcaaacataaatactactttctagaaatccggccaaaccgtcagtggctttgccattgtactccactacgcctcgcccactgcctcccttctttattgtcattgagattttaaaatcgaacatgattatcattgttttttttttactttttagaagttccaaacctttaaaaattggaccttgtagtttttagagtttattatcttgttgggtttcattttttataatttttagaagtcccgtcaaacgataccactatactcctttacagcccgtccaccgcctactctttattgtcattgtgattccaaaaatctaacataactatcgttggaattcattttttattttctatgatgaactacatgcgtaatcgagntcaccnnnnngcgcag

SEQ ID NO: 29632 - DNA, 743 bp, Oryza sativa
  unsure (1)..(743): unsure at all n locations
tatggcctttgatcgattagtagatgcanatgaganncatcaatataaccatatgaaatgacatatataagttaaacagtacatagagatataatttttttatttttatttcatttttttgatatttttttcacacttaggagaacataggaaccaaccggataaaaaataaactcaaacggacaaaatatgtgacatgtagaattttccaaaactctaccgaaacggacaaaatatgccatctattaaaataggcgtaactttctcatacggactcggaatcaggcaaataatatatgcacggagatctacagaaaaagttacatccgattctccccagctttgctgggttcggcgatattaaaacctccaaattccgcttgcaagattgtgttttcgaggagagaagtttttcggtggagctttggaaaatttcatatgccacatatttgcgccgattgagtatattttttacgtggttggttactgtgagttcctaagtgtgaaaaaaatatcaaaaaaataaaataaaaataaaaaagttgcacatctctctcctctgcactagttcggagagaggagaggagaggaaaaattatacatgtcacatattacgtccatttgagttcaatttttctatggttggttcttgtgtgtccctaagcgtgaaaaaaatatcaaacaaataaaacaaaaataaaaaaattcgggggggtgggggccccctctccctttaaatctgc

SEQ ID NO: 29633 - DNA, 862 bp, Oryza sativa
  unsure (1)..(862): unsure at all n locations
aaagtaactgatatcgcttctgaagtacacatcatgcattcacagctacttgtgtactgttttggacacagtcgtgaggagtggcctcctttgtagtagtatatctccaacaagtacgaggatcttttagctttgtccgagtctgcaactgcaagcaagcgaggttctggtcaaggaaacagtacacaaggaaacgatgaagaacgaaccaaacaccccccataaatcaaccagcaaaccgagagaagaagaaagaaaaaggaaaacagagaggcaagaatcacacatcaactgaacggtgcgacgttgccatcaaacccaaccgtgcgggcatgcctggcgggccaccaccacccacccacccaccccaactcgcacacgcacacgcacacgcacccgcaccgagctgtcgcgctcgatccaccgaccgccgcgcgcgccgtgtgctgcgcgggctaaaactgttaaccaatcgatcgagccgctagcccactagctagcccgagcccgtagtcgcgcgtagtacgcattcgccactggccacggggtgcgtgagagcggctcgtggtacagccgtttgctgatttttgctcggcctcttcgctaggggggcaggggaggttgggtcacgtggtcgcagtcgacgtcacggtcgcactacagaggctctatcctgccggaatttcgatggggggcaacggggatttcggggctgaagaagccaacagaggttttatggctccgcccgtgcagaacgggccaagcaacttgtcatggggaacccggngcacttcacaatcgggcggaagaaaagaccgtccgttcaaaaactgtattgcccatggtgagtgacgccgaatcc

SEQ ID NO: 29634 - DNA, 15726 bp, Oryza sativa
gtgggtttatctactactggtacagtagttcatcaagccaccagttgcatattttttttaggaaaaactatcacctttttaataatagatctaatctaatggtctaaattaacgggtgcaccaacttaagagaaaatcaacggtgagattagatagtgccacgtggcggtttaggagtgtttgtagaaacaccatgtgacggcttaagagcgtttgtagggagtttaatggacttttagtatataatatattagtgccgtgtacgccgggcatgcatcgtcttgcaaaaagaaaaaaaaaactgtaaagactatgccaatacagtaccatgtcttttttctttttaaagtgcaatacagtttctttagaagaggatatacaatgaaaaatactgttgcgatgaatccatgttcttttcagcttcactgggttattgattgccatgagaataatcccaacaataatttatctcattagatcttcaagtagctctctgttgagcaacgtttatgatattgtatttggttttccagtggttatgaattgtaattttaaatttacaattttagtaggtattgacataataataaacactaattactaaagattttcctaaatatagttaacatgtaattaaacgactaaatgctagttaatatgcactaagaatatgaacatatggtgatattttatagccaatttaccctattttatactaacaagccgggcacgtgctaaaagcctagcttgattcaacttggtatgactacaatttagagctgatctgaactaagcatgatataagtcgatcccagccactagttgagtttttttttttcaccactactgatggtgaagtgtcgcaggtacgtgacttattcattagacttgaaatattacctagacatgagtgcactttcaataggagtttagtggggtgacgaatatgtttttagtctccgtctctttttagcatatgttaagagacatatttatgggtgtgcacgtgtgcatcgttattttaatagaaagaaaagagagtgagattagaaacacgtcttttttatttgcaagctcagattaaatcacccaatgaaaattttctatgcccgcaattgcttcgtgaatataggatgatgttttttctatctttcaattatccaaatagtttcagtttcatctgaaataggagtagagctgggtgaaactctctcacaaaacgaactagctagataggtgaagttgggtttaggcagcttcataactccactacaaacttatcttctgaaactaaatttaggagttgagcctctaccagatagacccatagttgtgaacttagcttagattaaagcttctactactacccaccaacaacgtgcgatggccattccgtctttaggccccctgcaatcatggcatcaccatacattcttctttttgatgccgctacttgtgcgaagacacttcaggtgttaccggtcttttgtcttttattactcctccttgctctcccctttccaatagatttggacatgattgcagatctcaagacactacccgcaaaaaagttactactacggtgtataccgactactgcgtaaaactctgtaaagggtgcctacaaagattacttccaagttccaatgcaaggtgtttttgtcttagctcggttcgtcggttgcaacaagggattcctgtgccgtttgcaacccgggcgcgcggtccgcagtcagcacgagcgtgcgcgtggccgtggctcgtccggtggccgtcaccgccgtagctttcgatcgcgggcgcgcgggcgatcgatcgatcgatcgatcgattcgtccgtcgcgttcggccggcaggccggggtggccccgcgtgtcccctcgctgcgccgtggccgccccgcacggtcgccgtccaaggctcggaggccgggcgcctcctcgatcggttagttgcccgcggctggccccctgcttttatgtacgcgtggcccggcaggtggttgcgtcgcgcgcgcatgcacgtacctgtcgctctcaccaaccacaggcgcgcgcgcacacacgcacactcgctagataggtcccagcgagagagtcaccaccacctgccatgtatcgctgcatgctaccccaatatgccattgccatggcgccatacggcccatacctgccatagtgccattgcgtgacggatcgacgtctgcgcggctacggttcgttggcttgctgcagatcgatgcccaggcagctgcttgctgactagtactgcctgctgctggagtaatactactaaaattctctgtcacatacaagtgtctatcatggggcatatgcatgatcgtgcaagatgtaccccaatcatatacctgcgtacgtaccggcagctggtgcgatatttttcttttgttctattgacttggaccgtatgattgaggacctgcgtatacgtactggatgtagatccattaagcacgaaacttagggtcccttttgatttgtaggaaaagtgtaggaaatttgaaggattttaatcctatgaaaaaattttctatgaaaccctttgaaacaaaggattgaatcctatagtatcctttaaaattcctatggaatgggtaatcctatagagagattttagaggaaagttagcaagaggtccaaccttttggaaaaattcctttgagtatatctctctcatccgattccttcgttttttatatggtccaatcaaacggtcattcctgtgtttttcctgtattttccaatcctctgttttacacatgcattcctgtcagaatcctgcgtttttcctattcctccgtttttccattcctgcgattcaaaggggcccaatcaaaggatttatgcaggaatttcatattattcaaatcctataggaaattttcctatttggccctttgattcaaaggattgaagctttctaaatcctatgaaattcctatggaatggcacattgcatgtggattttagaggaaatatatcaagagctccaacctcttgaaaaatttcctttgagtctatctctctcatccgattcttgtatttttcatgcgctccaatcaaacgaccattccagtgttttttctgtgttttgtatttctctgttttacccttcaatccctatcagaatcatgtgttttttctatttctctatttttttcaaccctataatttaaaagggaccctacaactggacgggtccaatatgacgtagtgaagattcgtgcttgagctaacaaattaaagcagctataaagaacagccgatgacagcgtgctcgagccaatagaagcagatataaataaataaccaatgatgacagaattttctgacatataacacctgcaccaactcactgataactcggaaaagcctaagaagctgatcggtcagatcttaattaacccccttttccttgatccaattaaggttcctcaacttgatggtttaattatactatggagtacccacccgattatatgtaacgtagcaattgatcaaccaacttttctgaaccattcagctcgagaactctgaattctttactactaacagatcatccataagctaataactaatcccaactagacccccattcacatgctttgctaaaatctagtagtattacgtatcctggtcaacatactagtccccctttattgaaagagcctatcgaaccttgacagattagcgagagatcgcttctagtaccatactaatctcctcctcctggcctaaagaaaaatcttttgacaaaattggaccctggtgtgacaggaggcacgcaccctttattacacagctggtgtttagtgtggcttcaaggagtggaggaaaaccaatcacaaagccatttttttagcagctgattcagctcgcaaagtcaccctccgtcccacaaaaaactaacttctgaggatgaatctagataaatgcttgtccaggttcattcccagaagttgtcttttttttttttttttgacggatggagtatggagttccagctcttagccagccagctggagagctgctacctccagtttttctcctatcgtacggctgcctaatttaagacatctggacttgagcttcgatcttgatagggttgctttgaatctggactgcctcattgcctcacatttacttccgaaagccactttatctaaaaaaaacttatgaaaaccacttgttgcaaccggcaaaaaaaggccacttgttgcagtatctgcttgtgtggttagctttgctcttaaatattttttggatgactccctggatttggttgggttttggttggagagggtcaatcctgtgcgaaatcatgcttaacccatctttattgatagataatttctggttacatcatcaggaggtattctacagaaaataagctctactagtttagcccggccaccatgggagaagcacaatttcacaagctggctgctctgattaccaaattaatcaagtggtaatttttcttaaaacatactgtacttgaagaaagtaataggtagagatgatgacgggatttgaaccccctcacaggcagtcacagctacttgtgtactgttttggacacagtcggcaggagtggcctcctttgtagtagtataacaccaacaagtacgaggatcttttagctttgtccgagtctgcaactgcaagcaagcgaggttctggtcaaggaaacagtacacaaggaaacgatgaagaacgaaccaaacaccccccataaatcaaccagcaaaccgagagaagaagaaagaaaaaggaaaacagagaggcaagaatcacacatcaactgaacggtgcgacgttggcatcaaacccaaccgtgcgggcatgcctggcgggccaccaccacccacccacccaccccaactcggacacgcacacgcacacgcacccgcaccgagctgtcgtgctcgctccaccgaccgccgcgcgcgccgtgtgctgcgcgggctaaaactgtaaaccaatcgatcgagccgctagcccactagctagcccgagcccgtcgccgcgcgtcgtacgcatccgccactgcccacggggtgcgtgagagcggcgcgtggtccggccgtttgctgatttttgctcggcctcttcgctagggggggcaggggaggttgggtcacgtggtcgcggtcgccgtcacggtcgcactccgagggctctaccttgccggatttccgtcgggggcaacgggatttcggggcggaagaggccaacgggggtttaatgctccccccgtgcggccgggccaagccaactcgccatggggaccccggcgccacgccacgctcgcgcggcaggcaacgccgttccgtccaaaaactggtatgccgcatggtgagtgacgcagtatccgggcaggtaaatagtgctagtagtactagtattgtgcacaaacgattgcatatcttcgtgaaaagaaaaggaacatttttcggggaaaaattatggtgcatcgttctcatttcaccttcatgtactgttagtggccaccatttatttatcaagttagctaggttcatcttgaacattccaatcatgctagcacaatgcacagtcaacaaattaacaacaaccatctatcaagtcatgaaagatcatccgctgttaagcgacgagtagctcttacacacacgtgtgcagatttattattttcttttttgacgaaaagaaattggggagtactactagctctttcataattgatttctctgcttgtggcaaacccagcgccgttcgtcggatattcgatgcattcatcttcaacgatttctcgagtcggtagtagcattgtctttccgtgcagtgttagtttgagaaaagcaagtactgaaaggatccaacaaaatataatactgtgcgtctgaccagaaatatccaattgatccgtggatcatgcatgcatgtacttaaaaagctattctggcccgctataatgatcgatgcgtatgattagttagtggccctcaagaaattttttaagtatagccgctccttcttttcgagaaatcatttttaatcgtatcatttcattagctagccctccttttttgtaagtggagtggatgagacaaataaacatgggctaaggatgggagcatgaagacaacaggcaatatttatgcaccaaatctctaccttttcctttcccttcggtgcaatcggaacttttcgctatcataacgctataattaggtcctactatattgctatctcaatatattattccatgcccgctagaaagagaaccggcgatggtatggaaatgagggggaggcatgggccgggcttaattaagtggctaatttattcaagttgtgcactaatatatactccctccgttctataatataagagattttgagtttttgtttgcactgtttgatcactcgtcttattaaaaaaaattataattattatttatttttttttgacttactttattatccaaagtactttaagcacaacttttcgttttttatatttgtacgattttttttaataaaacgagtgatcaaacagtgcaagtaaaaacttaaaatcccttatattatgagacagagggatagtgtagtactactcttatgctagctggagcaatagaaatcactttgaagcgttggtccacatcagtccaatataatcaaactgacagttctgaataacactacaacagaatagcacatcactgatgatctatatcttaccgtccaaaatgtctcgtcccaaacgacctttatctctaacggatccaaataaattccgttgtaaataaggctatgagacatggctcatcacacgtagacatctgtgacatgcctcttgtacatactcggcacaactcacatttaacagattcaaacatagacccgttagaggcgactcttcatctgtgacgggtacagaatatgcacccatcaaagataagtcccatcacacaaaaccagaggaaccatattcttttctatcccccatcaacaacttgagaccagaggccacaatctctcatctctctctctctcttcttttctatcccccaccaacaacttgagaccagaggccacaatctctctctctcacacctcctcaccctcatcgagtgcaccagccgccgagtccaaagcactcgccgtcgtgggctttgccttcgtccccaagcacccacctcctgcatccctgagcactgtctgtcgctgcaacttcaatccccaagccaccgccgtcgtcgcccacgagtatccccgaggtcgggagacgccggatctgactagtcatgacctaatggtggctcgagcttgcgttggttgttacgtgaaattcgtcacacacgaaggcctaggaggactatttaattagttccaatgctggtcctatcaatcgggtttacggtgtgctaattagtttgatcctgcaactaacaagataaatagatagatcatataagatcaaggagccgattggtcaacaggctgatgcgatgtagcaaggccagccaatatcgataggatctcaatcaatcagctataggtttgtagtttttcttgacattgtgttaatatgacaacgatgaacaagaattaaccatttctcacggttaatatatatcagtgacactgtgctaacatgtgaattgaatctctttttgcccccattaagtagctcagtgacaggggtgataatatattgcccgttagagaacaatctcctgtgtaacaggtgaaattttgtggcccgtcacatattatggtcaccacgtaagagtctccactcgtaaaaggtgagaggagtcatcgttaaccactaatatctgacaagggtcaaatccatcaaaagtgacgatttgaacccatcactgataacctgagctggcgtagtgtaaaatcccgatggtgtacggtacggtagaatacgaactttatgaacggcaaagaagttgatttcatcacggtggtgcattgttgggacggaccgacggagccatctacaagcgtacgtcgccgtcgatcgagaccgcggttggacgagagaggcactcggccccagcgggaaagcgccgctgcctccatatcgccacgcagcggtctccgtcgcgccgcggtgtggccggcgccgccccttatcggtcgacgtggggcatgtgcgcgcgcgcggtcatatcacggctcacccgcgacacccttttgccacacgcgcgtacacgttcgtaccgcggcgagcgacccgtgcgcccatggatcatcgatcatcagtgtcgactgaatgcaaccgggctactgagtgatggatgatttttgatcagctcgtgatcgatcatggacgttcgtgcgttcctgttcatgattaattgatttatctttcgtatgtgtgtgttgataagacgaataatcaggtggatgcatgcatatatgctttggatgctgcacgcatcgatctcggcccctttcaatgggatggcagtcgctagctggtagctactacgtgcttatctcctgtgctctcttttgctcgtgcgcgcgcgctcgtgtggttagttgtccctctcgcgacggtacgaggcaggcaagaaagaggcccaacttgccgctgcgcgatggactgatatggctgatgggtgaatctattgcctgtgcaagtgtgcgccgagctaggcgccgtgagtggcatcgatcgacttgccaatttgatctgtagtgtgaagcactgatggatacacatgtaaatagaattaatctagcaacaggcactgatggtcacgtgcttattatcaacaggctttgtgtgtttttagtatgtatagagttctctgttttctgaaaactttcacaaattaccgatgcactctggaacacggtcatatgttatctgtcttgttcagactgctcaaaagaactcgaggttaggagactgcactacatatcgcagttactctactccgtatttctttgtgatgatcagttccaatcccccttctccaaacgacgatccgtcatcagggcggcatcaggaaggctgcatctgcaggtgcctgctacaacaataatgctgtagatcagtactgtaataagtactacttcgacacggactgtgtctaattcacaccaaaattaaaaatttggttgaaattgaaatggtgtgataaaaaaagttgaaagtttgtttatgtaggaaagttttgatgtgatggaaaagttgaaattttgatgaattattttagaactaaacacggcgtaaatagtggagtactccagtattaagctactccggccgacagtagtagacttgcagtatttgtttaagactgacttgcagttgtattaaagttgctcatccgattcccatgaacgaacagggcaagtggggaacatgccatgtgccgtacgtagtacagtggtactagtatattgtgtacgtacgtactagtactagtatactcctgcggtcctactgatacaggccagaaagcccaagatgagacgaatactcagcccagctaggtaccgtaccgactaccgaccgcctcgatccaccgggcgacacacctcaagctcctcttcggtcctcaccatcacatgacctgtccttcacaccctctgcccgtctctccggtctcaaccggacaacaggtcgcttcgttaggtgtggtcaggagtcgaggactactactagtctgttgccagctcgcccagctgtgcagcgtgatgcatgaactacacgcgctgggatcagatctctactataagctgcgatcggtaacggcgatctgtttaacattatcctttggggctttccgtgacaccaccgctgcatttcgtccaaaaatttgggaacgggtaaagtagaacaggcgctgtggcggtccatttctcgtacgaacgtctcgtgggcagcgacggccggcgaacgcgcacgtcgatctcagcggtagccatacgcccatacgcctcaaattaaggcgacgtcgacatgaaacgacgaaaacgggagggagggaaagccggggagggcaaaaaaggcgacgcggttggtgcgcgacacgtccgtgcgcgcgtgcgtgtgcgcttgcgcacaactgaaaacgaccggtgcacgcaggccgcgtgcgcacgagcggctagccggctacacgttcgcgtgagcgcgctcgtacacacatcgatcagtttttggaacatgaatatgtgccctggcagtctggcacacgaatacgacgagcaaaatcgaacggcggatgccagctacagtacccggtttaggagtctgtacgtacgtggagcacgtcgttggagttagtgatgacatattaatgctggtgcacgtgtgtcgattattaacttaaacgcgacggggtacgatccgagcccgtacgtgcatcgcgatcgatcggggcatgcaattgacaggaaccgaagctggtccgcagcttccgggatgtagcaggattagtaacgtactcacgtacagtacagggagtctggtaggagctattgcccaccttaacaaatcatcatccgcacatgcaacgccacctcgatccgaaccttaatctgcccggtcaaatcgagcaaccaccagcagcggagccggacagccaggacgggaactgaaatgaaccccaacaccatcacgctgcatatttgaatattcacggcaacgcgagtgacttgtacgttttctcgatcgatctgccactggatgctcgagttttttttgtttcgtcttctcttgtcgcctcggaacacaagttggggagatattaaatcagttcgtgcgacaagataagcgctaatcaaccaacgaaaaggccgcggcgggggggcctctccgtgatacggagcagtgaactgacgaggacgaccaggcaggcgacagctaaagccccggcctcgcacgtgcgacgggcgcatgatgcggcttggcacgcgcgggaactgatggctttggaatcttgcggcgggtggcgtgcgtgcatccgctgcctcgatggacgcaagctggccctgtcctgggtagagagactagagagaggggctcgatcgatcaagtgtactactacatcatagattaatctattcgagatcatagattaatccatccgagatcacgtcgcgcacgcatggcatggccattggccagcgtgtgcactgcacggacgaccgcacggcctcgtttctgtggctcgtggcctcgtgcatcgatgccaactggtgcagctaggagtactacgaccagcggtcgccatgaacagtggagtaacgtgtgtgcgtgcgggcgggctcgctgctcgatcggcctcggcgcgcatgcatgctggtgcatcaacatcacgagttcatcattccagggtacaggtacagcacggagtgaccaaagtggtcagaatcagacggggaacaacgctcggcgcaggggcacgcgtagcggctgcagagggaaaaaggtgccgcggcgcgccatccgttgtactacttctatcctatctggtctcgtacgaagcctcgtactctgacaacctttctcgacgttttttctttttctcctgcggttctccaaagcgatttctggagtagcgaattttaagatcggactacgaggtacagtattacttgaatcgtttcgttttggggtgattcatagcaaatttgttctgggtagggagatattcacagcagagagtgttcagcactttagcggaacgatgcgggcccggatcatcgagctactaaccgcagtaaaacgtcccccgtggctagttgatgggctgcaccgtttgccacagccgtattaggtgggccattaaagcccatgtagtaacttaagagcaggaaagaaataagtctgtattctcttcctcatctcttagtgctgattaaatcgcctcccttaattgcaaaatcaggtataacgtctccaaatctttgaaaacgtgtaaattgactccttcgatggtttggaaagtgatttttgctgacgtggcaagttggctgtggttttgactcgctaagttaacaggtgggatcccacatgttagtgacgtcctcatcttatcttcttcctcacctctccttcctctctctttccaagaaaagctacagaacgatatcccgtcgtcacgggacgattaatgagagcgaatcgttgtctgcctcatatgcaagatgtcgataggctccccacgacccacatgatgaacttgttgggcttttatcgcattgtcttgccgagtgtgaacgtgacttcttcttccattagtcgtaggacacacgcaagaggtgctcacatgctagctgggcctgcaggaaagagccatggtcaattatcttgttttatgtttatctttttcttaattatcttgttttaagtatcatatctgatatatatatatataggtatcatgtctaatacccaggtaccatatatgatatccacggtatctacaaatctgatacctaggtatcaagtctaaatatcaagtatgatacccaagtaccatatatgataccctaggtatcaggtctaagtatcaagtatgatactcaggtaccatgtatgatacccacgatatttacgaaatctagtacctaggtaccaggtctaattatcaaatatggtacccaagtatcatatatgatactcacgatatctacaaattatgatacctagatattggatataaatataagtatgatacctagataccacatatgatacatatggagtaccaggtctgttaccttgtaggttcataacatatacggtactatgtagtaccaagtatcatgggatttcatagatgataagtacatgatttctccatactttgtaataattagtcatagatgtgtgtatctttattggtctaacctaattagcacatgacccaacaagaatatttattgtgaagatatgtacttcctccattccataatataaggcacgactactttttttagatgttccataacataaggcatgtatgcaagcatacaattaactatgaccttttctctattaaattattacttttttgaatcctccactctcatgttatctaattctattggatgcatgccattatatttattaggatgatccaaactacaagatgataataattatttcttggtctttaggttaaagagtggttgtgccttatattttgaaatggagggaatatcaattgtcctaatctcatcagcatatggcctaacgagatactactagactattattagtccatatcagcgtttagaccaataggaaaactcttttcttagtatcagcccacctgagtcccacctaggccaaccagtcccgcttccttacagttcaaccaaactaatccagataggagacttgattacatgagcactaccgccacgtcctttccgggaagggggggggggggggagcagcatgtcgtgcacgatcaagatcataaactataccgtcagatgaatggtattccatcccctagctgtcctctttcatatattctctcttcctccatcttcctcctttgtcctttctcactgtccagtggtagtggagcccgggagggtggtggcaatggctagccgaacccctcgagcattcggggaagcttggggagaggagacgccgacgacaacattagagttggggaggcccggcgagagcatgtcgttgcgactcttcaccattggcttccgcagtgcacccgctgcttgtttcactccctcatgtcaccgcgtgcatcccagtatcccatgcccccacgacgatgatgtaactgttgccaccccctcccatcctgcacaagcacttgatcacgaccgccgccaccaccaccactgatttactcgacaccttctcgccttcccatctggagttgaagcagggtcaacgagctggcagctagtgaggaaggcggttcacggcagaggatgagaggagggaggcaagggaaaggggcggtgacaagggaggtgacaagctcgagctctccgttccatccatcatgttcctccccccgatatgctatcccgtcagccgtcttcctcaaccgatgtgccatcccgtctatcgtcttcctcccctgatgagttgtcccatctatcagtgtcaaggataaggcatacctcctatacacatgttcgtggcatacgataatactatatacctgatattataagagaaagtatcctttagttaaggaaatatgacaaagaaagaaggaattatctttccgaaatagaaggtgccagaatcttagtcgggaaagataaggtctccttaaacccgtgtcctgttatatgtccttaaaccagaatatgggagatacgggaaatatgacaaagaaagaaggaaattatctttccgaaatagaaggtgccagaatcttagtcggggaagataaggtctccttagaagccatagagaagaagatgatctacagtacatataacagaccctgacatcgagttacaaatcatagccaaatccacacccagaagcaatccaaaggaagctagcgtcctattcgctgaatttatctcatcggaccgttctcaacaacttttagtcggcagataagtctaatcgtcctattccacatttgtaatccatgtgatatttcaatccatatatacatataaattggagcagggtaaaagttattactcatcttgagagcctggaccattataaatctttgtctcgtgttccgtagatccgatctcacatacatcctggttccgacgatccccatactctacaaatgccgtttgcgaatatatctcgtcgacactatccactgtcttccacccccaatgtcccgtccgatcccccaatgcgtcgtggtctaggaggcttgcgacaaccagattgttgcgtcggtagaatcctcacgcgcttagctccctcaccatgggaggagatgttgccgacgagggcctcgtgctgtaatagcgcaaggatgccgaggcgcgaggataaagggtaaaggatgccacaggtcgaggagacctcctcttcgtcgcccttggctacatgtgtcacccccgacgttggctagagcaaatgtggtagatgggagatagtcaaagtggaggcactgtggaaggaggaagaaccgctgacgggaaggagcatgacgctaacgacggtccacccgtgatggagcctaatgaggctcgcttggcatcgccatccgtgataaagaaggtgacgctagtgggaggtaggtgggtgtgagcccaggatcaatgatgtcaccacctctagtccgagaacattatcggctacttaggttggttcctgcactacaacagccttgtggtcatggacctcctccgcctatagcttccctacattgctagaaagcgccgcacccgtcaccggcaaactctagggccttgaggaggaggtgggcaccgaggggaagaggccagtaagctcgccgcttcctgccacctctactcagtggatgggatgagacgaagagaggggcccttgctacatcgtccctataagctgaagcagtcgataggagaagagaaaaagtacacttgacatgtgggtctcaaatgttattttaatttattttcctggttgtaataccatgttagatgaaaaacatgttttaataagagggctgctacaaaacaggtgatgaactactgtaccagcaagtagatgataagcgcgg

SEQ ID NO: 29635 - DNA, 31504 bp, Oryza sativa
  unsure (1)..(31504): unsure at all n locations
ccgcccccgtgatgagcttctctngcagnagcncatcagtatcttcccacacagaaaatagcttttgaccggagtccaaaattggttgaactgctttaacatccgtcccagaagaataacactgctcgcaaaaaccagaaattttctggacatacggacatacctgcgcggctggcgactgggtgcggttgcactcccgcgtaaaacacgtcacattctaacttgcttcaaacaaacgccatcatccatcggatcatcccatcttccctaagcctcggggcaccaagtagcgttcggtacagacccccatcctctcccactagctcatcgcctacgaatccccgtccgattcctgtacgcttcttgcaggcttgcagctctcaacctcctcgtcgacgccggggaagggaagcctgcgttcgggcgagcgatggagcagggaagcgagaggcaggacgagcggccgccgctcccgtgcgcgaacggctgcggcttcttcggctctgccgacacccgtggcctctgctccaagtgctaccgccagaccgtgatgtcccaggcctccgcgccgtcggccgcagcacagtccgcggagcacgaccaggtggtgttgccggcgccggagggcgtacccgtggacgagggggcgatgccgccgccgccgccgcggcacggggcgaagacgaagagcaggtgcgctgcgtgcgggaggagcgtggggctgatggggttcgagtgccgctgcggtgccgtgttctgcggcgcgcatcgctactcggacaggcacgactgcggctacgattacaggggcgccgggcgcgacgccatcgcccgcgccaaccccgtcgtgagacccgacaaggtggagaagctctgaaaaaaaaggaaaagctacaactgctcgatcttgccaacattgccatgcccgaaccaaacgattggtcgattgctgatttgcttctcgtgcgagatggagtcggtactcggtactgatctatgtatggagatatgatatatgtagagattggaaattgatgattctgtgtggcttattgtgttgcgcacatatcacttcgatcttctaaaactttcagttagcacaataccgtggcaggatacaattttattgttcatggaagtagctgccaattctgaatctatagcacaaccatttgcagatttgctccctttcttttgcagtattaaagacgttagttgttataatgagtaaaacttcctttggatgcttaagcaacatgcgcatctggtgtagtggtatcatagtaccctcccacggtactgaccaaggttcgattccctggatgcgcattctttcagtttttttagccattatatttgccaagtgatatccctgctcacctgttgcttttgtccgccatttcgaatgccaagtgctatctcttctcacatttacttttgcttaccatgtcatatgctcgtccttgattacaaaaatgcctactacgatcttcatttatttgcatactcaatttttcgtcactgaaatccaaaatgtccgtccaattgcagaatagcttgtgtatgtattgctcaatgcacaccatctgttcgtcgaaacgtcgacatagatcaatcagcaagtagcggatcattccagtgttgattttccaaaatgcctgatcgttccggcatagtggcaatcgaggccagctacaacaagcttgtcagttgtcaccgtcctaattcacgatttcacatggagccggtcagccggatgcaacgggagctctgctgtgcttctcggcgtagacaaaatcggtgatcctctccaggagcacgtcgaagtcgtcctgtgtcttgaggaggttcacccgcgtgtaccgcgagatgatccccgccgccagcagcagcgatctcgcggcagtcgacgtcttcctcccactcgcatttcacccacgcgtaggctgctcatcaggagagaccaaacacaccagacacaacttcagccccgtctccgtccaacaccgtcgccacctcgcatcaccaccacccagccagtcgcctgaacacgccccgcccccgcagcattcatcagcccactcagatcttctcatttaaactctttctccgctgcagtccacgaacttgtaagagtgtgcagccgggcagcattcatcagcccactcagatcttctcatttaaactctatctccgctgcagtccacgaacttgtaagagtgtgcagcccggccacgtatcgtaggtcacctaggtcacattaggccaacttcaccacaggcccaaccgaaaccacaactatatatcctgagtctacacaacccaaaatactagtctgatgaaagagaactgccaccaccttttaagttgtcctcccccaccatcaattattgatgtgggactaaacccaagcaacaatcttccccgtcacatcaacccatgtgaccccgaagacttttacctggcctcccccaccatttgacctttggaaattgtttcggattttaaacctaagttctggtaccacttattagataatcagtccgaaattaccatcagaaaccaaacacggaagaaactccataggagatctaaacatgatgacaacaccgaggcacgatatttgttaacgaggttcagccgaagcctacatccccggggcacagtttatggggtgctactcctcaattcagtatattacagcataccagagttacaactaccctgggccggacgccgctggcagacgctacctctcgctatgctaagtcgtcatatccggttacaacaagtttgtccttctaattaaaaggatactagcatagagtctgactcttactctactccaataactagtacaactacaagtcctaaattgtaaccgactttgtacgcatattcgacacaaactctaatagagtgtggagagtaactccgtcgccactgccatccacaagccgacgcaacctagccgccgctcgcaagccagcgagatgcctgtcaccgccaccgtcgccgttcaccactgtgctcccagcttcggcggcaaacctcagcccatctgcctgggagccgaggaaaaagccccatcaccaccgtccttccactgcgcgcactcccggcagccagctcaagcaggggcgagacgggcggatgcgagcggaggggaagaatcggttgagggaggtattttcggcttgaactggcccgtcaattatatatattctaagaagatagcgagcccattgtttcgcttagaataagccaaatggcatatttgcatacgaaaagtaatttgtgaaaaaaaaatatatacgtgttcttagcttagcgatctaaaagcaaaagctaaaaaataaacttcgatgaaaaaaccttatcagctcgaaatttaagattataaattaaaattttggttgataagcataaaagatgaggatgtgttttgacaaatcaacaacgattttataggagacccgattataagaatgaaaggatggacacatatcttattttagatactaattaatgaataaacagaacggacacaaagcagacaagcaaaactatctactccagggaaagggctctcgcatcgccctctccacgggcgacacgagaggtgacgccgccaccgtcttcttcctcctcctcccctccttctctgcctcgccgccgcctgagcgggcgccggcaaagtcgcgcggccgcagggacggtggcggcggggcttcgcctcagcgcgcgctcggcggcccggggagctggccgggcggcgacggtggcaaaccgtccgaatccgcgcccgcctggccggatccggcggggcagcgcttggcggcggggcggagtggtggcggcggtgactggcggtgcctggtggtggcgtatagggccggcggcggcggaaacccccgcccagatccgcgctattttggccagatttggtggggctgacgccgggcgacggcgggcggcagggaagcaggcgtgctggcagcggggaagaggcggcgacggttgcgcgggcggcgcagctgaggtcgtgggcgacgcggtcaggcgcgtgtgagcgtcaccaacggcggttgaggccgtttgcccgaaggccggtgaggatggcgacgcggggcaagctcacggcggtggcggagcaagctcgcggcggtggcggcaccgcggagctcgcggcgacgtcggcggcggcaacggtgcgggagcacggggcgacggcgacggtggtaacggcgtggatttcatggcgatggtggcatcagcggcttgtcggcggcgacagcacggtggctggtcgacggctttggcggctgttggtggctgtggcattggggctctcgcggcggaggcagcagcgcggaactcgtggcgacggttgcggtagcggctggacgacggcgatggggctgcggctggttggcagcgaggtggccgtcggcagcagcggccgtggtggtggtgggagttggcatggtggcctcggtcggctagccgaggaggtggcagacggctgcatctggccggtgcgggagagtacggaagaggggtcggagaccggcttggcgcagaaaggcgcagccgatggcagtggaggccggctcggcgcgagaggcgcgggcggcggagatggagggcggcttggcgcgagaggcgcggccgatggagggaggccggattggcgcgagaggcgcgtccggtggaggaggccggttcggcgcggccggcagaggaggaggcgaccctggtgcgaggaggagatgccggtgggcgtggcacgatcttcggcgctcgaaggctggccggcgggggcgccagtgcgggggtcccacatgtaggcagaggttgtgtggtggtggagcatcggtgcgtcagccatggattcgcaggtggtgtgcggcgggtgaaaacccagtccggccttgccgggctgacaacgatggttaattccccctcctgagggcgttgtcgtgctgtctcacccctcagggcgatctcgtctgtgttcttttgttggtttagcggcggccggtccgatgctagcatcctcctggtcgtgtgtgttggcgctgtaggtgtgtggggttgtatatttttttcttttttcctggttatgaccctccagggttataatcttataattttttcctgctctatcaatagaacttcgcaccgtctcgtgcgagtcgttaaaaaaaactatctactccgggattagtcaaggagaaatgcggcgggagaagtgccatggacccgtagtggtttactggtatgtcgttttaagacgaaattaattgatgctatgaacatttaattaaatcggacccggtgacagccttatgatatgatactacacgccaactactcccttggtgtacgtgacaccgttgtcccagatcattaatgaagaagcctggaggacaatggccattttttatttgcgacggggctataaactatcatgggcgtactcctccttccaaaaatagttatctttctatttttttagaacaaattaagatttaacacgcaaagaatatattaccccttatttgaatgaaagtaaaacagtgataaaggtagaataggtagaaatttgaatttgaggtgactgatgtgactagtattactctcaagtgacaagtactgtggaatttaaactttgaaaagacaactattttaggacaaggaactaccatacaatatgacaatgagatctttagtaggtaaaaaaaatatcattaaagatagtaaaagaagatgccactaatactagttcaaaggtaaagataaatagagagaagaaaagaaacaaatataacaaagtagtcatggtattattaacagaacactagaggatatatcgcgtttaatttatggatattggaattagtattagtggcgctaagttatgttgacattttaatctttcataaataaaatgtgaaaaatatatatgctcttacgtgagaaaaatataatgctaaccgcatatcctgctattagctgattcagtggtagtaggtgattctaacttgatgacgatattcagagactactagggcctgtgcatctggtgtagtggtatggtattataggtgtgtttagtccctgaaaaaagttgaaagtttaggaaaagttgggagtttggaaaaaatttaaaagtttatgtgtaggaaagtttttgatgtgatatgatgtgatggaaaattagaagtgtggggtagttggggtgaattaaacacggccatagtacccttccacgataccgagtcaggttctattttccggatgcacattttttttcaatgcaactaagtactatcttagcccgcattttcgtttttgcatgtgctatctctgcccacattttcccttttgctcgcacccatgccatatgcatatcacattaccattttccctgccatgccatatgcatatcttttcttttactaaccggcacataacagtatcaatataattgtatagagtatgattaaaagtatttacaaagagttcgaaaaggaaataattatataagtgtttttatggaaactaaggtaacatattcataagtctttttgctcccgctcgtgcccaagtttttccttctccctttatcttagaggcacatattaatgtttttagagaaacttcaaggatgacgcatgctgatggagtatgcacacaaattagtgttctgccttaagtagtaaatgtaacatgtatgatattcatttaattacatattcaattgttgatcactgaaacacataattgcttgtgtatatctacatcattcgtcaatacacacaaatcaatatctacctgttcgtccaaatattgacggggaacaatcaacgtctagctgatcattccccttgattattgtacccatgaacttacccaagaacaatcagatagtagagctgatcgttccggcacagcgcccatcgaagccagctagacgaagcttggcaccctctcaattcacgatttctcacatggagctggagccaccgggagctctgccgtgctcctcggcatcgacgaattcggtgatcctctccaggagcacgtcgaagtcgtcctgcgccttgaggaggctcatccgcgtgtaccgagcttcggcctcggataaagtgccggaccgcgagatgatccccgccgccagcagcgtctcgtagcagtcgacgtcttcctcccactcgcatttcacccacgcgtaggctgcccatcagggggagaccaaacaagccaacacatgagcacaaagattttggttgacagaaattgattttgagtgttagcgagcgagacaaactgatcacctggcgatggctctttgatccggttgaagtaagtgcagtactggggcggtatcttctgcagcgagatccgggtggaccgcgacacgacggcgttgagccttcgccatcggctcctcatcacgtcatagccgaaggcgaagatgtcctccttgccgtgcaggttggccagtatcacctttaggatcttcagcatccggagctgggtgtcccgggacgcgcccatgatgctctgctctacgtacgaaagtgctcttttcgccaccttctcgtcccttatcagcgcccatctgcgcaacgcacagcacggtatgacgtatatgtagtgtacaagtttttgcgtcgttgtgttcacgtgtcgcttgcaatgtcaggcttaatttgagggcgtgtacccgaatctgctgcggcgtggccggagagcttggaagcggtgaagagcatgacgtcctcgtcggcgggcgccgggatgtgcgtcaggtgaggccagtagtacgcgtggtcgacgatcgccgacgagccggcgaggacgggcttgcgcaacgcggtgtcggggttgttcggcgaggtgacgaactcgatgaaacctttggtggagtttcccgagccgttgtttgaccacgtagcggtggtgccgtcccatttgtactcccgggcggcaaacatgtcggtttgtgacttgtacgcctacacatatcatcgatcaaagcagttcacttcagcacgacttaattaactgagatcatcgtcaatggcatggttcgcatgcaggttgtcagcgtgtggtggtgtttggaatcacggaccgggtaatacggcacggtggcgacgacgcttgccggcggcgagtcggcgttgccgtcgggggagagcgcgtacaccaacgcgttgatgagctgcatggagccggccccgaagaccaagtacttgtcgtcgacgaccgcgttgccgacggccctgtgcagcagccggatgtggcgatcgagctcgacggaatggaagcggccgccggtggtgatgtagctcaagcggtgccacccggagaacaccacggcgctggctgccgcgtgccgtctccagtacggctccaggaacaacgggttcccgctgcacaaaaccattgcaggattagtgttagggagtacgtgccgtgctacgtaccagcggctgtgctacacattctgtacggaatgatagctcatttgagcatttgcaatgtgggggccccaaaccagagagaagaataaaagaccgactctacacattgtatggaccttttgcatagatacacctaaaggagagaggggaaatgatctcgagtcaaataccaggagaatactagtacacgcgcccggttagacaagaaaaataaaaatgcggcgctgctactgctacatcttcctccctcgttcccatcttaaataatttttattttaaactacttatctgatctataatccgagttgtattcttcgtaattaaatttttacaacaagatatcacatgattatgtatattctaataaaaaaatatatatttcaacctgttaaaatttagtgtttcatacgtgatagcaatatgtttcaatgtgtgttccattagtatgcatatgtggtagagtttaggatccttaagtaaattatatattgtggatgttcttaatctcacacgcgccagttaaaactgatatattgggctggtctgtcagtatttccggtaagacccaggttaaaacagattttacttgagccaggtttgtacggcccaaatattgacatttagtccttgtttagatacggcccagccacatgtgtgggcaacgattgttttgactcgacctgtataatgctagaccgcagagacaaacaaaaaaaaaattaacctgatctctcgatattttccagcgatgacgtaaaatcctacttctagaactagaagtagtcatggaagaagattaatttgggctggaagattaatttaaactattacttaaaaaatatttgtacgttgcaacagaaaatatactaatttgaaattatgccaccatgcatgaataattaatattcggtcacaactgattgtgacgccgacttgtgtacatccatcacccgatcacggaaattgttagtttaagcttcatgataaaaaaaaaatcctaaattgtcacatcacttataatagggaaaataatgacacgaaattataacccactttggttcaaaactgataccatatcatgaaaaatatctagttaaaatttccgatggttctttttagttggaaacattttttctagttgattttattgggttgttatgacttaatttcttgtgctcgtcttctcctcgtgtactttgtggccttgataagctgacgttctgtttctaatatttttctttggagtttggttcggtaacacagggccacaaaatacatgattctgttgattgcttttgttgcgaacagtattggcttccactcaccgtcagttttagaagcgggatcatgtatgcagagatgcgaacagtattggaatcagtagtcgctaggaatcaggatacggggtgattagaggaatcataaacaggattatgtaccaaaacggaagaaacaaataaaatagatcaggactcaaggagcgacggatgaagaggcatgagtacagaaaactctttaattattataataggtaaagactgtagtattaattattgtggtgacaggatggttagatatgtttcatgtgaaattgttggggcaagaaacacctcttgcaaggacattaatttgggcaataacattaacttaaactttgggagtacctatttttttatagaactagtatgcaataaatagtggaactatcaaacagaggtgcactggtagtggttactgcagctggggttggagcttagattcaagttgaaatgaggaacaattatgactataaatagcgcagacactacatacaatttctgtttgtaaggatggttttttttttcccttttcaatatgtaaaccaagtttggaattacaattttatggtataataggcggctagcgtataaagattttcagatttttttttacaactatttcatctatatattgaactatcttattgatgatatttgagatttaataacaaatcgtgggatgccaaagggataaaataaccggttccgcatggacaagaatatccgccggccgcggatgcgccccttgccatggcgcctgaagccctgaacactcggaggctcggagcaagatgattgataattaatcctattcggcagccatcgccatgtgccaacgtacgtgtgcagtagccaagccaaggcaccggccaagaagatctgaagaacacgagagccaaattagttacctgtcggcgtcggcggtgcagttgggcgtccggacggagcagtccggcccggagaagcagcggttgcactcgcacccgggccgcccatcctcgccggtgacgccatccaggaacacgttgccgtggccggagcagtcggcggcggccacggcctcggcctccctggccgcctgcagcgcccagctcagcccgtcgccgagccgctccggcgttgccgtcggcgaggacctgaggaggtggtgcgcgaagaagacggcgttgagcagcaacgacgagcagaggagtgcgtggaacgcgagccctgcagatcccaggctctgtgacctatgccgtcccgtctccattgctttcctgtctcggggtgtctccaatgacctcaccgtcggccattgggccactgcactgtgagcctgtgagcctaccggtttattaatcggtttctagcacagcgcgtgtggccccagctttggttcgattataaaatctgtgcttataaaatattttgtccaaatcgaagttgtgatcgcgtgcaggtaattctttcatacaaagtacaatattttcgatttgaacagtccccgtcaattatatgtttttctgagaagtttgagatgcgttttttgacaaatcaacaatgattatatatatatatatatatatatatatatatatatatatatatatatatatatatatatatatatatatatatatatatgtatatagtacgcctgactataagactggaacctagttttatttaactaattacgcggtatatacgtacgcacacactgacacacaccattatactaaaaagaccaggacagggtagttgatcaaactctctgacctcattcatggaattattgggccggattaaacactaatcactaatgctgtgggagaatcaccgtggtggttttcttcccggtatatactgatttaatctgaaaagtgaaatgatattatattaaagcgggccctctagcagccatatgataagaacactccaactacttaattatttgctgtcccctgatctcaggtacatcaaataatgttcgatactaaatgcaaacaattactacatttgcagcactatataaattgatgaattaaaaaaatcaccggttggatcactttttattgctaaaataaaactttaaaacattcttaaaccaatcttttcactgtgaatcaggtaactttatcatttttaatattggaccacccttcacgcaactctctttactattcatataaaccctttattacagtgaagataaggcgttacatggatagggaagctcactggtatattaaaacatatttgtttgaggttgttaataagtgctgaagaagttatttagggtgatccaaacaaaaaaaatagcaaagttacccgatccaaagtaaaagaattaatttaaatatatctaaagtgaaactttaataataaaagatgacccaaattataattcgctctaaataaaatagtactacatgacacatcatcacagtccgatggttaagaaattaatgcaagcagaccattcacaaagtagcgagagtacgtataagggaaggagtaaatttcgtaaaactaaaataatactttataaaattatgaaactattcatttgttgtgaaatatcatatttaatcaataatattctataggatagatataacaaaggcagtggattgtctcacgtaattttgtgctgtgttacactttacatgacaaacttttagcttccatttcatatatgagttttataaggagagttcgatttaatatataactctttaatatatagtatttctataggcacaattgcatgttgtacacaactacacggttaatctagacccacaatgcattatttttttccattaatttttttacaaataccttatgaaaatattgatgtttaatggcaacattatttccacgaaaccttgtttatctctacataaccattgttggtcataacgaaatacatagaatgaattgaaaattgaccattctgatgtaaattagaactaaacatatatttgcttgagatggatatccttgttatttgcaaacagatcatgttatagaagtaaattctgaccaaacaaaagttgatgaaatgatatattgtgaggtataaaactcatgatagccttgtgactcttctgtatcaatatatatgtggcaaagcttttgctcttttttaaaaaaagatagccttgtgacaaaattagtgctaaatattacgatgataaggtataagtatattggaagtgtaggtgcttgtatgttttttttttaaaaaaaacatacctttctcatcctttatttaaacaaagtcccttctttagactaatagaaaataaattttctgttcatgaaaaaaaacatgcaaaaatactcaagcatataaacgtaaaaataaaaccatataaaataacaaaatcccaactaaaataaacgaaaactacacagtctagcgctacgattttaggcttagtaatatgtaatttgtattttttttaataaattttaaggcatttaaaatccagtagcaaataccaaacatatggtttttaataagcacgattgctaaaactatcatatcgtaatattacaacttaaatatgtatatttgttttatctacaaccaagataataaatagcgtatagtaaattggtagcggattagtgactgggtagcggattgcggatagcgggcgctattgcggacgctaagtttcaatagcaaaattaagaaaaataaccataaatttagattttatatcaagattaacatcaagtttcacttaaaaattaaaatttaaactgcatgcttaattacttctacatttcataacataaaaattatggaataacatattaatatataagataaagaaggcacattgtactaagttattctatccatatgtaaagaacatcattttagcattatagagatccaacaaagtcaataacagactgtatagcggtcgcgaaacgctatagcggctgctaagttccaatacgctatatgtagtccgctactatcgctatttattaccttgtctacaactactttaaaagtacaatcctgctctcttccctagcgtgcgtagcacgagaaaatcctgtaaactgaaccggcccacctctaccccgtatcatcagttaataaccctcctaccctcaccgtttttctcagtttttttcaatttcttttctcctctagatagctgacacattgctttattagtacagtgctcctcaattagaccagaaaaacctgcagcaggctgtttaaccggtcaaaattactttaaatcccatgaaaaatctgccgttgaaatgcacaggtatatcactgtattatatctttatctttacatattataaaatataaaaattgaagatgtttttgtctgtactttgatacgtcatccgtgtatgagtcggtttttaagttcgttcgcttttggaaatatagatcagtatttgagtcgggttttaagttcgttagcttttggaaatatggatggagttgtataagaaatctctacctctactattataaaaaaataaagatgtttttgttggtacttttggtacgccatttgtgtttgaatcggtttttaagttcaatcgcttttggaaatacatatccgtgtttgagtcggtttttaattgtgttcgtttttagaaatacagaaggagtcatatacaaatctctttaaaaaacttacatgctaatttgagacgatcggacccctaattgcggctcatgattttgtaaaaaatatatctaagcgaattcttacggttaatttcactttagctaaaccgtacaacaacaataagattaaaatatccttcacccgttgcaacacacgggcatttttctagtattataaaagtttaagatgtttttggcaagaattttggtacgtcgtccgagtataatgcgatgtgcagtccgataccctccccgtgcatttctttttttgcaattttttgccttatttttcagtccgattccctcccatgcacttttttgcgatttttctaacaaaaaactaaaagaatcgaactctaatccaaccaaataaaatcagaagagagatccacaagagaactcaaatacaccataaaaaaaaatccacgagcagatcaaccaattgctcccaacccctttgcccaaaatcacaaaatcactcaattgcaatcccaaatcaaaatcaagaatcccctacaaaatcaacatcccaaataaaaaaaaaaccaaaccctaaccctagccacctcccacagcagtcctccccgtggtcgccgccgccgccgccgtcgtcgtctgccgctgtggtcgtcatcgccgtcgtcgttgccattgccgttgtccgcatcaccgccttccaccgcgaccagctcccgagcccaccgccgctcctggccgcgtcgccacactaggaatggggccgacaccgccactgccgtcagatccgccacaggagggaggcgaaaggggtcggatggagccgccaccgcctgatccgtcctcagccgccaccattgcggccggatccacctgcggtcgccgtcgccggacccatcacgcgagaggcgtgagagagggcgaggggaatgacggttgggaggaagagagggagatgaagcggcccccccggtgggtggagggggagcggcgcctctggggaaggggaggaggagcggtggaggggaaaagncggcaccaagagagagagagagagccggctcgcggactcgcggtggggaaggaaaggagatagtgaatgagggttagggttagcggttttgatggattcagaatcgatctgagccgtcaatgaaaatgaacagctcaggttgatccgcgtcgggccggcctcccttcctgggttgcaacactgctgggatgctgggccgcgcgtgcgaatgccctagcaggccggcgggtctaacctctaaagaggccttttcttcttttttttttgaactttcattatttctctagaaatatattttcttaaaggcccatatcatgaaaaactcaaccctaataatataatattttatatttggtaaaattttagtttacccgttgcaacgcacggttatttttttgcagtgttatataaaaaaaaatctatgctacaatttcattgttggtccgttctaacggttttctacttcttgttgtttcctatatacgcgcggaaaagtcagctaaaatctgctcttattccacgaaccatcgaagtcgagccaccagtcaccacaaaaatactgctagagggaagagagagagattccactagattcttatattcactagtctattgcgatgagaaaattataaccctgattccccgagattttttgatggactgattccccagttgctatgcggggacagcgtagttgatgattccttgtctctcatcgtgacgtgaggaaattgtacgtaaagctgcaggcttgttgctttccgatccgaatggccgtgaagccgcccttgactagtctctatctctatctctatctctttctactattataaaagataaaaatatttttaacggttttttatgtcatcagtgttgagtcagttgttaagtacgttcgcttttaagatacatatccgtatttaagtcgggttttaaatttgttcgcttttaaaaaatacatgagttatataagaaatttcttaaaaaaacctcatatgctaacttgagatgatcgaactcctaattgcagctcatgattttttcagaaaaatatatattcaagcgaattcttacagtgaatttcgtataacaataataagattaaaatagtcttctatatattatctcacaagacaataattttgagaatataccactcaattagcgcgccttttaggttttaccaactaatcaatgcattgtactccttccttccctaaatgtttgacgccgttaacttttttaaatatgtttgaccattcgtcttattcaaaaacttttatgaaatatgtaaaactatacgtatacataaaaatatatttatcaatgaatcaaatgatagaaaaagaattaataattacttaaattttttaataagacaaacggtcatatatatttaaaaaagtcaacggcgtcaaatttagattttttaataaaacaaacggtcatatatatttaaaaaagtcaacggcgtcaaatttagagagggagggagtataatttaacattagtatttggtagcattttctcaaaaattgctaatgggcgtttgctgtgatcctggtggaacgatgggttttttttcttttcttttctagcctaggctcgcgcaccgcaaccatttcctctttctttactttcaccgttttgctgttagaaattgcttcgaattttgttgttttctcttttttattgttatcggttttgatggaagcaagttagtgcatatctctcttttttttcttttgttgctgacaaagacgtgcatgtactgcataactacatattaaacttttggaaaaagtacgaattaccgtcttgaactatcgcggttggtcgaattaccccctaaacctgaaaatcggacatcgtttaccctgaacttttaataccggacaaattaccccctcgacccaatccagatcgattttgtcctacgtggcgtacacggggcaatccagtcagcgttttctttttttgtttttgttggtggggtccacctgtctctctctctctttccctctctctcgggctctcgggccgtcgggcgcaggtcagcgcacggcgccgcgcgggtgcaggtggtgggcggcggcggcgggtcgatgagctcggccggctccggtagcagcggcgtgttcgctgcaatttcatcgctccatccatgccaccaccgctgctgctttttttttttgcgtggttgttggatccgctggtcctgcgtggtcgcgtgtggtgtgtgttgtcctctcgctggttttgacgaccttttcttcctcgatgccgctgtaggtggccggcggtgagcaggaggaatcatctctagtgttcttgtctctgaggaattttgattctctctgtgaagggatttggtgtgttcctgctgctactggtgctccagatgcttcccaccaacaggaacaggccccagcagaggactgccagatcttggtatttcatgagccagcgggtcgacgagctcggccggctccagtggcagcggcggcggcgtcgggacatggagcaagacggcagcggcgacgacgctgctcgggcagccgccagccaccgcattagcaggagggggctacgtccgtgtccccctgctgtcgcgccgccctcccgcgcatcgatggaaggtgaggccgcgtcggctgctgctcctctgctcccacgacgaagacccgccgtcgcgtggctcgccgccgtcctcggcccccccttcgcgccaccagttggctccgcccccgcgcgccgcagtcctcagctcgtcgtcgtcggttggtaatggaggtgaggggagagaggagggagagagggggattagggaaagagagagaagagaaagggtgagaaaatgacaggtgggcctcactgactggactgccacgcgtatgccacgtagaccaaaaccaccgcggattgggttgagggggtaattcgtccggtttgcatagttgggggtgaataatgtccagttttgttgttcatggggtaattcgttcgaccgcgatagtttaggggcgtaatccgtactttttcctaaacttttctatgcagctaccttcttggcctgttttgttgattaatttcagctgtggcccaatgcaagccgattctctcggagctgaacgggaggatgaattagtctagcaggagtttgttagagatgcaaataagtcgcgaatcagttaatcgtgaccgagtctagcgctggcagtggcgcgggtgtgtgcatggagttcagagaaaagcggatcgtgggatggcgcgattttgcctcggattcctattttttttttgcgttgagtataagtagttctcttagctctttattctttttgtaaggtttacattcagttgaatgagaaaaacccagaaaaaattgccccatacattcttgcaagaattctttctctgaaacttttcctctgctctgtttgctgctctgttcgttgttgccgctgcagttcttgccgtgccgggcgtgaacagtctgccagcaaggtgtttgatcggagtttttttgctattgccaacaagtggtatcagagcactcaggttgagggctgatctgacaccatggcgttggttccggcgggagcgggagcggatccggcgagggagagctcggggagtgctttctcctacccacaactcacggcaacgaactacaccagctggtgcattcgggttcaggcgatgatggaggaccagggtgtctgggacgccatcgagccggcggccggggtggccgtcgacccaagaagggacaagaaggcgaggtcccatctgttgcagtccctgccggaggacttgctgatgcaggtggcaaagaagagatcggcgaaggaagtgtgggattgcttgaagacaaggttcgtgggcgcggaccgcgttcgcgaagcgcgcttgcagacgttgaagggtgaatttggtgccatggtgatggagccaggggaaactctggatcagtacgcgggccgcatcaccgcgatgagcgtgcgtcactcggcgttgggctcgacgctgggtgattccgcgatggtgaagaagctgttcgacacggtgccggaaaaattcgtcagcctcgtcgcaggtattgagcaattttatgacattgatactatgccatttgaggaggcagtgggtcgaccgaaggcctacgaggagcgcatgcggaagaagaaggctgccgctggcggggtcaccaccgatgggcaggtgctcctcactcaagcggagtgggaagctcacttcaagaagaacggcggggaatcctcgccaccacagaagaacaaaccttcaggtgaaggtgctgggcgcggccagggcggtcgcggtcgcggcagaggccgtggcgcaggcggacgcggtgggacgccgcggggcgactcaggtgcaggctctggcggcggtggccgtgacaagagtcacatcaagtgcttcaattgcgaggagtacgggcactactctaaccaatgcccacatccgaagaagaagaagggagaagcacatcttgcacagacggaggacgccgggcctgccctgttgcttgcgatgacggaggatgtgccagagcgcgcgtcgtgcggattggtcgtacgcgagcagcgcgtgtggcccaagctgctactggtagacgctggtggacatgctggcgatgtctggttcctggacaatggggccagcaaccacatgaccggcgatcgaagcaaattccgggagctggacgagtcgatcaccggacgggtgaagttcggcgacgcttccacagtgcagatcaaggggaaggggtcgattcttttttcatgcaagaacggtgatcaatggctgctacaggacgtctactacatccccagtctgcaatgtaacatggtgagtttgggccaactaacagagaccgggcatcgcgtggtcatggatgaggatgtactcgaagtgttcgacaaaagtccatggcggctggtgatgaaggtgaggcgcactgtaaatcgtctttaccgaattgagttgaagctggcgcatcccgtgtccctgctgtccagcctcgacgacccggcttggctgtggcatgcgcggctgggacacgtaaattttcaagcaatgaaactgctggtggacaaggagatggcggggggtgttccggcaatcgtccacccgaatcagctgtgccaatcttgcctggtggcgaaacaggccagggcgccgttcccggcggcggcgcacttcagggcggaggagccgctcgagctgctgcacatagatctgtgcggcccgattacaccgagtacgatgtctggtaatcgctatttttttcttatagttgatgattattcccggtggatgtgggtgttcgtactcaagacgaaggatcaatcgctcgatgctttcgtaaagttcaagccactggccgagaacacggctgggcggcgcgtgaagacgttgcggtcagaccggggtggtgaattcctgtcaggcgagtttgcacaggtgtgcgaggaggcggggattcaacgtcacctgacagcgccgtactcgccccagcaaaacggggcggtggagaggcgcaaccgcacggtgatggccatggcacgctcactactgaaggggatgcgcgtaccgggcaggttttggggggaggcggtgcgtcacgcggtgcatctccttaaccggctcccgacgaaggcaatgggtgatcgtactccgttcgaggcatggacggggaggaagccacagctgggacatctcaaggtgttcggctgcacggcacacgcgaaaaacacgcagccgcacctcaagaagctggacgacaggagtgcaccgtacgtgtatctcggtgtggaggaagggagcaaggctcatcgtctgttcgatccgcgtcgtgggcgcatacatgtaagtcgtgacgttgtatttgaggaaaatgtaccttgggagtggacatcagttgcaggacaggagccaacggatttcacgatggaggaggagcctggtgagcagctgccgagcccggcaacagcggccggcgtggtaccgtcgtaccaggcaccgtctcctggcaggcgcgccgggaaggaagcagtggtggcggcagaagaagtaccgtcaccggcaagcccggtggcagcatcaccgactctgcctggaacgcccacgcccggttctccatcgacaaactctgccggggtggtgccgtcaccgggcacagatgacaacatcgatacagatgatgggcctaggcggtatagatcgctggcagatgtcctacgtgaggccccgcgtgtggatttggtggaggacgaatgtgatggagaggcgctcctagctgagtcagaagagccatcaagctatcgagaagctgccggccaacctgcgtgggaagaagcaatgcagagggagatggaggcaatcgagaagaacaaaacatgggagttggccatgttgccagccgggcaccgagcgattgggctgaaatgggtgtataagctcaagaagaacacgacaggggagataatcaagcacaaggcacggttggttgcaaaaggatatgtgcagaaacaaggggtcgattttgaagaggtgtttgctccggtagcgaggcttgataccgttcgtgttgtgcttgcagtggcggctgatcgccgctggcaggttcatcatcttgatgtcaaatcggcattccttaatggtgaacttgaagaagaggtgtatgttgcacaaccggaagggtttgctagatcaggaaaagagcatcttgtgctcaagctgcataaggcattgtatggactccggcaggcactgcgagcctggaatatacgcctggacagaagcttgagggagctcggctttgatcggtgtacgcaggagcaggcagtatacacccgaggcagaggaagtgatggcataattgtcggcgtttacgttgatgatctcattgtcaccggagaaaatccctctgaattgaaggttttcaaggaacaaatgatgggggagtttgagatgagtgatctcggtttgctcacatattatctcgggatagaggttgatcaagatgagagtgctaccacattgaaacagactgcatatgccaagaaattactgtctcagtttgggatgatggagtgcaactcagtttcaattccaatcgatccgagatcgcagctgagcaaggatccagaaggtcacccggtggatgcaactgagtatcggcggatcatcggtagtcttcggtatttgcttcacacgaggccggatctgtcatatgttgtcggggtggcaagcaggttcatggagaggccaaccgtgatgcatttcaaggctgtgaagcaaattctcagatacatcaagggaacgatggattatggtctcgtgtatgctgcaggcactagggcactgaagattacagggtatactgacagtgacctcgccggggacttggatgatcggcgcagcactggtggaatggcgttctacatcaatcagagtctggtggcgtggagctcgcaaaagcagaaaactgtggcactatcgtcgtgtgaagccgagttcatggcagccacgacggcggcctgtcaagcgctctggttaagagtgttgctagcagaagtggcgggagtggaggagaaagcagtgaagctcttcgtcgacaataggtcagcaattgcattgatgaagaacccggtgtttcatgggagaagtaagcatattgacacccgttatcacttcatacgggagtgtgtggatggcgggcaaattgttgtggagttcgtccggactgaggagcagcgggcggatgcactgacgaaaggattgccggcggcgaagctggcgacggcgagacaccttcttggtgttcgttcactagggccacggcagaattaagggggagattgttgattaatttcagctgtggcccaatgcaagccgattctctcggagctgaacgggaggatgaattagtctagcaggagtttgttagagatgcaaataagtcgcgaatcagttaatcgtgaccgagtctagcgctggcagtggcgtgggtgtgtgcatggagttcagagaaaagcggatcgtgggatggcgcgattttgcctcggattcctattttttttgcgttgagtataagtagttctcttagctctttattctttttgtaaggtttacattcagttgaatgagaaaaacccagaaaaaattgccccatacattctcgcaagaattctttctctgaaacttctcctctgctctgtttgctgctctgttcgttgttgccgctgcagttcttgccgtgccgggcgtgaacagtctgccagcaaggtgtttgatcggagttttttttgctattgccaacatgtttttggccctttttgatttttttaattcgtttgaaattcatgtatagaaactttttatatctaaattttatatacataaaatttataggccaaagttcatgtgtacaaaatttctacgtataaagtttatacatgtgaagtttgtacgttaaaagttcctacttacaataggatttgaagtcacccaaaaccaataaaaaaaatatgaagcaactagatgtgcttattagggatatgttgggtaacagactgacataaaccaatacaaacaaagtatatctaaaactaaaaagaaaaataagcacgtggatgttcacctgaaaatgcgtcagtggaaaacagaaatattatatttctggtttaaaaaaatttcctttcttttttgggatatttttactgcacgtgggcccgcgtgctacaggccagcgaggggggcgagctggtcgcgttcagcgatcgaccatgtattacagtattagaagcacccactttctcctccttttctctagttcttggttttcttttccatttcattatttttctcagttttggagacatttttgcccctagctagccccacatatcagatccaaagagagagaagagagaggagatagggtcgatcgatccatccattgtttggcccatgcgttgccgtcccaacaccgagtgtcgccacctaccgccaagcacctgcgcccccaacaccgtgcgttactgcccctgccgttgcgcgcctatgcactcgccatcgggcgcctctgcgtccccactgtcccgactcgggagccatctgcaccctctacgagagcattacaaagtatttacatcatgtacaacgaatcaaaatttgcttatctaccaattgacttcgagagcaatccctgctgctactttgccatcatactctctaccaattgacttcgagagcggtggctcccctcggagttcgctaatgaggtgccgagggccgccgctcggtggcggtaagggcagtgacaaccgacaaagcggtgtcgggctgggaaagcacatagcgacgggaagatggtgctcagcggcaggggcatgcttgatggtgaagcgcactacgttgggttgtggctaggaatgcaagtaggtagtcccactacccgcataaaaacccgtttactagttcatttcttatatgatagtacaatatttagaagaaaaaatgaactagaagtgagataagcgggctaaaaaaacccgcttgcctaccccgcttgcatccctacatgtggtgatgggcggtggtggggccttggagctcggtggtgcttggtggtgagggtgacaaactgacaaatggatggatcaatggaaatatgtttggcaccattggttgcaatttttttacataagtcgttggtcggctcaccgaaaagtttgtgcgtcgcaaaaacgaaattactcaaaaacattcaaatgtgtttttgtgcatatgagaatgagtttgacaccattctctctttagatctgacatgtgtgatagtagtggagatggagagaatggatggagaacccttcccttttgcctcttatgaactcttttttattcatatgggacgggaaattatatcactaccctggaccttttttatgggggtgacattgctctaagggtgttttagttctttattacagtagttaagataacaccatatgaatagagtttattcacgtgctcggttaggatgaacttggcgcatttaacctcatccgtgatctctattttttgccaacgtcattctttttacgaaacgccaacgacattttgttttactatactaggacttcctcgtcttctgtgaatccgctatgtacgcaacctgccctctctgtgggttatttagtgactcaccgaaggagggtagatcgggaggaggaggtggcagcgaaggccagaggacagattcacgtctccaagtagacggcggcatagcatcgtcataaaagcatgatgcccatcctatcaacttaacaatgaaatctttttgctctgttcaccttcaccacacacaaaaaatggttgtagacctggaagcccaaaattgatttaattaactggtttaccatcagacccagaagaacaatctccatcctatccagattaaacggctgcccgcaaaaaccagaaattttattggcattcctgcacggctggctgcgccactagcaccagtcactcggcaccaccaaccgaagattccactgcccgcggttgcgctcccttgtaaaacacatcatattcaacttgcttcggatcatcccaccttcccgaggccttgaggcaccaagtcgcgttcggtacagaccctacgaatccccgtccgattcctgttatcctgtacgtttcttgcagctgccaaccacctcgatcgtcgactccccggggaagagaagcctctgcgttcgggcgagcgatggagcaggggagcgagacgctggacgagcggctgccgctcccgtgcgcgaacggctgtggcttctccggctctgccaacacccgcggcctctgctccaagtgctaccgcgacagcctccgccagaccgtgatgtcccaggcgccgtcgtcatcgtcgtccacggagcttcacggcgcggtaccgtgccggagggcattcccgtggacgagggggcgatgcctccgccgccgccgccgcgggcgaagacgaagagcaggtgcgctgcgtgcgggaggagagtggggctgatggggttcgagtgccgctgcggcgccgtgttctgcggcgcgcacccgctactcggacaggcacgactgtggctacgattacaggggcgcgccgggcgcgatgccatcgcccgcgccaatcccgtcgtcagtgccgacaaggtcgacaagctctgaaaatgctactactgctggaaactattataatccctcgaggggatgtttcctcgtttgctcaaaaactatctaagtggttatgaaaaattctgaaaaaatttgacaacattcatacaacacatatatataacttcacaaaatcttaagtccaaactcaactcacacgtcgagatataaaaaagacaaattcagcgtatgaatagtagcatactgtttatttttgtttctcgatgtgtagatcgaatttgaacataaattttggtggactagtaggtatcattatactctacattgtcaatttttttcagattttttcacaactatttgcatcgaatttagaagaaaaagatgtacgcggagatatcccctcgagggattagaatccactcccactactgctcagtcttaccaacattgtcatggccgaaccaaatggttgcttctcgtgcatgatagaatcgctactaatcggagtatgcaatatcatatgatatctgtaatctgtagggattgaaaattgattattagagtttacctattgtgctgtttacatctgatagaagtatcattatcatagtactagctcgtagctctgctctagtgcttgacttgtgtggaacataaatcactttcatctcctcacattttcagagcacgacaatgtcgtaggagatgattttattttctggaaattggctgccaattcgccaaatctgaatatattagctcaacaatttgctcgctttaccgtgcaatattatacgagttattactttatactaacatcaagaacatgtttggtaaatttaaatgtaagcgcatctggtgtagtggtatcatagtaccctcccacggtactgaccggggttcgattccccggatgcgcagtttttaaaattattttagcagttctaagtgcctctatctgctttcattttccctttttcccttttgattccaagaatgacgagtgctgaatcagtaacatgtatgatcttcatttatttacatactcaattattagtcactgcaaacataatcacatagtgtccacctaattgattgtgtagatccacataattacacctgtccgtcgaaaggtcgacagcgaacgaatgaacgattaacgcgtagctgatcattccagtcttgattttccacgttgccttgtatttattgcctacaatcagctagcagctgatcgttccggcacagtggccatcgaagccagctagacgaaagcttttgtcccggtcccaattcacgattttcacatggagctggaggcagcgggagctctgccgtgcttctcggcatcgacaaattcggtgatcctctccaggagcatgtcgaagtcgtcctgcgtcttgatgaggctcagccgcgtgtaccgagtgccggcctcgttaacagtgccggtaagcgagttgatccccgccgccagcagcgtctcgtagcagtcgtcgtcttccacccactcgcatttcacccaagcgtaggctgcagatcagggtagaccaaacacgccatcgcatcaccttaaagaattcgattgagaggtagcgagagaaattgaaatgccatgatctgcagagataatgtgccgttttaacctggcgatggttctttgatccggttgaagtaagtgcagtactgcggtggcatcttctgcagcgagatccgggtggaccgcgacacgacggcgttgagccttcgccatcggctgctcatcacgtcgtagccgaaggcgaagatgtcctccttgccgtgcaggttggccagtatcaccttgaggatcttcagcacccggagctgggtctcccgggacgtgcccacggtgctctcctcgatgtaggatatcgccctgctcgcgaccttctcgtcccttaccagcgcccacctgcgtaatgcacggcacggcgtatatcgatcagctttggtgtcgttgtgtacgtgtcttgcttgcaaatggcatgcagctgggaactctgtggcccgtgtgtacccgaatctgctgccggcgtggccggagagcttggacgtggtgaagagcatgacgtcctcgtcggcgggcgccgggatgtgcgtcaggtgaggccagtagtacgcgtggtcgacgatcgccgacgagccggcgaggatgggctcgtgcaacgtgctgtcggggttgttcggcgaggtgacgaactcaatgaaacccctggtggggttccgtgagctgttgttgtttgcccacgcagcggttgtcccgtcccatctgtactcccggccgtcgaacatgacggtctgtgacttgtacatctacatacatatcatcgatcaacacaactagttagtgaagtcgcgtatagatgctcgtaggatgtgtcatcgtgaagtggtgttgggatcacggaccgcgaaatacggcacggtggcgacgacgctggccggcggcgaggcggcgttgccttccggggagagcgcgtacaccagcgcgttgatcaggtgggtggagccggtcccgaagaccaagtacttgtcgtcgacgaccgcgttgccgacggccctgtggagccgccggatctggcgatcgagctcaacggactttaagtggccatcggtggtgatgtagctcaagcgatgccacccggagaacaccacggcgctggccgcggcgtggcgcttccaatacggctccaggaacaacgggtccccgctgcacagagccattgcaacaacaacacaccatcaggacaggacactaatggttgtgaaaaaaaaacggaattgctataaagatggcgacagtttttttcactaatctcagtcggttttcaagtctgttagattcgttcgcatgcaaacgctgcggcaaccgtatccacccgatcttccggttggttttatatacggaattgctatatcttaaccgacagttttcttgcaacgaatatgtcacttttcatattttatacaaatttacacggtagttacacaccacttagatatgtaattagtatgtaattttagaacttacatatgtaattttgagacttacattgtaaatacactaaaattatatatgtaatttaatgacttacaatgtaaaaatataccgactattttttggtgaaaaatatggcgccataaatatagctactcccaaaaaaatctatttttttataacataggacagacaaatagtaacatctatcacttcagcaaaaatcaatttcaagtttaacttgtagttttttttaaaaaagacaaatttagagattaatagtactatattgtttgtacgttgaaatttctctcttttttttatgtgtgagttgagtttatgtttaaattttgtgatgaagcgttatatgtatattgtaccagtgttagatatttttatgatttttttataactatttgagtgatgtaagtgcaaactgtcctcgataccctcgagagttcaaaagtatttcacaccaaagacaaagaggaggaaagctgcgtgcatgcaaggcgttgtgagcagcgcgcaagagcacgagcaagcgaggagaggccagtcattacccttgaccgtcgacggcgcagttggggattcggacggagcagtccggaccggagaagcagctgttgcactcgcacccgggccgcccgtcctcgccggtgacgccatccaggaacacgctcccgtggccggagcagtcgacggcggccacgtcctcggcctccttggccgcctgcagtgcccagctcagcccgtcgccgagccgctccggcgttgccggcggtgaggccccgaggaattggtgcgcgatgaagacggcgttgagcagcaacgacgagcagaggaggacgtgcagcccgagccctgcagacgccaggctctgtgacctatgccatcctatcgccattttttctttctgccttcctgtctccggtggccctctccgtccaaagagatgggccactgcactgtgagcctgtgaatttatcgtcattttctacaagcagtgttcgtgtggagcagcttttgttagatttcgcgtcgtgctcaaacaataaaacctgtccaaatcggtgttgtgatcgccggcaggtagtagtaattcttttccagagatattttgacaaatcaataacgatttataggaggcctgattagagtccctatcaatacttcattacaatgagagtcccttatagaacatactagtatgcaagacacgtttttcaaatcttagtattcgcattttaaaaaaccacctcgttcacttctgtttttattaaaataatagtaaagaaatagaacacatttttttatttccattttacaacataaacataaaatcttttgatcaacagatttcttcaatattcactacaaactcaacaatgaacacgcaaatccaatcaatacattcaccgatttgaatgtaaactggaacatggttttgttagtgttacaaaagcaaaaacttgataatgtcacatgctcttacatgcatgagcatcagagtaagagacaattgctacgataaaagagcctaaaggtctgttatacgtggattctaactttataaaataaaagaactgaaaaccacagatattccattatcggatttgaaatttgtgagtatgcttctgccctttagattgctcacttattaaaattttgaattgaaaaaaaatcatatcaaatgatggcttaatcaattcttttaactgctaacannnnnnnnnnnnnnnnnnnnnnnnnnnnnnnaatgggaagtctaan

SEQ ID NO: 29636 - DNA, 2075 bp, Oryza sativa
  unsure (1)..(2075): unsure at all n locations
gcgcgattganattcgattgcnnnnnnnnnnnnnnnnnnnnnnnctgtagtgttgaggcgccctgctttcacaagctgccaatttgctatccgagaaccatgcgcgtgcggttaatggcaggaccgtttaagggtttagggaacccatcactaaccaaccaagccaggaggatgtcattgtccgtcctcacaatcgactcccacccgaccacactatttatcatggcaaaggtttaaagtgaggtcttctattttttttttcatcttctcatttacatctatttagtttgaaaattaggataggattttgttttgttcttgttgtttaatttacatcgtaattttaggtgttaatcatgttagtaatgattatttgtatcgccttagatcatatatattttataaaaaaatatgtattataagtaaaaatatatttactcttaagagtatatgttacgaaattcgccaatcactctctgaaacatagccggtctggttgatggccccctcgaccactcatttgcccaactgttgtggtcagttggtatcgttgattgtgtgtgtgtttacttcaaaggcccactacggacgcagacacacggatagttttctccaggtgagaccatgacaagaggaaattgcatgacaaaccgacgggttgatgatttccaatctgaacggcccgaacaacgtaaaggccttgagcagcgcacttagctcgaccagcctcctcgacttctctctcctgagcagcgccggtaatggtggcggccgtcggtgtgcaccaacgacccaatccatggccggacattgtagcgcatggggttacacgtagagaggaggcgcttggctaccttgacgaacgaggagcgtcaaggttggcagcaggcacgatagggagcgtcagcacgaaccgcatgatgaagatgaggatttgcgatagtggccatggtgggtggatctggtaggagatcctgcacatgggcgccaccaggtgtcgggccactccttcgggggtatgcggaggtgattaaggaggcatatggccctgcacatggacttctcgaataggaagcacgggaacctattgtgctcctccagccgcctaacggaacggaagaaggcgagccggtcaaggatgggggaatcgagttgggggacaaacacggaggtcatgggagccttgaagaagatgggggtgaatgggttgtcttgttagccaccgcccttctccttgccgcccaccacacgcggtccttatcctttattggttgtcccctgggaaaagatgggtaagaaaggtacaaagggcgggaagaaagacttggctactgacatgtagggcccgtctgtaggatcgaatcacaagaactaagccaaccagaggggggtgaatggttggtatacccaaaaaccgaaaacttttagcggaaataaaagttactctcgaaatcgatggaaatcggtctgaccgaagttgccttgccggtctgaccgctcagatgccgccggtctgaccggtatggtatagatcaaccggtctgaccgccgaagtcgttcgtcgtgcctgtcgcggccgccggtcggaccgcccaaatgctgccggtctgactgccgcttgccgccggtctgaccgccggtagatcactgggtagactaccgaaacccgataaacacaaatcgaagaactcttaaagtagatgacgactttattgattctctctgtgtttacaaagtgcaccaacagcactccttacaaaaatttcgactaaactcgaaaccctaactcaaaactcaactcaattgctgtctaaagcgataccgggaagcctcacgctccccctctatttatacatgaggtaggcagcataaagccacaaaccaaactcatattaagagtcctaaacaccttaggaaaccttttagtacaagaaagaaactttacataaccaatcgaaaaaaatttgacctccttccaaattcgactccgcatcccatacgcacacaatacctccatcgtatgccatatgtgatgaggtnctgtcccatcggatgcgcaattcaatnnngcccaa

SEQ ID NO: 29637 - DNA, 2778 bp, Oryza sativa
  unsure (1)..(2778): unsure at all n locations
tggtgnnnnattgattgcgantcgttctgnagcncatcagccttagtatgccgcatgatctttgaccaccacgaacgttgtcttatccccaagctgactcccggtccatcaccgcaaatactctcccaagacatcgagtcacctacacatgaaataaacaaaaaaccatattccgagaccaagttatctccaacttgactcattaatagcaaacaacagtattacatacatatagtatccatctagaagccataatcataaaataatcacggatatctaaacaaacaacccgaaacagaaaccgacacagcgtcggccggtcagaccgcgggctagccggtctgaccgctcgatcaccgccggtctgaccggcaacacctgcccggtctgaccagtcacatgaaataacaacaatatcctatagattcacctgtgaaatccaatcatctccaaaaccacttcgtgaataaatttcaaataacaaaactaattatctccaatgccaattgttcatcacagaataataatcaaaaacacctttgattttacaatctcccccttgatgaacacattggcaaactcataaaaaatgttttggtgtttggaaaaataaaaacgaaagtggtaaaaagcacaattcgtacaaatgtacacatcgtgctcaaaaatcgtgctcaaaaatccaaaagaaaacttctcaccctttttaaaagaaagaaattccctattgaaccaaaaacatgctcttctcaacaactctccaaaaattcaccttgcttctccaaaaatccaaaaatttcacattacttctcccccttttgacaatgatgtcatcaagcataggaattatgttcattaatggtcaagagcttagcatatatatagcatatcaagtcatgtgttgcaataaaaagaagataaacccatctagtataaccatgaaccaaagattttacaattaagcttgaatcaacaatcgaaattcatgatttcatacgatttataatgcaacatcttaacaagcatataggttgaagaataaacactaaacatatatacctattgcatttatcactctttctcaaataacctttagcacaaaataaccaagagaattttttaactttttcttttctagagcccttttgctcatattttttttcttttattccgggtacgtccctgtcgtcaagactgtttccagggattcggcacccattattttgctcacatcgaatacgtccttgtcgtcaagactgtttccagggattcgggattcattttttttcatattttttattctctttttcacaatgagcaattaaagctatttgaggaataacaagtcaataaaggcatatatatatatagagcatttataaatcaaaccatatgctagcatcaacattgcatattttcttaattcaagtagaatttaagtgtcatgcatcatctcccttaaaagcaaaatctaaatcttatgaaaagactagaatacatacaagctatgctagagacaaataaaccttcaaagtattgctagcatgcacaagaaaataccatatgtataaccaaagctctcttttatcaattttttcattgtcatattattgcttgataaaaccatgaggtacaaactccccctcaaaccatgccaaaaggatgaattattcccaattcaccatgaagaaaagcaaaacgattagaatccaaagatttagtgaaaatatcagcaatttgcaactttgtgtccaaaaactacaattcaacatctcccttctcaacatgatccctcaaaaagtgaaaacgaatatcaatgtgctttgtgcgtgagtgttgaacaggattcttagcaatattgatagcactagtattatcacaaaatagaggtactttctcaaaagtaagaccataatcttttaaaatagataaaagccaaagaatctgtgaacaacaactagcagcagcaacatattcagattcagcagttgattgagcaacactaaattgtttcctagaagaccttgcaatcaacgatgtaccaagaaaatgacatgttccactagtactttttctatcaattctacaaccaccgaaatcagcatcggaatatccacttaagcatatagaagatgaagtagaataccaaattccaaactcaagtgtatgattcaaatacctcattattcgcttgaccgcttgacgatgtgaagcacgaggagaagcttgaaagcgtgcacacaaatacacagcaaattgtatgtctggtctagaagcagttagatacaacaaagatccaatcattcttctatattccttttgatcaacagcttcaccatcttcatcaggatccaacacagctgtagaaccaattggtgttgaaattggcttgcaattctccatcttaaaccgtctcaaaagatccttcgtatacttcgtttgatgcacaaaagtaccttgaggtgtttgcttaatttgcaatcccaaaaagtacgataactcacccatcatgctcatctcaaattccctgcacatagtctcagcaaaatctacaaccaaagcgtgagtcgaacaaccaaagatgatatcatccacataaatctgaacaaaaagttgattatcaccatgcttaagaacaaaaagtgtgttgtcaacctttcccattgtaaaaccttttgcaagcaaaaagttcttaagcctatcataccataccctaggagtttgtttcaaactgatgagctnctgcagtaagggggcgacatgtcttgagagttcaan

SEQ ID NO: 29638 - DNA, 3224 bp, Oryza sativa
  unsure (1)..(3224): unsure at all n locations
tgatttgttccggtggatgtcgtcgttgaatgtgcaaagagcagcgacttctgaagttgatccatgttctgtattagtactggtccaagttgtaatctctggaggtccatctcgatcagcatcacaagtaccggaacccgacgaacctggccagtttgaccgctcctcatgggccggtctgtccgaaggtgtgccggcggtcggaccggcctggcgcccggtctgaccagctgagccgacctcgtcgtcgtcgttgtcatcgctctcgtcttaaaaaatacgaccatcctccccctgaacctgtgacagtgtacctgcaatgtcgggtctagtacctagactagcctcatcaaaaaaaacgtcgcaagtttcaacaattttgttagtctccaaaataagtacacgatagccacgagtatgtgtgaggtaaccaagaaacaatccatcggtagaacgtgctttaaacttatccaaattttcagatttcaagacaaagcacttgcaaccaaaaacacgcaaatgtgaaactttgggttgatgtccaaatcgaagttcataagaagtttttccaagtttacatctcaagaaaacccgatttgaaatataacaagcagtgttaattgcctcagcccaaaattttctaggagttttatattcatccaacatcgatctagccatctcaaccaaaacacgatttttcctttcaacaacaccgttttgttgaggaacattaggagaagaaaattcatgttcaagacctctttcattgcaaaattgttcaaatgaagcatttttaaatcaccaacaatgatcctttngaattattgttcaaataaccagaaaattcaagctcaaatcgaagaatcgaaccacgaaagggttgaaaagcttcgtcttaggttgccataaagaaaaccgaagaatatcgagaataatcgtcagcaataaccaacacataccactttcctccaacagattgcactccagctggccaagcagtgtccatatgtaatagctgtcacggtgcatctgtcatcacagaagcgataggagcatgtgaaaaagcaatcatcttagcatgacgacacggtgtacaaaccaaatcaagatctttcttaagtttaggcaaaccacgaacaagatccaaaccacttaacctagtgagatgatcaaaaccaacatgtccaagtctacgatgccaaaacatcacatctttatcaaacttagcaaccaaacatgttatcacaggtgaaacaggattttcaaaatcggctttaaacactcttccatagcgagaaatattcaacacagaatcaccacaagaatcaaaaactttacttccagttttcttaaagtggacctcaaaattttcatcaacaatttgtgaaaccgaaagcaaattgtactttaagttctcaaccaaagctacattcttcaattcaaatttttcctttaccttaaccaaacctatagcgagaacgacacttgtagaagcatcaccaaagataatagattcagtcttggatgccttcttgagtgaggagaaccaatttttatcaccggtcatgtgccgcgaacaaccggaatccatgatccacacattctccttccttgccacaaaagcctacacacaagtagaagtcgaagcctcagtactggggttagatgataataaaaatttaggaatccagtactgagacacatgaccagaagatccaataggcatatatccacgtgtaaaatcaattttagaattttcagaaaaattcctccgagaccggtctgaccgaggtatagtggccggtctgaccgggggccggtctgactacctctgtaccaccggtctgaccggtgcccggtctaaccgacgctcagtaaccggtctgaccggtcgccggtctgaccacgggacccactgcggtctgaccggtttcctcgagggaaaaccagatttttgccactttgattttgcaaaagcaatctctctctctctcctttttctgtttatgagctaatctgaaacaaaaaccaacaatatgtccatcttttccacagaaagagtaagtatatttttcacgatgattagacacattggtaaaattagaagacttagcaacacaagcaacaacaggaggttttgcattcacaacattggattttgaagaagatgcactcaaagtagacatgataccagcagatttaaacacagttttcttagtatcaggtttaaccaaaatctcaccacttctagcaccagcacctaacacaataggaggatgtctagaattatgaccataaggattaaaacctaaaccatgattatgtgtgctaacctttgattgatccaaaatcatgttgaggttctttttaccatcataaaatcttagcaaagaacttttcaaataagaaatctctttttccaaattagcacaattttcactatctaccatgacacctttgcttttacgacatttagggcaagaaagcacttcattgtttttcacaacatcttccatgtactcaacacgacctaaagcatccctcaatttcaacttattcaaattacatgttgagcaatccaaaacatcatgaggttgttttaactttttagcagaaatcatgttaaacatcaaactagcatgaaaagcaatttgatatttttgcaacaactttttagttaaaaacaactcatccaaagtgcgtgtgtgcaaagcaaaactaaaagcaagagaagatctatttttcaaatcatgtgcagcattaacatctctaatttttgaaatctcattcattaaaaccccacagtttgagcaatcatcatcattaggaataagagattttaatctagtaatttcatatttaagagattcaatgataaattcctgttttctatacatcttctcacacttcctttttttcactcaaaatattaatagcttcctcaaaagcacttacctcattatcttcatactctgtgtcagattcaccacgcgccatgaagcaaacatcggagatgttctttcccttatcatcatctccactttcaccatctctatcacttagtggctcgaaggcggcgcaaacttgttgaaaagcctttctgagattcttcagcttcctcccttgggatgaacccttcggcttgttggtgttggtcttctcaccatctttggcttctcttttggctcctccaagcttaggacaatacgaacgaagatgatcaa

SEQ ID NO: 29639 - DNA, 6646 bp, Oryza sativa
  unsure (1)..(6646): unsure at all n locations
ngttcgagttgatcatcgnatgtggcattaaaacaagcaagaaaagaagncttagatgagaaggcatcagcatccaaagaggaagaagaagaaaccaaagcactcgacttagaatcaacttttcgagaaagaacattcatctcatgtgttgtcaattgtatataaagtgaatccaaagtcaaagtagacatgtcaacagactcctgaatagatataactttcatatcccaaatagacatatcaagaccatttaaaaagtgacgagaaatctcagattgtggataattagcatcataagaagaattaacagatctaagattactcaaaattttattaaacctaaaagatagtcatccaacgcttctccaggtttcatctcaaatttaatatactcctttttgaaaatatcacgacgaagttctttaatgttatttgttccttgataaaagttactcaaagcattccaaatttcatgagcagttcgaaagtgcgcaacacgatcataatccgaacgagaaataccactcaaaagaatgttgcgagctttgcaattttgctcaaaagcagttttttcagcggcagtattaatagcttcaggaatcacataaggataagaaacttttctccaaatatcataatcttcagtcataatataagattgcatcctactacaccaatgagaaaaatccgttccgtcgaaaacatgaggcttagttgaaaacctagcaggagtagccatggcaaaaactttagatcgataaaaatccaaagaagaaaacaagtctctgataccacttgtaggatcgaatcaccagaactaagccaaccagagggggtgaatggttggtatacccaaaaaccgaaaacttttagcggaaataaaagttaccctctaaatcgacggagatcggtctgaccgcagttgccttgccggtctgaccgctcagatgccgccggtctgaccggtatagatcaaccggtctgaccgccaaagtcgttcgccgtgcctatcgccgccgtcggtcggaccgcccgaatgccgccggtctgaccgccggtagatcgccggttagaccgccgaaacccggtaaacacaaatcgaagaactcttaaagtagatgacgactttattgattctctctgtgtttacaaagtgcaccaacagcactccttacaaaaatttcgactaaacttgaaaccctaactcaaaactcaactcaattgctctctaaagcgataccgggaagcctcacgctccccctctatttatacatgaggtaggcagcctaaagccacgaaccaaactcatattaggagtcctaaacaccttaggaaaccctctagtacaagaaagaaactttacataaccaatcataccaaatttggactctttccaaattcgactccgcatcccacacgcacacaatacttccattgtatgccatatggaatctccatcaaccaagtacatcaactctagaattagtatcccgcatgatctctgaccaccacggacatcgtcttatccccaagccgactcccggtccatcaccgcaaatactgtcccaagacatcgagtcacctacacatgaaataaacaaagaaaccatattgtgagaccaagctatctccaacttgattcattagtagcaaacaacagtattacatacgtatagtattcatttagaagccataatcatgaaataatcacggatatccaaacaaacaacctgaaattgaaactgacacagcgtcggccggtcaaaccgtgtcacagcctgattttcgttttaggatttataaattatttaataaattattaatagaatttatattaaatgttctttaatttacaagtgaagttaaatgtgggaaataaaatttcctaaatttaaagcatggcaggatttaatttttattaaattctccatgattaattatactctctgaaattttctcggttttttcagagctcaattcctaaatgatacaaagaacagttcaataattagttaatcaataatcattaatgatctagttataattatgttaagtgcttttctcatttaaaaatccttaaattataaattgttgtttaaaaggaattattagaaataatcttaaaagcctaaaagagaagatctaattttaatttgttaaatctcaatataaaagtgggctagataaaattttgttaaatacttctcttgtttctatagttcctagatttttctgggatttatttgagccaaggaagtatttttaataaatggaattgcatttcatgaataatttaaattgaaaaatgttttaaaattctccttttagctttgggccaaaagtcagcccaagtctctctctctccctctcctcggcctgcttgcgccggcccgttcggcccagtctgccacgccctccctcctctctctctctcggtgccgctgacaggtgggacccacatgtcagtcgtcttcttcctccagccgctcctagccgcgcaagccgccgccgatctccttccaaattcgcccgcccctttcctcctccggctgaattgtttgaggggaaatgatcctcgagatctcctcttccttttctcttttggaaacatcggctaatttcgtttggaaatcatcggattcgatctcgaatcggattcgtctctctcccccgaaccctaaactttccatcccgtcgccagcctccgtgggcctccgtcgccgcctcctagcccctataaaaggatccccgggacctcctctctccgtcgccaccctcgccttagctcgtcgccgctcgtagcgccctagccgcgagagctcttgtgccgccgtcgccgccgcttgtccagccgtgcgccaccgccgctccggtcgtcgtcgtcgctcgggaaggtcaccgccgggttcgcgaagtcgtcgccgtcctcgtcccgtcctccgttgctgccgaggatcgccggagcaccgccgtcgtcgtcgacccgatcgtcaccgccgcttcaacctcgtcgccgtcgccgtccggttgccgtccgccgccgtctaagccctcggtgagttcgcgcgtcgcccgctacgcgttggttccctccgtttgcgccaccgcgccgtcgttcgccggcgagcatgcgaggccgagtcatcgccggtgatgacgtcatcgccgacgtcatcgtcgatgtccccgtagacccgcgatagatcaagatgatctcggccgttcgttttgaatcgattagatcccggtcgttcgtttccgtaaaccgccgccatgcacccggtccaccatgagccgagcccgctgatgcaataattcccttttccttttcaaaaataattctttattgtgtcataattcaattaaaatctatataaatgttttaatccggtttaatctttaaaaattcataactaattcatcttagctcggatttagttggttcaagtttctaaagttgtataaaataaagatctacatattaaaattatccataaattgaattaaatttatttagttctttttaaatgggctttaattagattaaatcttgtaaaattcataattaattcatatgaagtcagaatggggccgttcaagtctcataattcatctaaaattatgatttacgtgtttgtttactttttatgtattgtttgtttggagtttcttagtctttttccttgttttgcgttttagcttgtcgtttccgtcgtttcgaaggttcgcgagtgcgccggaagtattcaagaagattaattgaagacccgttattgcaaggcaagtcacacagatcgcaaacacaattcctttgagcatgttgatcctacatttaaattctctatttatttcaattgtgcatttattttcgaatgtcactaggtggtgtgaacttattcctttgttatggcctgtttgcattgattactctattccttgataccttgggttattataatttgactagttgagctttatatattggttcagctagatgttagacataattgcttagccatgcttagaaacattagcacacaattaggataactaatgtttccctgttacttaatgatggacatgataatggtagctcacgatggctaatcgtgattggttaattaattaatgtgccaactaaaacttgataatggtgggttgtgagcacatggttttgatggtcgtgctcatgacaattaaggaccggttcacgagtttcggttgtgaaacattaaccgtgccaaccacaagccagaatgggcaacagctggacactttgtataacaaggctcattgcggagcaccagactgagaagtggcggagataagcccacgggggtagctggggagtccatgcctctggttttttagggggtgactacgatccaggaacggtgcactgctttgggttgagttatgcgaagggtcttgtcacaatcattcgtcatggtgacatgtctgcgcagacacggtgacatgacggtgggttgtgtcttgtgagtacagtggtacacctctggccagagtaaaactattcgaatagccgtgcccgcggttatgggcgggtcgaacaatgtctttcgtgattagtcacacgctactcattaataataatgtggtaattgatggtaattaatttagctcctggtttggaatggtatattcctggtttggagatagatctgtgcagccgggtatggttgttcagaatggttgggcctgtgcagcatgggtgtgctgttcagtgttgattaatattgatgattaattactctactgtttaccaattctcaattatttgctaaatgctgcttttgcaaatgagccctatattatgccattctttggtatccttgtgcacttgcatatttgctgtgcagcttgctgagtatgtcatatgctcaccttgcaataatcaatcaaacctcagttgaagacaagttgcgaaggagaagacgtttggtttataccccagttgagctgcttgtgggagtggagccggagcttcgctagattttattttccgctgcagttttcttcatggtaaggactaagtgcctcttaagtaagtatttatcgttttagttaatttgatgaatctgtatattaaattatcagtttgtgtatctcggctgattcctggacgatgatttaatgcacaaataagttctgtaattactagtgaatttctgggcgtgacaaaccgcgggctagccggtctgaccgacaatacctgcccggtctgaccggtcgcatgaaataacagcagtatctgcagattcacctgtgaaatccaatcatctccaaaaccacttcgtgaataaattccaaataacaaaactaataatctccaatgacaaatgttcatcacagaataataatcaaaaacacctttgattttgcaccatctaggtctcatgctaactcaaccgactctattaccgtcaactcgcaatatcagtcaaaaccaggcataatattgttaaggtctcaagtaatccggtttcgtaaattaagaaatctgatattacggttcaaatgacgtgatctaaactcgatattactgtgaggacctgaagtgaacatttctatgtttaatgtagccttagatttcaggatatagacgcaactacaacggtggcgttgcgctcgggccagcccatgcgaatcgcatccaacacggcgagaacgggctgtttgaatccaatagcgccaaatcgcatccaaagttaggagtaaagcgtgtgcattccttactgccggtcaccctgttttctcttactctgtttgtagttcgctgtaaagaacacttcaaatcaagctcacacccgaagccttccactcgtgcaacaacttcaggagttccatggtgtgattggtgtcatgtcgttcatcttttttccttgtgatgttcgtacagatttggtcttggtagctcaccttctttacccttaacgcaggctcctaccatttgtttctcgttttcttttatgaaaaatcctcggaatattttggcgtggtacgtgatatttttggccgtctgtgcttttgcttcttccagaaagcgagcaaccgttcgttggctgatgatggtccatttttcagtgttattcggccccagctctggttcttgttctatgtttgtgattatgttctctggtcctgtttctgaatttgttcctttttctctctaagaacatctttgtgaaagttttcgatgtagtagatgttacaaggcgatgtcactgtgcatgtccaagtttatgtcgctttcgtgacattagagcacgtacaatgcctagccctaggtcattcccctggctcacgccatcggcctccattgcctttcgtgcgtttgctcgcgggggacgcgcccttcgcccacttttggctaagccacggagccgagctctgtgttgggcgcacagtggctaccaatgtagcttatggtcactgctcccaccccaaaatttcccaaacgacttctagggactcttccactctcgcccctcgttctcatcgacctcctgggcgggcgccttgtcttgttacttgaccggacgcaatcgtcgtcgtccccgtgagagcaagcttcggggagggcagatccaccgtccaagcgtacaaaaagggagggggagaaaga

SEQ ID NO: 29640 - DNA, 2484 bp, Oryza sativa
  unsure (1)..(2484): unsure at all n locations
ggcggcaatggtcaactgcttgtacagnagctcatcagcgcgaggcgggaggttggcgaggacacggagccacgcctcgtgcgccccatccatcggccaccagcgacccggggatggagcgggcccaccaaatccggggacggcgacgatctgcgtctcgcccacgctgctcgccatcggtcaccagcggagggagggcggtggcagtgcgctgggacagagacgacgggcggagggagagagatgtgggcggaggaagagagaggcgaggcagcgacacaagggtaggataggaaaatattacaaacggctttgtgggttgggacacacattgtgggctgtagcatcttcatataccctcagttttttaagggtccaactgagagtattctttattgaaaggtgagtgtagtcatatgtagtggcttcagtcaacgaggacactactagtgtggcttggattgtagatgtccctatgacgtttaggcttcgtgttccgatggatgtgcagcgattacgcgtcctgtgatccccaaatgatcgcgcatctcgctgtcactaccggtctaccactccaagtgaaataataatggtcacttggctgtaaattggagtgcgaatgttgttggcttgttgcagggaaagccgtcaacataggccgggaatgcctcttccctttgctgctgcttcacaccttttgcaaaggtgagtgtttaacagaaaaggaaaagaaaagattaagaaatacataaattaacataagtcattagcttatgattaattatatattaattactttaaatttaaaaacatattaatatgatttttcaaaattattttttcatagtaattttttaagaaaaatatattgtttaatagcttggaaaacatatacgtaaataacgaatactcgaggtgccatggtggatgtatgtcgaagatgtgcagccatgaccacgacgccatgaggcccatgatgcatcgagccatcgacgcatcaacaaatatgaaacatcaatcaactggcaaaaaaaaaaaagtgctcagcaactagtgctaatgctatacagactacattagacccgttcactttgatgccattttcaacaatactattgtttaagttaccaaaaaaaaatatctacgtttagtttgtcgtcaaatttaggtcaatacataagaaatcctgctaaaaatttttagcaatatcgctattttaccaaaactttgacattaacaaaatttgataagatttattttggctacaatctaaacaggcctagtatgtttccttcagcaattcaatctgctcatcattccgcgaggcgcgaccgcgcgagcccatatattccgaacgctcagcgaatcagaatactactgtttgccgctgatcgcgtgctgctccgtttctgttttctttttgccgcgaaatgggaccgaccgaaaggtgttcttctagggagggcatagtttcgggaccaaccaattaccaaccgtctcagattctcgctagtcgctcggacaaaaaaaaatatcatatcagctcgaaccgctaaaaagcagaggtccgagacgacggaattcggtgtgggggagggacggcgacatggttggcacagagacagtcaaccgatcgcctatgcagctacgctatatagtacagatcgctagtactacagcattccatggtgaccgatcgaggaattggatctcttctctctcttttttatttccagcggatggtgcaggacatttcgccaaaaaagggctcgcgtttttcagagaccggtagaggccaagttgagcccaagaagaaggcgaggagcacaattcgtaggcattagtacttctatgtcaaaagaaaaaaaaaactaaacatgagaatgtttttggataacatacatatatacagatactccctccgttccaaaatataataacttttagcactaatgaattgtcctaaagtataacaacttcttcaccaaccaatcacaaccctccaccattcactttttttatctacttacacttctcaaccaattacatatttaattctatcacttttcttaataaccatgtccaactctaaaactctcactgctggagaatgcaactacactcccggtttgtaatccccttcaatcacgggtatacaaccgggatctcgaatccggaactaaagatggtaacgccacgtggccggtgctaccatctttagtcccagttggtgttaccaccgagactaaagttattttttcttttttttcattgttttttgctatttgcatattgatttctaacaaaactcaacaataaaatcatccacattcatagaaacatcacaaaattatccacaaattcaccgatcaaactgacatcacaaattcacaattcacgtcgcagatttacagatccaaaaacatcacaaattacanatttacttgttgatgaactactgaaccagatggtcaaacaaactcg

SEQ ID NO: 29641 - DNA, 3379 bp, Oryza sativa
tgaagtggcgtgattcgcctctagtgcaagtacctcatcagctactgcttctgcaagtccagaggagaggataagagcaagaaaagaggagaggataagagagaggaggaagttaaaagatgaggataaagactttgcgatagaagatttgaggataagtgcgagggattatatacgacgggttgaattttagtctcggttattaataccaaccgagactaaaaatagtaaggggtcgcacgctttttgacccgggacaaagtggcgttgggtttttcaaccgagaaaaaaaagatttttggtcaacccaataaagatgtttctctagtagtatctctatattctaggacggaggaagtacatcttttcaattaaacttattttggaatggaagaaatacttcattatattctatactactccaggaaatacttcattatggagtacatttcacttgaaaaaatatatacctgttcatggaacaccaggttgtgtacagagaaggctatttatcgaggggaagattcggtgcgttgcactcgatcgaggacggtgcctgcttggaatcgtagtacaactctagtagtagtactagtaagctgcaccggtcacactcacacctagtacaccgctacattacgtgcgtatgggagtgtggccacccacatccacctgtcatctgcatcgccccttggaattgttgataccaatccatccaccgctcgcctcacctgttcgtcacgacctcacgcctgactctttaacctggaaccgcccgtctgacgagctcaccgtctttgtagttgcagacaaaagtctacgtgacgcacacccttatacggtcatacagtgatacgtactgtacgcattggtgcaacgcaaacagggtggttcagacttcggagcatgatgggtcactcggcccttgtttttatttcccaactttttttttcaaacttctaactttttttatcacatcaaaatttttcaacacatatactttcaacctttttaaatagactttcaattttaatcaaacttttaattttagcataaaactaaacacaccctctgacttttaacttgagattttgagaactcgaacgcattagcaggtactgtacttgatatagcaatgtactactccagcatgctgactcggcgccgacaccggcgacgtgtgacacgtcttgatggacagtatagcgaccgggagtcttgatctttttctggaacaagtggctctcagcatgtaggctctactgcggccgtgtttacttccatggatataaatttttaaagtatacggacacaaatttaaagtattaaacacagactaataacaaaacaaatttcaggttatgtctgtaaactgcgagacaaatttattaagcctaattaatctgttattaacaaatgtttactgtagcacaacattgttaaattatggtgcaattagactcaagagattcatctcgcaatttacacacgagctctatgtatatgtctaaatatttgatgtgatgtttttgttaaaattttttaattaaacaaggcctacttctaaaatagttactgttgaaaggaccttgcttctgtgctgtgcagtgtgcagtttctggggaacttttcaggaaagcgatggcgtatgtagctgttgccttccctaaaaaaacgaagattcctacatcgtttataagggcaataacaatatatataataaaagtagtatataaaacccacttatatgaactttaactattaaaacattcataatatatatggatagcaaatagtattggaaagagagaaaagatagagacaaataatatattttattctctatgggcaacccatatgcttatgggtagcttttgctatggactagttccacaatgttgttaggtggctgaaacaaatattttattacttatggaccacttttagactacatcgtggatgccctaattaagtaaaattagcaggtacctcgtaaattaacttctaggttacctattgatttatatataaatcggttaatgggtcgacccacctacatctctaaatacatgggttatctttatttaatctataagcgggctcgtgggttgacccgctagcatccctagttccagataaattaatcgttcatctcgctggttgtctcaatgtctttgggcccgactatgtgagtggcccttgtacgggtagctgtcttttccctagctattgtcactagcaagtgggctcgtagctttacccattctaccataggtgtacatgcccttactcaaatccatgggcttgtttggatttatgctaatttttgttcttctaaattgttggtaactttaatactagtattataaggatgtttgtttgatgctaaattttatccacactagtacaaatgatactataacaaattttataacaaatttggtagtttcaaaacttatcaggattttggtactaccaatatgttggtagggtgaaaattgtcatcaaaataaattagccccaaatttctctatctccatggatcacatgggaggaagatggtagtgtgaatcaagagcaaacaaaaaggatcatgctctataggttctttattaatctatcgtatgtactgccggtgaccccatgacctatcccaaaacatataaatatattctcgtccccacgtaaaagaacatttgcatatccagcgttacggtgtaaggtcatattgctcttttttgagaggaaaatagctttccattaacttaaggactcagcataatcgttggccaccaaattctccatgcccgaagacgtaccatcccattgcaattgcatgacgttattatgaggacactcacaagttacaacctaaaatttctaaagcgtgagctactttattccattctcggggagctaaaggtcatattgtttggtgcgtaacatcccctcgcatagacaatgggagatgatttgcttctggaattaactaatcacagcttcacaagaaccaaacaagcaacactgtcaaacctagggagggacttatgtttttaagagagaggctaaagtttagcccctctctcccaaacacccccttagcagcaacaccgtatcatgccatcagcaagcggtcgcaaaagtcagagcacgtgtgccgtgtgctaaaaatggaaccgtgacttcgccgcgggaccgtgggtccaaatgttgctaacaaagaggcaagtgttagaggtcaatatcgatcggccatccccttatttgtttcgatatacacatattcatactacaggatagggctcgcaagtcgcaacgaatttgtgacgtggatttgacaaaaacgcctttgctagcttctctataaaatcgattatat

SEQ ID NO: 29642 - DNA, 10951 bp, Oryza sativa
  unsure (1)..(10951): unsure at all n locations
cgcgcaatgagacgctatgcagtcctnatcattgttgccttttcatggaatagaccctggcttctgaaagaatggagcgtgtgccccttggctcggccagcctggaatatatggattttttttcattagctggtttattattttgtaacgtggggtactcgactctgctatatggatcgatattatggtttttgtccaaaaatgttatgggtaaggacaactagtttggtttctaattttgatccctggtcactttagtccttattgctcactttaaattgataatatttatcgttttgtataaggatatagtctgaaaaaaattaaaacgacttataatatgaaatagagagaataagtgcaatagctagcctggttgtagggacgggagggcagatgaggagcctggttgtagtactaattgtgaggagttgacaatagacatgtggtttggtttgtgagtgacttaaactcgtgaaggtaacaattccatccaatgttattccggtcaccttacttgtttgaaatgataagtcggtggaaaataaagggaagatgaaattgtatagcaaagatgctatatgtcaaaatggagtaaactttgtgaaaaataaggacaaccaaggagaagcttggttatcaaatataattataagaaattgtgagcgcattaaaaaattaaacacaagatcttaagattaaagtcacacacctcttgcaactatactatggatgtgttcgctagttccggttaggaacccatgtcccacacacagaaaacggagcggcccattagagcgtgattaattaagtattagcaaaaaatattcaaaaatagattaatttgattttttaaaacaactttcatatagaatttttttggaaaaaaacaagagaggggagttggaaacctggggaaagaacacaacctatatagtgcatctctttagactctattaaggtaaatcaacaacttccgtcaaaaattaactagttactttgtttaattgatataattctatttacagctatatattaagagtactcggcagttgaaatttaatgaagtttagtcttatattttaaaatgtatttgtataccgtatagtcagaaatatttttaaccgatcaatagtagaaatttagtcttggaaaccttatgaaatagggtgaaaacggtctgattcggtagcactttttcggaaacgatgctcgatcggctggtaattgaccatatttatcatttaaactactcaatatcgacattaatacgatgtataaagaaattagaaaaaacaaaatataaaaatagacaaaaaggtaccccttaaacggaacggcgtccggtcgatcgggaatttctgtgacagttttcaccccttgaaatatgtataccgtatatcgtaaaccgtacaagaaaaaaagaagttgctgacgacccagtgactttgtaacctgtgagacttccaagctaagcaacaaaaatacgctaggtcaacagttgtttgacaagggaggccctggtatagaacgtagataaaacttggagggggcatctacaaaatcccggcgcagcggactctatttatacgcggccccgctccttgatccccgagggtgaatcgtagcgatagcggatcagattggaggaaaactcgctagtacgcttgttacttgcaactctttctctaatcttgcttcggaaagatatccaaatcgaagaaaaagaaaaaaaaattagaaagcgtgattagccattcctcttctcatctctagccacttcgcttcagcttttcttctttcttgatcgcgagcaaaaagggagagagaaaaaaaaacggtaaaaggacgtgattagcaaggatggtggcgatcgagaaccagagccagggccagcgggcggcggaggcggcggcgcagccacggatccccagggaggcgcggcggctactgcacgagatggcggcgtcgtgggcggacgttgccgactgccgggcgctgcaggtgattccgctcaagggcgccatgaccaacgaggtgtaccaggtgcgctggctcaacggcgccccggccaccgccgacggcggcgaggtggaggcggaggcggccgcaagggagagggaggtgaggaaggtcctcgtgcggatatacggcgacggcgtggagctcttcttcgaccgcgaggacgaggtgcgcaccttcgagtgcatgtctcgccatggccaaggcccccgcctcctcggccggttcaccaacggccgcgtcgaggagttcatccacgcaagggtaggtgcacatgaatatgatatgattccgcgctgctgtagccaaactgtctagccttcctcgcgccacggattgtgttttctcctcccgttttttccctttagttttcctctgtttatcttcgactctcttgaactattaaattgggtagggatttttaggggattttggtggtaccttttgtgctttggacgaataaatctttgttgattttaccgcgttagtgaaaagttattttcctaagtttattagcaccaaaattaggcagattttggagtttgttcttgcatactgataatttttttagctgaactcgtagcaatttgggctttaacgttcttcttgatactttaaagattctacaggcactattccgacttatttattgcagtctggttatcgttttctaaaaggttctgccgtgggaatctgcaattccttagacctttcttatctatcagttcataaaatctctcttcatgccctagtcaaatatctctcctacttaacaggaattgtttatgcccacaccaattatctcccaaaattatttgcctctgtggcatgaggcgtacaatcttatttttaagggtattgtcaacagctggaatttagttttctttgcactctttcctgtattgtcagtaaaattgtgatacaaagtcaatagtcggtgaagctattaataactcgtttgaaagatttttttttctttcgtttgaattagtcagctagaattgataattgtccattcgacaacaggagatgtctctttcagagaagctgttgattgaaaacaatttattggacttgagaaaagcaagatagctgactaaactggtgtaaaagtaaggactgaatggagtaaatctagaccatacatggtctatttctcttgcggaatctcttttagaaagtgaattaggctatagctgttaaattgcgagtcgaagcactttctggattcttcattttgctttaatacatgtgtcactctcataaaagggatatcttgtgttgttttcttggacgaacaaaaggaaaaaaagaacgaaatttcgtgcaatactcctactatcagatttttctcctcaagttttctggtgataatgaaatgttatcacgatggaataactgtccaacctgttacgtcagcaactcaagcatatacaaaaattaatgcaattactttctttcagacactatctgcagcagaccttcgtgatcctgaaatttcagctctggtggcgtcaaaactgagggaattccacaaccttgacatgcctggcccgaaatctgtactcatttgggaccgactgaagtaagagcattttctcagataaatatacacttggcacttttaataagtatataaaactaaacctggccgtgctttttctagaaactggctcaaaactgcaaggaacctgtgctcatctgatgaatccaagaaatttcggctgggtagcctggagaacgagattgctgcattggagaaagaattttcaggggattaccacgggattggtttttgccacaacgatcttcagtatggcaacatcatgattgatgaagacaccaacatgttgactatcatcgtgagtaatattcattcacaataatgtccctgtgatcatatttgttttttgctgcattttttttgcgtgtatctattatgtgcaaatgtgaaatgtagaagaggctattgaacgtaggttgtagaacttttaagtttcttctctcatgtgatcatctgttgaacaacaagcgatatgggatagttggaactgccgtatcattttcactagttggaatagcgccagcccttttccctttcatacaacttgttttttgtttgttgcgttcccttccccctcgacattttaaattgtcacggctctgctaaaaaacaacatagttttggttttggacactacctaccttatggaggactgatgctttgctcctttttttttcccttctgtataccaatttgtcacgactgtttcttaaagaaatctgattcctttttctttacatatatgacaagccccaattaattgttggcaatttgatcctttctgttcttctcatatatatacaggattatgaatatgccagcttcaatccagttgcgtatgacatcgctaatcatttctgcgagatggcagcagactatcattcagagaagccacatagactggactacagtaaatatccaggtacccaaaaatactaccaatgcgctgttttgcttatgttttggtacttaaatcagtttacacaatcttggtccaccttgcttatttgctattctacatgtggcagacactgatgagcagaagcgttttgtgaagacgtacctaagcaattctggtaagtgcaaattcatttctcgtttcattatctgaagatttctttggcactaccatgattatttgactgcaaccattctttttggaggaatatttctgttacaaattcgaattcagcttccattgaatactacttttttcacaataactagctaagatatgctcctaattttgtttagtaagtgaagaacctgatgcggaagaggtggagaaccttctccaaagcattgagaaatacacgctcgccagtcatctagtttggggcctctggggaataatatcggtatgttcatatttctggatgtccattgcctgtttcttttttcaaaagaactatatgaatccattctgtcactgtaaacctgtgctattatctgacctctatcttctgcaggatcatgtcaatgatattgacttcgactacaaggagtatgcaaggcagagattcgagcagtattggcagaagaagcaagcacttttaacttcatgaattgcctgaaggcgtcaggtcgtacctgaaggcctgtgctgcacataacttgtgcgatgttactgacacataactccctgtgaaaagaagaaagatgaagatgataatgaagaagaaaccctttcgggatcaggagttctcatcccgaaatttccgtaaggttcagcttcaggaggaagctgtgggctttggttgctttgtttatagtctgaaaggcagcgaagaaaaagcccctggttgcgtgtttgtttgctcgacaaactagaggccgcttgtggggctagtagtgccgtcgtgtttcatgtgtatgtatacctaaatatatgttacataatggatcttgctttcgtcgactcgagagtcgagacagtgcctccatttagtccatattgtactatgcttacatgactgccctgttgaagaaatagcctatacagctgcactgttattttggttgttgatactacctgataataatatggcgtgtaccaaagctttaacgtggccatgttcagcagttcaggtcatcttcgttgctctctggtgcagacgagctacgaggtatgagctgcctgatgttggtgatacctgacgaaaaatccgtccgaacggctgtgatggatatcagctttcgctgcctcttcctcctgactttgtttcatcggctcatcgccatttcgcctttcgtcaatctctaaccctctcttctttctccttccccacgctgggctgcgaagaggaagatcgatgacgcgtggaattccatgacgcgtcgcttgtgagcccggaacgagatctcaatacccgtttatgacggcccatataagtggaacgggattgccgctaacaagcggcccatatgtgttggctggaacacgacgtgcggcccaagtcccgaggtggaatcagatggacgtggtccatgtggagaagggcaaaagttgcccagtccagttttcgctgcccgcaaggctcctggcgaggaataattctagggtgaaaagttttggtatatattatcggataggaaaaagtacgaattaccctcctgaactatcgtggtcgtccgaattaccccctgaaccataaaaccggacatttttcatccctaactatgcaaaccggacgaattaccccctcgacccaatctgcggtggttttagtttacatggcgtacgcgtggcagtacagtcagcattctatttattaaaaaaatgtgggacccatgtgtcatcctcttccactcttcctctctctctcactcttctctctctcactcgctgctcactcttcctctctatctctctctcactggtcgtcagcggccttcctgtccacctgctgctgcgcgccaccgccggccgacgccgccgagtagttgtcgtcgccgttgttcgcggcgaacgacgagtcggtgatgcgaccgcgatgccggctcggcgccgcggggccagggctgtgggagtgggagcgggctggcgtccacagcggcgtcatctcggcggtggccagcgccacggcggcggcgtcgtcgtcgttgaagaggtgccccgtgtaagtaagacgcgacacggtgacagtgcagatgaccgaatctctcagagcagcagagcagagctgcactgtgctgctagctgcttggtgcgtcgagacataggattcctttaggcattgatgatggacggcaggttggcccctgcacggtgcgacgccggcggttttcccggccacaagttcgtacgcctgcctagctttgccagccgcctcgttgggccgtggcggaggaagaagacgtgctagctcgcctacacacgccgtcgtcgtcttctttcctgacaatgggtaggagtagtatgtgcactgctgctctgctagcacgaattcttccaccgccgccgccgccgcccgcctccatccgtccccacgccgaggggcggccgttcgtcgtggccacggccgccgccgccgccgctccgcgtcccccgcctgccgctgaccggcgagaaagagagaggaagagtgtgagaaagagagtgagagagagaggagagagaggggaaaagtgagagaggagtatcacatatgggtctcatattttttttataaataaaatgctgactggactgccacgcgcaaaaccgcttggaattgaattgaggggggtaatttgtccggtattgaaagtttagagtgaacggtgtctggtttttgggtttaggggggaattcagtcgatcgcaatagttcagggggtaatttgtactttttcctatcggatataccgacacatatttaaagtattaagaccctgtttgattcagtttaagattattataatctgaattattaggaataagctgaaacaaacaagtagattgttatgatagattattataatctaataatctcctgtgaaggagcttttctcagattattgggtggctaaaaacccactaccttagatgcctccaataatccagagaaacaaacaactcgcagcttattctatgccagcttattataatccagtttagagtaatctgatttaataatctagattacaataatcttaagctgaaacaaacatggcctaaatatagactaataacaaaacaaattacagattatgcctgtaaactgtgagacgaatttattaagcccaattaatttgtcatcagcaaatgtgtactatagcactatattgtcaaataatagagcaattaggcttaaaagatttgtctcgtaatttacacttaatctgtgtaattagtttttgagtaaatttcacaaaactacaggtgttttgcacaatttatcacaaaactacatatttaagagcttgtttcacaaaactacatatttagtgtctttgtttatcacaaaactacaggtattttctacaatctatcataaaactacatatttaagaatttgtttcacaaaaatatagatttagtgtattcatttatcacagtactacacatttagtgtctttatttatcacaaaactacagatttagtgtctccattctcacaaaactacatgttttagcattgttaaaacgtgtagttttgtgagaatggagacattaaatctgtagttttgtgataaacaaagatattaaacctgtagttttgtgaaactagttcttaaatctatagttttgtgatagattatgcaaagtatctgtagttttatgaaatttactctagtttttttatctatatttaatactctatgcatgtgtccaaacattcgatgtgacagggtgaaaaagttttgcgtggaaactaaacagggccttagaacatcccctaatatggcttcttaaaatttagaaaaactctccaaatttctatttgaccggtttgctaaaactaaagaaagtaaagagtcaaatttatcgtttattccaacaacctctctttttttatataatggaatgaaacattctggcatttgctcaagagatacagccaattattacaaggttcacacaaaagtaaactcatacagtgagtatgtagccaaagtaacaaaaccaaaagtaaaagcaaactaatcaaaaaccaagcaaggtaaagaccccacaactactaaattctattggtgaatctccacccgaagttggcaaagagctacatgatgagtgggttccacgtgtcattctctttttacttctttctccctccctcatcttccttctccccacccgacccatccttcccctctgatgcctattctcaggtgctccaatgttggagagtggagatggtggcagacatggaggtgactagaaggcgaggagtcgacaacgatgatggtgatgacggagaggttgaaggggaagataaggcatgggttccaacgatgccgtcgtgacgaccactggagcttggtggactgatctagaacctcgacacagagggttaggactcggtctcaagagggcagcttgggtcaccacgacccgccctcggatccacccctggcctatcctcacgcgccgcttgctccatccttgccttcacctcatcgtcaccgccgtcgctcatagggaggagaatagacacgtagagctcacgcttagcaagccagttatgccaggccaaaacttggctagttggcaaggttatgggagagcatttttttttcagcaagctggttaaattttgggttatagagtcatttgacaactctgttagggcctcttcggattgagggatttttagaggatttccagaggaatactgtatataggaaatatttcttcacatgaatcaacccaaaggaaaatcagaggaaacattcctttcctgtggaatcaatagagaaacaaaggaaaatttacatctagtcctaccttattttttccatttcctacgtttttcctctgtctatccaaacacatgtttatctacagaattcttgtgtttttcaatcctctgttttacccatgtattcctatcatattcctatgatttttctattcctacgtttttataatcccatggttcgaataagcccttagagttgcttcataggatttggtcgcaatatttgtcatgtgccatgtgtgccgtgctgtcacgcaaggatacgtgatagcaggcgcgtgacctacgacgggccagaccaatcaatcaatcaattggagcgggccgcaggctgggacaggatgccaagtgccaacctagccacgtactccgtacgcctgatcccaccggaaggcccgcgttgtgcgttgtgcgttgtgcgttgtgcctccctttctcgtgcgccgccgggctccgttccatcacccgcggtgccaactgccaactgccgattgcggaagtggaacctggcatcggcggcaacggcacgagcgcacgaggcagccagccgcgcattcaccgatccacgggccgggggaccccgagcgtccgcccacccagcagggcaccgcaggcagccgcgaccgcgagcctcgtgtaatcgtgctggatttttcacattttggtccttttgaaaaacttatttcgcaagtagatccctagaaaaacttatcccaaaaatggtccttttttggggcgccagagtggctggcgccgtcgttcaacaggacggcgccagcctctttggcgccgtcccaccgccgacgtggcggggcgatgctgaggtggctagggggagtcccacaccacctgtttgacgctgtgccgcgcccgacccccgccctttggggtacgctcatcttcgctctctcaaggctctgctcgcaccaggagcttctcgacgccttttcatctcttcaccgcaggggcttctacgttccgccccgctgtgtgcccctcgttgttaagtccttccccatcttggacccattacctcaaggaaagcaggtgcactgtcaccccattgttcgtggtctccttggggatatcttttgtcatactgctctggtggatttctattcaaagaacggcgacatggattgtgctgtgaaggtgtttgaccagatgccggtgaaggaccccatacccatgaactgcttgatcactgggtattccaagaccggtgatgtggtgaaagccaagaagctattttatggcatggtaagaaagacatttgcattctggaattaaatgatccgctgttatgcgcattggggggaataccaggaagcttttaggctttttcctaagatgtttattaaggtgcaaggtccaatgccatcactattgcgacgaggtttttcatttgtgcgcaagacttggtgatcttcaacaagaaaattggctatgttctttataccact

SEQ ID NO: 29643 - DNA, 19282 bp, Oryza sativa
  unsure (1)..(19282): unsure at all n locations
agcacgatgaatagtaatacaacgattcccgacccctcatagaaaagaataaatgtagaaaaaggtagaacagagggtgaaaatgagagaatgaggtacggaagaagtaaatgtccgtaagggagaagctcataaaatgaggaaaaatagaacgtggatcccgacattatagaagaagagttatgaaccgatacgggtggaagtatttgcacaataaagtatagtggtttgtgggatgcttaacctcactgggtaatagatagaatagggtataaatttggggtatgtagaatggaataaataaacaaaggagaggtgaagtttccttgtagcattggcgaaaatcgactctagctccccaaaaaggaccatttctgggataagttttttaaggagtatatttgccaaataagtttttcaaaaggatcaaaatgtgaaaaatccagtgtaatcgtgttgcctacttgccagcccccacgagaaaacgtcgtcttgccctatttctgggcgcagaatcgcagatagcgtggtgccgtggtggcacagggcaggcacatcaagtcatcgaggaggtcaagtcatcaaagacagagtccagctcgctctcctccatccaacgggggaggttgactgatcgcccttgtccaggtccaggctgcagtgtgccatcggagctactacgcagcttcacactcagcagtcagcacatgtaagttcacaaaacttgcagccttctgaagcaaaaactacaccgtactccctccgtcccataaaaaattaacctaatgctaaatgtagcacatcctagtactacgaatctggacatacctctgtccagatttattgtactagaatatgtgttcagttttagttttagattcgtttttctctggacgaagggagtatgtccatatatcagggtcaagcaatcctaataactgaactaaactgcacatagattttaatattttacttgcactgtttgatcacttaaaaaattgtgcaaatataaaaatgaaaagttgtgcttaaggtattttggataataaagtaagtcaaaaaaaataaataataattctaatattttttaaataagacgaatggtcaaacagtacaagcaaaatatcaaagatcccttatattaggagacggagagagtactaattaatgtacactggtttgcttccttactggtagcaatagattcaaaactgcacataggagtataggtcaaaccccaactgaactgcacaatcggtctgcctaggaatctacagtattcaaatgtttaattacaaaatcagatcgtcacggaggccattattgcgtacaaactcctcatagtcagaagaggcacacaagagtaaagctaaaaaaaaaaaaacatgccacgccctggtctccaaatacagagtgtggaaggaatgtacatgatggccgatgctaattgcgagtaggatggatactggaaatagcggatgaaatgtgagaacaataattcctcggagacttcagaaaagcatcgcaattcattacataaattccccgatgtacttggtgctcatctagtcaaaagctaaagattccagaagtgctctcttcctcaaatgagaattggtcctcaacctctgcatcggtgaaggtaagagctctctgcaactttttgggacagaaaacctcaacatcggaagtgtacacagctgtcacagggcggtgatcggatagcctgatatcaactgtcctgtaggcctgcagcctcattcccttgccaaaggaaagaattcggtcacacctacaaagttaaacaatatttttttttgttagcacgcatcgctcatcgcaacttagagatttcctcatacacaacctcaattcttacaatacctcttattaaatagtagtaatgaggtgattaatcgtgagttatgaggaccaattctttcctcttacacaatacctcttacaatacctcttacaccttcatgagttatgaggtgattaatcgtgtaaacaacgaggaaaaatgttactacctccgtcccattctaggttgtttagcatgtattagggttagaaaaaaaatactacaatacctcttattaaatagtagtaatgtataggtggatctgagattatagttgaggggtagaatggtgagaaatttgaattgtaagtggttgatgtcacaagtaatacttcaaagtgataactattttaggacaacttttgaatgctagaaagacaagtattttatgacggagggagtattaagaaaggacaggataaaaaaaaatgaagagcgtatgcagatcaagttacgaatgatcagattagcataccaggcaggtgttctccttccagattttggctcatcactcgtgtatttctctgagttaaccttgtacttgtatgtcgggggaaagctgataactccttcagtccacccatcaaataaatgccctttcttaaattctcgttttagctatcatagagtagaaaacagtgaggtactatgtatttataaagtagtaggagtatgtcacaagatgctgcactgctgccaaaactttacctggtcattctggaacaaaccattccagtccttcatggatatgaattcatgtgttttttcatatgataagttgatcctataattgagatctcctaaccatattatccttctgaaatattcaagaaaataaaaatattagacaaactgataagatttatataaactaataagcaatggttcctgcaattcttgatcaaataaaactaaaatgaacaaaagaagtttagaaaaatttcaatgtgtgcaaccctcgaacacatgcttcattatgtgatttttgccactaatatgcacagattcacttcaaccatttatcccttgttataccatcatatttaaacaagtaaacagtgacgccaaacacaatctaaactgaaattgagccatcatctgcttcattatgtgatttttgccactaatatgcacagattcactttaatcatttatcccttgttatcccatcatatttaaccaagtaaacagtgacgccaaacacaatctaaactgaaattgagccatcatctccaaaagagtatcaaatggcatggataaaaaacatgcttagtttagctagagctttaggaattgcgtactgagcttctagtgttttagagttgcaagtttacgtacttactcatggtcatatatagtcttaggcatgctaactctggaaaccggattaaatattgtccttcgatggatttcttgcacatcagcattccttttcagttcatctccatccttttctccagaggtcaggtggcaacatataaagcaaaagagtgtttgataaatggacatgcttactgctattgatccctggagcatgtcaagtaagaaaaattagcccattgttttctaaatagcacattgacttaccagcgcatagtaaatgtacatgagatggtacgaccaaagtgcacaaaactaggtgctaaaacgaaagtgtaatatgatcattaagaaaacaaatatagtataaaagaatgctaattttggctgtgcctaacagtagaggccggagatgtaaaccatttctattatccaaaaaaaggaatgctaattgttttctacatatttggaattgctaaaggaattgagaatgatgtgcttcacgggaacttgccttattaccaatataacccatagcaccgacacctacggttgatactttcaaattttgaatatgcttccgcaggcttcttcgtacccatattgaaataaaaactccaaccatctgcttgcttattatccttacgaagtatggtcttttcgttttgactagtgcacttttgatgttaaaatcatgaactaaacaatcatctggaaaagcattggaatctccatgtgctgatttgaaagacaaacatgacctcagtgccttctctgaaataaatggtttcgtgctgtctggaagacgctgggccaatatatccaacggttgttcaggccaaatcattccaagcctctctgagtagctgagtgttttagttaacattttttgatggattggctcttccaaactagatacatagtctttaaaacttaagttgtgtgatctatcgaaaatcttcattgaaggcaccctgctgaagttgtttccatttacggtagtttcagtaggaccagaagtagagtgctcatatttattactatgaacactgtcatcatcaacggtaaaatcttgttcattccatgggtgcacttccccgccactttcgctgtcagattcactaacaagttcatcttccacatcgtcagaaggcttgaaccttgatggagaaggaggatcactgtgacatttatattttggtttatcaggactaatcttattcaatgtttcacgaatgatatgttcccacattgcgacaggacggttgtcttcagcaccaaatatattcccagcatttaatggaacaatttcttgaaatctaaaagataataagttcaatttgtttaataggtgaaaaaaataaaaaggagaaatatcagtcatagtgtaatatgaataagtaacaagatgggatgcaacaatttacccaagaacataaatatcagctggctcctccatatccaaccaatcttgaatatccaagtcatcaggtggaagtcttcctgcaacattccatgttcctacgcagaccctgcatatcaaaccaacattttaaggaatagtgacagaacggcagtagattttataggtttcagctgcaattaggcttgatcttaaggggttattcttgtgctaggaaagataaatatattgaggaacaaaccaagtcatttagcttatctgaagcaaattcttacggaaaatactgtgaacaaacaactaggcaagtccagataatctgaagggagaacaaatgcatgcctgagttccttaatgtcgatatattgggcacgaagggtctctgacttgcgccttctattaagcttgtagggagcaccctccatttggctatctgaagatttgatagtcttcgtcagtgcacaaggaagctacctgggttttctctgataggatgtgtatgccagaggtgcttaagaggtagtactagttcccatcgaaaattggtgaaagggtggactagtatgtaccatgtagtatctcttagtttggcagaatcaacaccgtatttcacaattttcagtgtgtggcaaaacaaagaagaaaacatactattaaacaaaacctggaaataagcatccagaaaaaaagaagtttgctactgtgattaatatagtaacttatttcgttggtgatatgtagttcaaatttttcatgtgatgctttgtcaataacccttttgccgatgaatgtgttgaacacaataattatgcgaatcaaataaataccaattgtctcagcgcccaaaccacgcagtctcctctcctcatcatatagttggcgctcccaatggcacatttctgcacaaatcccattataagttcaactattattagaaccaatttttgaaaaagaactgaacatacatatgccgtagccaacaaatttaagtgcaaaatttacacttgttttcccttttttaaagctgcctcctttttgtcagcatacatgtgcggcaaatgtatttatggccgtcagattcagatgtcctttcattttttttccttatttcctttagaaagattgtactagtatactatcttaggaataggatgggagagcttgtcgttttgaaattcactaaacaaaagaaacattggttttaacattctttgaattcaacgtctaattttgtttttttgttctaggtaaacggaggaataaacaaaccaaaggaatagcctaggagttgggaatacaccaccacaagaaaccaaaagaacaatacagtccacctctactttttttaagagcgaggatagtagtgagttataaaaaagctatatgcttaagtggaagagagagaaaaaattgagtgactctcatagaaaagctagctctaaacatgctccaaaaatatgcattaacttcgtggtgagggaaagaaagaggaggaaaacaaatagagctaacctcgtagctaatatattatacatgttagttctacaatgaatttagtaaggagtaagctctactattaaacttgctctaatgagcaaggttagaaaggcatctccaaatttcgttaactccccttccacttcctatcctttttcccccctgaaataccagaatcttacggttgtgctaagtgctaactggaccagctcaagttgaaagaagcaaccgtcaaagctctcatctttattggttgtaagcaaaaacatccacctaccaaaccaatcgatgcattcttctggtccacaacttttcttttccaaagaattatgatggacaaaaagatcaattctggagacgagggaccagtggttgaaccaaaacccgaatgcatttcccgatccattgagcttcacagcgaattttggtttcgatttttttttatttttattttgcaataatgaagcccatgtggtagagagagggagagggtctagatcaccttcgtactcgaactcgctatcggtgtcgtcgtcgccggtggcttcgccctcgtcggcgctgaagtcggattccggcgacctgatgttgagccatttccgaagcaccgtcttcggccacagctgtgtgcatgccccgcgtcgcgtccgaccaaacgtatcagttagcccccgagcaacgaaactccgatccgagagagagagagagagagagagagagcgagcgagctttagctagcgcggcgctcacctgcttctgcttccttcccttgcgccgcatcggcctggacgaggcgccggcgccggcggcgtggtggctcgcagtggcagccggctcctgctggctccccgacgcgccgagcggaggcaatgagcgagccggtggcgtggcccgcgccgacgcggaggtggaggaggcgccggccattcgcgccctcgtcacagcccaccaacacagcgcacacagcaaaaggcaacttctccgtccgccttccctttccggttcccttttttatcgagtccggtgcgaagctataaaacggcaaatttattagcgcttggacttggacttggacttggactgcacggcagctggcctagagggaccctagagtagagccgcagcccgcagcaagcaaagcacccccccctacttgtaccagcgccgctggtggcggtggaatggtggatggatcacggccgcgacgtgcaggctcacgatgtggcgccacgcggcgcgtgggttggctgtgtcgtggtctctccccaagttgcacgtacgcgcgcgaccaatcgcccgcggcgcccgcccgtgccttgaccaccccggcttgggccaccgtcgtcccggctggctctcggtgactggaagaacagctatcgcggtgaccaaaccaagctccgcgttctcctcgtgccgacctgtgctggtgctgtgccccgctgcgcaccgtacgtccattgctatacttgaactggacggagacccggtttatcctcctatcacggtcacggggattccctactcctgtactacagctaccgctgccgctaccacttgctcttcttcctcgcagcgaacgaagcttctttcgacgcgaaaaaacctgtagctatctttcttcgctcgtctcgtcgccgttgtacgtgacctgtatcgcggaccagggttaattagttcgatgtgactgaaatcttgacatgggcttggtttagttctcaactttttctttaagcttataacttttttatcatatcaaaactttcaattttagtcaaactttcaactttttttttaacttttaattttagtcaaactttcaattttaacatggaactaaacacacccatgtttgtgcagtttgccgaccaccgcgcgtgtcaaagttacattcttcgtgtaccacactacctcggtacctatccgaatactacggatttgtcgctagagtcttaacggttgttgcatcgtcatttcatccggtgggagtttcacacttcttcaggttccaacttggagcgtatggccgagtgaaaaaaatggacggtgcgtatgcacggcggtgggccggtggctgccatggcatgggcacagcgtatgcgcggagagatttccaagcaaatccgcatgcacgtgttttccacgcaaagcagcttggtttggaggctgtttcaccagtagcttgacagcgatcagccggattagctagggcaattgatgttgcttgcctggctgccgcctgcagatctcccttcctacttcgctttatctcaccttttgggtgcactcctcatctgggccagcataaccattgcactagtttttgtttcgttataaaagtttctcctcttcttcttttttttttctttcttacacaggaaaaacaactgccatgttcacacaaatttgtttgggcattcctgcatctcttcatttttctctagtgttttacgtgtgacttcagctagtctacagttatgctgttatatggggcactctcaaatattaatactgatcacgcagaacttgtggttggtagcatattgttactttacacaaatgatgtaaaagaaggcgtgttgtctggcccagagcacaacaggtcgaagaagaatcctcttgaagatcgtaaacaacaggcatgctagccaaccaagaaagatcgaatggggcaatgctcaaccatgattgacttgtaaaaagatcaggagctcatctttcctcgtctgagattattcagctgtatcaatactaggattgacatttggtacaagcatagctggttcgtattgcttctggattccgtgggcaatgatttttcttaagcaaaactgttctctatgttggtattaggtgtgtgctttgactagattacgttctgaaacaaaatacctactatacatgattcaggggaaggaaacgctatgccacgatggatcacgtacagagaaatgtttccaacttctttaacattttattatctaagtcggtgtcactgtcttccatcaaacaaggagtataatacattaaattgtactggaatatatttgtttaccaattcatggcatgacaggtcgaagcactgtaccagacagtggtcatatgttttcctcaatacaaaggacggtggtcatcatgcccactgctcctattatcatcactgcaattttgttgttctctatatttttcgaaccatattgaaagtttgcatatttttctagtgaggcatcacctggtcagtttgagacaatagaatccaatcaagtctgctgataggggaataaaccatcatggcacctctttctccctcttttctgaagggagacaaaccatgttctctagtaccgggcgtctgattaaaattctttagtgcaatttatgcaactaaatctgccccatttgcagtacacgcaccactcatcttctctagagagagctagtgcttgcacatgaaagcagagcatgaacagatcaggccatggatgttggtcgtttggagatgccccattcgtccaacagctgcattattggcaacctgacataaccgcactacaaatcaatccaatgcatccgaattttagaggctgtttatttcgtgaaaagaaaatttttggttgtcacatcagatgtttgaccggatgtcggaaaaggtttttggacacgaataaaaaaaactaatttcaaaactcgtctggaaaccgcgagacgaatcttttgagcctaattaaactgtcattagcacatgcgagttactgtagcacttttatggctaatcatggactaactaggcttaaaatatccgtctcgcgatttccatgcaaactgtgcaattagttttagtttttatctatatttaatgctctatgcatgtatcaaagattcgacgtgatgtttttaggggaaaaattggaactaaaccaagccagttcacgttttataacctcattggcattgttctatcgatcggcgatgggctgatggcgacggagagctagtacttaagggataagcaaaaacagggccttgtgcagctttcacagtttgcgtctagcatgacgccatatgcaccactatactcccattcgcagatgatgcgaaacaaaagcaccaaaatccgtcatcccactggcaattcagcatctgtgcaaagcatataatgtgcggataattgagcggtcgtcatgtcagccgaaatggatggtgagatcaacaacaccggttctccgtggtaaatggtgatacgtgcccatacatgcgtgctgtcttttcacctcgcggcctcttgcggaatactcctgctgcaccgctaacttcaccttcgtcttatccccccccccccccccccctgaagcgctcaccacttcactgcgtggaccgcgacgcgcgacgcagcgagtggccacggcgcgttcggccgcatcggttccacgcgcggaaccgtacaagtctcaacgtgacaaacgccggggttgtagagcagccgggtgatatctggggtcgcattccctgttcgctttttacctttcgattcggttggaaaccgtagcgcgcgcgcgcaggggcggagtcgcggttgacgcctgtacgtacgcgtcgctgtcgcgtaccacctgctcggagtacatgactacattacgcacgggccggccggtataccgaaagctagtacgggggcagtagatttttgatgccgcagaagagacggagcgagcgggggtgtggtggagacgtcgacacgcggccgcgagtggtgcgcgcggtgtggttttgactcccgggtgacatatgtacacggattagattatgttatcttcagatgggcgcgcgtacgttgcagaaagcgtgaggtaccgagatggcatgaatgggatgggagccagtcagtttttttatatcagaaagatcataggtaaaggtgcaagcagaccgatccacgaacctatgtatgatacaaataataaacagacaaccttttgggttatctattaatttgaattataaatgggtttgcgaatctttccacttgcacctttaatcatgggagtgcacatactacttgtgcttgacacataatttcctttttatctcatatctgaaagagattaagggtgtgttcgaagagaaggggattgaggagattgagaagatacgtaaaacgaggtgagccattagctcatgattaattaaatattaactattttaaatttcaaaaatagattaatatgattttttaaagcaacattcctatagaacttttttacaaaaaacgcatcgtttagtagtttaaaaagtgtgcgcgcggaaaacgagacttaatctcccctatcaccctggaatgaacagagcctaagggtctctctgaatcgcaggaatggaaaaacgagggaataagaaaaacatagaattttgataggaatataagtacaaaacaaaaaaaaagaagaattagactgcagaaaaatcacaggaattagataaaagagattttcagttgaagctctagctaaaattcctttaaaatctctatagaattgtctattccatatgaattttaaaagatcaacatatgatccaatcatttgtttaaaaacattcacaggaattttttcctataatattgaaatctttcaaatttttttatgttttttcttcgaattaaagatgccctaactttttttttaagatgaaatgaaagagaactaatcactcggcaggaagagccgcacagggcagggatagcctcgtgagagcgactcatccgagacgtgacagagaacccggttccaatagggctatatgccgcgaagtgggagcataaacagaagcaaccaaacgctcgcattctcgcactacagctctgcagcctttcctccccttcccaatgcattactgctagaacaggagacggacggacagcgaaactttggttacaatagcaggctataagccagctgcaaacatattttaaagagataaataaggagaaaaaggagcagcgggctacagatttatagctagctgtagcacggactccaagacgcggtatgtgtatgataggtaggaccagatatttatagtatagtatgtaactattgtatgaatgagctattagattggctatagatgaattggaggctagtagttgactatactattaaacttgctctaagaaaaagtatcatatacggcgaaaacgagactccagtagcagccacaaaaggagctatctccattctgtatcacttgactttcgaatgttgaagaagatgtgttacatttacagagagattgcacgcaagcatggccttgaacccatcttcgtgcactcgtgtgctgtgtattccacggtgctcctgcgtgtgactcaagcactgggatcattttgtatgtgcgttcgccgatcgatgtgttcttcgatcgaaccataccgatcacggggaaaaggagtaatcgaggcgcaccgggggcaccgagcccgtaatctttcaatcctgctttttgtgaaagtagcacgtacggatcgagcggctccgacgttgcctcggctgccaggaacggaacgtgattcctcgagtatagatactctttttttttaagtagctatacaactgttgacagtttttgggatgaaaaacttttaaatataactactatgtaattacattgtaactactatgtaactactatataactaatatataactcgagtgtaactaaaaaaacccgatgggagaattggttaggtgaacaatccctactgcacgcgtctgaattttttaaaccgttttccctcactagcacaaatctcaaagcatattagacggcttaaaatttaaaagtttttaccccctattaactgtcgccagttgtatagcaaatccatttttttttaaacctccaaggtagatactcgacggacgtcataagatttgctttcgtttgtttactcactgtttacatggtgcagcatcgtgcttgtcgatactagtagatatttgggcgtacaacacgacaaagaaggttccgaggcttgggaggctggcccccggcgtccgaggccttgagggtagtagggtggctccggcggtctgcttcgctgttccatggttctgaattaaacgggcctctgatgggcgatgtcgcatattttttgggccagaatcctaaggcctactgttgaagtggacgtgcgggtttgtttaggtgggctcgttatccacatacatgggttggaccgtccaagtaaatcgattcttttaggaaaaagtacaccggaggtccctcaacttgtcatcgagttacaaaatcgtgctccacccacaaaagcagatatagcacatcaatcattttacaaaaatcaatcattttacaaaaaaacattcactttatgtcattcgggggttttgaccaaagttttattctacgtggcagttaggtcagcgtggaacccacgtgggctccacatgtcagcatggccacgtcgggctcattctctgttttcctcctcccctctctctctctcacattcttctctcttctctgggcaagccgaccgacgactggggcggaggccaccggggcgaggcaggagagcagaaggcggctgcggctgcggcgggcgttgcgagccggggtggagaagtcgcgggcgctcaaccacgcactagcagggcggggcccaagcttggggagatccaggcgaggttcccggtgatggagacggcgttgtgcccgatcacgccccgcgggacacactcgagggcgctggggagtacatcaaccgcgctgtggggccggccgtcgccgtgcgcggcctcgagccgccgttcctcgcggcctccgccgtcgccgacgacctcctcggatacctcgtcgtgttgtcccgcctcgaggaggtgctccacttcctctccgacaactgcggcatcgcctcccagtggctcagcttcgccgagtacctcggggaccgcagcctcgccgacccctgcttcgtgtccgacctcgccgaggtgctctctcacctcaagaccccctccgcaaacctggacggcggcctcctcgtcgctgccttggacattcttgaggacgagttctgtcgccttctcaaggaacactcagcttcgctcgccatgaaagaacccaactatagccggccccgcctccaccttcgtgcccactgccgcgggcgttcggccccgcctccgcctccgcgcccaacaccgcggtgcccgcctgcacggggccgcttcaccggcggtggcgacacagcgcgacgacgccattcgcaaccggccgccgccctcgccttctcttgcatcgcagctgccgccgtcacctcctctcccgcctcactctagcggcatccgccccagccgccgtccggcttgcccagagaagagagaagggtgagagagagagaggaggaagggagagaataagggaaagagaggaggccgacgtgccacgctgatatgtggggtccacgtgggtcccacactaactcagctacgtaacgaaaacgggtcaaaaccaccgaaggatctaaagtgaacgatttttataaattgagggatgtgctatatctagtttcacagttaggggacgattttgtaactcagatgacaagttgagggaccttcggtgtactttttccactcttttagctttattaggactgtgttcttccctttctttttcaactcatcttcattttttttacgtgtatgtttttcaaattactaaacagtgtgtttttttcgcgccgaggttgaagaagctggtgagcaggaccgaaacaaagtttgtttcaaactggcaatgccaactataccgtcccattaccacactaatcttttaggccctacttgcctgatgcatctgccgaatttaaaccccggaaacgatattatttgctgatgacgctggcgaaaattcccttgttttaggcatataaaatgcagaattgcagataccgtgcagtatatccaataccagctcgaacttattcggcaaaaaggggtgcccagcatcgcagtgcaatgggctgcgacaaagcggcaaacataaagcaacatcacaaccgtgcacaaccccgaagcagtcaggtggtgtttagatccagggacttaactttagtccctgtctttagacactaatttagagtattaaatatagactacttacaaaactaattacataaataaaagctaattcacaagataaattttttaagcctaattaatctataattagagaatgtttactgtagcatcacataggctaatcatggattaattaggctcattagatttgtctcgcaaattagtccaagattatggatgagttttattaatagtctacgtttaatatttataattaattttcaaacatccgatatgatagggacttaaaaatagtttcatctaaacagggcctcagtcgtctctccggaatttattctggtgaagtcaccaatctatcgcaacgaaacaagacgcggttgaccaatgatcagcaatcagcggttcagcgtacgtttcagttcagcactttgggcttcccggcgagcatgaaggccttgaacacgagcttcctcgccaccgccgggtctccccactccgcctccacccccttcatcacgtccttggtcaccgcctccaggtctactcccttctccctcgccgtcgtcacgacggagccggtcttcaggaacccgacgaggtcgtccagcgtcatgtccacctctatgtcgacgtcggccggctcgccctcgcggcccacgccgacgggctcgaacgggaacggcaggtcgcggtacctgtccatggccagcctcgtcctcgggtccatatacgggcgcatggccgggtacagctggccgtgcagcttgtcctcgaacgggtggatctcgtagttgtagccccacaccgcgaggacgccgccgggcctcttgaggacgcggttggccacggcgtaaaagagcgggatgtcgaaccagtggatggaggtcgccaccacgacgaggtccagcgagccctcgccgccgaccatggcgacgaggtcgtcctcggagaggtccaccggggtgtgcaggtaccgcaccttggggtgcgcgacggcgtggcggatctgcccctcgctcgcgtccgtcgcgaccacgctgtcgtagtgctccgcgatctgaacgcacacggagaaacactgatgataaagacggtcgatcgccggcgaaatttttcgttttttttcagagttcagaagatgatgaagcggcgagagtggttcagagattgggcgcttacgctgatggaggcctggccggtgccgcagccggcgtcccaggcgcggtggtggccggctgtgagggcggcgagcttggagaaccaagcgtcagggtaccgaggccgcttcttggtgtacgtctccgacggtctctcatacagcccagccattcttgctctctgcttcttctctataacctccaccggaccacagcttcagtcctggactgtgaagagcgcgaattgttggggtggatctggatggaatttatagatcaccgaagatgacagattcagagtcaaagtcaaaatcagcagttgtcatctgatccatctcagtgaacaactttgcatttgcattatccactagtgtattctagtggcggttacaccatttttctcctcctaatagtacaccaccacatgctgaaactgctgcaacaaaaattatgcacaagataaaataattttcaaaggcaatcaggaaagtagaagcatgctgctaacaggacaaggaaaaatatggggtaaaaggtaggtaaaaacaggcaatgcatcaaatctgaaagatgtggattgtagaaagatgaggtaaagacaggaatagcaatctgaaacctgtagattgaaaaatagcctgggtcttgcaagtcaaccagacgtgggcaagttgcttacttcgatttgtggctaagatggccctccacattagtcctgcgctgaactaactgaacccaaaaagatgcttcagcagccgtatatgggaaaacaataagatgctttataacatggatcatctgccagatgaaggcttttacggttaggtcttgattacatcttcacagtaaaaacagatatctttggtttcatcagcatggatataaacatctctgcacaaatcagagtgttgcaacctactataataacgctacaacttaggaaatagaggattctgaataacaagacaactatacaacaataacatgggaattccagagtctgtgactgggaattttagactggcacagcatatgcagggactggaggtgtgcctctgccaacttcagctgaggtttggaggtttaggtaagtgccttggtcactacatgtaaatatttagcttaggtacagcaatatttaaccaaatacacttaagtatttaaccgtgtcttatttgttcttttagataagggttaagtccgatttatttgttagcacttgaagacatggtgacagtaaaaaaggcatgacattagatgataactatataagataaagaaccgctcattttacataattactcttttcagcgatacctgaatgttattcttacatatttgtagtctagtgggtgcaacagtgcaagcaattcctgcactggatcaagtccgcagtatccacagaccacagtccacactgcctgacttagaggtgcaaccgtgcaagtcatttgggaaccttctgtgccgttagaacacatcaccctgtctgcaaaatacctgattcttttccaggagcaatctgataatgcagctttgcatctccaggagttcccaaaggtgcaccagtgcaggaacagttatcaaccatataaagctcccacttcttgatcccacacttatctaaagcagatgccagtcttgggtcatccaaatctggacaagagccatctgggctaacgagcactgctccagtgtatgctagtccagcggcctgagcggctccgtgataatggaacagaccccagctgaaatcatctgaaacatcaacgattgtccaaaactcctttgaaaccacaccattatccagcacactgaagtaaaatgtaccagggatgagagctcttcttactcggtactttctgcgcctccaaaccagttccccttccagggttctgacttgaaaaattggctcataccaaaatgaacctttagcttttcccctgtaaaataattgatactgacatgggaattgatcatatgctggattttgtccagctacaactctccaactccattccaagttgtccaaccatccaacaaacatgtcttctgcaagttcatggcttagcatttgttctctgaacatggttagtgggggtacagagggcttactggggatctcggcattgagatcaagacaattgttcttctgcaaaacacataaagaaaaggcctccagatgcggactctcatacgacgcaatgcagcgatagttgcaaacttgatcagttggagaacatgaatttaaacactgaagggctttcctacagttgggatcgaacagacaattcagtatctgaggaccacaatttcttatcatacagcttagggtagacagaccttttgccctaaggttttgcagcatatcaacaggtcttatgtacgcattaaccacaacaagtaagcaaaatctaatgtcatctgaattatgcctttcccaggcattagatacagccttaaggacttcagcagattccttcatgccacctgtttctccaatatttgttagcttgcaaaacatgtcctgacgtccagtgtattgaacatacctgccacctaacttgttttctaaggttggagatgattgaaagcagattatattgggaatgtcctcactgttatttataagccactgaacagtctcctgactcgttattgcaacattgactagcatatcacactgtgccagctctttcctaagttcatcatggccaattgacttgtctgtgaagacaagcatttcaaatccttcgtcaacccacttcatcctattagcctaaaaagacagaaaaaacgagatgcatggttactggcagtaaatttatgcagagagatattctgcatattcatattaagttgatgaactgctgtgcgaactggctaatcaattnnnnngatc

SEQ ID NO: 29644 - DNA, 14204 bp, Oryza sativa
  unsure (1)..(14204): unsure at all n locations
catattattcgaagtactnnctaggaacnncannaatcaggtgacattttacagaatctaagattgtggcatcgataggtttattaaatcacaaggcaaacaaggtaaaataagcgatacaaaattataatcaagtactaaaacaaggtaaaataagcgatacaaaattataatcaagtactaagtactaacacattttggaggtaccagaaatttagaatgttcgtgcccatataatcacatatacttgaatacttctacaactagttctccaagtgagcgtgcgaaatggttctgtgtgagtgtgcaattgaccaatcgcgtatttgcatgtgctttgccgttacaacattctatctatagaagttcttcagttatcagcatattccgaatcggcttattgcaatactgtcgagttctcctttgcactgcgactccgcactagcatttgatagcggtgaatcggtgctaggttcagagctcagagcggaagcataccgtgtggcgcataacctcctcccatggcgtgtccttcagcgggctgatgctcccgtcgcctactatggagactatgcggacggcgcccttcccggtgatggttccgccggccccgccgccaagctcgcccgcggcggcgcgcggtggcccgagagagcggacgccgccggagtagcggcgggcgatggtgcgcgaaggggcaggcacggaagcggtttcatggaggtggcggcgagtaggtaggaagaggcgagtggtggccgccgcggaggcggacgtggtgggcgtggctgccatgggagtctgggaagaggaggtggacgaagcggctggacctcgagtctcgagccttcgagaacctttcgactcatccctaccgttcgatcagaaaatcgacggtggatactaatctcagggaaaaaaattctggaaaacgtttttctacacaaacaaaatacgagttataaaaactagctggtggcccgcgcaattgcgcggcaaaccccaaacaaaattatatatttttaagtatgattttacttaaaaaatttattaaatagctatctcattgtcttaagacattgaaaggccaaaccttatcatcatcgtgtttctaaatatatagtttttaaaagtcacaccagttgctatccattatgtcatcctcttctttatttgcttgctcgattatcactatttctattcattcttcttggaatcattaaaaattggattttatagttttagagttaattgtcatgttgtgtttcgttttaacaattcatagatgtcccgtcaaatgttgccattatacacctctacggccagtccactgtctcttctctttattatcattgagattttaaaaatcgaaaataattatcgtttggtttattttttactttctaaaagtcctgccaaaccatcagcggctttgccattatactcctatatgactcgcccgttgcctcccttttttattgtcattgagatttcaaaatcgaacatgattatcattggttttttttactttttaaattggacttgtagtttcattttttataatttttagaaattccatcaaacgatgccactatgcccctctacagcccatccgccccctactcattattgtcattgtgattctaaaaatcgaacataattatcgttggaatttattttttattttctagaagtctcgtcaaccgtcggcggctctgcaactatactcttatacaccccgtccgctgcttctctttttattgtcattgagattttaaaaatcaaatatgattatcaatgtggtttattttttttactttctagaagtcccgataaccgtcttactcgtttgcttcacggcctgcctgacatccctccttttaatcgtcattaggattctatttggtgttttattaacattttttatatgtcgtatcaaccgccaacactctactctgttttagatggtattttctttcaatagtctttatttttatcacaaattttagttatttataaattgtattcctaattgaaatcttatttttctttttctaatttcagaattttttttaaaaaaaattagttagtaccgtattgtgttatcttaatgtttttattttttattttcaatttcagttgttttaaaaattgtatttctacttgaactctctttaatttttctaattttagatattattttattttttactctaaattttaattaatctcatattgggttcttatatggattattctttcaatgttgcttatttttaattccgaatttcagctaattttaaattgtattactacttgagctcttcttttattttcttttactaatttcggatttatttctatttttattctgaatttaattaatctcgtattgagttcttatatggactcttcttttaatattccttatttttaattttgaatttcagctatttttaaattgtattcctacttggaatctcctttccttttctaattttggattttattttatttttatttcgaattttgattaatctcgtattgtgttcttatatggaaacttctttcaatattgcttatttttaattccgaatttcagttaattttaaattgtattcctacttggactctccttttattttcttttgctaattttggttttatttttatttttattctgaattttaattaatctcgtattcggttcttctatggactatcttttaatattccttatttttagttccgaattttagctatttttaaattgtattcctacttggactctcctttccttttcttattttggattttattttatttttatttttatttttaattaatctcgtattgggttcttatatggaaacttcttttaatattgcttatttttaatttcgaatttcaactattttaaaattgtattcctacttacactctcctttcctttaataattttggattttattttatttttatttcggattttgattaatctcgtattgggttcttatatggaaatttctttcaatattgcttatttttaattccgaatttcagctattttaaaattgtatttctacttggactctccttttctttttctccgattaatgtgggaatttctaacccccacagcgaacgtggtgtctcctttcaaagctgttttaataacataatagatagatacccgcgcaattgcgcggctagcaccgatataaaattatctaatttttaatatagttttacttaaaattttgttaaatagatatctcgttgtcttaagactttgaaaaaccaaaccttatcatccctgtgtttctagttttattttttaaaaagttatatcagttgcaaatcctaaattctttgtcacccctcatttatttgctttctcgatcaccactacgtctatttgttctcactaaaaacctctaaaaattagacttatagtttttagagtttattgtctcgtttgggttttgtttttataattttcagaagtctcatcaaatgctgccactatactactctacggtccatccactgcctcttctctttattttcattgggattttaaaaatcaaacgtaattaccatttgggttctttttttactttctagaagttccaccaagctgtcagcacctttaccactgtacacatgtactgctcgcccgctgccccctctttattgtctttgagattttaaaattcgaacatgattatcattggggtttatttttttactttttagaagtcccgtcaaccgttgtaaccatgctacttaatgacccatccatcgtccctccttttaatcatcattgggattctatttggggttttgtttatagtttttagatattccatcaaccgccaccactctaatcctttacatgcatgttgcttctcctatatttgttgtcatttgtcatagttttataatttttagaagtcatatcaaaccctgtcaccatacttctcttcggcctatccactgcctcttctctttattgtcattgggattttaaaaatcgaacataattattatttgggttcatattttactttctataagtcccgccaaccgccatgaccaggctgcttaacggcccatccatcgtccctccttttaatcatcattgggattctatttgaggttttgttaatagtttttagatgtcctatcaatcgccaccattctacttctttataaacttgttgcttctccccctctttattgttgtttgttatcatttgtgttctagatgaagttttttagaagtccatatttttcagtccgatattttatttacaaattatattcctacttaaactcttataattatttttctattttcagtatttatttttttgttatttcaaattttagttaatctcgtcacatgttctagatggtatcttatttcaatagtttttatttttttatgacgaatttaagttatttataaattttattcctaggtgaactattattttttctttttctatttttggaatttattttaattttgatttagaattttggttaatatcgtattatgtcttatatgaattattttttaatgtttttttattttcaattttatagttgttttatcctactcaaactatcttttttatttctctaattccggattttattttatttttattctgaattttaattaatctcgtactggattcttatatatactcttcttttaatattccttatttttaattccgaattccagttatttctagattgtattcctatatggactcttcttttttcaatttcagattttattttatttttattccgaattttaattaatctcgtattggattcttatacgaactctatattgcttatttgtaattccgaatttcagctatttttaaattgtatttctatttggactcttctttttttcttctccgattaatgtgggaatttctaacccccataacgaacgtgatgcttttttttcgagcagttttaataatataatagatagatagatatcttcgaaactcccgcccgccaccgagcgggatacgcaaaaatctccaaaattttccccaacccgcgcgcccccagttttcctctcctccgaatcccaatctctcgcagttcgttcgaggagctgagacgctgcgacggccatggcgacgagtctcttcctcgcgctgcagtgcgtccagtgctccactatgcaggtgcgcgtcctcgcccaaatccctcccccgaaaaccccgcgagtttcttcaatagctcacccggtttcgttcttgcggcttcggtttgatttcccaggtgaagccgcagaagaagagcagcaacaagtgggtgtgcgtggtgtgcaaccagcgccagtccgtgatgcgcgtccacgcccgcgggcaccgcgccgccgacctccgccgcttcgtccaggaagccaacctctcgcgcggccgcgccgcgcatgtgcccgtgcccgaggaagactgggtccctgcggtgccgggggagcagcgggatgagttcccgaaggagaggaagaggcggatggactggtccgactatctggaagatccgggggagtacgatggcggcggccaccacgaggaagctcgagatgaaggtatgcgcgaaacctgtttgatgtgatgtcgcaatgtatgtgtatcacagtatcagtatgatattgggtagcgtgtaaaatgatatgctcattaggaccaatggtaagttgattttgctaggggcctagtgttactacttaaaatcaacttgcttgccgcatggtttagtatcgtgttttcaagcttggacgcagtgagtacgggtaatgatacttgtggttcaaggcttaacaaaggcattgctgaactaaaattataagcacctgtttgtgaatagtcttgtatttcatattccatgcatgaatataaatgttattggggcaagctatacattgcttatgcagcgctagcatgatcacaggtctgttacgcagttacaatggctagtacctgaatgctcggctataaaaaagttgaatatctgcattatgtttcaggatgaggttgtattatgtatagcacttctaagtcttgagttagttctcttcatctttgtttatctgcacttatctgggaaggaatgaccagtctttaatgcatgatctaattgttttcatacctcaatttacaaatagatgtagggattcaagtaacaactgaattacctgaaaagaggcctaaagtcacttccttgaagagggcccccaaagcccaattgggattaggtggaaagaggcccaagacaccagtcacttccactttacccaagaggcaaccgatcgaagaaggttcactcccatgttctgcagctcctactgctgaaggcacattcaaatcctaacacatattgtacttgtcattaacaaaacatgtaagttaaacgggttgtatgttttctgcagcacaaagatcaaaatggagcaattatttggatacaagtttctctgaagggggaagtgggtttgaagactctgagcgacattgcagtgaactggaatgctccattactgatgttgtggtggatgatgaggtacaccctgattttgtgtgatatatatgtgtcttgtcttggtctgtagcattttatgctttgaatagtgcagtagttagaaaagatctgatgtgcagttggcaaaatattatcatataggatgggcactttattatgcactgaatcgcaacttgctatgttaaaattgaggagaaattaagatgcatgctaaccttttgaaacaatgatgttaacagtgcatctgcttaacctactttcagagttctctgaacttagtcctttgagtttaaaatgtatatgtataaggtgacaggcttatgtcacaacaagagtttcagttagttgtatactccacttaacaatacccccacccctgtaatttcaaaaaaatccctggcaaaaagagagaggatgggaaaacacaagtggtgactcttttcttcattttggaactccacaaagttatcctaaaaggtaccccgtataaaatcttctgcagtacttcaactggaagtagggatatgtaattccgagttaactgaagattttgttggatgtatatggggattatgcactactaaataactactgattgcatgcttcatttgttatgcttgtgtctggctgagtgcatcactgcatcttccaaacataaactgatattccgaaacaataatccctacacgaagcctgaatcacaatgaacaaatttgaaacttgctgatgtctgaacaattcaacaacttctgatttctgaaaccattgttagtttaaacaattttgatcattgaccatgatgaagatgtgcactcttctgacatgaacctatcaccgatcactgtttcgctgccatcaacctgctaagttatgttataacctattaacttggtaagttcatacgtctcaacatctttctaaatccagaagagggacttgaacaaatggtcattatggtagggcagtctgaagctcaagcgggaatataaagcatcatatctgtgtcctgctactttgtagagaggggttggataaagaataccttacattgctttcaacccagttccaccatttccttttcatcattaaccctcttttgcatttataatcaagtgaaagttcacatacctcccttatttggcgatacaagccacataatgctttttctgagccctgccgccagacacgcaaagaaccaaacaaaatacttattgcccttctaatctggagcaatagctccttcggttagccagtcaaccactttttggtccagtcaatcatttcgtttctccctgaatctgttgagtggtcacacagtattttaacctcgaattcaatttggcatattatttatttgctatttagagtacattggttttagattattaccgtgtatgttattgcaatatatttacccgtattccttgcttccaattatgcataatttcaattttttggtttcatgactcaaaaactgtcccaaatccagatcatcaatcttgtactctaagagaaaaagaccattccatcgttaatacgctactaacaagtcatgcatttggtcatacatatgttaaatttcattagacaactaccagatgcaatnacattctcctattatatcctcaccacagttcactggcaagcacatagttgtgcctgtggggtggcgtgctctgaagtgcgcctataaagttagcaagagccgacagctctgcttgcggtgataatctccgtttggtagcgaacaattttgtacgacctcccgcagacccactgcttgccgtagccagcacgacggcaacgtctcaactgcatttcctagtaattcatcacttgtactggccatgtcttcctggtgtttgtttacagtctgtcagtggcagtcagatgaacctgccatttggtgttctgtgtgtcgttacggctttacgcgatctgggtggatttggtggtagttggaagtataacggactgaatatcttgacatgtcagcctgtttattcagtaattctagaaccgtgggagtcagtgcagcattgatggaatttctatcccgcaacttgaggcacttggccatgtgtggtactagcataatcagtactacatcttgagcacttgaatatctttatattgtggcctgtgggagtctgggagatctatacaacatagttacacagtagtgccaacatacactgatattatcctattactgtattgcttaactgggctcgtgtcattctgacctgacgcttcgcgtcacagcctgtgaacaaatatgttttgccgtctcatggtcatgggcgataggtcatataatgatataaagctgtgcaatgtgccaaacttgtgtgatggcacgggctggcggcgtaagcggcagccgacaccgtcagccaggttgccccaaatcgtcgcggcccgcccgtgctcggggcagtggctatcgcgacgccgcggccgcgcgggcgatcaggcgccgtgccgcgcgagatgccaaccgcgaagcgcgtcgcgcgcgtcgcatgcggctggggcgaaatcatagccaacaacgacactcccagcaatggtacggcacaatcatggagcatcaactggtgcgtccaaggatctcaccccatgatgaccccgccgcagcagctgggtatcgcgtgttgtgggctcgagtacctcgtatacggtctctagtctcagttaattgttgccacctacgtacggccctataggccattactgccctcaacaacgcgcgacgtcatcatgtttattgctacgcataatcgttgaaatcaaccatgttgccgcgctgttccgcccgtgcgtgccggcggaggtcaggtcgatcgagctcgcgagctagccgaccggggttggtagttggctggtccttttggcccatccggtcggcgtgataattaggtatttggatgtgtattaaatcacgatgcgatgcccttatccgtctcttccctgttgcctccggatctttggactttggaattggaaaagagctaagggagatgtcatgcttttgttgatgctcctaactaccgaagcttcggtgtttcttttcttttggcatcgtcgcaagtgatggtgactcgacttaacactcatcatcctgctgattgatgccttactttaccgttaacacgtcgatgcgttcgacgaggtgcacgcgccaccgaacgcccgcactatcacggcggatggcaatggctgtacttccatactaatcatattgttctccccgtattcttgtgctaaaaaaaaccggctgtagtaagtatccttaccaacctagctcaaaactgtctgtctgtctgtctgtctgttgtagtggagcatttgctccgttcatcttgccctcccattccgtcgtcgtcgatgttaccgtgaatactttttatgtagtagggggcaagattggaacggggaatcttctaaatcacgtcattaccataactatgtaggctcacataggcatgctagacagcacggcactggtcctcattgcctcagggcaagtataatagtaggttataagccggctaaatgctgagttggaagaagaagcgggctgtaaattaacagccggcttgaacacaggaactaagaaactttgtgagagagacaagtgggtcctgtattaattgtgaagagctaactattatatggataggatgagaaaaggctataaagaaccttatagtcagcaggtcggctgtattattagccttgctctcactggctccaaagcgaagccaatttctaatcttcttttaagcgcgcggattaggatgctttaaaccttaaccagtaacacgatgcaggggtcccaccacccgacaccagctttcactgacaggcggtcccagaggcagcgcatgtagtagtactattactactccggaaaaagagtcctggcagccgttggaaacgttcgttaccaaccgtaaaattttgcatgtgtcactgacagcttgtccccgaagtattctggccccaccagccggcgtcaggggctcatcggatgtcggtgttggattccttttcctgtgggcccccgcgctgcactgttcctctgtctgtcagtcacttgcgctgtgtgcttctgctcgggctcaaagtcgtcagctttttctgtgtcttcccctcgccgtctcgcgcctgagccctgaactagacagaccaagcctctgtctaccaatggaggcctgagtcttagaggccggatttggtcgttggagagagagagagagagagagagagagcgagccgagcctgtgcggtgcggcgacgcctgctcctcttcgctcgcgcgcggcattccggtcgtgtttctgaggtgattttcctcgttagatttttggcgtagtgtttggtgccttgttgatggcttcgtgtggaatggtgtagtttggtcgtcagattcgtgtctgctcatacttggccccgttctgctcggcttctggtggttctctaagttttcttcgttgtcctcggcctctggtggtttcttgtgctggttgtttgctcgggcagtcgggcctgtgtgattttctgccgctgcattcgcatcaccttctcccagtctgtgccctgtgctagtgtgctactctctctactgagctctctcgcctttccgcgttcgacattctcttccagctttgtctcacgctcgcaactggttttcccggttatttcgggtgcgttgttgcctttttgttttgttcaggaaggggaaaaagaaatgttgtttgaggtttggatctgcgtactgatgtctgatgagctgctctgtaacaggatccggattgcacggtgttcgggctgtttcgtcaaccatggggaagtctccggcgaagtggatcaagtctgtgctcctcgggaagaaatcagccaagtccaactctaccaaggccaaggatttggcggtaagtacttctttgtgtttgctgctccgaattcgtggtaaaagatgatatctgtttcctcgcaaaaaagaaaaaagatgatatctgtttccctgtaaaaaagaattatctgttggtagcacgaaaagagaagtcagaagtgtatctatttaaatttttcaaagaagtaatcgacttaaagtaagatactaaggcttgaaattgccattacggctcctggactggattgtacaatgaaaaagttgcgtatgggtatgggtgccttttatatgaagcattgcagcattcttttttgttttatccatgttgtaggtctgtagcatactttgattcttcctcctactttcactgattggttggttgaatcacaattttgttgctgatatatagaaggctgcaaataacaagcctgtgctttctgaggatccccctgtgatttctgagccagctcttgttaattctcacaacgatggaaatgctgaaaattgcaagttaccaaacggagttgcagttgaagccatgggtcaaggagtggagaaccaaaacattgttggctccaaggcaccaactagtccagagaaactaagcgaagagctagctgcagtgaaggcacaagcggccttccgaggttacctggtaacaccttttgcttggactgatccattttgttcctgccatcttgcctcttgttaatgcacttttgatctggagctctctgcaaatgttgctgctagcttgtcccaaacctttctatagttttatggggtcatcgtttttaaaagtttcagaaaaggaaacataaacagccagccctgcagaaagaaaatttgtgtcctaaaaaactgatgagttggctgtctgatctatacctaaacattagtaactgctgacacattagcacctcttcgttttcttttggaagttatagaagaactgatcagataatatgtcccaggctttttgaagttatataatttgccattgttttggacctttggtgcaggcacgtagggcattccgtgcattaaaaggtatcataagactccaggcactgatccgaggacatcttgtaaggagacaagctgcatcaacccttcgtgtgacatggttgatcgtgaaacttcaagctttagttcgtggaagaaatgttagactctccggtgcttccattcaatttgttgtgaagtccggccaacataagtttctggtaagtatcttgacatgtggcagttcaaatatttgatttcttgtatccttccctgcttttctacctgttctatttgtattatgttaaacctctgtttcaaagaatgaatgtatgcaatattgaaagcaatgtaattagtctggcaaactgaaactttttttttgtcgggacggccaaaggtaggccggccaatttcattaagattgggggaaacaaagttttaattacaacgaggcaaactgaaacttttcacacacacttcagacatctcttcagtgctgcataaaatcagtaatgacacatgttcagaactacagatcttttggctaaaccccaagatggacatatcagccaagtaacattcagtacgccccagaaaatagagaattagctagatactagtatttactggtggttgatgattattattatgtacctggatttttataaatagcatggcaataatgttaattctgtgcatatctctatcatattggtacttggtacaatgtttcgtcattgttgtgggagcaagttctggtgtattattgtattgtactaggttgccctttattctttaacttaattttctacttgatttgtggtttgttctcacagatcattaactaccttcatgtggtcatattgcaactgaaaacaatactccctccgttgcatattataaggtgttttagttttaccctaaatcaaagttctctaaatttgaccaagtttatagaaaaataattaatgtctacaataccaaataaatagactatcaagaaatatttcatggcggattttgttgaaaccaatttgatgttgtagatgttggtgcatttttctattaacttggtcaaaatagaaaagtttgacttggacaaaactcaaagccttacaatatggaacggagtgaatacacactttcttttggtattcttttattcaaacattaaatacctccctaactatcctatcgaataacccacaccgttcccttcaacacaatatagaaatgcaaactgtcttttcaaaactataaatgtcgaagcttttcatcagataggtgtctttcatactcaaaagtttacaattaaatatttaccttgttatcctgattgagtatggaggtaaatctgctgaactacagtataacttaaattgcatacatcatggagcatgcatttatattttcttttcatgattcctacttaatgtatgacccatatgcaatattttctgcttgatgtctttatgtggccaaaaatctaaaacatgttcttgttgcaattattaaagtgataaaccatcggacgcttggaaagaagaggtatcttcaaacgcatatgttccgaaggtatgccatttggtttaaaaaaacaagacttaccagtgagaattgcttgatgtctaaaaaaggtggcatggatccggtcaattcatctatgagaaatgcatgagcccaaattcaa

SEQ ID NO: 29645 - DNA, 4434 bp, Oryza sativa
  unsure (1)..(4434): unsure at all n locations
nnnnnnnnnnnnnnnnnnnnnnnnnnnnnnnnnnnnnnnnnnnnnnnnnaagcagactgtgtctctcaacgcatatgttcgagaggtatgccatttgttttaaaaaaacaagacttaccagtgagatttgctgtatgtctaaaaaaggtgtcatgatcctgctcattttatctatgagaaatgcatgagcccaaatcaaatcgctcaccatttatacatttcagaggtgtgctcactcacttttgtacattttgtagcttctatcttcatcaattgggttagaagctcttcacttgcagtatgacaagagggaccccaattcattgtacaactggttggagagatggactataagccagatttggaagtcctcttcccaaccaaaaaaagttgctgatggcaaaccacaagtaaggaaggccagttatgcaatggaaactgagtcagccaaattaaagcgcaatgttcggaagagttctgctgtcactgttgatagcttccaaactaatatgacagttgaacctgaaaaaattaaacgaaattcaagaaaattctctagttccgctgctgattcagtaccagatagccagttatctgaacttgagaaggttaagaggaaccttcggaaggtaactaattccatggctgaagcatcaaagatatctagctccagggcagatgcctcaaaggtatctagctccatggctgatgcctcaaaggtgtctagctccacggctgatgcctcaaaggtatctgattccgtggctcaaatcccacctagtctcgtgaatgggatctctgatcatcaagacaaccaatgtgaggaagcacaacagaatgcatgcgtgtcatttcctcctgaaactcaggagttgcacagtggcattctgttggaggacaattcacatatgaatctgttggaacctgatttaatatctaacccggaaactcctttcacttcgattttaacctgggaaaaatttaatgattctactgctgatgctcaagaagttgaagttctgccactgcagaacattgataatgaagataatttcccagaaaatggtgtcttaggaaagaaagagaagccaaggtccaaggaagaacctctgtctaatggaaaccttaaaactagcaagaggaggtcttcgttctccaccaaatcagattacccggaaaatggagcccagaatacgccagttccacgaaggaagccaagctatatggctgcaacagaatctgcaaaggcaaagttgcgaggacagaattcaccaagactggattctgattcaccagcagacatgaatggcttcacacgccgccagtctctaccttcttctacaaacagtaagttgaacccacactcacctcatacacaaggaccaatctatttcaaatttgactaagtccatagacaaattagtttcatcaaatcaataattgaatatatttctaaaactaaattagttttatcaaatcaataattgaatatattttcataataaatttgttttgggttgaaaatgttactacttttttctacaaacttggtcaaacttaaagcagtttgactttgaccaaagttaaaacgtcttataacctgaaacggaggaagtaacagttatgaactaaaaagtgataaatccatgttaccagaaaaaaaatgtcgctgttaaacattaagcaaaggtaaccatctgaaaagataagatgatgttctaggctatcagaatgtgacaaattttgagtaatgatagcaaaaatgttcacagggagttcatggtattattctattgatcccagaagaaacacaactgtttattccatgtttaaaatactcccttttttctagtacaacaggggctttttgggtaatattaaatctgagaataaataaaaatggttgcacacattgtatttacattcatattctgaagtattgcatggattataaatctgtcgccttgactatgcatctttctgaagttctgcaactaccatattctacatagtcgcaccgggtggcctattgccacatttgttagcattgtatgtacttgtgttatttaggcttttactgacgttagaatggatctgtttgcatctgatcagtttaaaattcagacttcacagctcatgagccaacattcagtttttccttttcgtttctgaattctgatgtcccattttgcttgtttattttttatttttaccatctatcagacagagcgatcagagctgaatggagacggtggtgaggacaaccaacttccatttgaacggtgcaacgttgtggtggatgaagtgccctgctgtccgtgagattgtcgccattgttttgttcaagatgtaaaaatatgttggccctgtgttgatctattatctgttgcatatttgagttgttaatttattatccattgtttcttgtgcaatgtcttgttcatagctacatcttactagtttcgggcatatgctctcgtttccacccaaggcaccctgcctgataaatggtcagggggctgatgccctaagcgtgttttaatagaacggcttcatcctactttcatgctttcccaagttccctttgtgctaacacgtactctatccgttcctataaaatataagatgtacttattttatggaaaatcaatattttaaaattctaagtaaagagtaaactatgtgttgacagaaaacacgaggcctgggagatttgcttaactccagtgcaggtccaaagctcgcctttgactccaccttgatctaatctctttttccgatgctgatattaccaaatttggtcgttaacacatgtcccccaagtccgggatatttgataatgttccggatttgctgtgtaccgactccgagcaagtttcgcactctggcgtttttttgaccgttattctatcgctttaaataccaaccgttgccctcaaaaaatctcacgccgtgacttccgttttcaccgctcaagtgaaactttgtcctttctctatccggcgattcctccgacgtaaaagcaatccccaggcgatttcgcttttgatcagatctccgtctgcggcgatgtcgtcttccactagcccatctactgcgccatcggccaagtacgctgaggtaagttctcaccggctagatcccttttcctcgcatgaaatcgatttctccttttctcattatgttttatgctccccgattcctttggatttgcagcaccttttcaacctagttgcgattcccagcctatcgcacaaaaaccactattttcttggcccaatcggcaatcttgaccccactgatttcatcattggtgaaaccaatagaatcccctttagactagccaaccctaacttgggtcactggaagaataccttcaagtcttggccatctctcgaaaagcctacccctgataagagctggaccacctggtaccaacgcatatcggctagtaagaaagcccactgggatgagattgggatcggccaagcgcttgctctcaccatagccaattcttctaaggatgaacctctgatggctgccgccacctatttctggtccaacaccatcaatgccttcttatttaaccaagggccgatgactccaactttgatcgacatcatcatgattactggattagatgtaacttcatcggctaaccctatgagtatgaataccaagaaccaatttgacttcaagaccaaaagcataggagggtggtctggttatgtagcggcatacatgggcaaagggcctgtcactcctcgggagcacgtagctttcttgctaatgtggctagaaaagtttctcttctgtggatccagctgtggtcccacaaccaattggcaatttgtagccgaagccttaggatcaaagaaacaatttcccttgggcaaaatccttctcagctatctataccaaatgttgaacaatgcatcggctaagatagccgtcggctcaatagttggagcaggtggaccatggtggctactgcagacctggctaaacctggtagtcatgaaagttgtcaatcggccatctgtaacagacgctgaattcccacggttggaaccaattgtagaagacgatggagaagaacgcacccatcgcggatgcatgtcatatggagaatatgcatccacaccagccgatgctggggcaaaactatcggctgagctgctcaaagattggttctgtagcttttatgaaggcttccagaaagatgcccgggtttggtttctttatgaagactcagcaaaccttgagctcccattagacttcagatttgaagacatcaatcatgaaagatatcaaacgcccagggaagtctttatagctgcaatcagcccatgcatcctacctgtcggtattcaccaaggaagaaatatccatgatgagctgcttgcagacggaggaagtcaacaaagggtgcgg

SEQ ID NO: 29646 - DNA, 1595 bp, Oryza sativa
cacagaagcaatagtggtagaaacattgaatatgccccaggtctgattcctaatggaggcgaattgtctcccccaaggtctcaaccctcctccaaggcgccattagggaaccaaccgatgtaaccaagaaaagaaaaactagatcatcggctatgaacaccttgactctagttccaaagaaaaaaggccaaatctaagaaaaccaagccaaccgacgacctgcctgctttggatccatccattgaacatgctctggatgaagaagatattgaggatgatgttgatcaggctacagccgaagcaagtgatactgaaaaaacaccatcggcttcgcctaagcagataccttcaactccttctgcccccactcacttcttcagagtaaaacatctttccttgcaaacccttttataatcattatttttcagctgactactcataggttttgtagttgcagaagaagaaaactgctataaagaagaaatcggcagcaccaattctcaaaccagctccaccagtaagacactctcaattttactagttgatttcagccgattttgtctaacacttgtctttttacagcctcctcctcctccttcttctcctgtacaacaatcattgagtgactgaactccatcggccgtggggagtcatcatattgtggaagaagaacaaccggctgctcctgctatcccagtaagctttcctttaatgcaagaatttagatcgactatattgacttagctctcaaactttctgaacttatacctgcaagttctagccgatctcttttcttttgatatcaaagattatcttgatgaggcagaaaaagatacttcaagcaaagctctagctcccttatctgatgatgcaaagaaaacactggaagatatctcgcgtcggctagaggcctcttctctggatagcttagtggtcgactatggatcgattaggacacgattgcacgaagttcaagctctaattcctgaagaactggccgatgtcctaactctagccacttatcttgagcaacatcaatttaaactagaaaaagccaagctaagattagccgaacgccgtgagcgcaaggagattgaagccacaatccaagtcaatcggcagcttgtgcatgaagaaaaagtcaaactcgatcaactatccgaaggtccgatcaaatccaatatcgatcggcttgaagcccgcaagatcaaatccaatattctcttggcacagcttgaagaatgcaatgctgaattggatatggagcacaaaaaactagccgatctcccaaaatttgtcgaatagcaaaaagcaaggctcaaatcggctatcaagaatgttgctgacctaaccaagttcctgaagatcatttctgggactgatgctcaagatgcccaagccattgaagaagtcgaacaaattaggcaaagaactatttcggctatccagcagtacttgtctcaataacttttgtgtaatcggctaagataccttaataacaatcctttgtgccgattaacataacttctaattttcactttcatttttgtatttatgtgcccaaggcattggaagagtcgaacaaatatgcaaag

SEQ ID NO: 29647 - DNA, 2991 bp, Oryza sativa
  unsure (1)..(2991): unsure at all n locations
ccgcccttgatttgangtcgcattngagaagnctcataatccatgacaagccatccgataagaccacaatgctttggccaaccgagtatgccattgccgaggataattagaaatcttccgcttaattaatttgatcaagctcttgttagatgcctcggcctgcccattagcttgtgcataatatggtgaagaattcaacaatttgatacccacgctatcggcaaaccgaacaaactcatcggacacgaagattgaaccttgatcagttgtaatagtttgaggaataccaaatcggtagattatatgttcttgaacaaattgaattgcatccacagaatcaactttcttcaaaggaatggcctccacccacttggtgaaataatcagtcgccaccatactgatggtggctttatcatactgatcatatcaattccccaacctctaaatggccatggtttaataataggattcatagccgacgccggcactcgttgaattgccccaaacttctgacaatcttgacaccccttataatatctgaagcaatcctccagcattgtcggccaaaaataccctgcacgccgaagtaaccacttcattttatgggccgattggtgagtgccacaaattccttcatgaacttcgccgattgaaactttagcctgatcggcactcaaacacttaagtaacactccatcaatcgtccgataataaagctcattatccaatagagtgtacttcaacgccttatattttaatttcctagaagccgattgatggattatgtaaatattgatgcacatcatacctccaatcatcggctgttattgctgcaatttcaaccttaacatctttgatcatcggcttataccccgatgccccttgggctaaataattagtttcaatattttgttctcgagatacatgccttaaagtaaccagccgaaattccttcatcagttcttgacacttctcattataaactattaacgtatcattcttgcattcatactcccctgccaattgactgattaccagcaaagaatctcccatgatttcaatagcatcggcttcaacttccttaagcaattgcaaccctttaagcactgcttcatactcagcttgattattagtcgcataaggtttaatagtataagcaaactcgaaacatgcccccctaggggaaattataactaggccgataccacaaccatgagtacacaccgatccatcaaagaataaagtccatggcaccatttcaaccgagccgattgaatcatcacgatgttccacaataaaatcggctatagcttgtcccttaatcgtcttcggagactcataccaaagatcaaactcagttaaggaaaatatccactttccaacccttccttttcaatattggagccgataacatgtacctaacaacgtcggccttgcatataatagcacattcattggacagtaaataatgccttaaccttgtgcatgaaaaatataaacataagcataacttctccacaggagaatatctagtctctgcatccaagagccgacgactgagataaaatacaactcgttcttttccatccaactcctgaatcaggactgagccgattgacttctcaccggccgacagatacaatctaaaaggtatccctttctgtggaggaatcaaaacaggaggggaacttaggtatcctttaatatcatccaaagccttttgctgctctgccccccaagtaaactgctgatcggccttcaatctcaacaatggtgtaaaaggttctaattttccggacaaattagaaataaaccttcgaacaaaattagtcttgccgatcatctcctgcaatttggtcttgttttccggaggcttaatctttttgatcgcattgatacttctctgagttatctcaattcccctctcatggacaagaaattccaagaactggccagccgatacaccaaaagcacactttgtcggattcatcttcaagccatatttcctggtcccctcgaaaacttttcttaaatcggctatgtggtcttttacttccttagatttaacaaccacatcatcaatatagacctcaaccagccagccgattagatcatgataaatataattcatggcccgttgatatgtagctccagcactcttcaagccgaaagtcataacaacccattcaaataagacgattgcaccaggacatctaaaagctgtcttatggatatcttcttcagccataaaaatttgattatacattgtgtttccatccataaaactcaaaattctgttccctgacgtagcatcaaccagctgaacggctactggcattggatattcatctttcggtttagctttattcagatctctaaaatcaatgcataccctcaccttgccgttcttcttgatgacaggaactatgctagaaacccactcagcatatcggcaaggacgaataaaaccagcatcatataaatgtttaatctcagctttgacaggttcaagcatatcggctttgcatctccttggaggctgctggtgcggcctaacccctaacttgataggtagccgatgttctacaattgatcggctgagtccaggcatctcgtaatactcccaagcgaagcaatctctaaactcttttaagagctctatcagcttggttctaaattctggagacaaattcttactaataaatgttggccttggccgatcgcttggacctatatatatttcttccaaatcatcggccgacataaaaccttgaccttgcttgtcatcgagatcatctaccgtattcctagtgtagatacttaaacccttcacgacgcccttaaaataatagcttggggtctccatcttcaactgcctgtatatcagaatcggacacttttagaaaatctccattccaaactttttcagataaacaatcaaggccatccatcttccaaagagctaaatcggcactggcaacaataacttgt

SEQ ID NO: 29648 - DNA, 15090 bp, Oryza sativa
  unsure (1)..(15090): unsure at all n locations
ncaagcattgatgcatagttgaaggaattcaacaattgggcgtgaatccaatcccttccaagcaacaagctgtaagaacccttcctatcgatgacaaaaaacgtggtaggaatagtcttactgccgactgtcagctccacatttagaacacctttggtttccgatggattgccaccaaagtccttgagcaccatatttttcttgatgagatcctcggcatttctacccagcttcctgaacgtagcataaggcatcaaattcaccgcggtcccaccatcaaccatcattttagacatcggcttcccattgacataaccatttatatacaatggtttaagatgccgattctctgtcccctcaggcttctcgaacaccgcctgctctggtgatagaaccaacttagccgattcctcttccacctcgtcgacatcggcttgatcgatcccgaattcggctggcaaggtaaaaaccatgttaactggtgccgtcacaacactctttccttttgccaacctctttgcctcatcagttgcaacatcgtcggctacaggagcctgattcttaacacgccactcctgcctcggttttgctttcttcagccgatgattaatttcttgctcgacctcctggaagcgttccctactcctcaatctttgaacccttcttttctgattcttcgtaaaaataccaggaggacaccattgagtcttcttattttcgtcatcttccaaatcaccatgttggtttactgggcccaatctctgatggacatgcactcttgtctgttttggccaattgcctccatcgtataatcggcttgaaccccctgcaacatcactgcatccaggacaatcctcgatagatggtaacctcataccttcattccaacagaacctaaagaactcacagccccaatgaggatcaaagccaccattatcttcttcatgatgcctttcctgttgcttgtcgtatttcctttgatatttgtttataattctagccgaacttacttgataacccctcatgcgccccgtatcggttgttcggccagctgtgtgtaccatgttaacgggaaatgggttaccatcgaccctcatcggctttttggaatcatcaaacttaatcttgcctccctcaatggccacctgaatctgttgtctaaacaccttgcaatcgttagtagaatgggacccagaattatgccatttgcaatatctctttttgcctaattcctcagccgatggaatcgtatgaccagcagggagttgaatttgcttctctcggagtagcagatcaaaaatcttgtcaactttaataatatcaaaatcatacttctcttcctttccagaactctttacccattggcacggtatgacctttttactcctcacccattcggctgtagctatctcagagtcatcctcatcatcatctgacccatacatgtaagggcaaacatgattaaccttttagagctttttctagcctccgcagacctatgctcgtgcaaggttaccttttatatcagatgtgacaagctatcaaagtcttcagatgagaatttctccgtaatcggagcaatcataccctgaaaggctagatcggctaactgagcgtcagttaaactcaagctgaagcacttgttcctcatctccctgaatctctgaatatactcgtgcacgggttcatcatgccgctgcttaatcgctgtcaagtcagataacttcatctcatgaaccccactgtagaaatagctgtggaattgcttctccaaatcggcccaactattgatcgacccatacagcaaagaagaaaaccaagtaaaagccgatccagacaaagataaccggaacaacctaaccctcagagcgtccacagccgatgcttcaccacactgagctaaaaatcggctaatgtgctcataagttgacataccatcttgtcccgaaaatttggagaagtctggaactttgaaccgattggggagaggaactctcttaaaccactcagggtaaggctgccgatataagcttccagtctcttttggtttaagcccaaactgttccctcattacatcagcaatcacatcggcccacggtcgttgctgagctgctccctatgactgttgttgcatgggctcgaactgactgtactgagacgcaaactgaggttgagccagtccccctagctgatattgggcttgcggggaaggatgctgatattgataattcaagttgcccctctggtaattatgaaggttcagctgcatattacgtgccaaatgctcgggaacaacttgaggcattattgtgccatccggctgtacatggtgaaccaagtgttctgggacgacttgatttaaaaattgttgtacaggctgtccaccaggcgtcacaaacccagccgatgcgcaggcttggtgctgaatcggctgaacgatttgctgtcttaacggcgtttgctgaatcggccgcggaggctgttgccttggtggcgtttgctggactggttgcacaacttgttgctggactggttgtacaacctgctgaatcgggagtgtctgttgaatcggctgctgctgtattggatcaacagcaggttgaggcggcagaaacatggcagcaacctgatcttgcgtcggccgattcacaacctgcccactatgctgtggctgctctctcattaacaactgagggttcaccagctggcctggtgccaatgctgacggagcaggtaagggagtcgatgccggcgccgtcggctgagctaatggtgcgacgggggaaactacctgaatagatggctgggcatcagtgatcaaaggccgataatttggaaagacacctccttgcaaataaactgggcctgcagcctgatgctcagctattgatccatcggctattgacttcatcatgtttgataaggtattgactaacaccccagactgattgatcaaagcatggtgcacagcatagtcgacctggtcttggaaattattgaaaaaatcttgtgccgcatcactattctgattaagatttcccccttgcaacccctgagcaccatcaccttgaactccatgcactccatcgccttgaactccatggaccccttgagagttgtcaccttgacttcctagagaaccgccggtagcacctttgtcactcagttgagccgagccatctggagcttgtttcccgtcttcacctttggaagaactggtcctaggatcattggcaactacctttactttatacttctgaactaatgttcccttgcgggtctgcatgaatgagtttaagaactgatcccgggctttctgcaacattgcttcaaaatccttcttctgctcaggtgtgaatttctctggatcgatgggcacgacgtttccttcattgacgtcagtcaaccccaacttctggatcttttctttaacaaggcttgggctagtcgaggatggcgacagcggtggcttctcggccatgaggaagaattgcttgctgacttctaatcggtcccaccaggagtgccaaaagcgtgttgaaagaaaacacggggcctgtgagatctgcttaactccagtgcaggtccaaagctcgccttcgactccaccttgatctaatctcctttttcgatgctaatattaccaaatttggtcgttaacactatgacaatacatgtcatgcatatatcatcgttactttcgtatttgaaaatatttttatatgatgttaagtcatagctgataatatgttagaaatgaaagttgttgataatatgtcatgaataaaaccaatgggtcaaggtatactcttagacaccgtgtagaaaaaactaatacttctatgttttacgcaatttagaacggaggaagtaaccagaaatccatggcgcagcgaagtggccgaccttcatgaatcgtcaaatttgaatgatgctaacctgttctaaaggagaattttgctgtgagcctgtgatacgagaattttgctccagttctaaaggagattgaactattttcttggaaattccacataaattaagtgaaatcaggcgaaaaatgtgcgtgatgtgttctttcttgtgggtttccaacaaggtaataaatagcgtatagcgggttgttagcggattagtgtctgtatagcggattgcgaatagcggacgctattacggacgctaagttccaatagcaaatataagaaaataaccataaatatatctatattaacatcaatttcacgtaaaaattagaatttataatacattttttattactcatatatttcataacataaaaaatataaaataacatatagatatataagataaataagataaataatgaaaagttctacaatccatatatgaaaaacaacatttaagcgttatagcggtccaacaaagtcaatagcggactgttatagctatcgtgaagcgctataatagactaatatagcgggcgctaagttacaacatgctatcttcagtccgctaccttgtagcagcagcggtagaggtccgctaccgctattgtggccgctactgcggccgctacgaacgttatttattagcttggtttctaacccatttccctcgttttccgcgtgcatatttttcaaacggttaaacggtatgcgttttgctaaaattttatataggaaagttgcttttaaaaaaatcatattaatccagttttatgcgttttgtgaaaagtttatatatgaaagttgctttaaaaatcatattaatcaagttttcaagtctttttatagctaatacttagagcaggtacaatagcaggctataatccagctataaatatattttaaaaagataaaggaagagagagaaaagcagcgggctacagatctatagccagttgtagcacgggctccaagacgtaatatgtgatattaatagtataacaaaaaactatgatatgaattggttattacattggttatagatgatttggagttaatagtaagctatactattaaacttgctcttaattaatcatgtgttaatctatggctcttttttttttccgccggaacggttccaagtcccaacccctcagaaggctggtactgggctactagtcatcttctgcctcttcctcatgcaaacacaacaaactgccgtaatcagactatcagaggaaagcgttccgcggcgccgccgtggcgtccggcgtccggcctgtcacctgtgagtcgaggccgcactttggcgcccgcggcagagcccgcgacatgccttgccgcaccgcgccgaggcgtccaaacacacgctccgcccagcccagagagcccactcccgccgccgcgcgtcccatccaaacctccctccgcctccgcgtcccgccggccgccgccaatggaggcgccgccaagcctcccctaccgccacctgccgcagcatctcgccggcctcctcaagacccggccgctccacgacctactctccgacgcgtccaccttccgcgccgcacgccacctgttcgacgctgtgccgcgcccgacccccgccctctgcggcacgctcatctccgctctctcaaggctctgctcgcaccaggagcttctcgacgccttctcatcgcttcaccgcaggggctccgacgtcccgcccggctgtgtgcccctcgttgtgaagtcgtgcgcgatcttggccgcgtcacgtcagggaaagcaggtgcactgtcacgccattgtccgtggtctccttggggatatctttgtgcagactgctctggtggatttctatgcaaagaacggggacatggattgtgctgtgaaggtgtttgacgagatgccggtgaaggacccgataccgatgaactgcttgatcactgggtattccaagtccggtgatgtggtgaaggcgaggaggctatttgatggcatggtaagaaggacatctgcatcctggaattcaatgatcgcctgttatgcgcatggtggggaataccaggaagctttgaggttgttccgtaggatgttgagtgagggtgcaaggccaaatgcgatcactattgcgacgatgttttccatttgtgccaagactggtgatcttgaaacaggaaagtgggcaaggtctttgatcgcagagcaggatttgcagaacatgatagtgcacactgccttgatggaaatgtatgtcaagtgtcgggctattgacgaggcacgccgtgagtttgatcggatgcagcagagagatgtcgtggcatggagcactatgatcgctggttatgcacagaatgggaggccacatgaatctctagagctgtttgagaggatgaaggcaaccagttgcaagccaaatgaggtgactcttgttggtgtactatctgcctgtgctcagctgggctctgatgaattaggaggacagattggtagccatgtcgagagccagaacctaccactcaccagctacctcggatccgcactaattgacatgtacacaaagtgtgggcacgttggcagagctcgcagtgtcttcaaccggatggaacacaaggttgtcataacctggaactccatgatgagaggcctagcactgaatggctttgcgcaagatgcaatcaccttgtacaaagagatgacagaggaggacgtccagccaaacgagattactttcgttgcgctgttaacggcgtgcacccatgctggattggtagaccaaggtatgtcctttttcaaagagatgaagacaattcaccatgtttcccctcaagtggagcactgcgcgtgcatagtggacctcctctgcaaatctggaaggctgcgggaagcgtacaagttcatctgcgacatggaggtcgaaccaaacgcggtgatctggagcacgctgctgagcgcctgcagggctcacgccgacgtcgagctggccaagctcgccgcgagcaagctcctggttcttgagccggacaactcctccatctatgtcctgctgtccaacatctacgcggatgccggcctctggggcgacgtgagggagatcagggacctgatgaggagcaagaacgtgcagaagctgtctgcttatagttggatagagctggacggtgaagtgcacaagttcctggtgcaggatacgtaccacccgaaatcagctgagattttcaacgtcgtcgacggcatggggttgcatctggacgacgttgattctgaccccgatttatttgttctagagcactattgaacatttgaacatgctaacaaacaattgcagcagggcatccttcgttcactgcagattgattgtactttgcataatttatatacatgcatgatccatcgattcgattattattagttagtactagaaagtatgtagaaagtataattggtaagtgttgaattgttgggccttcttgcctagcccaataagaacaatgactaccagtaggccttattgatgatgagcccagttctgagttatcccgagtcctgcctgataaagcaagcagtccaaagcaggagacggcagaacaccaggttgtcagatcccttcgcctctgaaccctgagtcgccgatcgaaacaatccgatggagtccgaagctgacaaggccgccgcgccggcgccggcagcggcggcgtcggtagcggagacgagcgacgacgcgattcaagaggagtcaccggcaccggctcccagcgggaagcctggatcggaggcggcggccaagccggaggtcgaggtgcagctgttccggcgtgggcgggggccggtggccgtgttccggtcgccgctgggcgggtacacgcaggaccagctggaggtgggggacatcctggagcagcacggcctcaagtccgtcttcgtcttccaccccgcctcccgcacccgcggggtcgccattcgcttccacccccgcaacggccgctccctcctcacctacgtcgctggttccaccatcttcctcgacggcgagcccaaggtaagccttacggatcggttggctctctctggctcgctcaattttaggtagtcgaagtgatgtgatcatgtgagtacttgatggattggtctgtttggttggttggttaggattctttgctgaagcccgtcacgaaggtgatgattggtgtggcagctatgacagcagttgctgcagtattgctgaaggagggcaagatgcccgagtggcttaaggaatccaagctcggcaatctgaacttcccaccatgggtactggcttgcatggtcattgtgttcatgaggctccggaagagaaccaaggatgccatgaaaaagtttggctggtcttcatgaggtaccaaaagttttaccccttttccccagatttgtgatcgaacagtttccaatttggttttaatctcttgtgagtatagcatgatgcacaaacggttactaccaaaactcagtgctgttctatatgtgcagtagtataatgaatgaaacttgtaggtagttgtgacatggttattctagaatgttaagtgtgctttaaggtttcttgtactataacagcatagtttattaatcgtcgtatcatggcagtgttattttttctattctacaaagcatatatagacaaaaatacccactactcctgagttttgattattaaacagaataactatccgctcctagttacccctctccagtctccaaagcgtgtcgttttggacatatatctcatcaaacttttgaaactttgaatatcaatacatttttaatatttagatttgatacatggaaataatgtgcatatttgtctcttaagtactctatgatactataatatctatcaacatttgtaaatatattcaaaatttgcaatagaaattagtggtgaaagatgcattttgataccatgtcaatgttccaaacatgttttcgcaaccagacggagcattacaacacaaaacctccgtagagtactaattagtctattcaaaacattattcatgtatcatgagttcttggcgaaagggcatgtagtctagtagttacagtgacctgagtaacaccccaaggtcctgagttcaaattttaataggagcgaatttcagattgggttgtttgaggagctaagttcccaatttaaatggttgcatatatctggttggatgtagaggccgggtaaaaaatacccatctctaaaaaaagagtatcatgagttcttgtcattcataatttctgctgaaatatacttataggctgttcctagaggaaccaaagtaagtatgtcacgcatgtgcttccgcctcattcattgtattattaggatatgggaaactaactgcatctctgagttcttttactgaattttatctaagctgtatttcaatattccacaggttcgtaatgacaaatgtgtgtttttggctgctgcttcaaatttgttgccaatactggagatgtaccaagcgggtgacacgctaagtgaagaactattacacaaaaaacactagttttaccctttatttgcatactcgatgccggaaactcgatagatttttacttgtacttatgttcatgaataaaaaatagcaaaacaatccttatcatatctcttcctgctcgctaattggtttatccatttttctggaaggcttcccaggtactccctccgtcccataaaaaaccaacctagatgtgacacatcctagtactacaaatctggacattctagattcattatactagaatatgtcaaatccagtactagattcgttttttttttggacggagggagtattccttatatgctggtagattcatagttcatatcctgtagcaaacatggagtttcagtttacaaaacaatgatccttgatatatgctattgatgatttttgcatctgtgcattggcacacttcgatgtgcccatcttgcttcgcccttaataaagagctattggataccacaaactgtattttcttgtgcctaagctagatctcggcttaccattatctataggatttaaacactggatttactataaaatgtcatcctgaaaattgtgattgtttcaattatcatacagagaaatcatcaagtaatccccgcatgagaatgctttaggttttgtcacatagtcgaggggcacacttacattgtcatttgctactggcagaatgtcacaaagttctgtgcccatttgccagccatgtgagaatggcaaagttgcccatatctccttccgatctatctatccgctaatctctaccttcgaccatcaccgtgccttggctccagagtgatgctattctcgcgcatttatatgttagaatggatgcgctagaatagcatcaaaattgatcaccagtaatccttacaggagcatgctccatccttgaaatggtgaaacctattcctatctctcataacaatctccctgttgaagaccttggatatcatcttggtataatcatggcagtcctcacatactctcaggttcttcactatcctaatctccatgtcttccggcaacgcgactaggccaaatgcaatggccagcttctcactatgcaaggagattgcatcttctttgtcctcttcctcgatatcaaacaacacctcttttgtgttcgcaatgtacccttgcagcctcagcctctgattcatctctgcaagcatcatctcgatctccttgtgtcttgggtgtgtcttgcctccaacaaagaactcatgcaccttgccaccaacctcaatggcactacacccaggcacctttttcactcccttggccttcatcatgttccgaacattgctgacacccttccagttctgcgagtctgcatagatgttagagagcaggacatgggcggcatcattcttggactcgatcgccatgagcttatccattgcatatttccccagttcaacgtttttgtggatccgtgacgcattgagtagtgctccccacacgccttcgtgtggctccaatggcatgccattgatgaagttcacggcatcatccagacgcccagctcgaccatacaaatcaaccatgcaaccgtagtgttcaagccaaggatcaattccatgattgctcttcatcgaatcgaagcatgctcgtccctcatctaccaacccagccatggagcatccacggaggaccacgacaaaggtgacaccgttaggctcaacccctgtgctctccatgcgcttgaacagcgcaaggcagtctctccccatgccattcatcgcaaggccactcactgcactggtccaagtgtaaacgttcctttcgcccatgctgtcaaacacctccatggctgccgccaccgcgccacacttggaatacatatcaatcaacgcggtgccgagcgtgaccgacagccgcatcccacggctatgtgcacacgagtgcacccacttgcctcgttccagcgcgcccaattgcgcacaggcagtgagcgctgacaccagcgtcacctcccccacggcagcgccagcatgacgcatttcgtcgaacagcctcaaggcctcccttgaccggcccgtgtgcacatacccggcgatcatggcgttccacgcgacatggtccctctgaggcattccgtcaaacagctcgcgcgcagcgtccgcttcgccgccagtggcgagagcccccaccatcgcggtgacgcacaccacgtccgggctcgcgatctccgcgaacgcggcccgcgcggcacccacatccccggccgcggcgtacatggagacggccccgctctgcacgtgcgggtcgcccgcgtgtccgtggcggagcgccgacgcgtgcacgctccccgcgatcagggccgcgtccagcgcggacgccgcggcggcggccagggcggtcgcggcgcggacgaggaaggtgaaggagtagttgtcgggcgcgagcggcaggtcgcggaacgcgccgaaggcgaggtgcgggcgccggccgcgagcgagggcgcggaggagggagttgtgcgcgaggagcgtggcggggcgccgcggcaggaggaggcgcgcgtaggagaggtcgccatcgtcgtcgtcgtcggaggaggaggaggcgagggaggcgaggaaagcggccaggtgggacggggacgcgatgcggcccgagacgaggaggtgcgcgtggatctcgcggaggtgccgctgcgaggaggccgccgctgccagcttcgccgggtcgcggagcggtcgcatttggtttgacacgctacggcctacggcttgtgagctactctgacgaaaggacttcccgtttcgagcattcgccgcgcgcgggctgacgaggccgaacgcgactacgaaccctggcccgcgtgggagtggcccgttccatggaaattgctatacgtacgagatacaactcaattattggaactgagtttgatcgacggcagccatgcgttgaacatctgctcctttcattgatcagtggttgcatttgcatatgattgcgcccgtccataccactacactcgcagggctaaccgacgaaggaagagtgaaaaccagtggattatcggggaaggctcggcagagcctgcaagcaagacagtaacattttcacgttgccacggcgaatagcggcacctcgctttaggcctggtttagttctcgaaactttggatacatgtatggagcattagatatagattaaaaataaactaattgtgcagttaggggggaaatcgcgagacgagtcttttgatcctaattagtccatgattagccataagtgctacagtaacccacatgtgctaatgagggattaattaggctcaaaagattcgtctcgcagtttccacgcgagttatgaaattagtttttttattcgtgtccgaaaaccccttccgacatccagtcaaacatccgatgtgacaccaaaaattttcttttcgcgaactaaacgtgcccttactctgaagattgatgtgcctttcagcaagcctcctggaagggaccaagttcactgaatcacggtcacagacatgcaaagtagaggggagtaaaaaagccaaggagatactctgtgaagccttgcaaaatcagatcagaatggtaacctgcaaacttgcaagggctgctgcctactccagctctttggcgtgtgtaaaacaaacctgacaaaagtcctggacagatgttttgctgtcggattaatcttacttcctccgttcaagaatccttctgaagagacccccttttacaagcatcttggcctagagtttgatccatgcaaagaagtgataggttttacaagcatcttagctgcaggatagagtttgatccatgcaaagaagtgataggatgggcggtggtaaagttaaaaagatgcaaaactggggaacctgctagcttgcaaggattgacggccacaaattcttcagagaacagctgatgaagagcataaagagaagtcgtaaatgcaaaccctgagcaaagatgatgcaatgttgctatttatggggaaaacgcaaagcaagtttcaccgaagcactcattccagtcttttgccatatttggagaaacatggaaaatctggtgaactgtaaatgtacatctcttcgttgcttgattgcttcctccacaattaacttctttattcttgccttcgacctatcagctttgtaggactggtacattgcaggaacctggagcaaagttttttttttcccgagaaaatgacagcaaacctgaaaggacaataaacagcacaattatcttttgaacagcatactttcaaaggaatgagcccgtcactgcactccaaatggcaatttgatcaatttacgaggatgtgaaaacaattgatatattcatacataggatcagtacaagtaaggtattgtagtcgaaatatcagaattttttaacagcatgtaaacagagaggtgaggccgccatacggtctagaaaccaatgcacaacaactcaaatataaacttgtgtaaaagtacaaatcaagtgagtgctgttcacggtcaagtgagaccgtgaggaccacaatgccactactaaaatttaacgctgatgatcagtgaaacaccaaaccgacaagctatgccaaagcttctgtgttatttgctggaattgtcacccaatttctttttctcaagtcttgttctgctgactagaaacaaaaagaaaaagaaaaagaaatgctattctgactttaaactgttggagcacatgctttggtcattctactgcttagcatgctgcataatgtttccctactgataaatcatggggaaacaaactggctgcagaatgtagaagagacatagtccattaaacacggcctgatttcgcacatcatcaagacatctttgccgtgatacgtcagtccagacaggcaatgcaacatgtaactctgtcaaagtcacgaaaacagtttctttgccctaaaaaaatcttaaagagtataaaacatcgagagtctcttttatgcaagctctacctgaaggccactacaaagattgaaaggttcataaaaaatacatcagattttctctgttatggcattaatgttaataaatatagaggtctaaaggcccactgagtcaacaacataaagagaagaatatcaaaacttcacacactttttgcactgggttttcaccattattctgaactgggtttcactgttattatgtctaataacataagaaaacaccaggagactttttgcagattgaaaacaatgaatcaggatttagtccaagcagtgttttacttctttagaattccacataaatatggtcaaatcattatcattattcactcaaacagatgtccttactgcacacataggaacgataacggaactggcatttatccagcatgggcaatttggacaatttttccaaagactctgctaatgctaaaacctgcatggaaaagtttgcacaaaacctggcttctgtctgtggtctatataagacagctacagtatgcccaaaactttctacatcccagttgggcaggagagttggagtgttcttcaaggtcatccattatggtgtcctggaaggacatctacctcgttcttgaagcgacagttccactatatgtagctatgatactggcctacctatccataaaatggtggaagctgttcaccccagagcagtg

SEQ ID NO: 29649 - DNA, 5799 bp, Oryza sativa
  unsure (1)..(5799): unsure at all n locations
cattgtaaccttcacaaatagtgcaaaaatgaaaaactcctgcaaatgttatagatcttactttcaaaacgaaagaagcctgctagatactcaaataaatgtcgtttaagtgaccaatgtaagaaaatatgcattctatgatggtagctcaaactgatcttatagatgtcgtataatgcaatcatattattgtgaactgagaatacactaagcaaagagaacatagctaattctccgtttaatagaagaaccaatgaagtgaaatactgttctacttgcatcacttctattttaatctgcagtagcaactatagtgtcatactaacaggaactggcctactctgcacaaatatacaactaagtaactatattgtctagaaaccacctgtagtatttaaagttcagaatgaaacagagatttgaatcgctacagcccaatttaaagttgcctgtacaatcatttaaattacttcatttttttagataatccagcctctatatccaaaagtggatatacacagccaaggagaaattgcttcatactttttcattgtaatgcagttcactttacgcaatagatttgtctgaaacattgtacatgaacttgcttgaattatccagtgattgaagtatattttgaacttctttttcatatacgcctcaccagcaagcagcttaacttatcttctgggaatttaacttattattctttattaaattagttcgatggtttttatcccatgtcatgtttcaaaattgaagcagaatcaggtactagaggacctacacagcaaagatatggagatgttcaggcaaaaggtgtatcagcaagatgttcttgtgcttttcgctttttgttggtggttggtaagaagctagtgatgaaccccaacatgtatgcatgcctgataggtttaatttgggcactggtcggcttcaggtatgttaatgagtttatatgaatcaatttggcttcaagcagaaatgcagctgttattgacttacttcatacaactccataacatacccacaggtggcacataagattaccgttgattgtcagcaattctataaggatgctctcggatggagggctgggaatggcaatgttcagcctaggtaagaatagcaggatatctgattcagcttgatgcaatgcagataaacttctaaatacgtctaaactttgcgaaaaccaattatgttattataaattctaaatacttctaatcacaggccttttcactgctctacaaactaaaattatagcctgtggagctaaaaggatgctactagcattagccatcaggttctttctaggaccagcactaatgggtatgtcttcttatgctattggaatgcgtggagtattgctgaagatagccattgtacaggtatattctagttctttctttggacgagctattatttgtaactttgaacaattcaaccacagaaattacgattaacctgtcaaaatcacattcaggcagctctacctcaaggaatagttccgtttgtgtttgcaaaggagtacaatgtccaagcagatattctgagcactgcgtaagtagatcacctaccacgatacgatcctatgcttgtatatatgaagaagcagggaagcatcattaaccaacaccttacactgatctctcttatggcaggataattgttggcatgatggttgcagttcctgtggcgctggcttactactttgcaatgatcatcccagctatcaaataactatttgcagaagctagcctgattgtgttcatttgagaaaacaatgacggctcgctgtggagaataagttcagttatgagtgaatattttgctagactgtatatatatgtgcccttgggtttgtggtgaaccataataaggatatctgatttgtatcttagtgcatagtggccatacataattcttaccgtttcaactatgaacaactctaatgaacagaacatgtagagaaagctcacattccccggcgacgcggcgtgctctgttcctgtcaggcgctccgtccaacagacggtgcaccgtgcaccccgcccatgagctgctggcacccctgtggggcattctgccgaacatcttgcaggcgtacccagggctgaatagcagattatctggctcagcttgatgcaatgcaacagcagccaagagcttcatgtgcatcaaccatttcttggcctcattttttcctctccggagaacaattacatggcaatatggcattcacacaccgttcccttccaactgtggtgtggaagaacaaacagttcgcttcaccggcagcgtggaacttgcaactgttcgacattttgtagttgggaataagttcactttattaccctcaaaactgatcgaaatcgaccctaaaccacaaaaccggatatctcgacccccaaacttttaaaatcggtgtaatttgactctctaggcggttttggagggcggtttcgctgacgtggcgcctacgtggcagtattgactcggtattctttccacgtggcattgacgtggcgcttagttggcattagaaataaaaaaattatgcatgggacccattagtcattcacacacaaaaaattgtggggctcactgacatgtggaccccacatgtcatcctctctctgcctttcttcttcctcccctcttcctcccttctctctttctttctctctcttctctccccttcggctggccgcagggagcacgggcgactgaagctggagtggcggcggtcgggggccagagcggcggcgaccgcgggagctgaagcggcggcggcggcctcgccatcggcctcaccaagtggagagaggagaggagaggagaccaggtgagggaagaacggaggtggtgggtatgacgtccggggcggcggccgcggcggcggggaggaagccgacgtggaaggagagggagaacaacaagaggcgggagcggcggcggcgggccatcgccgccaagatcttcatggggctccgagcactcgggaactgtcgtcgttgtcgatctggtctcgaactggtactcggcgtggtcggagaggtcggcggtgacgactacgaggaggagatggagggggcgggcagcagccggacggtccagcccaccgccgacgcgtacagcaacctgacaaacgcgtcgttattcccctcttcaaccttcctcgattgtatacatggcagcagcgcagcacgtcgtcgtccggccatggacgtcacgggagctggtcaggccatggaggagcagtgagcggaggggtcgatgtcggcgttgggacggggcgatgcgctcggagccgagggcgccgtggggagcaacgcggcggagggggcccggcgacgctggccgtggacctcggcgcagagggcggccgtggacctcgacgcaaagggcgccagggcggaggagatccagcggagaccgaataagggaaggagatcaaatcagagcaaagggggagagagaagggagagaaagggagaagatgacacgtgggaccaacatgccagtggggcccacaatttttttattttgtgtgtgaatgacatatgggtcccacgcatattttttatttctaatgccacgtcaacgccatgtggaaagaagactgagtcaatactatcacgtagacgccacgtcagcgaaaccgccctccgaaactaactagggagtcaaattacactggttttaagagtttggtggtcgaaatattcgattttgtggtttagggtaatggattagatttcaatcgcttttgatttgagggtcatgaagtgaacttattccttgtagttgcgcaagataaaagcccaatgggttaaaccaagcccagtgtcacccacggctcaccagtattgtggcccactggtttgtggtcttcggattagcacaaaagtgggcccagtttagtctagaacttttcttttttcttttttttttcttttgcgaaagtttggtactacaatctttgagttctggacacgtataggtaataattaactgtaagtaaagttttgtactgtaacttaatactagtaattcgtggggaatctgtattactgtagacaaaagggggagaggggatgtgataatgacacggattaactcagtataatgccattttaccaagccaccaactcactccccaagaaagcacaaagccacatcaacctcaccttcttgcccccgaagaaaaagaaggccacggaagccacgggagagtgatctgggccgtccatctcacaacaagccacggcggggagagatctgtgccgtccatctcacaaccagctcctcccccacggccccacccccgccgctataaatagacgcttcctcttcctccccccctcttccccaccactccaaagttccaaaccccacaccaccaccgcgcgcccgcatttctccccgctcctcgcgccgccgccgccgccgcgtagtcatcgagtcgagcagaagcgttcctcctgccatggaggcggagacggagtgcaaggtccccggcgtctactccgagaccggcattcccgtggaggatccggctcccggcctcaactccgacgtcagcaagaaggacgcccctcctgccgttgcggcgccgggtcccggcctctacttcgagatcggcaagaaggccagaggtgtacacgcgctcttcatcttgtttggttctcttttttctgggtggtttttgaggggggggggattggtggtggcggttgctggcttgagcaaattttagtggagtggtttgctgatttctgctgcttttcctggtgtttttgcagatcttctgtacaaggacttccacacggaccagaagtttaccctgaccacctacaccaacaatggagttgtgagcattaccgatttccgcatgctttttactggttcctttcttgtggacatcttggctcgcttgctttcgattgtttgtgtgtatgtggtggtttggaatggtttgagtaggaggatctcggtggctgtgtgatgtgcgtgtcggagttgtgttggttagcggggctcggtgtggtccgagcttgtgtgtgtggcgggttgcggccagtgtgtttgtggaattgacctgcgggtttactgagttttggtctgatttgattttgagttgagttgggttgaagagttgatggatagtgcattttactttttctccttcctggtgttggatgagatggtgaatcggtgatcgaagcgtcgattgggtttttctgttcgattgacaggtggtcaatctgtcaggttgatgtttgttacgatgtttccactgggttttttgttcgttggatggttggtaaatctgtcaggtttcggtttggtgatcgaagaattgactgggtttatttgttcggtccatgggtggtcaatctgtcagtgtcaggtttcggtttgtgatggaagagtcgattgagttttttctgttcgatcaacaggtgatcaatctgtcgggtttcagtttgtgatcgaagattcactgggttttttgttggatgaatgggtggtcaatccgtcatgtttcggtttgtgatggaagggtcgattggggtttttgtgttcgatcgacaggtggctaatcagtcaggtttcggtttgtgatcgaagagtgctttggattttttatgtatttctgttagatcgatgggtggtcaatctgtcagcgtcaggtttcactttgttatagtaagatgcttccattccgttgccagtttagtgggttgatgngctacttgcatacgttggaaatcaacntcaaaggggcgg

SEQ ID NO: 29650 - DNA, 6282 bp, Oryza sativa
  unsure (1)..(6282): unsure at all n locations
cgcgcattagatctacttgttggacaccccnccatcatttagtgtcgcgacgcctactaatataataatcaaatatgactcttattatttgatttctgtgattctgtctataggtaatcactgctgcaagcacaatgaaagatgaagctatctttagcgagatccagaccaagctgaagagcaataatgtgatgctggatgtgaaagctacttccgattctcaggcaagtttctccttgaaaatgcccttcatctatcaaatgttatctgattattacttcctgattaaactcgctggtgatggactataaattgagtcagtagcttatctactggtgattgatttgtgtttaacttttcccaggtgttaactacaatcacaactgaagaccttggtgtatcaggcttgaagcaaatcgtatcacttccttttccataccagacagctgggaaggtatatgcatcttcatctctgctagattggttgggtcttttagatttcaaattgacttaccgtttgtgactctctgccttgtggttgcaggctgaactccagtacctgcatgactacgctggtatcagcctcggtgttggcctgacctcaaagcctttggttaacctttctggtgtgttcggcaacaaatctgttgctgtcggtgctgatgttgcagttgatacttctactggggacttcaccaagtacgatgctggactgaccatcaacaattcagatcttgctgctgatctgacgctgtaagtgttttcttctaacgtgcccactgtaacactgttaagttgcttgcaattttacgattcatgtctacaatataaccatgtgcgtacctgtttgctagcttgagcatacattcctcttaatctgacttctcagaaactcctaatcgaagcaaattttctgtaatgttgcagtttctcttttgtatccatgcgtgaaatccttggcttcccattttcaggaacaacaaaggggacagcctcactgcgtcctactaccatctggtgaacaaagagtcaggtacggctgctggagcggagctgacccacagcttctcgaccaaggagaacaccctcagcttcgggatgcagcacgccctggaccctctcactaccgtgaaggcgcgctacaacaaccacggcatggtcagcgccctcatccagcacgagtggagacccaagtctttcttaacgctctccgccgaggtcgacaccaaggcgatcgacaaggcctccaaggttggactgtcgctggttctcaagccctgatgccccccctcctgatggcgatgattcgatgatgacgatccctttttttggtatactagtaggacaggatggtatcgtcccgtatcagcagctcctgatgtctagtgaaactaagtctggttaacctctttggtgccgtggcatctttactctggaaacttggcctcgtagcatcattctgagtatttcccacctagtagtagtagtagtagtagtagtagtagtagtagtatagtgtttccccgtggcatgttttagaagttaaaactgaatccatactaatgttcttgtcactggcatcttgtctattgttggatatcttactgtaagctccatgttggtttcaatactacatcgaaaactggtgcaatttgaaatgggagatgtctcaaccttttatgatccactcacacacactgcaggaaaaattggtactaacatttgcagatagcaagaaatgcatgcacttcatttatttatcgccaaagtgtatcacatagtattacatagctccaacatggtggaggtatctctgcaaaaatgtataaagaacatgcatacatcaacaggcgaattgcctgcagacaaattattcacaggataaccggtgattctgcatgatcaaatgttcgaatttacaatgtaatttcactgcattggtgaaatcttttcggtaggacaagtggttccattgcccttgctgtccacttcttttcttggtaccatcagcaggatgccgaactctagctttgtgctattcagttttccttttgtgagctataccgaatggttgtatactgtctacaatagaagttctgcaagtaccagcgcggcaagtctacgatgacacttcccagaccttgtaatcctgtccctcggcagcaactacccagtttgtggggccgcttggctcaaaatgtcctgcgccaatcttcattgttaccctctcatcaatctctgccgcatataaatttccctctgctttcagtatcttgatctgtaaatgttatataaattcaagcattacagaacatgaatagagtggggaagggcaaggagggtaagagggggtaccatacgatacaagaggaagttttaccttgctacggcaatggatcttttggcgatttctaatagaaattaatttagcaatctctggctgtaaatgcgaaaatatatgatcatagaagattgcaggagtgcctgggtgagttaagatgtagacatagccttgcaactccataccaaaggggaatctccaatgaccctacaaagatatcaaagaaagttagccatgattttgttcgaacacagcttaacagctccagttataatttgattagtatccataaaagcattccagtttcaaaagagttctacaaggatgggctgagcaaaatttagttgtttgaaaacaagaaattaagcagcgttcaaaaaaagggacaacctatctgactattattaagaaatgcatgcaggtcgttgcacatttgtgatgtttctatgccatgataccaattatttgatgtcagataaaccaaaatcatgctgccatatagtaaccttctgaagataatgctacggagtaatacttatttgtgtatgtagggattttgtaatgtacctgagtagaaccagtgtcatgattttctataaatgtgacagcacgcgaaggccaccaacctaacactccagggggttttcctttttcatcagacagacgccagtactcagatctttccagtgcctgtataccagaaaagatgtgtaagacaaaatatgcatggctaatccagagcaatagcatccttctcaaactggcagaattggctattacaatcatggatgagttaactatcatcagaaaaccactttacaacagattaatgagactttaaatattgccatggaacaggaatactgccaaagatgcaagtttaattaatgtggttcagcatgctgcgtcttcatagcagcaataaaactttaattatcaaataattgaaggacaaagtatacctccacccaaaagaaaaatgctaaagggcaggaaattcttcatgatgcatatccgaactgagaagctcaaaccatggaaaggcatataaattctagagtttcaaaaatactaaatcacccataagcactattataaaacttggtaagaaaatggagtctcacagagtgaagtattcctttcgtggtaacatcaaatgcaccagcagttccatttgtagcatttatccaatcaactattctctgcctgtgggcatcttgattataatccatttcaccataggtgtaactgagagaatcccagtactctctactgcaaaatatggttcgcttgcttccaagtaatcgtggacatatccaccccaaaatccgcgaacaaaatcaagtcgccatcaatcgtatccaacttcctttctgcaagtcaagcagaagcaaacatacaatgaagtcatctgatgctaacgttttcaggaatgctgctctaatgctatgttctatgatttaatttatcctgttcagctaatgaaaatatgcagcaaccacattaggactagtaagctactgttcccaacaatactccctaataaattggctccaagaaatagtttcagtattaatgagggtaaagctcctgcaatatcttccccttttttttgcatatgtccaagcactacacaattacatagatacagaatcgatcatccctaagctacatggcaaaaatatatatacatatatatatggtggaacccatgacaatttgcagatattcaggtgtagcatttgtccaatccagtttgttattataggagcttagcagcctacaatatatacctattatcgtagcatgaaaaagaatcttgtgatattgatgaggatgtgcactgtgtacattccattttgtggtaagagcaaggtaaactaacatatatgaaaacatagctttgaaaagaatgtgatatgaggaaagaaaactagcactcagctaaacacgccatccagaaacaatgtatgtacatcaaatctatttaatctgttgcatggggatgctataacatacaacccttcgcatggggaatacacatatatagttaagcatgagcaacaaaaggagttttagccaagaaaaaacaagatagcatacctcatccaacaaagccattctttaagatcactcctcacaaactcttgcgagtgatcaatgtttggggctgcatggaagttatctccactgctcttgtttcctcttccctacaaggacatatagttttacccaaaaattagaaagtaagtctagtacatcacatagtgcattgttaagtaaaatgaaatggaataggcatgtagaacaatattatgattgatcaatgttcatggctgctgaagtttgagtatgtcttttttccattttggaactatgtcaatttctatgttatttcggatgctaatctgtgtttacttccaatactaaatgtatgcaagttgaaaaggtggagtctatcaaagtttgtaggtcactcaatgagactatctccaagcatcatttgttggttaaattaagcttattttcgcataactttatcaagctccactggaggaaaatatttgtgcaaatgaaaccagcagttcatgaagaaaatcataatgttgtgatacttagttaacataatgaacattcatgaatgacattttcaaataattctaattaaatagtttgcaagggaaggtggaacctcacctggaaatgtggatcatctgcaacaactgctcgatcatcccagttaaggcgtccaccaaaaatattccagacgccattttggttctgaaattgagcacacctgtgattcaggacggcatcaccaagaaccttcataccggcttcatgaaaacgtttcacagcctccttcaactcttccatggtcccatatctgaaacattgatgatatcatattaatgaatggcatgagctgacatgatgggttcatactattatgctgtataaaggcatagatctttcagtgtcataattttccctttgaaaatcattgttttttttttttttttggaaacaaggaagacaacaactaagaagcttcataagggtagtcaaaatcaagtaggatgagagccagttttctggacaagctatgatgcaccgatacttcaatttcttgccgtaccggtatccgatacggcgatacgtccgatactctgtcgatacggtatcggaggagtatcggtcattaaacaatggaaaaaaaagaaaaaataaataccgatactcacacgatacttatcagatacttctttgatacctagcagtgtaacctccttgttcaatagcacattaaagacccaatgctatacttctgatatatttataactttaatatacttgctatatttgtaatacaaggctatatttgctatattttttgtaacaggcaacaattcatagaatatattttaagataatcttattgctttacccttttgtagttccctatattttatttttaaacatatttttatatatactcgccgtatcgacgtattgatgttttttaaaaaatctcgtatcgccgtaccagtatcgcgtatccatgcatcatagtggacaagtgatgcctcaagcgacatataaatatttattgcatagtggtggtagtgttaaccatagaagaacaacaagctactgcagcagtaatagtgcctttaatagagattttaggggtataaaaggggttttctcctttagaatccatatgtgaatttcatatgctacccaggttttcgtttctactagatagcgtagtactaaaatcttcagcacaagtgctatatgctagattgtagaaggttagctgaggtaggcaatggagaattaccagtagattggtttggaaacagcaaggaggaagaagcttgagtattctatagtgtcgcgtaaatgactggcgtaaaatnnggnngcaatgcgcg

SEQ ID NO: 29651 - DNA, 737 bp, Oryza sativa
  unsure (1)..(737): unsure at all n locations
gtggtttgatgacagctcgtggaacagnacctcatcaaaaatcacaaaatcactcaattgctatcccaaatcaaaatcaagaatcccctacaaaatcaacatcccaaataaaaaaaaaaccaaaccctaaccctagccacctcccacagcagtcctacccgtggtcgccgccgccgccgccgtcgtcgtctgccgctgtggtcgtcatcgccgtcgtcgttgccattgccgttgtccgcataaccggcttccaccgcgaccagctcccgagcccaccgccgctcctggccgcgtcgccacactaggaatggggccgacaccggcactgtcgtcagatccgccacaggagggaggcgaaaggggtcggatggagccgccaccgtctgatccgtcctcagccgtcaccattgcgggcggatccacctgcggtcgccgtcgccggacccatcacgcgagaggcgtgagagagggcgaggggaatgactgtagggaggaagagagggagataaacttccggtcaccttcgatagaataggattgcattgggccacaactgaaattaattaacaatctcccccttaattctgccgtgggcctagtgaacgaacaccaagaaggtgtctcggcgtcgccagcttttgncgacggcaattctttcgttaatgcattcgcccgctgcttcttaatccggacgaactccacaacaattttgccgtcattcacacacttccgtatga

SEQ ID NO: 29652 - DNA, 75695 bp, Oryza sativa
  unsure (1)..(75695): unsure at all n locations
atggccctttgannattctctnnnnnnnnnnnnnnnnnnnnnnnnnntggccagtttcctatcacactccttatctgagtggccaattaaaccacatatgaagcagaagtgtggcactcgctcatatctcaaatcaaagtgccgaacgacctcattaccttgaacattgattttaatggctagctttgttttcaggggacgcttgacaggaagatccactcataagcgggaaaaaaaatcatgtttgttacgcccgtcatcctccacatccacttccttgacctggccaagtttgcttccatataaaattcctctttctttcgtcattagaaccagcggtaaatcatatatcctaactgttggcggctattaaatgcctattctatgtcgccagtacctgcataatacttggataatacaacatccaacatagtgataggatttaactctaacatattccacgagtgttagtgtatatttggatgcaagtaataaaccactgaagttgggagaaaatttagattaaagtgaagaataattctattcatatgagagttgggctcctaaactccatcaaaacagcaaaaaatgggcccaactactggagaaatggataaggaagagcgaggaggaggcccagactaaatctggggaccatctggcctagcccaggttggttcggtcgaaccctggtgaccgccgttggatccaggttttggtttagacacttcagacgctctcttgatggcggttgcggggtatttttgcaattcacatagttacaaccgtcataccggcttatttaaggagttcattctttcacttctcacacacactccaagcttgagttgaattataagaggctctattgtactttatgtatactagaattagggagagagtaaagtagaagaagtcgaaggaattctgaatttgtcagtaatcctcttctatttcttatactttattaattattctgctttaatagaaatatcattatgagtaattaagatttacttcgtgagaattattcttggttagttcctaattagcgcgtgggatcattgttcactatagtccattaatttatattgattgctttagtgtttagctagcgctaaagtagttattaattgcgtagacgcggtgtctgagtaattaacttccggtgattgcttcgtatcccacaataggcttgaggtgggtgtagaggtggtgacagccctcaattacaagtcctccctgtccgggtacgcagtagagtgacatctgggagtagcaggatggtcagtgcctgaagtatcgcgttaggattaaactgagttttccgtagacactgtttcttactagtaaatcctctctaccctttgcctacatttgcttcatgcccttggatgagcctgaagagctgaacacacatgttccctgatgaaattgataccttggaatactctcagatgaagtgctacattggtatcttccgtatgcttacggattttacctgtgatgttaagaaataccaatactaacctagatgggaactacctcaaggggaacctgtgacggactagtaattccatcaaactttgccaccataagagcatcttctctgtgcagccatgggcctccctgtacgatgaactggtagacaccctccactatgaaagtaacaatgaacaaattgtctctcagagacttaaacttatgtcagatttcagcctccacgcccgtggcatatcatcaaaaagagctgtctgattcggcgttttcagcgaataatatcattccaggattgaccattgtcctgcttgcttgacctcttcttcctctaaattcacctcaatcacgtcctcttcttcatagacttcgccttctgtaaatgctccaggtccctgcaaatagctatcttgctcttctctttgaaccgagctttgagaggatataaccagcttgcatttatccccctatctttgagaggatataaccaaagctaaagcagttggatcatccaccgccatcttatccccctacaacttgtggcacatcttggccatggcgtcgctcgacggcttcgggcaggcaaccttctcaacgatggtccctttatcgcccccaccgtcaaaagacgtcatggattggatcttgttgcctcgaggactaaaccctagaaaccaaagcagacctagcacctccatggatttcacgggttcaaccagtagcggcgtagtcccctcagctttatacgcttcaactaccgagtccgatttcttcatgatctcaaaccagaaataccatccacgatcatatttccaacgtttcccaatatgagatcccatatgtttgttataggacatttgcttatttgaccctatttcgaagcctaactaccaatttagccctatttttctagtttgcttatttgaccttgtttttcgaaaacaaacactccgtttgattctgtttctgccacaccgttaaatatccattaaaaaaaaagaaaagaaatataattacatttcgtaatgaccaaaataccctcgaaccctatccagacaaccctatccagtctctctctcttgtattcttccttctctctctcccggcgagtgacgcggtggcgctggctggtggagggagcaccgacggcggtagcggcgggccgtggagggaggggatccgcgccggcaccgactcgcggagggagggcggctgtgccggggcgtggatctacggtggtgacggctagtggagggaggaagcaccggcggcggtcgcggcgggccgtggagggaggggatccacgccggcggtggctcgcggggggagagcggatgtgccggggcgcagatctgcggcggcgacggctgggggagggagcgaccgccgggccatggaagacggggatccatgccggcggtggcttgcggggggagagcggctgcgccggtcgcaagtggaggtagtggcggcgcggccatcatcgttccagtgttcgatgtagtggccttccatggcgtcgaagctgttgacgatgaggccatggctgccggcagtggtctttcctagcttcgcatccatctccacgatctgcgtgagaaagacgtgcgggaactccagcacggggaacgccgccgcggcgccgcgcgcgccgtcagccaccaacacgacttgcgggaacatgtacacacttcgcaccaaagaacgccaccgtcgggaagatgtcaaattgtcttgttcacttcaatttgtgaaaaatctgtcaaattgtaattaaatttatcaaattgattcaaatttgtcaaattgaattcaaatccgtcaaacttgtattgaatgtgaaacatatgtcaaattaattacaaatttgtcaacagatctgaatatatacatgttctgacataataaaatagggccaaataagtaaggacaaaaaggactatttgctcctaacttaacaccgttaactcatcttaacggaatagggtcagatggtaggttcgttttcgaaaagcagggtcaaataagcaaactagaaaaagtagagttaaattagtagttaggcttcgaaacagggactgtgtttagttcacttcaaactttcaatttttccgtcacatcaaatgtttggacacatgcatggagcattaaatatggacgaaaaaaaccaattacacactttgcatgtaaattgcgagacgaatctttcgagcctaattacgccatgatttgataatgtggtgctacattaaacatttgctaatgacggattaattaggcttaatagatttgtctcgatgtttacaagcgaaatctgtaatttgtttgttatgattaatagattcgtctcgctgtttacaggcgaaatccgtaatttgttttatttttagtctacgtttaatatttcaaatgtttcaaatgtgtatccgtattaaatttttttttttgccaaaacaactaaacacggccagggtcaataagcaattgccctgcttgttatagataccatagtagattatctcatctggtatccttaccttatccgctaaagatttattggtatggcggctgtactgggaatcgaacccaagcagaagaccaaaacagaccttccaaactcgattttccaaccggatcacacccacgggtgaaatccctgaagcgtttttctgcaaatcggagtagaactccatctagatccatctctacacaagaaaaatggctgccgcctcctggtcgcccaggcgccgccaaaaccctagcattccgtaaaaaacggagcaaattataataacttttttttgggggaaattatattgtaacaaatatatgtataaagttatgttttaatttttagtatttatattaaagttataatttagttatagtataatctatctattattatatactaaaaatccattaaacttcctgcaaacgctctgaaaccgccacgtgacacccctacaaacgctcctataccgccacgtggctctctaataaattagaagaattataaaaaaagcaaaacatctaatcattggttttcatttaatctggtggacccattatttttaaccgttagatatagcataaaaatgtcaattagatttattatcttcagaaagccacacatggcacgtacgtgtacgtcaagtacgtacgtactccatccgtccaaaaaaaaaggcaaaccctggatttccgtgtccaacgtttgactgtccatcttatatgaaatttttttataattagtattttcattgttgttagatgataaaacatgattaatattttatgcatgacttgtcttgttaatttttttcatattttttttaaataagatgaacggtcaaaagttgtacacggaaactcagggtttgtctttttttttacggacgaagtacatattttgtacgtgagccccacaccttattttctatttttcttttgcacgaacacatgaaaaaaataaaattcatatttcagcccatatagttcggagtatgtacgttgcacatcagataaaaaccacattaaataattctaggcttccagcccatagttatacaaatataagttattttgagttgtattgtactctactcacgtcatcgaaatattcataaaatatctcaatatgtgaataatatacattatataattatctaattgtatatcacttaataatatgtattaataaattagaatttcattttcaaaaataaaaacaaatccagttatgagtaacattaaaaaaactccagttgtgagtatcattaaaaaaattactccctactataagaaaatactgttatatcagaataatattactaaattatcataattacaccctaccaatcaaatacctaataattaaaaaaattactaaaacatgataaaaaaaacacttgaaaaatattagtgcactaaccatctacactattcattaaaaaaaaggaaagttatttttttattaattatactattaataattttaatgttatgatttaataagtaataatattatttatttgctatttttttattataccgtttagccattcgaaaaagtgctcgctacaaataagggagtaactaatcccacaagcattttagaacacactcctaaatttattacacttagatacaaacacaatatgtactatacaatatacttggtcaattctagcctaaaatatcagttgtatatcctcactgatctccatatatgtaagttttatatacgagccattatccactaatcgccaagtcatattacttacgagaaatatcaatcgtatatactcattgatccctatttatgtaagttttatatacaagtcattatccactaatcgccaagtcatattacttacgaggtatctgtgcacacagtgcatataacgattagctgagatctaatgagcatgtgtgtcatcaaacactgaagataaggcaatactaagtgcgaaactgtcaacaaattatagataagtagaggatgcaaccaatccaccgcaaataatagttgactacaattagattgcgacaacgagtaatagcattcctacactcctatagatgcttataagatgtcatgtgatgctctaattagatagaatctaagaaaagttataaaaaagcaaaacatctatcatcgatttacactcaaaatcggtgatccattattttcaaccattaaattagatatatgacagtaatacatttgccctaaaaactgtccaatctgtccttacatacacacacaactcctacatatgtacgtacgtacgcaagagataaaaaagaaaaaaaatagtatatgatctatcccatctagaagttttcttcctctttccaactataaggtttttcccaaattgatcatatgcatagcgacaactcctagcgatatggaaaaaaaagacatgccatggcgccgcctcatgccacccattgctccaccctcttctcgttaatttatttgaagtatttttttttactaacgatgtaaaaagcaataacatgagctcatataaatgcgtgcatatgcagtgtatggatacacatacgtacgctctatccctatccctatgatagacaaatatttgttcgaacaagcataggtgaaatagatgtatactatataaaaaaaataaaaacttgtattaactcatatgttagcgaagatcacaggttgagcaaatattttttacgtggtcctcaccattgactgaagctattagatttgaagtaggatcgaatgatcaaccgagctaatttttaaaagagaaataaattatgtctactctatacaataaattgactcaaagacataaaaaaactattttcatcatctccatcttctttcactcacaccctaaacaacgccaagcatggatctcaattgacctacttaccaatgcaattctttataaaattatacacctcgcttatcttgaggagcgcgactatatcaatgcggaacccaagaataaaggcatcaaagaaaaaatcttaacggctaccatcggcttcacccgatgacttttaaagaggcattgatataagtttaatgattttatccagttaattggtagaagcggtatttttaaatatttatatatagatttgatacctgtaagttattgtatttggtatgaggtagagatgaacttttttggtattaatgatgtatttggtttatttttgatacatatataattctatctattaaaaagaccttcatatttaaagacaatgatagtaagtagtggtgataggtgagaacaaaaagatattcgtattatttagtatgtcaacatctatggtttgcccctccccctcaaaaagacccacttttggatttgaatatagatatatatgtccagattcaaacatagaagtgaatattttttttttttgatggaagggagcattccttatagtgaatatggtgagacaaagcttcatttagtattttttttataaacaataaataaactacccgcgcatgtgcgcgggctttcttactagttatattaatgattatattataattttagtacagttaaatttgaaagtttttcacattaaaaacttgcggcagttttctttagatatatagtctttttcaagtttatgtttatctccattttcaacaatttacggttgagaataacgtcaatatatttgacattctttttactcgacatgtcggtaaattccaaaagtatacattgattgcagtatactgcagtagattcttgatcttaggattacatgcttgccgtacatcttaattagcacatagctagaataatcagcgtgttaagttgctcagggcgtactcactggccggccactcctggaagccgaagccggtggcacgccggggatcaacggcgggaggaggggcactggcggtagaagagatggcgggggcggtggaggcggtggtgggttgagcaacggcagcggcagcaccggcggtattaacgacgatggcggcggttgtggggtgagcggcggcaggattgatggtggagatggggtggggaacaccggcgggacgagagacggcggcgccggcgtgattggattcggcggaattggcacgccgccgatgttcggcggctccggcacgagagggagcggcgggaagaagatccctttgtcgtcgcagagctccgggtggacggcgaacgctccggcgttgaagactcgggcgccgtcgccgccgttgtgcttcgtggcggcgaggcggaagcctctggcagtagcggcggacgtggcggcggcgtcgtcgcatgggcgcgccgcattgctggcgagcagcttcaccgagcacgacgtcacggaggccagccggctcttggcctccggcggcaggtggacgcggaactcgccgcgacggtcggtgagggcctgctgccggaagacatcccgaccgttgccgtcgtggcaccggacggcgaccggggcacctgcacgcatgcgcaactcacgggcaagagaatcatggactgcaagaagtggacatggctgaaagcctggaacgtttgagatggaggagaaggcccctgcgcgcgcgcacctgataccgcggccttggtggcgtctgagccggagtggacggagccgacgacgacgacgacggatgacggtggttgccggacattcttcccgccatggtgagcggcgagatggcagtggaagcaagagatgaccaccgccacgagtagcagctgccaagcgtgcattcgagcagtggccaccatctttaggctaagaatgcgaggtggattaatttgtgaacgtctcgcctgctactatttatgaacgtgaggagaagaagaatcgagaagcacactgttggatgcccacgtagccagccctgttaccaacttaccattactaacgcgcgagaactggagaattactcccttcaaaaaaaaaaaaccctggagaattatttttattatttaatcctttttattaaataatttaaaaaacaggccctccaaacttctcatgtcatgccaatacttatggcatcacagtgtagcttggccacgctattcagactggtgtagccaaaagttttagtttggaaaacaaatatttggagagtctatttttattttttaagtaaaaatggttaaataataaatagagtaaattgtattgatggtacacaaacttaaaaatggttaaataataaatagagtaaattgtattgatggtatacaaacttgttaggcgagtgcaatttagtatataaacttataaaatgctcatttcggtaaaagaacttgtctagtttgtgcgaacgaggaccaaaatagcttgcaatgttaattttataaagctggtgttgattaggatgtgacgcccatacgtgtaatgagtatgtataagacatacaatatttataatattggtctctactttatccttcatcatggaaacgatgaatgtcatatatctctaacccttatatcattgctcattttttcatatatttttctatgttcactatatatatcccgttctattttttattgtagaggtgtacggataatagcaaccttctcaaatatatatgtatacatagtatcctaatcagcccctattgaagaggtgtatggctaatagcaaccttctcaaatatatgtttacatagtatcctaatcagcccctaaatcaataggattatccatgttcgcctttctttgcacgcaccaaacaagctcatgcaccaaaaacgagtattttacaagttcgtgcattagattgtacccacttgacaagttcgtataccttagatgcaatttaatttactctaataaaaaaaatcagaactgggcaggtaaaatacgaacgaatgtttttttaagacgagacgagggaggtggtaatacattactacatctctccggctgctcgccggattgtattactgtagaacagtttccatgcacgcacaaacgacatgacatatacgtacacacaacaggcagcagactataaattaatatttttataacaaataaaataaatttattatgatcatgtgtgtgtgtcttttacacaattgatgaatagttagctatcacaccctaaagtttcacatttctttagcctcaattcaattaataaactgtctcccaagaattaatttgaattaacctagagctaaaccctaattaataaatacaattaataagtggaaatggtatggtgaggtttttcttgagttccccatgattaaatacatcaacatgatttttactagaatttccaaagcaaaagaaatcattctaataattcaaattcgattatcataattaaattaattgttattcttttttttcctctacttctctcctcaggtcgcttgtcggacccttcccttacctccggccggcggagccggagggtgcaaacgtcgctcgcatgtcctgcacatctcctgcgccccactccaccctttccgtgcagccgacgcgctccactccccgcaactacctcccactaccagaaacattattacctctgacggctaaaacccatcacgaataaatgaaaaaccgtcaggaaaatcggtcctgacgtgtcaacgtcaggaaaataccgtcagaactagcttggtggggaaaaaataatttgcctgacgtttgtccgtcaggaaaactattcctgacgtgaggaaaactattcctgacgtgcgctcacgtcaggaatagttttcctgatgtggattgcacagtcaggtggtttcatacacgtcatgaaaattaatgaccgtcggtagtgtcaactactcccgccgcatgtcgctcccctcaaaatcggtgggattagattttcaaatctggccgatgtctctctctccctctccactcccatgtccgctgcaaaatacgcccccctacttgccacatccgagctccctgccactatataaacgaccctcatgctcacctccttttccctcatccgtcgctcgctcccgtcccataactcgcgcccacgccgccttttcgccgcctctggtcgccactagccgctgcgctaagccacgccgtcacctccaccgggttcgcaaggtcgagggctacctcagccgccgttcgtccgtcattgtccgcagccataacacgccttccctcagttcgccggtgagccctccatatccaccgcctccggtcggcaatggttgccgccgtggcctctcaaacccctctgatcttcttccctaggtcgttctggagcctgtacaccccttgccgccatcgttgtcgtcctccccgtgctggtcgccgtcgtcgtcggtgaggccctcctcttttcctcctccctctccttgccgtgccgccgctcgccgtcatcgggccggcttgtcccgagctgcgctccagtacccgtggaccggtggtggaccaccacggtggtcccggtccacagtggacctggtgctatgtcaccgacggatggggaccgtgtgtcggcacccccttcccctcgctgacgtcagcgtcggcctttaatgcaaaataattgattaaggacttttgtttatagtaaaaacacaatgaatcttctagaattcatatctaatttatttgagctccgtttaagtccactcaagtcttagtgaattcataaaaatgattagaatccattagaaatggtttcatttcctgtttcagtggacttatatagcctgttttgcttgtgtgctttctttgtcacatagaatctggcagttccgacactcacgtctattacgaagtggttgcagaggttcgagcagcaccggagcaaggaaagtcatgcattacaattgatcatattgtacccaatttgtaaatgtctcgctttctattaaatgctacattattttacgatgtcatgtgagatggttcctattacttagccatatgttgtttacctcatacctttcataacttgggatccaatatgattagatattggtttagaaagtgcttagccatgcttagatcaacaagctcttgatggggaatctcactaatatcttagaccttgattatttatgataactttggatatgtaccaccatggtattaattaaactaaaatatgcttaatggtgggccgtgggtgcatgattttgatagacgtgctcatggcatttaaggattggttcgcgggttaccctagaagatttaccatatttaccagaagccagcatgaacaacggctgggcttgtagtgtaggttttccctagctgacgtaccaaggcaagggtgagcgtgatggaatttggatgggccctgtgatggcctttgtggcttttggattcacctaggcacaagaggggatacctgacttggttataaaggaggaggtgatcgaaacctgaaaagggtacaatttgttagggagggttatgcgaagggtcctgtcacagtctccttctggtatgttatggtggtatatcatgcacggaaacgtgtcgtgcggctgtcttgtgggtacagttgtacacctctgatcagagtaaaactattcgaatagccgtgcccgcggttatgggcaatcaaccagactcgccgtgatttgtctcactcttaataatttgacttaatggaactagtttagttcaggtggttggttgggcctattgcgatgtgttgtagcattgtacagtgataattaatattgcttaattagcttgaacaatttactactttcaacttctccttttaaatgctagctttatgcaaataacccttagcctcctttggaattaccttgcatcatacctcctcttggtatgacttgctgagtaaagtgggtagtactcagtcttgctctatcttcctcacttcagaggcagagtacttttcggatggaggttactcagaggattaggctcgtcactgccatcaaggatgcccgtggagtagagtcgccacgctgcgagcgtcaagttgtctagtttagctcgcttttaactccatcgcatatgtaggactttattacgtttataagacatggatttgtgtatcaacttgtcgttcgtgtactctggttggtcctggaaaggggttctaatacacattctgcttggaaattctgattcgtgaatttctggggtgacttaagtttaaacaaaagcttaatcaaattgaacgacaaaggtcagaggagctttcaacagatagagctactcatagactctctcgcttttcaaatactttacgtacctactctagattttgaaatttggtagctgtaaaaatctaaaaataaataagtagccaaaagaaacacccagtttctatttatatccactagctgaatactcattaattgcttctcagaatctctagttctctcagtaggaaaagaaaactcttgctccacaatcacctcctattgtatggctctaccgcactagtggttacaattttttttcatctcttgaatgtaagttttcaaattcatccaccactttgcttcagactttttaagtactcccttcgtcgtttcattttataagtcgtttaatttttttctaatcaaacttcttcaagttgatcaagtttatagaaaaatatagtaatatttttaacacaaaacaaatatattatcaaaatatattcaatgttagatttaatgaaactaatttgttattttatactccctccatccataaagttacacctatttcacatttgagtttttccaaataagttgttcctatttgtagtctttatgcattcaagacttaaatgaagagataaattaaatgttttattagaatccatggagtcatctaaatattcattggttgcatgcttgcattcactccttaattttgtaacatccaaggtgacttaagttctccttggtcttggtgtcaaaagtaatatgtgtaacttttgtagatgaagggagtatgttgctaaattttgctataaacttggtcaaactaagatagttgccttaaaaaaaaggtcaaacgagttatactataaaacagagggagtaacaagtgaaaattcagagatatatatatatatatatatatatatatatatatatatatatatatatatatatatatatatatgtctagaaaacaaatgatattttctttatgtgaaagtgaacaatcgagtgaatcaagtgaatcaggaaagtcaaaatgttttgtcccatacattgaatagcggcttgtcggcatgaaagaactagtggatataaccgaacattcctctctacaattatagcacaagcatcgctagatggaaattcgcctaaaaaaaaacatcagtacatagaatggctttagatctctgatgaattttgacacagtcaccttatatgtctgtactcgtataatttgtatacatcgatgacgcttcatatgtccaaagcagacaaactcactccatccatacatgcgtataatagaaattaattcgatcagcccctatacttgagagatgtatacgaccactacttttatcagaggcctgcaacagcccaaaaatcagtcatctatgcactatcctaagcacaaactaatgaatacaatcgtatggccagaaaggcagaaacaaccagccgttaagagaacaaccaattgacacacatgagtcgacgtctacacggagggatggcagtgttttgggaggttatgcgccttcgttgtcagggaagagaacaaatatacatacaagtttatttggcacactcgtgactcaccccattcacagcttcacgtgcagcggttaggaacgagtgagatgctacgtggcgatgaaactgttcagcgagataatgtttccgatgattatgtagcgattggctccgaatttgtatgcggtgcttgcctaaatgcctgtccatttgacatgtgcctttgttaaccttattgaaattgaaaattagtttgtgctttatcgtagtgagcattgcttatctagtaagtattttaagaactccagttcaagttgtatgcttcatatgatcctcgtatttatggctaattatttttcaatgataaactcataatgactttatcaatatcaaaatataccggtacagtctttcggagatagagatgctcctggatgtacggttgcactactatagaaataatttttctggacgagcatctcaatagattgcagacagacaataggtgtcggcgtttgtaaaaattgacccctactttcgcatacggctatttaagagacccacaggtaaaaatcaattttcgtatgcgtgccacttaacatgtccgcatgcgaaaatacccccattttcatatgcggccttcactactaggaaatcgggcttatgcaacggctagaattcgttgcaatatgcccaaaatcattgcaataggagaaaatgcaacggatttttgtcattaggactcgtggcgcaaaactccgtagcaatagggtttttaccacttgatcactttgccgttgcaaataacaacttattttgcaactgagtgaaccatggcaattaacaaataatgcaacggtgggttggtggtaatagaacgtattgcaacatctgatgtcgttgtcgtaggaactagtcgcatcgcagcaaagcgtggtaataagtgcttaatggcgttgcaaaatgtgtattaccacggacctcaaatgtggtaataggtcgacctcttgccatgctcacaattttagttgctatagatagatcccactattgccacgctatgtctcgttgctatagctagaccctttattgccgctcaaaatatttggttgctataagtgggcacctctattgccactagaattatttggttgtgcacctctattgccattagaattgtttgtttgctataggtgggcatcgctattggcacaattattgtttgatggctataggtgggcacttctattgccaaccaaacgtcttcgacgatataggtgaacccctatattgccacgatgatggcgtagttgctaaaggcgggcatctgtattgcatcgataaacaagtgggctaagcccatataggcccaacaatcaaacacaataacaacccatatagcacaaaggttacagcctaattagcatccaacacaacccgacaaacatccaatacaacacaaaatttacaacccagttaacagccaaatccagctacattccaaatacaatcgcagcaaccaaaatttcaccagatgccgcgtgaccatgatcttcgaagtgagcttagcagcactgcatatgcacaagttaaaacatcagtaactgccaagctgagctcctgcaatcaaaaagtacccggagaacaaaatcacagtagtacaccatggtaataccttaagttttctatcaggcaacaatcttgttttgatttgtaaatcgaaacatcacccccaaaaaagtaacctgagaaggacaaaagtgattactcggtgatgccagagcaacgaagatcacaaagcagttattgccatggaataaaactatagcatccaccatggaagatgattaatagcatcaacaaggaatacaggacaagtaatccaataatgtagattaagtcaagcctactctagagcataccattcccatttgaatagtctaaagtattgggctaccttggctaaaaatgacatgaaaatgtatgccaactcccaaaataaacttaaggctttgagtgcacaagaagcagttattataggtctaatttttttgggactgcaattctagaaaaaaaaaccagtaaaccataggggcataacataccttgtttcttcttgtctcatctgcaccattgacaagcaatatcattgttatatctctatttctactctgtatagctaaatgcaacggtgtccacccatcctgcatgaaacaaaaaaatataaaagaaaaaatcgatttcactgtgaagggttgaactgataagaaaaagaaaaatgcacaatagtacattacattatcaacaacattgaagggccaacatgccataaaaatatctaaaattggagtagaaattgttatgtacttatgttgctagagagaaaccagatcaatgtgagaggcactaacatcacaatgtttactatattcctcattgcagcgttgtaatgtgcggttaggtagccgacaatgttaattaggaactatttataataaacattaatagcaagtcgatcataaagttgaatgattctttatcttggttatctatactaatataaaaaggagcagttgtccccctccaatcctacagaccaaatcacccgaatcgatctctgccgtccatctgcgcgcttgatttcaccaccgcacgatccatccatccacgccacgctgaatacttcgctcctcctccacccgccaagacatcactccacacgcgaagacttcgcttctcctcctcgctagctcctcctcctccccggatgttctgccgccgcgccgccgcatcctcgctggatatcctccccgcgtggactgccgctgccggagcctctgattcttcttcttccccgccaccggagccagtgcttcttccccgcgtggactgccactgcatccccgccgccggagccggtgcttcttccccgccaccggagccgccgcggccggttccaacctcggcaccatccgccagcaccgacgacgaggtccaccgccgcgaccggagccgacctcggccccatcccccgcgcgatgactccgggatgctcctccttcccttgatccgcaactcctcactccagcgtgctccgtgcctccccgccgctgagacactccaccgcggcctgcccctaacgaagctaactctgccgcgcgctcctcgctccgctcctccccaccgccaccacacaccaccgcgccctgccctcgccggcgccgtggatctgtatgtcatgaagcctgtctccgctgctgcacacagtcgactcccccgtgaatatgcctttcggctggtatcaccatcccgtcacggccctgtggtcctaccttccaacggcactctgccgcgcctccagtggtgccgccgttgtaagggtcatagtctgcccacaccacgcactcggttctcacggacgtgtgccattctctcttttgcaggtgagagtgcagagtgcagagtgcttcagctgaaagtgagtcttccgattcccctcttcagcccaatagtcctctatgtggattatctgaatctgaatgtacatcattttctttcactatggcttgatttacactatttgatctagctatcagttcaagtggatacaatcctattgttatcctttcaccacaatcagtagttttctgagaagttaatttctttgcatacactgatgaactctgtagtagattctctgcaggctctttcttgctcaattaattattgctcactctatagcagatcaactctggatttagacttatttggccaagcactatggctaaaatggcatgccaagcttggaacagaaaggtcaagcaatttttccaaccacggtgcagcacgtggcaatggcactaccactaatttctatcatatgtaggaagatccaagttgatgctagcacaggctttggtgaatcactgatgggtgagagacctgcagagttccttgtccaacagagcaatggctgagttctttcagttgtgggatgaaattcagatggtgcagcttcaaccaggaatagccacgactccattcggtggtagctaacaggtgatggccagttttctttctcatgggcttacaacctcttcttcatggcaaagaccaaatgtttatatggtgaactgcataatttcgattctttctgttcatgatgatctgttggttaatctggaaagacggaacgcttgggtatttgagcagaggtctagacctatagagcaattatttggagacatcaaggagatcacgatttggaagtcggctagcattttttatcctgcagtgattatttattagtgttggttgtttattgtggtatgaggttttgcctcatacctttgttcgatagcatagtactttgtactttgtttctccctaaatcttaatgaatttggtgggcctaatcctttggccaacctggcaaatcatttcagtagtaaaaaaatgtgttttcctggtcagatttatatatatatatatatatatatatatatatatatatatatatatgtatatatatatatgatgtctactaggctgaaactcttggcttggagaaactttgttgcataatgtagcaggagctgcagcggattgaaaattgatggtatcaaaggttcttaataatacaagcaataagttgtcaaagaatcattgtttgattttgtagtaccaaaattccaatcacacttagtggctaatcttttttattttgactaaactaatgccacatgttagcagcagtagcagaatttttttattttggtttcaggttttagaactaatgttatttgttgctccaaataatccaccgatattgtcaggtgggagctatttgacttgtgtggctagaagtattcaagtcaattatctgcttgcctcggcctacttcaatagacaacagaggatgctctacatcataatcgtatgcaaagacaggtaatacacaccatatttcccttcatttgcaaagtcctaataaactgaataagaacagataccacattcatatttttctgatagatctcaaatccatatattgctaatggtctacttctcaaattggttttacacctcaatgcttgttctgtattccgtttgccacatattttatcaatcaattgcagttctttgaaattggatcatgacttccaacttgcagcagctaattgcattgtatcacacgttcattacaagatacttaaagcaaaaacggcaatatattggttggctgcttgcacttgcaatgagtaagagcatagaggttctggacttacaatctgaggttaggatcatgttccatatatttttacattgaacactattgcatgaattgcactatttgtagatgttctatagttaatcaactatgttaccttaaatatacatggtgtgttctagattctgaaatgtttagcaaacttaggcaacatgtagattaactatcacaatttatgtcactttttcatatccagcgaacttatctaacttttcttttcaggttacaaaaaatgcaggaaaaatgtttagactgtcgaagcaaatccatcaggaggacaccatggcatctgatgttgtctactatgcatcaaagagattactggttgtttttattccttctttttggttgagataatttacgttaatataatgttttcatagaagtgagccaatcttgatttgtttggttaacacgggttatgtgttgaacgtgtgatccaatagtatggctttgtcatgttctcttatcagctaattgtaagtccttagcagctggaatgctagatcatgactaacaagtgaaaacgatcagtgatagttttatgcgtgatagttttatgctggtgcagacatgcaatgccaaataaaacatggataattccttcttgtttgtgcataattaattgtttgtgcaggcttcttagcactcagtaatttatcttttcgaagtttctatagttgttgctcatatacaagggataattttgttgctcagtctcacaaggacagctcactacctatccatctaaaatctgattacacatttgcccattaaattctactatgcacaacaagaagccacgaattctactatgcataacaagaagccacgattgtgctcttaattcaaatctgaatttgttaggacatattattgacgtataaccacataaataaatccgaagtatatataatatttttgtttccccatttcaaggtctatatgattttacttatttggttttggtccgcatactggtagtatgcctgagagtggttatgttgatgactgttaagagaatgacaagtcaatatcttgctttgatacctttttttttttgcatttttgatttagctaaaaataactatgtactcgggtgatatattttatcaaaaacgtgcattgcacgtgcacgattactagtaatctgaaattccgaactgtgatcttctcccaaacaatatgcttacatgttcattttcatttggcgctatgctgctgcagcagttcagcaaaaatagaaagccttggcaaatagcaatttcagaatcactgcattatagccaatagcagtcatctgatcatgcacatgacacatgactggataagcacatatgatttattttgtgatcatggattatttcattaaagtaatcataaaacaactgtttctaacacatgactggaaattgagtacaacttaagcttaatttttgcacccattaagcactacatccagctcaggaccagtcaggacacaatgtacccaataaaactcaaataatgacatgacacaaccaaatgacaggaaaaaatggaagaatatttgactcataaaactaatcaggttccatgtcacttttttatccgtttacaggatactcatttcaatttatctgtttcagatcagtcacagatcaagcataaaaaagtatttactttgctggattcaagggccattggagcatttcctaaaacaagatatgtgcaagtgcaactcgatctatcaattaacctgacaaaaagaactgaaaaggttacttgggatatttaaagaacaacataagcaagaaattcaaagcctaattatatcattatatataaggcagatattgctttaaaacataacaaatatcagaacattgcagcttgcaactctatgtagccaaatcactgtaatgtgaaagcgtattaactaaactagatgataccccgtgcgttgcagcggacatggcatgacaaacttctcaatttgcaatatgtgtaatagttgtcggtgaaaggtacctggctactggagctagagaaccatatctgaattctgaaatacttagcacggttggcgaatattcctaataaaagaacaaatggcctgcaaaaatgtgcaatgaaaatgttatgatgaaaatatcaccgaaaagatatcctctatactattattatttatcggctgacaaaatcaagttgcacacatctacataatggagtagttgtcagcataccttagctagcaaatcaagtttccagagtgaagatgtccaaagtctcaaatatatccagttttataagttcttgcttcatctgcaacaaaaaggataggtgaaacctcatcatgatcacaagctaaaactcatctgagattgtcgctgcaagataaattatcaagatccataggaacaaaaatcaaacaattctccccaaataccaaatgcctaatttggggaaatagattccaaaagctcagatttagagggaaaccttgcacttgagtacttgtgcccagtaacaataatagatctaaactattagagagatcgacagtacaaagataaaatttaagtgtactaataatcacttaccttgcagcagttgatacaaaactgggatcatcaggactcgggatgccttgtgcaagttacaatttttgaagcaaaaatcagaggcgctgagcactaccattactggaagtgctgcttcacaacgacaggaagagcactgtgaacctgaagataaaaacagccggaagaatcagagatgatggaaaattcattagttttttatagcactgaagcaaaatacaatgtggtgcccaaacattctgtcaaatggcaaccatccatgtgcaggttgtacgaaattaaggatcgatcaaagctataaacagtggatcgtgtaaatagaaaagtttgctacagatgatgggaagaatcagatgggcaaccaagtagtacatactcttcacggatactttgtgatcatgcacgagacagaagttgagctttggtcacactgaggtcagggctgcttccggccgggataccgataggacgccggcagctagatcgacaaaaacggtagtggtagaatagatcaattgcaattgatttctattttgttcggttcctgttgcaaagttaccgatcacccccataagaaaatgtgaagcccagacctggcttagctgatctagaatcagaattctttggtgccttgctaaacaaagaaagaatcactccctgctaaacaagtaaaaataaagaaagaatcaccttgttcctcatcgtatattcaatttgacataatcctacgaacaaaagccatgccttcagttaatcattgaactcatcaattcaaccaaatgtaatcgttcagagaaagaggataaaagatctagaaagactaccttggcaatcagatatctagttgtcagttccagcagccgccggcgtcccgcaaggccacaactcaattcatgctggacgcagcgccgacgggagtcattttgagggccttaggagcagaggctaaaaggaatcggaggccgtcgaaccgcgtcgcgaacttcttcccctccacatgctgctcccccgccgccgcgcgtgccgcgtcccttgacaacgacgaaccctgacgagccaaaggagaaaagggtatcagaggagatcgaggaagaggttatgatggacgaggaaggcgtcgcacctgccgacggcggcggtctcctgctgctgcggctgattggcgactcctcttcctgcggctgctgcgggtgggcagtgggagggtggggcgcgcggggaggggcgtcgggagggtgggtgccgtgccgcccgtggcggtttggagcgagagggaaggggcggggattttgtgacggtaagaggcgtgggagcattaatccatccatgggttaatctaactcgcgacgtgatcattggataagaggatttgacggttagaaataggtgggtatactaaaaaggaaaccgctattttttatattagtatagttagatagatgattctggattgtctatttatacaactttgttattaataattgtttcatttgaaattatttactatctgaaacattatttgaattaaaaggaggaaagcaaatagacttctcggcgatggaggagaaaaagggttgggcctgcagcccgaagagggaggaggagggagagagaggttgcgggctgagggagagagagagtaatgcttgggctgaaaaaggcccaacgacagagagatgaattttaatttgttttttatttattttaataggttaaataaattttgtggtattaaaatttgttattgagctccgaaaatttaagaaaaatttcagagaataatttagaccacgtagaatattaaaaaatatctccggccatgatttttaaaggaaaattttagtttcatcattaattcacttgattaaattgctttaacttttaatatatttttctagaaatgcattatataaatctatgatgtttgctttgttccccttatgacaaattaatatttgtcacgttgtcccattgaaatactttatgacgatttctagttggtattaataacgaacacctttttttcgtcactaagccaccccatcttatactaattgtcataaaatggaatgtgctaatgatgaatagcaccgtcgtcacgaggaattcgtcacagaagatcacatttcttgtagtgtttaaatttaattttagactgatctttatgtttcaaatgcaaaaatcataaacaacaaaattgtagaacttatcgagatatacaactattgtattggtcttttttcaaataagttcatttgaaccgttcaaatatttaattttcaaaatttgataaattcgaataaaatttggggttaataaatgatttcaaatggaaaaatcaccaaaaccaaagttgtagaactcatcgagaagcaaaatttttattttagtcatttctccatccgactctatttgaataattttaaattcgaaattcaaagtttgagaacttcaaattgaattttttattagtgaacgacttcaactgaaaaagtcatcaacaacaaagttatataatccatcaagaactataatttttattttggtcatttcttcatccgataaagtgatagtaacattgttcacaaattttacatatctcccatatggttttataaattataagagaggctgtgtaaattctgtgaacaatgttactatcactttatcggataaagaaataaccaaaataaaagttatagatattgatgagttatacaactttgttgttgatgaccttttcagttgaaataagttagtatttgaaaatgttgtttgaagttgtcataattttaaattcaaattcaaattattgaaacaaattcatatagcaaaatgactaaaacaaaagttgtagatcttgataacttatacaactttgttgttgagatttttttcatttgaaatcatttactaccctaagttttaatattttgaaattaattaggaggagggaggcaaaatggacttcttggtgagggaagagcaaaaggtttgggccggcggcccaaagagggaggaggggaaggggaagccggcccaaatagggagagagaggtgcggattgagggagggagagagtaatacttgagccgaaaaaggcccaaggacagatagagggaatttaatttgttttctatttattttaataggttaaataaactttgtggtattaaaattagttattgagcttcgaaaattcacggaaaattttagagaataatttagaccacgtagaatattggagggaaggggacaccgcagccgcaaaggtgatagcacacgcgtgccctgatgcggctatattggaggcccacataaacatgtctattgcaacaccagtaatcgttgcgatatatacaagttattgcaacgaggatcatgttccttgcaataagcatctagtaattgccaccactttaatcattattgcatccacaacaaaccgtggcaatatgaacatgttgttgcatccagtggcatccgtcgttgcaatatgcaactccctcttgcaaccccacccaagagtaatgcaacacaagaaaacggttgcgatattggcaaactaaagcaacgcaaacttatgaggttgcagtatcacatttcttttgcaacgccaaacatcactaacgcaactctgaaatattgtggcaataggcccaacgaattgcaacacaaataggaaaatggttgcatcaaccccattcttttgcaaccgaaatccatgcatatcgccacacacacacgccgttgcattactataacaaattaccaccatttcacggtttggatgcgatacaaaaccctattgcatccacatgagtgccattgcaaggggggactcgtggctattgcccgaattcctagtagtgttttttaagtgacccacatggaaatatcacccttcctatttcaacaccttttttatgctccattcctctctctcccactcctactaccatggcccactcctcctctctcccccactcctcctcagtccggcctcctccctcccgacaatgggcaccggcggcggcagatgcaacggcgggtgtggttgacggcagcgtcggtgggtgtggacgatagtggtcgtgggcgatggtgacggcgacggcgacagccccctctcccctacccgcgcggatctggcgatgggtttgagtgtgaggctagcggcggttctcccccgccctccttgcacggatccgacggtgggctcgagccggatgcagtggacgcggtgggcggcacggtggtggcaggcatgccggcggcaggtgcatacgacgacggtggcgctgatcctccatcggcgacaatgggaggtgtggatccactggcagcggagacgggagaggcagatccgctagccgcggctggctagggttaggttttgatttttggaattttttttgtgattttccaattttgcgtgccaacggcttatgcgtggcatgcggaaattcggttgtcgcatgcgggtgcaccgcctgcatgaaaaaatcgctatattcgtagacctttccgggaagacggttagtctaaccgcatgcaaaaattgattttgaccgtttggaaaaatcccttttgtagcagtgttgtgtgtttatagaattaagtatgaatgtattgtgtttataatgtggtttaaaaaatacacacttatatgcacatcttcaatataagtacacacttatttttacatcgtaattatgacacagacaaccgacaatgtgtatcttaacacactcttaggtaggggtgaaaatggtaaccgtaattaccggccgaccggcgttcgtttttgactttctactggccgagccatatggaaatggtaatcgaccgaaacaaaaatggaaatggtaaaacatatggaaatgaaaacgaaaatggttttgctgttataccaatcgtttccgtatttaccgtattcttatggaaattaccgtttcttataatatggtaattactgtattataaatatgtcgatatttatagggcatgtctatacttgacccacaacttacagattgactgactcttcaatcaaatctctaacttttgtgcatggctaaaatgaagttaatttataatttatatagtataagcttgaatttatgaatacatataacatacttatgtaaagttaaatatatgtttttatagtttaatgttcccgtatttattatcggcttccgatctgtaccgacaagtttccgtccgtattgttccgtttccggttttccgatatttccgatattgttttcgtttccgactttaccgtttccgatttcgtttccaagaaaaatatggttacggaaatggttgaggctgttttccgatcgtttccgaccgttttcatccctactcttaggtctcaacaaaataagcaaagtgacatggcataggattagtctcgtaacacactcttaggttttaagatttcaagctataaagtgacatggcataggattagcctcattcattgatcatatcgttcaagatttcaaacattgcgagaaagttcatctcacatgtcgagactcatgtcaaatccgatttcatactccaattcactgcatttgtatcattcaagacttcaaacacccaaatccaagcaatttatctcacatcgattgtcaaggctcatggcagttctccagtttcatctcatattgtcaggctcatggcagttctccggtttcatcctcaatcggtttggttctatatcacaatcagtcatctcttctcctaaatctcatagagctgttgttgacagctgttaagtaccaaatttacgtcatcaatacctgcataaatctaaaagtataagacatccaacatagtggtagggtttatttctaacaatttccacgagtgttagtgtatatttgatgcaggtaaaaacctaccaaagttgagacaaaagatacataaagaaggaggtgaattaaacttccaaatttaagctatggatttttgagcccacaaacctaatgaaacaagagcaaatggaccttcccactatacatatgggctgagggattctccactagtgtccacaagaaaattcggggcaaagggggccagaaagggtttggccgaacccaaaactagcctgttcggccccaaatttcacaggccggtagataacgacttgtattacagttgggaccatttataccaatggaaaccatcatagagaggacatgtggaggctcaagagtgaagatgccctttggattccatggagcatcctcatcctcccaagcaagctccacctataaataccccttctcatccttcaatctatcacatacaactttgagctgaattataagaggatctattgtatcttttatacattaaaaataggtagagggtgaagggaagctctggaggagtgcccagaagtttggcgctctctccgacttctacctcgacgattgtagctttctaggaggaattctggaggggtaccagagctgtcgatacactctactccgggttcggagaacttccattaagtaaacatttgggatcctttcttatcttatttaattatttagtctaattaagatagatttccatctttacgggttcattgtttagtattcgtactaggactccggatagagaaggaagttcctgcgcatatattagagtagtaattaataacttagatgtggtgtctaggttagaaattacatttgtttgttgtgtatcccacagatttgtcagaggtagacagcaggtggtgacagccctgaatcccatcccagtaatcttccacgttcagatacatcatagagctatggccggaaccacgctggcagaccagcaggagtcggtgcctgaagcaacagataggaaattacctttaacttagcttagataattaaaacaatagaaagtcctttgtagcctagccagcctacctatagttgttgtccttggatcgtctttgccttaggtagattacacacgttccctgagttcgatatccttttggggtcacccgaaagtgaagtgctgcagcggtattccgtgtgcttgcggatttatctgtggttgtaagaaataccaacagctgctctagttatgggttttatctaatatttccatcatgagacaggtattttgtttttcatctccgtagctttattttggtatctaatggtgcattaaaatattttcattatatcgctctctgtttttaagcttgcttatcagcttagttattctcttaaaataatgtttgtacaggtgctaactaaatattttatcttaacatttattgatggacaatcgctaacaagtactaccttagtatagtccgacagaacggcagaaccgcacaagataggaagcatgcttcactgcttcaccgttttcactctgctttgaagattgtttttttctagaaaatttgagtgactaatctcttcctttgcagcacacacatatattgaacctaaatgtataaccgtattatttgatacgcatgtattgagatttctcaattaatatatacattacaacttaaattccaaatagtgttcaccttgttttttaacatgttcttagaatgcacatccttacaaggatagtaactatttaacacgcaaatgttccgcagcaacgcacaggtgtcatctagttctactaatttcatgctaaaatgctactctatctgtctatgaagcctataaatattttatactgtcttcaattaaatacattaaccattaatttatttcatattatattatcaacaaatataaaataagcatcatatgaaaatattttgaaaggcgaatctattgatacttagtatagatatttagtatagatatagttagcataattattagttaaaagttatagactttgattttaaaaaacaaggacgctctgtaatttgggatgaatggaataccaggtacgggcgaacagtacacggccttggcccaaattggtgttgttctttgggggaataagtgcattttaggttacttaacttgacagcgagttcaattttcatccttgaaccaaaataccagctacaatgggtccatcaagtgtcaaaaccaatacaatataggtcccatggtagtatagcgagtggttttgtccgacgttgcaattcgacccaagtcaacaatgctgagagtcagcgtagacctcacatgttagggcttcttcacctctctctctctcttcacctatctcagtattcctccccttgttcccatctcatcagggagcaaacaatgaggagaaggcccacggcggatggtgaggaggaggacggcagggagaagggcaattgccggtggggcgaagagtgattacaatgacacgtcgtatctctcttgagcttctcttctctcttcctcactatctttcttcagtcaccatgcaacgatgatggtgtggagcgggatggccaagcttgtcgtccatgccccatgcatgaccctcacggcaaagcagaagcagagaagacggcgctggtccaatctccatgcggcttttcccctccatgtggtcatcgccatgatgcccccaacagccaccaccgccttccttgccactgcgcccacgcctcctcaccgacggccttctcaccgcctgttggcagccttctcatctcttgttgtgtttgaggtgtcgagatagatgagtccagctaatgtgggagcaattattgggttttgtggcaagtgaggtgttggtatgcggctaatgttgaagaatatatcggcactgcagttgttgttgctgttgctcccaatatatcggcagcacgaggaggaagagaagctgcgaatcttggttggtcaatggaggtagtgaggagactgccatgccggagtcttggagagacacggaggcgaatgccacgccgtcagccttagtagccgcgtcagactcgagcctaggaaatgggaagggtggtggcagtggcgccacggcgaggaaagagcttgcagtgttggcttgcgtgtcgttccacatgttatttgcatccgcaggcaagacagtcgcgacggtaatggtgttggggacgttgggcgttgtggcgaatgacgtcatgctgccattcatgatggattgactaaatgctcttcggcaacctcattgatgcctccggtggtgcgcttggcatccacgacgtagtcaactgggtctccatggtctccctcattttcatccataaatacagagaaaccaggctccaccattgcccttctcccagccgttgtcctcctcaccacctgccactagacttctcactgctcgccacctagcgagataggaactgggggacgacaagagagataggtgaagaggccttgacatgtggggaccatgttagacttgggtcgaattgccacgtaggataaaaccatccgctatgctgccgtgggacttatattgcaccggttttaacatttgagggatccgttgtatctggtattttggttcaagtacagaaatcaaactcactgtcaagttaagggacctaaaatgaacttattccttctcaggccacagtgagacgaacaggctgtagtatcactgtatcaccccattgttaggttggaaaaagtcgacttagactcccttaattgttcaccgaatctaattcgtaacccttaactagaaaaccgggtaagacgacttcccgaattattgaaaccagtgcaatttgactcctctagcggttttggagggcggttttgctaacgtggcgctgacgtagcattagaattaaaaaaatatctgtggggccaatctatcattcacacacaaaatatattgtgggacccacttacatatggagcccacatgtcatcctttcccttccttcctcctcctccctctctctctcccttctctctctcttctctccccttcggacgcacgcaagaagcgggtgccagatcggcgacggcggcggccaggggctggaggggcgacgccggcgtgcgggcgagggctggagcggcgacggtggagtgcaggcgacggccgagccaccgcctgccccgtctccaagccggcccaccgttgctccccctccttaaagtcccagagctgcagcctctgctctcccccattggtcgtcgccgccggagcagtagcagcagcgccgccgccgcctgcaaggatgaacgggaggccggcgacctcagccggagcggcggcgaacctctgcagcaggcaggggtgctgcgacggcggcggcggccacagcgaagctgcgacaacattggactgaagtgtgcgctgatcgaaggcggccaccgtggcgtgctgctggtcctgcgagaacgcgaggtggggtggcatcgccatcatcttgaggtggggcaagcaagcgtcgcctgcttgctgctcctgctgatgttgcatttgcaatggcttgctgttgctgatgttgcaatggcttgttgccgttggtgttcgagcagtggaggagctcggcgaacgcgccgccgccgccgttgtaggcgttgccattgttgtcgcagggggcgttggcgagggagagcacggtccgccgttgccgatccggctcccgctcctcgcgtgcgtctgaaggggaagagagaggacatgtaggccccacatatcggtgggtcccataatatattttgtgtgtgaatgacagatgggtcccatagatattttttttaattctaatgccacgtaagcgccacgaggataaagactggattagcaccgccacatcagcgccacgtcagcaaaaccgccatcctaaaccgctggaggagtcaaagtggactggtttcaataattcggagagtcgtcctacctggttttctagttaagagtcatgaattagattcggtgaacaattaagggagtctaagtgggctttttccttgttaggtttgggccatgtgtggggcaaggccctggagattgagcctaagtagtgccagcctaactgccgctgccacgagtccttttttgaaaacaaaggatttaacagattacgtataacatcctaaaaattcatatactgtaacaatcaataacatttttcaacctttaaaactttttatcagtattatttgcaaaaaccctaagtgaccttttcatgtaaaattcaaaaacaataaaagtttcaaactataccgttgtcaaaatcgaagaggtctattgtcatcgatatagaaatctaacaattatatttgcgtagtatctctcgtgagagagatgcatgtcaatcaaactagcgattttctataaaggttcggctccttcacgaaataataaccctacatttgcttggtactcagtgtggctataaatgggcatctggtgtctagtccaaattactatattctcgtcaggagttccaaccagaaggtggttggaagatgggccatcgagaactggtttgatctggttttacttagctcgatatttgatctgttgttgtcttattcttggcctcctcttatggtcacatgttaagtttctaaactactccctccgtcccctaatataagggattttgacattttgctttcaatgtgtgatcattcatcttattaaaaattatttattttatttgtgacttactttattatccaaagtactttaagcacaactttttattttttatatttgcataaattttttaaataagacgagaggtcaaacagtgtaaacaaaatgtcaaaaattttagaaggcatactctctatgctacgacttatggaatataccgataaggtataccttcacgtgtacggttggtttccgtatacgctgttaggagtttgcctcaaattacggaaaatatatctatgagttaaggaattgccgaagtcctactcggaaggggtaaaatctctagtgtatcgtatcggtttacataatctccaagtcttacatggggtcaaggtggggaaaggctaagggcatcgcacctcatagccaacacacccaccaaagtttactaagccggagtctatagagtcaattcgccgggagatctcgtcgaatccctcgaccatgatctcgtcggtattatttgttcagttactccctttgtaatctgttttcatcatcatcaatcccatataaactggaataggactattacctgataaggggcctgaaccaatataatccctgtcttttgtctgttttgatgtcgtactacgtagatccctgttccaacgtaccccaataccctattctttcggtctgcgagtatcactcgtcgacaagtactaagctacgtgttctgtgtaaaagttttgcatacaaaaatttcttaaaaaaattaaatccattttcaagtttaaaataatttatacttaattaatcatggctaatgactcatttcgttttatgtgtcgctgagtagctcagcccgaatgctcattagaatgcatccttaaggccctctaatatcttaggtggacaagtacatacaggtattgcagaaactcttcggtatagtcctgatcgagtccgaccatacacatctccatcagatgtcgtttgaattgtagaactaagattttgtaaaaacagatatggtattttataatgaatatttagaaccttgaatgatctcaaataataaaataatcaacaagaaagttgtagatcttatcgagctttgcaattttgctataaaatgtcttcatatgactgtatgaaaaaattatgcatatatccgaataaaattttatccatctctgcagatatccgaataaaattttcggatagtttccgaccgtttcccattccgacggatagtatttttactgtattcgatttcatttttgaatccgagaatttctgaatagttacgaccgaatctatccgaatccgaaaaatggtccggattgacggaaactatccatacaagtttcaaccctagctataggctatgggaatggtattggagggtatttttggtactaaaagtaccagatgacgtgccgtgaaatttctcgtgagaggatggttcactcgcctattccaaaccgagcaaatacgacaatatccaaacaaaacaaacacgttgtacagaaaaagtgacggagtgagcaatcagagaattcagaaacgaagtcgccaaaaaccggtgaccggctccgtagaacaaatccaacatcggccatgccgccccgccaagaacgcgtacgcccgaaccaccccaagaggccaagacatctgaaccactacgtggtcagctttgacggaccaaccgaacccactcgctcgccctctccttcgcgccgcggcagctgcttctgctgctttaatttcgctcctcttattcccttcctttctgcattgttactccaaacccaacaacgagaattacaaagcaagaagctatctgcacgcgtggcatgcagctgctcctcctgctgctcgccgccgtcttggtggcggcagagccggctgcagcgatatcgacgatgcccatggagctctacttctcgccgggggagctcgcgcgtattgccgggtacggcgaggagccggtttcgaccgtggtcgtgtccggccaggtcgcctgcgagctctgcctctgtcccggctccgacctcctcaccttcgagctcccaggttagcaataagttctgaacagtttggtatattctacttgttgattcattaatttgatagttccagcggtgctttctttcctgattgcatgtttgatcatggacctgccttgtgtgttcgaagttgacatttaattagctgtcagtgttcttgtcaaatcaccgtgtttaagttcttttcgcaacgcctgtgtgcacagcacaaacgtttctaattgattgattagctagattcctctagctttgatagtagggaccgtagaaaattatctttatggttaatcttccgatatagtagtgttaattcttattcagtaaagaatttttatattttcaaagaggaatgtagttggatttataagaacaaaaacatatatatgacgtgaggtccctcgttgtctgatgaaccgtcataaaatgctacgaaaaacattttgcattagaaacaacatcactttgaactattcacactagatgatccttttctccgctgcgattatccgggcggtaaatgcatggtgacaagccatgacaaactttgaggacgtgtttagataatatgatatgtgtcaatgactaaattgattttgagcaaaagttcgaggaccatattgattatttaccccatgtaaatcacagaataaatgttcgtaaatcaagaaaagacactcaatatagcatgtgtggtattagacatcatgctaaatttcgagatagaactcatgtttatttttgagatatgaactgataaacaggaaagcaaaaggataaaacaataaaaaatagatggccgattgttaatttcatctctcattcaatttgctctcaacatattgtgctgctgtttagtataagtattttcttaaatatatttttttagtaaacttaattatactttaaaagtttgaaattttttgctacagtacactctagatttgtggtgtttcctccaccacactttatctgtggttatttcataaaagacactccgaccattttgtgatggagagagaaaattttgtaatagatgaatttactcttggaccaccatgcaaaatttaaatttgaaaaaaaatggttgaacttatacatattttgcaaaatgcaaaagccatcccaaattgtggtaataaaagatttcgggtgcactgcacataatgagaattaccaaaagaaaaaatcaaacaaaagaaattaaacctggaacaaatataagtgaaatttaaacatatttttataaaatgttttttacattcataattaaggacaagttccgaatgttgcaaaatattgttaaattcagttaaactttttgcaaatttaaattttacaagatttccctaagggtaaaggtgtaaatttactaagtttttccttggaattatttatttttcttcttctttttgaagaaaactaaaaaagtatactgtatgtgtaaccgtaaagacaacggactccgagtctttggagatccttccgaggtcgctggctcacatggctcacgcgtagtagtacgtactagcaggtcaccaaaagcagcagaatcacaggtcctgtactgtgctgttagcctaccatccggtgtcccgtcgctaaatagcccagtagtccccaaaataagtgcagccgtggatatccgtgctcaacgtttgaccatccgtcttatttaaaaattttgtaaaaaaattaaaaatatttaatcacacataaagtactattcatattttatcatctaatagcaataaaaatactaatcataaaaaaatttcaaataagacgaacggttaaacgttgaatgagaataatgcaaaatagcacttattttgggacggaggattaccaagcaagaagctttttttctacatgcgtactttggtatacttgctgtgttctggtgggcatagtacgagcgatggaacggaacggtacaaacactgcgatgcgtgtgctgttgacaaacgatacgtgccacgcttaaaagattttcttgttttttcaagtgaggaaacgcatatataggtagcgtttgggaaatgaaatgggaaaaagttaacggggtttgtgatgggagaaaaaattatttccctcatttcgcatgtgataggattgggttatgattgtttgcttggttttgtcaaagaaatataccctctttccacctggaatgaaccgagtatttaacctttttaagttatatttaacctttattttgagggcaggtttgtaccttcacacccattcagtacccacccccaataacccacctccttcagactatgttcggttcttttctttttttaaaaaaaagaaattgattagaagggatttattttatatctattatggcgtaaatttatttccgctcaatcccctttttcctccaaaccaaacgaggctcctttaggataattatggtgggaaatgagctgaatatttcaaaacctttttcttttccccatcatccaacaatccaaacaagggatataaaatgcaatatccaacctcttattttcactcctaccactttttccccttatccaatcaaatggcaccttagagaattttatcatggttaccttttctttttcccacaaaacaaatattcacttagttatatattcttagatactctggtggctcgcgcatgtgacattttcattgtgttaatgtatttataaaaaatataagtgaaacccactctcaattcgacacatatatatgatactttatatcttataaaaatttggacatgtttgggttaatgcccaaacaaacacaccaaaattttgtcagtgctgaaacatgtgcttgctgtttggtttcctattaacaatttttttttggtaatgccaactcacccaatacaaatgttttgacaattcatattggttagaaatcttcatatcttttggggaaacatagcaacttcatggttttagcttctggacacgataaaagttgatctttagggaaaacaatttcaaagtgtggttattttgctaccggacattgcataggttaaaatattcgtttaccagagaaaaatatggtaatgagtggtgtaaaaaaaaatttcaaccattttcacccgtatcagcaccaatgtcgtagaagcagtaaaagcagagcctccttgaaaacatgcatacgatgggttccttaattagggctttactcggagtacgccttagcagcctgaagccaataaatatatgtccttccaatcataactattaacgtttagaattaaaacttctactgtcaattttctattaaaacaagtttgcaaaatctaatatctaataattttatgatatcatgacagtattattttacaaatatactcttacgatatttttaattttaaactaagcattcacaaagttaataatggtcaaagtttcgaattttggccatttttttgtcataaattattaaatatgtatgagcggattgcggatccagtaattaattgtaacttcagttttcttaacatgtgcccgaagtggtattaagccaaaatgccattagaaatgcttcatagtagtgatagcaaattagggcatgtttagttggcaaaaaattttgcccctacatatcatatcaaatatacggacacacatttaaagtattaaacgtagtcttcgccaggaaactgcgggatgaatttattaagcctaattaatacgtcattagcaatgtttactgtagcaccacattgtcaattcatggcacaaagtaggcttaaaagattcgtctcgtaatttcctagcgaactgtgtaattggtttttttctacatttaatactctatgcatgtgcccaaacattcgatgtgatagcgtgaaaaattttatttgaaaactaaacatgcccttagaaacgaatatagtaaaataaatattttaactagtcttatccaagtcaatcgagacagagttagtttgcgtaattcattgtaaggtcaagtctatcctagaataagataaaatcaaaagaaagaaaaggcaaataaatcttgatattgattactttcagtatggcatcacaattagacagtgccataatcgtcacgcctacaatgaaagaaatggtcaggtgtttgtttggtcaacaagcacaaaccacatacagtaggctagatttgctttcctatctactactggctagtgctagtatcgcctatcatgttaaaaagctgatttagatgctcggaaacaaacgaaccagacattcagacatggactacccactacccagccgtatgggccacgacgatattgtgatcacttatcaccctgacaagtagttctgcgagcgagatgaattcacccgttacatcaaataatggcgcttgcaaattgccattcattttccgtctgtgtcaacggatgtaatgtaatttgtattttgcaaattcccattcatcgtcacaatcattttccgtctgcgtcaaatgtatgtactccctccatattttaatgtatgacgccgttgactttttaacaaacgtttgatctttcgtcttattcaaaaaatttatgtaattataattttttttattgtgacttgatttatcatcaaatgttctttaagtatgacataagtatttttatatttgtataaaaattttaaataagacgagtggtcaaacgttggttaaaaatcaacggcgtcatacattaaaatacggagggagtagtatatttgtagtttgcatagtagcgtgagcgcatgaatttgatggtctccagaaattcctttgtgatgtttacctatcgtcgcacgatatatagaaggttcagaaaggatttggtgtacaagggaaaagaaaaaaggtacgccctttatagcttggtttgagtgtgtgatgaattcgtcactttgattataatgagttcgtttgatttgaggaatggaatggacgtcacacctctgttataaaatcagccccaatatatacagaacgaagaagaacatccaaattaaacgtgatgaccatgcagatatacggtatttcttaatgagattcaactaaaactttatatcaccgggacactgattatagacactcctagctgatccaacgtattacagtacatccgggtatacatgactctcagactgactaagccactggctaggcgtacccatgccattgatactatcaccatgtggttagaatcagtgatgcatctctacttaagagagagtctaggacatagtccgaatttaactctatcatacacctattacaactctaaattctaaactgtaatcgactacatacatatattcgacatatactctgacgaaaacaacttccatgctcacttattggataaataatggagtcatttctcaaattatgtagaatttttatttgtgaggatgataccatgatggatcaattattctagatggtttgattcctcagaccaaactgcccattagacaacgtcatgacaccattgaaattgaatattttcgtatgactgaaatctagcaaacaaataccaaatgaataattgaactctagtgatcaattgacaaacttactgacacgactttctgtgcttaatcaagtattgacaaattgaccttgcaaactaaattttcttcaggagccaaggtagaagtagcctgtgaaaccgaaggccccaacacacaggcgaactctgtatttacagcaaccgatgagttcggcaacttcaccttccacctcccttctcggctccacgccacaccaagcctcgagaacgcctgcgtcgtcaaggtgctccagctccctccagactctgcatgtggccttcgtcaccgtcccgccgcctcctaccgcatccggccatcgtcctcgttgtcgtcgtcggctgatggcttccgcgcctacacggccggggtgatacggctgcagcacggcggcacgccgtccggggagtgcgtgcaggtagaggacagagtggataagtagcctaagaatggctggtggaaatcgtgcattgggcgaaacccagagatttcatcgaccgatcgatcagttgcttagttagataggagtagctgtcttctggtttctccaatttgagaaattgtatatggagaggagagcggaggtgttgattaggtcttattaccaagcatgtaaatggaaaaaatgctgcaaattaagtacatttcaggagtcagtttgagttatttctcataatgatgacgaatgatttgactaggaacattttggaaaatagaaaaaagatatagtacgttcagggcttcaggcaccattcgtcacaatctgtttgactatattccacatgtaaccaagtttccaacatcaggaaaggacctgccaagttcaaaaaaaaaaaaggaaaggacctgcctgcaagcctggttttaaacccaaaaccggtgtaaaataccggcccgcagtttttttcagctgggctacaaatgagtccttcgatgacatgtaatagaaataagtctattttgcctccctcatccttgcgctcggtcgaatgacatccctcaaccacaaaacaaagtagagcatcttccccatctctaaagaccggtacaaatcgaaccctcgggtgattttggaagcggttttatactatgtggtgcttactgtgcattcaagatagaataaaataaaaaaagtgaaagtgggccccacatatcggtctcactttctctctgcttctacccttttctatctctctagtctccctttcttctccggggtccaggaacagactgatggccggcgatgcctgcgaagaggaggagaaagagaggtcagcggcggtggatccgccttcccgtgcccccccacctcggcctacggcttaagcagctcgccgacactgcaggggcattggcctcagccggggacatatcatagatgaaccggagcagcatggcggccatggtgcggcacactttgtgcatccagagcgtaccagagcatcccggctccgactgttctaatcaacaccaccgacgctccggaacaacgtcggtcatgaaagagtgagaagtgttcgatgcagaaaatgtaaacaaaatgtacttttcccttactgcacagtctgcagtggcttctgttggatggcctggtccatgcgccggatcgctctcgtccccttggtctccggtggaaccaccgccaacgtcggccatgtgagaagacgctgtgcggctggacggcctctgcgtggctagatggagaagacgatgtgcggccacggggaacgcattgagggtgacgatgggggatgaagtggataaccccgtgatatgctgtgggcccacatcgcgtgggtgtgtgtatctttgtattctaatgtgtacggtagataatgcataaatgtcactcgagcgcgggaatacatactgagaggaatttctatgcacgaatcactaggcacatcgtgtggtgcctgtctggggtacacatcccccctgcagataaaaaacttccgccggtcacgacacctaatagctggagaagaggcatggccggcgcaagactgccttgaggagaagcataacagagcctaatcccagagcaaaaccggataggaggcggaggccgatctccaccgccacggataggatgcgaagtgcgaggtgtggggggacgggcaactggatccaccgctgccgagctctctctctcctcctcttcgcaggcatcgctagccgtagtctgttcttggaccccccgagaagaaagggagattgaaaagggtagaggtggagaaagtgagactgacatgtggggcccactgttattttttttggctatctagaatgccacctaagcaccacttaggacaaaaccaccagaggagccaattttgccggtttttggagatgggagaggtgttatatccggttttacggttgagggatgcgattcagggcaagagggaggctagacatcccatataatatgttttttttagttcacattttgtatagaaagaggcccatatctaaaaattggtccataacattcgcaagtaatacacccgcagtcaaatcaccttagaaaaatggcgccgttaattctcaatttcataatatttgggcagatgacctcgttactctttttttaaaacgagaaaccaagaacatttggtctttatattaagagaaggtttcttacaaactcttgcgctttcattcttttgatcggacgcccgattgaaagagtagaaaatcagacgccccgattgaaagagtagaaaatcagacgccctctctacctttccatactatgctaggaagcaaacttacacttaggggctgtttgagatgggagggacttattttagtccctctcaccaccttactctccctggtaccatacggcagtgtgctacatgtagtctgcatgcacatgcacatgcatatcctactagagcttctcatcacttctcataaatatatttttaaatttttaaactaccttttctcttaaattactcattttatttgtgatccgattgcaccactatatttattataattaaatcttcacaataagttgtcacatgactatatttcgagacttcaaaataaagcaatgtgcaacatttaaaagtacattggaaaattagcaaaaatattttttcatcgaaatataatcgtgtgagatcttaatataaaattaattataacaaatgcaatggtataactataatcatatcataaatcggataaatattttatgagaaaaaatattttaaagtttgttaaaagaggtgattttatatggagagaagaaaaataatgtaatgcataacggcagcaagatgcaacactaaggccatataaagagtattagggtgcatgacatatatagggcaacaacgctcggaggggcgctcgatatcttttcgttgcatcggtcacccgtcttgaatcaatttccatgcctattgcctctgatgaccattagatttttcctttccaaaataaatatacttcccagtgctacattaatattaaacacaattcccaatattaaaaatattcatttacaaaaaacaaaagggatagaattatttgaccacgaatttaggaaaagaagcatatatatatatatatatatatatatatatatacatcaaatttgattaaattaatatgactttagaaattaaaatgtttataattaattaatcccttcgatccaatagttctacgggcaatcccaacctaaaaactactacatttgtttttcatatatgatgtcgttgacttttaaaataagtttgaccatttgtcttattttaaaaaatatataattattatttattttattgtatttgatttataatcaaatgttctttaagcatgacttaattttttcaatatttgcacaaaaaatttgataagacaaatggtcaaagtttgttgaaaaatcaaagatgtcatatattaaaaaacagatgtagtatcaaatagttttcatacttgctatgttatgtatgcaatatatatagaaattatataactagtgagtggtttcttcaaaataaattctcgtccaatcacctctcttctttctacttttaatttttatccaccaatctctttttttcttagttcctatgtatagctagcttcttacatggaaatgatttttcatcttttctcatctctccttattaactctcttgtcatctctgtctttttttaatgtgacaatactattaaatgatatgtaaactataggattgggactgctcttagccaattctcgtcaaaactagtttaaaaaagattaaatttcataaaaccccatcaactactactatagtccaaaacgcacaaaaccacatagttctacacatactcccaagtattatggtgctaaagtttcacaaaaccacactattatccaattttatatactcctatatgaaaattttaatttttttacttacatgcatgtaacatttatacgatagataaaaacttataaatttaaaaagtgattgtataacttaataaagctgtagtagatcaaagttaaaatgattaatattgtggttctgtaaaacttttttagccctaatacttgggattaagtaccacactagaaaattagcgtgccgattggcacgctggtaaatttatagccctgtgtgtattatcatgtgtactacataagttatgatttctaccaagcaattgctttcagtttattaaaaatatcaacatggtcatggtacttgtcttaactgtatttgtctatagatttttcaacaccgtatgaaaattgttggtgttacttgcttatgtacatgtaaattcgcttattttatcttaattttcaattaaacctatagtagattacatctatttgaagatttttttaataatgagaatcttgctacaactttttggtgcttttaatttcgctatttactgttttattttctagacatccaggatgttactgtcattgtgttacatgcctcgattttgatataacatgaagtaattgcatttccgaaaaaacttaccgtgtgctagaaattctaatatcgctccattccttttatatttattccgttttgtattgctccatccggtcagaaatatttgaccaaacatctgtaacttgtccactgataacttctcatagcttatatagcttagtttatcaaacatgggaaaataacatataaaaaaatattataaaattactgtcataatcttatgaactcaaactgatgattaaagttcataaaattgactgaaaaatcttagtttaaatgtaaaatatttttctatcgttggagtacttatttttcttttctattttttctttagtattgtgtttgctaggcatgcacacgcctaacacatgaaaagagactttcttgatgagagtttgatatgtgagaaaacatctagtgtgttttttattctttttcatgctataagggtatatgggcgtcaggccctgatgtgcactagggttcccgatcttccgaaagattctaataaacaacgatttgggcagagtcgcgacacaaatcgatccggcttcttgaacgcgcatgctcttgagccccgcaatcgcagcaccacgtctcctctagttatctcccgtgccgaaacgcggatgacctcgccgagaaggctaatccctgtttgccaatcgaagaacacaaacaagaacgagatagaaaacaaccaaaattgcagatgaatgattaagctcactagttagggtcttacaaaccgatctagcggcgaaactgttctcgacagattaatctaagcaaaacccaactctaaatgatgacggctacggattaagtacgattaggacgtcctagggttgccctagggcgcacacccccttggctaagcccacgacacaattacaaggcccaaaacccgagtcagattcggactggatgagatacgtggcttgttttgcagattcccggcagctcggtaggaattttgatgtgggaccaaaaccatatgaaaatagactccataagctttccaacaagtactcatgggccccgaaattccttctagatcagcggctaagtccgtttgaagatgatgctgtcaggaggcccgaatccgaatccaaaacgtgtacaacttgatctcttgtcttctgtggaccaaaagtgacgtggtgaggtagaagtagacttggagaaggtcttggtttggtcctcaatcaacttctttaatcatctatgcattagttacgttcggtctcttttccttcgcccaagcaagtacctctgcaaacgaaaacacacaaaacttattgtgtagcaacgtttgttcaaatatataacaagtaaatctaatgtagaacatatgcacctttatttgattaatacataagatagtcatggttatatccgagctagttatgtcctcctcatcctccccttcttggttggaaatcgtcctcggtttcaccttgtcatggagcgtattgtacttatctttgtctatcacaacatcctgtgcggaacatttcttgatggccatatgattggatcctaaaatctttgtagtcgaaaagccacaacactccccttcttgcaaaccaacctgtaacttttaaacaactagaggaactagatagagaattacttatatgcatgcggtcctcttgacaatacatttcatcatgaaaaggaggtatagtcaaattcaaacaaatatatactcgatgcacattatattctcctttactatcataattgccaataatatgaaagatcacatctgaagggcatggcaattcaaatctagcaaataatttcttctctaaacagttgagtgaacaaagatcatcaaattgaatataaccccaagtatttaaagaagatagctatgtaacctcttcattctcgctagcaatgtgaataacatgtttaaactcaacacatggtgtctctactatagaactaacatgttcattcactagttgtgacatagatataagtgaagcatcgcacaactcttctttatcacaagaaacatcaaacaaattattttgtgacaaaggtatttcagcaattgcttccactataggttgctctagtgtagcataagtagtgaacatagttggcacatcataactatgcataccttgagcagttgtagcaccattatctttacctttttggtcatcttcagaaattgtaggcgcttggtcaattaaacattcctcaagcatgcatggagctatggatagatctttttgctcttcgtctttcttctcttccacctcattaccttggttgttctcagatgcctgcaagatattagtatccaaagcaataggcacaacaatatgttcgttttgtaattcagacttggttgaatacatcacaatagcatctttcctggtatctctgaaaatctcatcgattccattcttcatcttttgaagattatcttcaaaaatttcagtaaaactcatgggtaccaatttcattttctgaccattatatctaaatgtgtatgtgttagcaacgaaattatgcgaaccattattatcatatacccatggttgaccaaacaacaaagaacatgcttgcatagggacaagatcaaaattagtagtatcatgataatttctaatcgaaaagtttattctcataattctatttaccttgaacttaccacaagagttgaaccatttgatgtaatatggatgaggatgcggttgtgtaggcaactcaagtttctcaaccaaatctgaactcaccaagttattgcaactctcactatcgattatggtacgacatgctctatccttaaccacaaactttgtttcaaataattcgtggtactaccattgctccgctttctccatttgagaacttagcacttgttgcaccaaagtactgtcatcacgtgcaccttgttagtatcgctgattttgagcgccactcatacctgtcattgcaaacacaaaaacaacaacaaacaatgaaggttatccctaataatctgctacgcggtgtagtggtgccccgcaacaactcagccaaatggagcaccttaccaagctcttacaagtgtcttaccagcaatgctaagaacggtacaaccagtggctggtttgtgacaccttgaaggacgtgatgtggcaattgcaaggatcaaagcggtgctgaccagaagtatatatgtggagcttgggaggcacaatatatagtagcaaaggaatgcaattatgctaataagaaaatgcaaagttgaataatagttcaaagtactagtcaatgtgctggcctagcctagactcaactctagctcaagcaagcacccgacaccactaaagactagatatgaatcaatgcacaactttgcactctgataacatactcaaaggatgaatgattttttttctttcttggtgcggctttttttaagcacctttctgcccttttttttcttttttttaggtgcggactttttttttgcacctttctgccttttctttctttatttattcttttttttactttttttttcaacaaaaactgaccactgaccttgaacatggattcaaatgtaaatatgaatattacagggactcaaacgcaaagtgcaaaactaaatttggatcatctcaaaaatggattgctcatatcatgtaggttccgtttttataaaaatatctcaaatccgctgcttaacaattgtataaagaggataatacggacagtcacagatacatctgatctgatccggagtttctcttcaaccgtacagtattccccctcgcgcgcacagtacacatgcacagtacggcaactccaaaaccgtttgataaaaatttctccaaatcacaaaaatggaaacccgatgagagacgattcaatttttcaaggtcccggcaacaaccaacaagatgcaaaactggacccaaaattgacgtacaactcacacgtgataaaccctagacacaaagtgatgaacagatgcaatactcaaaactaaaaattaaatctaaaactaaactagcactcgacacgacgatgcaatctagaattcaacaaagcaaaatctaatagaacaatgcaacggctcaaattgtctaggtaaagagtaaatattttttgtgtggcaattttctggttatgggaagataaattacctaatgggcaaccgcgctctgataccacttgatgcactagggttcccgatcttccgaaaggttctgataaacaacgatttgggcggagtcgcgacacaaatcgatctggcttcttgaacgcgctcgctcttaagccctgcaatcgcagcaccacgtctcctctggttatctcccgtgccgaaacgcggatgacctcgccgagaaggctaatccctatttgccaatcgaagaacacaaacaagaacgagatagaaaacaaccaaaattgcagatgaatgattaaacttacgagttggggtcttacaaaccgatctagcggcgtaactgttctcgacagattaatctaagcaaaacccaactctaaacgatgacggctacggattaagtacgattaggacatcctagggttgccctagggcgcacacccccttagctaagcccacgacacaattacaaggcccaaaatccgagtcagattcggactggatgagatacgtggcttgttttgcagattcccggcagctcggtaggaattttgacgtgggaccaaaaccatatgaaaatagactccataagctttccgacaagtactcatgggccccgaaattccttctagatcagcggctaggtccgtttgaagttgatgctgttaggaggcccgaatccgaatccaaaacgtgtacaacttgatctcttgtcttctatggaccaaaagtgacgtggtgaggtagaagtagacttggagaaggtcttggtttggtccccaatcaacttctttaatcatctatgcattagttacgttcggtctcttttctttcgcccaagcaagtacctctgcaaacgaaaacacacaaaactcattatgtagcaacgtttgtccaaatatataacaagtaaatctaatgtagaacatatgcacatttatttgattaatacataaggtagtcatggttatatccgagccctcatcaggcccatgcatgtatgcaaggcccagctgaatgccaggccctcgtatgagcgcaacatagcgttcttttttttcttttctcgatctctcccgttgcaagtatgttcgcctgttattttgcgtggaaaccgattccgtgaatagggacgtgccacatggcttatctctctagtgattaatttgcatagaattctttttataagataacaaaatcctatagttttatgcaatttagaacgcagtacctataattaagtgaaatttactcttaataataaaaaaaaagcccccaacgaagtctctgctttgccgatgcgaccggtctcacctcccctacccacggcaggcgccaactgagcccggcgcttcccgtccgtctcccttcctccaccagtccaccctctctcctttccgttccgttccgtcccccaacgaataaaagcgcaccgcgtacatgccttccaccgtgtcctccaaagcaccagcgccggcaggagggccccccgccggattcgattcccggcacgtccttctcctccctttctcgcgggcgccgcacgccccttccccctcctcctcctcctcttggtctgatgaatggggagagcctcctcgaccgcagctcctccgccgacgccgccatgaacgacgccgtgcccggccaccgccaccaccacccggttagcgtcttcctccgggacgccaggttgttaaccgagtcatcggtctatcgatttttttccctttccatctatttatctctgagtttttattttcttgggggtcctgttgcaggttggcgttcaggtgggacgagctcgggagggagatcatggggattgcggtgcccggcgcgctcgccctcatggctgacccggtcgcctcgctcgtcgacaccgccttcattggccacataggtttgcttctcttctctccttattttccttattttttttaattttttccccttactgctgacttcgttgtgaagtttccaccaccagttctgacctgctccaggtgggattggaacgtactctgttctacccttcggccttggtcgcacgatgtaattttaatactactagatttcttttcagcttggagcaaacctaacccagttcattccgttagtggtaggaattaaggtgtggtgtttggtcctgactattacgaaatttatctggctgtgctggtaatagatctcgcttccataatgtcgaacctaaaaaaatgaagcagtagtttgtaaagtagtagagtcttttgccgacatcgtggctgatggttgccattgtttagaatattgatactaaccctaatatttcattgctaagtattaaaacaaaattttaatgctttcaattcaagggttagtgtgtagttatgtagtacggtgcccttaaatgtcttaacatcaaagttgattgtcagataggttttttattgatgaattctgtaagaaagcaatcaaaaagcataaagttggataatgaccattgtttaaggtcaacgcaaactggccatattttatattcagcaagtatgtatggtaatactaatgaatcaatgtcatgtaaaatagatgtagaattaattactgaagtttagaccattactaattcgtagagaattccaattggctttgatttatatttagtttagctactttatgtcttgaaattgagtttagatcttctacggctaatttgctttcttgatgtgcttacatttgacttcaccagttagctaagaaagtgcttctacgttatcaagtagtaatttgccaagaagaaaaacagcaccccctgcagcagccacccatggcttttgtgttagtcaacccatacattttttagtttgtaatgtcaaactgcctactagatgttggcactagactacatgttcaccgttatcccaaataagattattaatgaacttaatattgctctttcatttatttttatttatacatttcagcctgctttgaattttgtatgaactttacttcttactgtattgtaatagaaaaaaagggacacattctgattttcaagtctttgacttattttgtctcaagttaatttgattccttttgttcaaaacaggcccagttgaacttgcagctgttggtgtatctattgccgtgtttaatcaagtatcaaggattgcaatatttccccttgtcagtgtcacgacatcatttgttgcggaggaagatgctacatccagtgacagagaaaaatatgaaataaatggcgagaatgaattcaatgtttcagacagtgaaatggaagagctggtttctcatgaaggtaaaacagttctaatcttcttttaagaaacattagaaattaaacaatgcttatttctttgacactcaatcttgccaccagaggctagtgctgctcccagtaagtcgtctttcgaaactgactcaagtgatgtcaaaattgaacataagcggaaaaacattccatcggtgtctacagcattactacttggtggggtgctcggccttttacaagcactgcttcttgttatttgcgcaaaacctctcttaggctacatgggtgtgaaacaggtatatgttccttcataccatttcctttgtggtaaaatcaattattttgtctaatcgtaaagatgtaaacatcaaggattgagtcatcattttttcctgtttttgaaaaatctatcaatggatgttctttatcaaaatttaataactgagaactcatctattattaagtttagctctggatagttggatgtgcacatatatattgtaagtacgaagtatcactaatggaacttaatttttcatgtatattatgatctgaatgaaattgtagcaacaaactagtgtattggtgagtttcatcattaaggacttctatgattttggttttttaattctagaatacactgtttatttattatttttcacatcggagtcctttttctactgaaattttctgatagggctctgcaatgttgatgccagcactaaagtacttggtagtcagatctcttggtgctcctgctgtgcttttatctctggcaatgcaaggggtatttcgtggacttaaagatacaaagacacctctttatgcaactggtacagtatttccttgactgcagaatggtgtatgctgtatataatcaaaccaagtgtctaaaataatgattatttaaactgtcccttcaaagtcattctacttgtggtggaatactttaatactttcttttaagttcgcaaagttaaggcaagatgacatgatatgaactggtgggatcaaacacttatgacctaccgtacattattcatgtaataaaatgcatgactgtagaacatgtgtctcttgtagatggtatatttaaatgcatgagatgttacgattagtgaataatttgcctcaggataatacatatacctaatggtgttaactctttttataccagtggctggagatgcaaccaacatagttttggatccaatatttatgtttgtcttccagtatggtgtcagtggtgcagcaattgctcatgttatatcacagtatgtagcacaattctctcttataatatcattgttttttacccgtgaagttggatgacaaactatgtccaaaagtatataatacctttcttctacctcttgtgatagtgtatggtggaaaattctgcagatatttcattgcatccattctcttatggaggttaaggctacatgttgacctacttccacccagctttaaacatatgcagttcagtcgattccttaaaaacggtaattcttttctaatatttttgggttccaactaagacatggccctttttttttgccacaaaccattttacaatacctggtcttcataggatgataattattaatatccattttctcgtatgcattcttagatttgatttttttcattgaaagtgcatacttaattcaaaacagcaaattaactatttatttccttttttacatttgggttatgcctgcttgactttcacattgttttagcacataatttcattctaaacgcaagttgcccttgcttgtttcaattattttacttgaaacatttctggttatataaaactcgttctcacttttcacacttcaggtttcctattacttgccagagttattgctgcaacatgctgcgtgacactatctgcatcaatggctgcacggctaggttcagttccaatggctgcatttcagatttgcttgcagatctggctggcttcgtctcttcttgctgatggattggcttttgcaggacaggtaagggaacagttgtctccactcactccaatgctgacaatactgaaggtttctattgaaccttcattttaatgaaaaattctacctcagtaactgcaccaaagggtatataattgagttttctaaattatctaacgttggaaacagataatgagatgtatcagcatgaactgaaatgaatttgcattttgttcttatgcatctggatcatattttgacaggctatacttgcaagtgcatttgctcgtcaagaccattctaaggccgcagccacagcttctcgtatattgcagctgggattggttttaggacttctcctaagcatttttcttggcattggcctccgtttaggatcaaggttatttactgatgaccaggatgttctacatcatatttacctaggcataccggtaaactttctttatactgatgccaaaataattacaattttaagtcatattgtagttaggattcctcagttgtgtgcgggagcctgatgttcctttatgatatctttcctactgtgcattgggatgcctgcctactgtcagagttacctggaatttttttaactaaagagttatttttcctgttcagtttgtctctctgactcaaccaatcaatgcgttagcttttgtttttgatggtatcaattatggagcatcagattttggatatgctgcttattcaatggcaagtcaactagtcaacacctatgtccttctatctgtattttcaatcctttttttttcacatatttttgttgaattcattgtcctcagattcttgtggcaattgtcagcatcatcttcatagtcacactagcaagttacaatggttttgtcggaatttggatagctttgacagtctacatgagcctccgaatgcttgcaggattcttaaggtacaatcagtcaaagcattatcttttctaacctgagtatttgattacaaacctttattacaatgacaaacaatagttataagtcttcagtaatgattgctacaaccagaatcaccaccaaacagttcacaggacaccactacaccagctttctcccagtctgcacaggcacacaccctaaaagctaacattccatagggaacatcacaatctggcaattcatggtcaggaataaattcacattgacaggatcaacaccaccctgtgataaggaacatcaataagacgtgcagccactagtctcgtgccctcgccatgcccttcccccatggctaaaacagaaaccactttgctctagcatctatcaactcgaatgagaatagatgctatcatgatgaggaccaatacgagtaacagcaagcatcataccccagctttagagctcaacaccaaggaagaaaagttgctgattataagaagtgatttgtgtcaacgtgcacttggcaaataaaagaggtagctagaatgtagtaatgtatccccgtgaggccgtgacagacgaagcaagaaaaataccaaaactttgtgctatatgcctacaaatgtagtttcatctcaaatacgaaaataaaaacttaaattcgttttatacctactgcagtgtcattcgttttctatattgattttacaagtttgcaataaatcgctatactaaattttcaggatagggactgcacgaggaccatggactttctatgcagctcaacgcatgcattctcatgaggtggttggactttgttgaacaatactataggaagacaccatggatactttgtaaggttttgcaggtttggtgggaatggaggttgtttgaacaaaagaaaatattcaactgtcatgtacatagataatcacacatgttactactattctaatagattctcccctgtcgtgtatgttgtatttgcccatgtatagttcagtatgttcggctggctattttgtaacaagtttggatataaagtcacgtagcataagatgtttgcacaccgtgagatatacggagcattggcatttgatttttaaaacattaatggaaattttaccagatgccaacgacaagtgatcggttctgtgaattattattgacggacaagtttttgaaactccgcatgttgctgcgagagtttagtaaaatagctagacgacatagcttacataagttgatatgatttatgataatttaaaaagtatatagaatgatgatttaaatgtaaaattaaggtgatatggctttataagagaagaaaagaaggaagataatttagttcatagattaatcatctaagaacttaaaaataattgagtggtatagccatcacataaccacgatccgaagccacaccgagcaatcacagaactacgatccgaaataactagctttatacctgtcaaggttggatgcggccaagtggtgagggtgagaataatccgaagcctcctggactctgacctgtcaaaccgaacaatcacagaaccacaatctgggactaatccacacaagagacccgagagccaaaagcacgaattagggggcaccagaggagccttctcacaaatccaaaagaactcacaagaacaaaggggtaagacacttatgtagtcttcagcaatctctcatatatgaggatttcaattgaacaaaagttatctaatggatggagtagagaggtatttatactaggaacatccctcctagctgaggttgtgaatataagaagccacgttctgatggtcaaggctaacataaatgagaatgcaaagcgttttctcgggttcgcgcacatccctttagctcctgcacaggcttcagtaaaaatgccataactttttcttggaaaatgatattgaggtggggtttgatgcattggaaattagatttgtccctctttccaaccatgtatgcatgcaacccgtcttttgactggctgggtcgcacaagccttggaagttgagcctttgcagcgtaaaccatcttcttgttggcgtagacagctactggttgggcatgaactgattcctcctcgacgtaacccttgtcgtcctcaacataacctatccttcttggcgtagtgatgatatcctcgggcgtaaaccttagcaatacaaaggtagagcatttaggtagtataaaattctcactaaaatttgggttaagttgagcaaagagcgagttcacctcttgttgtattttcctagcatggctgcgcataattggaccatgatatgcttgatcgttcttggtgaaatgtaatccatcaacttgatttacgtcatcttcattttcttcatgtgatgtatgacgtaaaccatcacccttgtttacgtcaagtgtagctgggatatgctcatcaaggagcatccttagttagcaggcaagttaagggtctagcaactaaagtgaaatgtttaatcaagcgccgatagaaccttgcacgagctaggaagctatttactcctttaacattggtaggatgtggaagctgttgaatgacttctatttttgttctatccacctctaccccctttcgaggactggtgttctaggactataccttcatggaccatgaagttgcatttttcctaattaagtaccaaatcattttcttaacaccgttgcaagaccatatctaaatttatgagacaataacaaattttttttcatagactgagaaatcgttcatgaaaactttcatgatttccttgatcctgttggggaagatagatatcatagacctttggaatgacgcaagtgtattgcacaacccgaacgacattctacaatttttttatagaaatgttgctttaaaatcatactacccattttttaagttttttttagctaatacttaattaatcgtgcactatcgttccgttttccgtgtgggaggtgagggttcctaaatacagtctaaattgggatggaaggagtaacattttagggcagaggaagtacagagtttcatcaaagcagccctgcgaagtggcagcatcggagttttcctaatgcgcgatcgatcgtgcgccctcagtacagagtttcatcaaagcggccttgcgaagtagcagcgatggagttttcctaatgcgcgatcgatctcccgcgccgagggcgcgcgatcgggaaagccacatccgtcccctaacacactcctctcctcttccttctcccttattctcttcctactacaccatacatttaaaaaaataaaaaaacacaagttagagaaaagttaaaaaatagaaaaaaaatctaatactcttatttatatgcatagactatatacttacgtacagactttataccgtaaacatcgcacgtataaactttatgtacagaaatactatatattaaaaatatttgaattcaaattcaaatttgaatcgggtatataaacttctgacttataaactttgggtttataaactttagctgtaaaaactttagatgtataaactttagatatataaattttaggtgtacaaactttagatatataaagttactaaaataataaagtaaagcggtgttaaaaaaaggaaactgcgtggggagggaactgatcgcctagcgcgatcgatcgcccaataggtttttcggctgcgactcactcagtcgctccctcgacaagttcacaaatcgtctccccttctccgaccatccaatccatcggttcggctcaagtgctcaaccctccgcagatcgccaccggctctttcgcctgatctcatccctgacgctcctcctcctcaacccaacacatgtgccttccctccctctccctggctccaccacctcgatcttccgacgtctccaccccctgctcgttcaatccaacaccgacgccccctcccccttcggcccttcccgccaccatccactaccttggccttcgcccacggtcccctccatctgatgctgccacttccgcctcccccaagtccctttctttggctcctctttcccaattgcgctcgttcacaaacttgagcgacgacagagcactgggcatgggcgagcttcgattggaagggcacttgcagaggaatgataagcaagtgcgctcgattgacaagagacgtgtctggtttctaatgattccattgaggtatagtatctctactttttttttcctttttcattctgttttagataacaaatccatcggattttgatgattggtggaacgatcgtattgtgttgttttctctgagtaaatttatcaaaaccactcgttccgtggtacaagtaggagaaaaccactgatactttgacagttggcacttaattagtgctcattgccacaatctcctttgtgtgaaatttactccagttacttcattctccttatccttactgccatatttatattttaggtcttaattaaagtacaagcacatgacaatccactataacttatactatccactcaattacaaaagggcaaaaggctgctatgagtagttttgccaacgggtatgtttgatgatcaaaaggtaaaattaatgttcatagctacatgcttctttttttaagacatttttatcatctactccctccgtcccataatgtagcaacctaggatgggtcatcccatccaaggactaggatgggtctcatctcatcctaggttgctacattatgggacggagggagtagatgcctgataaagtgtcactatgaaaagacccttaggtcgtttgctgggaacaatgttgagcatttaagttgtacagccagctacaactttatgatgttaaagttgtattgtgtttggcaacccaaggtgtgtgctaatatgagatagaataatttatcttactagatccaaatctattatctatgtaacaagttcttaaaataactgttgttcaattgttcatccctggaaaccttacctccatcctccatcctcataatccgtgatggtctatttcgtattcaagtaaaggacaaaaatacttaaactaagctcctttatatatgttatggctgcatggaggtgcaacgttgcattaagaaaattggtgataggaactgataacatgtatcttccattttaaattctgagcactgatcagtcctgctaatatttatggcagtattttagaatgcattatcttcatagtcaccaaaaatatagttctttagctgggtaccaaagtggttcttggcatgttgatgtgctgcaagcctgcaaataaatatcgtagagtattccatcaggctatcctttatctattgtctgctatctggtaaaagatatccttgatgtctccatggtttgtgattggaacaagtacatttttggcccttgaactcttcttgaagtccattttgcaccatgaactaaaacactatttctttttttccgcaatcaactttcaaaaccggacaaggagtctatttttggtggttttatttgcgatgacagtggttttgctagtgtagactcctattacacattttcctgatgacgtagttaggttacatcaatatgttaggagctacgattcgtggctccaaaacacacacacacacaagggatagagatggagaagcaacactggaacagagaacaaccagagaggaacagaggagcagatagagatagattggattaattcttgcttgccattaaccttaaacactccggctcttaatagccttacaatccaactaatggcgctaaaaggaagggataaaacaacttaacaaacttcaactaatgttgctaagataaagggataagcagcagcactaaacagccgtgccgcccggccctatagctcgtccggcaccaagcccagcttgctgcttgcgccggcggaagggaattccccacataacatctctccccccctcgatcagtagctcgtccgcgagctggaacgagggatatcggttgcgaaagtcgtccaagtcctcccaagatgtggccgatgccggcagtccttcccattgaaccagaagctggcgcacccctcgagccaaacgggcgcgcaacacttggcgaggaacaggttgggccgctccatgctgaatgggtggcaaagccagtggtgccgatggcgacacacccacgaacggcttgagcagtccgacatggaacacatcatgaagccgtgtccccggcggcaatgcgaggcgatacgccacctcgttgatgacggcgacgacgcggtatggcccgtagaagcgaggacgaagcttgcccttgacagcctccgggagggacgcaggaacgcggtggcgaacgcggagccacacccacgcccccacctcgaacgacacctcccggtgcttctgatcatagtagcgcttggcatactgttgtgcttgttccaggcggagacgaacatcagcgaggaatgcgtcgcgctcctcaatggactgtgccaccgctgccacccgtagctcgcttgcgtcgtatgcccggattgagggaggatcgcggccatagaccaacttgaacggcgtgtcacgaagggcggcgtggaaggaggtgttgtagatgtactctgcccacggcagccagcgcagccactggcgggagcgatctccggtcatgcagcggagacacatggcaatggccttgttcacggccttcgactggccgtccgactgtggatggaacgccgtactgcggtggagcttggtgcaggtggcggtgaagagggctgtccagaacgccgacgtgaagacggggtcccggtctgaaacgatggactccggcaccccgtgtaagcgcacgatgtcgacgaagaacgcacgcgccaccgtctccgccgtgtacgaatgtgcgagggcgatgaggtgggcgtacttggagaatcgatcgacgacggtgaggatgaccgacttgccgccaacgcgtggaaggccctcgacgaagtccatcgcgacatcggaccaaatggcagatggtaccgggagtggaagcaggaggcccgcgggatggaggtggtccgtcttgttgcgctggcaggtgaggcagccttggatgtgatcgtggacgacacgccggtcgtcgggcgtgtggaagtcgcggcggagtcgatgaagtgttttttggatgccctcgtgtccgtcatcatgcgccgcggcgacgacgactgacacccatggtgagcccggcggaatgtagatgcggcgcttgtaggtgacgaggccgtcgatcaccgcccatggtgttgtgcgcgtgccggagttgatctcgtcgcggagggcttgtagtgccggatcggtgtcccccgccgtgcggatgtctttgaggagatcgaacgtcggcgtggagagtacgaaggcctggctgtctggtgcggcgcggcaagacagagcatccgccgccgcgttctgtttgcctggcttatattcaaccacaaaatcaaaccccaacaatttgcttacccaatgatgttgcgggatcgtggataagcgttggtcaagaaggaatttgaggctgtagtgatccgtcttgacgatgaattgccgcccccacaggtacggccgccagtgtcgcactgcttgcaccaagctgatgagctcacgctcgtacgcggcgagcgcgtgatggcgtgtggcgatgggccgactgaagtaggcgatggggtcttcgccttggtgaagaactgctccgaagccggtaccggatgcgtcgcattcgaccacgaatgggcggttgaagtcgggaaggctgaggaccggcgtggttgtgagggcgagcttgaggcgctggaacgcatcatcggtcgccggcgcccatgcgaaactgtccttgcggaggagctgcgtgagtggagccgccacggaaccgaagtcttgaatgaacttgcggtagtagctggccagaccgaggaagccacggagttccttgggcgaacgggggcgcggccactcagctaccgcttgaatcttggcggcgtccatggcgaagccgtgctgcgaaatgatgtggccgaggtacgctacgcttgggtcgccgaacgaacacttggtgtgcttgacgaagagctgggctgcccagagcgcggtgaagacggtgcgcaggtgctgcaggtgcgacgtccacgttgggctgtagacgaggatgtcgtcgaagaagaccaagacgaagcggcggagaaacggccggagcacgtcgttcatgagtgattggaacgtggccagtgcgtttgtgaggccgaacggtatgacgagaaactcgtagagcccatcgtgtgtacggaacgccgtcttgtcgatgtcgtcagggtgcatccggacttgatggtagccggaccgcagatcgagcttggagaagatggcggcgccgtgcagttcatcgaggagctcgtcgacgacggggatggggtatttgtctttgactgtgcgctcgttgagagcccggtaattgacgcaaaagcgccatgacccatctgccttcttcaccagcagcaccggcgatgagaacgccgacgtgctccggtgaatcaatccattttcctccatcaccctgcactggcgttccagttcgtctttgtggcggacggggtagcggtacgggcgtaccgccaccggggctgtcccgggcagcaactggatgcgatgtgagcggtctcgggccggcggcaatcctgtaggctcggtgaagacgtccgcgaattcctccaggagggagtccagtagtgccgctggagcgcacgccagagcacggggtcgctggtgtcccggcaacccgtggagcgtgacgcggtgccagaaggacattgtcagcaccgtgaaatcctagaggatcggccccaatgtcgcgagccactgtgttcccagcacgaggtcatagccacccagagtcaggacgtaaacgtccgtggcgaattcctcgccggcgatctgtaaaggcatgtcggggaagacgccggggcacgccaccttgtcgccgttcgccaccgtgacgttgaggcccatgcggggctgaggagcccgaccgacacgtgccgctgtatcctgagacaggaacgtgtgcatcaagccggagtcgatgagggtgtagaggtcggtgtcgccgaggtgggccgtgatgtgcatggcgtcggacgcgcgaactccggtggccgcatgcagagaaatccggagtgtggcggccgcgtctgcttggtcggtggcggagtcgttgtcggtgtcgtcctcccccaactccaggaagaacaatcggcggcacaatcggttgtggccgcgcgaatagggctcgtcacagttgaagcagagaccttgtcgtcggcgctcatccatctcctccggtgacaggcggcggacggtgcggttgatcgcggtggcgtgcctgccggttaggcggcggtggccggctctggagccggcgcctgggggttggccgccggaggaagtggtagtatgccgcggccggcgtgtcgtggcgggcggggtggccgggctgcgagttcgcggcgttcgaacgaacgagcaagactcatggcctcttctagcgtcgtcggatgctgcatctgcacatctaaactcatcggttcctgcaagccaaccgtaaacagttgtacctgttgatcctcggagaggtagccggtgcgcgtgagcaggtcaaggaaacgctcggcgtagtcatccaccgtggtcgttcgccggcaggctgccagctcgcccagaggcgtcgagtgcagaggtggaccgtagcgcatgttgagcaactccgagaagcgatgccacgaaggcggttcatggtcacgttcaaggcgagtgtaccactgttgcgcgccgtcgagcagatggtaggaggcgagccagactttgttgtcctccggcgtgcgttggccccggaagaattgttcacagcggttgaggaaggggagcggatcgccgcggccgtcgaacttgggaaagtccaacttgtggtagcgtggaggannnnnnnnnnnnnnnnnnnnncggtggccgcccggacgtccatgcccatgaaagccatcgccgccgcgaccgtagcggtcgccgcggccgacgttgtgatgggcaaagcggcccccattgcgatcgccgacgtcgctcaggtcgtcgaagcgagaagagggagcgcgggcgccattctccaagcggttgatggccaaggtctgggtacgttgctgctggtcgatgtcggtgatcaggccgctgagctcctccagccggcgcatcatgtcgtcgaagcgttggcgccaaacgtcgtcgttagcgccggccatggcagaaatggaagcggaggatcggtggagactgataccaagatgttaggagctacgattcgtggctccaaaacacacacacacacaagggatagagatggagaagcaacactggaacagagaacaaccagagaggaacagaggatcagatagagatagattggattaattcttgcttgccattaaccttaaacactccggctcttaatagccttacaatccaactaatgacgctaaaaggaagggataaaacaacttaacaaacttcaactaatgttgctaagataaagggataagcagcagcactaaacagccatgccgcccggccctgtagctcgtccggcaccaagcccagcttgctgcttgcgccggcggaagggaattccccacataacaaataaatgaggccatgcatgtgatttctgtgtttcagttgactgcaagaaccctccaagcaaatgatgcagattatatttcaggatggagttctctaaatatactttaagatcagtgctatacgtactaaaagtttcttataaaactcttacaaacaaatatcttaaccattaatttatttactcagttggtagttatgaaaaatcaagatacaagtacatcatgccatataagttctaaagagtcagtaagattctttttggtatgtgtcattttccatctttaaatagtgtatcatccatcatgttagaccagattctattttagtgatactaggaacatgacgtacaattaactttgccaactatgtgaaaaaaaatgaagcatcattccagttgttacctaatgtaattctgatttctgtattagcagctgtctaattatgtttttttcttcacttaatttataaactttaattagaattacatcctaatgatagcatctccttttgtgtacagttgcacttcaagggtttagcagaattactcaaaacatttcctgtaactaatgaatttgacaaaaaaaattgtaagagatgttgatggtcttgtgatttaaatccttaagtatgtctttaataacctggaataatctacaccaatttttgtagtgttatttattccattagtaaaagttggtgtgcattcatgaattaaatatcaaacgatgtttgacaattattcttaccatttgacagatgccactgggcagataattaaattattgtttaaattttcatgaacttgatatatttacgcaggttgatgttccatcgaaaacatagggtcctcaaacgttactactaacacgaaggtgtaaaaatgccagtgccctcttatatgtcaaattgaacataaatcactgcgagcaacaattattctccctgcatccaggtaatctacatgtttttttttacgtgaaagcggcaagagtattgccgaatatattagaaggagaagtgcgggttgcatagttgttacaagtggactattacagtatgaatgtaagcaactcacagaggtaaaagctgaaaatatcagcatatcgcagcttataacaaccgaatcgttcaaggaggttggaaagtgatctggttttcttggatatcatcgttgatttgctgagcagctctttggacgttcggttcttcccctctgaagatcttcgcgtttctctgcagccagacacaggtaatctatatgtcaatctgcaattacatacaaatataacacaacactgaaagcaaaactcaaacagtatcaatcaatgaccatctaggttgacggagtcaaaggcatctgtttcggttgttgctgataggtttcatgtcatttttttcagataatgaataggtttcataccagtattagtatagcttttcgaatctaagtaccaatttgtggtttccaacaatcaggttcaaatctagatacaaatttgtaccgtacagcatttaggttaattggttaatcatgtttagaggggcaacgtgaaaaacacaagcatacttggtttgtggaaaaggttgattctgcactagtatttacatcactttccagtccaacttttacacttttgagtgggctagatgggagaggaaacttaatcacggagtgttaatgtgtgtgttagttggcagtaaaaagatactgttatcagcctgggcttaaattgacctgttttgatatttcagaatatttgataaatgcgaacttaatttttgaagtccttagtataatttaaaattctgactaaccaaacttaaaaccttataatcatacaatatattagaaaccaaatttatttaggtacacttaaattccgcaaatcatatactggaccttggatgtgttctgttatgttgcttgcatccatgccatgcaaacattagtgttgccatgttagctcttgacattgctcactcatgaccaacatactaagcatgcaaatagttttgttgtgaaactacctctaaacgatgcaatgctagaaccaaggtatgtattacgaaaaaaaaaaagaaccaaggtatgtatttacctcttcagagataagtgcctaagtggagcgtgtcagaaaaattcttttcagtaagcgcttgcatgtctgcctgccacaaaatggggcatgaatctcccaagatatctttcaccactttcctacttgcatttgcatggcatgtcatacactccggaataatctgttgaatagactttttgtgatggctttgatttcttttgaaacaacttgatgtctttattttccaatctaccagcgcctacaagcttctggtcctaacattacgtttacgattagtgctttgtgcacttgcttttcttttcattttgaatgggaacagtaggaaaggatcctactatagtttcctgcacaatctcactcgggtaatcgggttgaccaattgtcaaggtcttgggtgtagaacgcaccatttgcttgcatgcacgatggaatgggtagataaaacattaaggcctatatatgcagccccgagaagtaacactgtcttgttgccaatgcatcatacacactgagatatggcgcttggatttccagaatgcatatccgctgttgtgttgatctctttgtccactatgattgctgcttcttcgggtctgagtatgagcaacagcagcaacactgacctcactgcactgatggctttcaaagcgcagctctccgaccctctcggcatccttggaagaaactggactgttggcaccccgttttgccattgggttggggtctcctgccgccgccaccggcagcgtgttactgctgtggagctgccagatgttcccctgcaaggagagctcagccctcacatcggtaacctctctttcctatctgtactcaacctcagcaacaccggcctcatgggttcagtcccggatgatataggaaggctgcatcgcctcaagatccttgatcttggtcacaatgacatgttaggaggtgtcccagccaccatagggaacctgacgaggcttgatgttcttgatctcgagtttaacagcctatctggtccaatcccagtagagttgcgtctctcgcacaaccttcgcagcataaatatccagatgaattacctcaccggcttgataccaaatggcctattcaacaatacaccttcattaaaacatctaatcatcggcaacaacagcctgtctggaccgataccaagttgcattggctccttgccattgctcgagcgccttgtccttcagtgcaataatctcaccgggccagtgccaccttcaatctttaacatgtctagactacatgttattgctcttgcctcaaatggcttaactggccctatcccaggcaacaaaagtttcatcctcccgattctgcaatttttctccctcgactacaattatttcactggtcagattccactagggcttgcagcgtgtcggcaccttaaagttttttccctgcttgataatttgattgagggtcctttgccctcatggctgggcaagttaaccaaactcaatgtcatctccttgggtgagaatctccttgttgttggtccaattcgagatgcactaagcaacctcaccatgctgaatttcctagacctcgcaatgtgcaacctaacaggagccatcccagcggatcttggacagataggccatctttcagtcttgcgtctttcaacaaatcaactaacaggacctattcctgcttctcttggtaacctgtctgcattatctgtcctgctattggatgacaaccacttggatggtttactaccaacaacaattggcaacatgaactcattaacagaacttattatttctgaaaacggcctacagggggatctcaatttcctttctgctgtttcaaactgtagaaagctttctgttctatgtatcaactccaatcgtttcacgggaattctcccagactacctggggaacctatcaagtacgctggaatcattccttgcatccagaatcaagttaagtggtaaacttcggcaaccatttctaatttaactggcctcaagctgctagatctttcggaaaaccaactgtttagtgcactaccagaatcaatcatggagatggagaatctccatatgcttgatctcagtggaaataacttggcgggctccatcccatcaaacacggcaatgctaaagaatgtcgtaatgttgttccttcaaaataacgaattctctggctccataatagaagacattggcaacctcaccaaattagagcacttaagattatctaataatcaattatcatcaacggtaccaccgagtttatttcaccttgatagcctcattgagttagatctgtctcgaaacttgttcagtggtgcattgccagttgatataggtcatctgaagcaaatttacaagatggacctctctagcaaccactttcttgggagcctgccagattcaattgggcaaattcagatgataacctacttgaacctatccattaattcattcaatgattcgattccaaattcttttggtaacctgactagcttgcaaactttggatctatcgcataacaatatttctggtaccatcccgaagtacctgtcaagttttaccatgctcgctagcttgaacctatctttcaataatttacatggtcaaataccaggaggaggtgtcttctcaaacatcactttgcaatctttagtggggaactcagggttatgtggtgttgtccgtctaggatttgcaccgtgcaaaacaacctatcccaaaagaaatggtcacatgctaaaatttttactccctactataatcatagtagttggggctgtagcttgttgcctatatgtaatgattagaaagaaagttaagcatcaaaagatttccactggtatggttgacacggtcagccatcaattactctcctaccatgaactagttcgagctactgataatttcagtaatgataacatgctggggtctggaagctttggaaaagtttttaagggccagctgagcagtggtttggtggttgctataaaagttatacatcagcatctggaacatgccgtgagaagtttcaatactgagtgtcgtgtgcttcgaatggctcgacatcgcaacttaataaagatagtgaacacttgttccaatctggactttagagcactagttcttccctacatgcccaatggaagcttagaggcactcctgcactctgaaggaagaatgcaattaggttttctccaaaggttggatattatgctagacgtatcaatggcaattgaatacctgcaccatgagcactgtgaggtgatcctacattgtgacttgaagcctagcaatgtactatttgacgatgacatgacggctcatgtatcagactttggcattgcaaggttgctgttaggtgatgacagctccatgatctcggcaagcatgccaggtacagttgggtacattgcaccaggtactataccatactcgtagcttttttactctttcaagtttatcttttttactgccattgagtggtttattactaactttttttattgagtagagtatggagctcttggaaaagcatcacggaagagcgatgttttcagctatggaatcatgctgcttgaagtgttcactggaaagagaccaacagatgcaatgtttgtgggagaactgaacaacaggctgtgggttagccaggcatttcctgcagagctcgtccatgttgtggacagccagcttttgcacgatggctcatcttctactactaacctgcatctgcatggcttccttgtgcacgttttcgagctgggtttgcactgctcagctgactacccagagcaaaggatggcgatgcgtgatgtggttgtgacactgaagacgatcaggaaggactatgtcaactggatggtattaatggggagcactgcccagcagtgatctattgcccttgtctcctcacagtagaatgggttttcgcttccgcattaagaataacacaacaatagcgtcagctgcatctgcatgcctgttgattaccctttgcttctatatttgtactgttggatatatatatatatatatatatatatatatatatatatatatatatatatatatataatgattatatacacccgggtgtatataatctattgtgcttcttcagttcttcctaagcttcaacaaacattatttagttggagtgcatgagtaattttcatttgagaggtgtgagtgtgactgagtgttctttttacatcagtgtaacccaagtgattgatctgctgcttaaatttgcttatttccaaccaatacactaacctagaaaaggaatgaattttcgctggtgccctccaattccagcactgttttccatatatacatcgaatacagttttaacagtggcgctccaagtaggttttctgatcggtgttggttatgctaattttggtctgttcacgttaatttcaaattcacctgtccatgagatgttcggtagtactggacccgttagcatttaacaaggacgtttgaccatcgatcctacttaaaaattttatataaatgttatttgttttgttacatgtttggttactaaagaaattttaaatattatgctttagcatatttagattaattttttaataatttacactatgtttggtactactatttttaattatatattaatgctattaacttttagggtatctatctatctatatctatattaattgggcactttctagaagctctcacattaatcagactaatctagccgttgattaactagatcataaaatcatgttcatagattaattactactaaaaaaagcccatgagcttggcactataggtgtcggaataactaaaaccgacacctgtagtgccttttcctcctccacgagttgaaaacacataaagctggtacttttaagtaactatagatgtcggttctaaagaaaaactgacaactatagtataggtgccggtttttaaaaaaacccgacacctttaatatgttataggtgactgttaattaaaaacccagtgccagatcctgctggaggggaggcggtgggcgacgggtggcagcggtgccctccgctccgccggatctggcgggaggggaggcggcgggcgacaggttgcggcggcgccctcccttctgccagatccagcgggaggggtggcgggaggttttttaaaaaaacccgacacctttaatatgttataggtgacggttaattaaaaaccggcacacataataaattataggtgtcgggttttttaaaaaaccgacacctatccaaaccgcgtcgagctatcgagccgatccaggccgacacatcggccttatcctatatgagcgtaccttatcctacctctctccatctctcgtctctatctatctcgcctctattggctatatctctctctcggctctctcacttctctctcgcgcgcatgggggagggcagatagcggcccggcggaggcggcagcgacggcagtcgcgccctccccttcgccgcactactagaaaaggcatttttcccaacggaagggtctcattttcgcaggcggacatagcccttagagccaaatgaccgcctacaaaaatataaatcggaatgaatatgccggtccgcctacgaaaatatattttcgcaggcggcccggtagatagccaaaaaaaataacagtgggcggcagatgtcaggcttacttggtccacctctacccttgttaatctacctttcttctcggggggttcaggaacagactacggctagcgatgcctgcctataagccgaaatagagagcctcggaggggtggatccacgtgcccgtccacctccaaccttgagtttggcatccctttccgggggggggg

SEQ ID NO: 29653 - DNA, 19849 bp, Oryza sativa
  unsure (1)..(19849): unsure at all n locations
agaggaaatcgactnnnnnnnnnnnnnnnnnnnnnnnnatgaacgacgccgtgcccggccaccgccaccaccacccgcttagcgtcttcctccgggacgccaggttgttaaccgagtcatcggtctatcgatttttttccctttccatctatttatctctgagtttttattctcttgggggtcctgttgcaggttggcgttcaggtgggacgagctcgggagggagatcatggggattgcggtgcccggcgcgctcgcccttatggctgacccggtcgcctcgctcgtcgacaccgccttcattggccacataggtttgcttctcttctctcctttttctaagtctcaaaacgcacccctccctctcatctctcctcccctcccctctcctccccacggccggcctctcccacggcggctacagcgcgtccggcggcgtgggccggcggcggagacgacggcgcgggcggcggcggcggctctcctcccccctccctcccagatctgggagaagggaggggggaggccggcggcggcagcggcgacgacgaagcgcgggggccgctgcggcggctcccctccccctccctcctagatctggccggaggagggaggggggaggccggcggcggcggctacggcgcggggcggcggcggcggcgatgacgcacgcgcgggggccgcggcggcggctctcctcccccctccctcccagatctggccggaggagggaggggggaggccggccgcggcggctaccgtgcggggcggcggcgtccaccacagcgtgaggctggcgtgacgacgacgacgcgtgcgcggggccgcggcgacggctcccctcccccctccctcccagatctggccagagggaggggggaggccggcggcggcgactatggcgcgaggcggcggcggcggcgacgacgacgacgacggcgcggggcggcggcgacaacgatgcccggcgcggctcccctcccctcccctcttgcctggcgtggcgacgccggaggaggatggcggcggcgaccgccgcccgtgattttttttttgtttttttgaatgtattttcgcaagcggattgttgccccaactgcgaaaatggatgattttcgcagtcgttgacctccgcctgcaaaaatcactttttgccgcctggaaagatattttttctagtagtgcgcgccctcccctccgccagatccagctgaaggggaggcggtgggcgacgagtggcaacggtgccctctctttcgccggatccggcagaaggggtgccggaaggtggtggcgcaagagggaaggctgcgggcggcgacagcgccctccctttcctacctctcatcccagtatattgtagaattcgttggtgatgtttttgtgaatttgttcattctgtgatgtcaatttattttggtaatgatttgtggatgatttttgggtttgggatactaatttgatttggagatgggcgcatgcgcggtgacggcgcttagtgagttcggctcgaattcgagctggctctctgtttttttttggcttgagcaatgctaaaggtgtgagttctatttttcttataggtgtcggttgttagcattggtgccgaccaattggtgctggatttatgtggcacctatggtcctttatgaaccggcacctttgaccttttttaagtagtgataaatattataaccgtggatttttgaagcccaacaacgtatttgggtctccattcaatgtccgttacatatgcttccataatttgtgtgtatcgtcgtatcgatctctgctgccgtgttagactccgctggtgacaagatcaggacacgcatgctacagaccctgcactcgaggatctccgtcgaccaaacgcagtgcggtcgccttggcagccttcgtttctcctagaagagttgaataaaattttgtatactcgtgatatgtttttcaaactgctaacgatatgtttcgtgtgaaaattttctatataaaagttgctttaagatatcatattaatccatttttcaagtatgtaataattaaaactcaattaattacacgttattactacctcgttttaggtaaaacacttaatcttcttcatcttcatcttcaggagattcaaacaccacctttgttaagcaagatttgattcaagttaatatctgcagctactatatcttcgttttaatttctcaagcaagcaagatatattcgattcaacttttttgggttttgtttagttcttttttacatgtttctcatctgaaattacgtataaattaatctcaggtatcatgatcttcatagccataattttgagggagtttataaggtatattcatttgcttttaagttaatttctcccacgtccttcgtaagcaaccaataggcttcactgtggatctttcatatttttctttttgtctttgcagatctttacaatatcaatattaacttaattctgaaattcaaaagtattaattagcatgtgtacatcttttaaccaaaaccacaatattaacagactaatgagtatattaaacttaagatgaaaattttattatttaacatattatattagacagtataatatagggttggcgattagatctatactaattggatattttgtattttctagaagctctaacgttaagtagaaacatctgaccgtttatcacataaattatttaatcattgcagttgataattgctgatctaaggccatttaaagcccttctactctaaaggtcttcaaaagctattcaaggcccagtagtccagtacgttaatagctcatctcatgctctacacattgaacctaatggacaggacagggaatatgcagaaagaccattcctaacctaacgactaaaatgatatccatagcattaaataagctgccacctagaatgaaatatgatgtgacaagtgaataaataagaaaaaaagaaaaaaccaggtcttgcatacaccatatttaagacatcatgtgagataagtagcattaaatttaagtatagaatagtggtttttgcattgaaagattagtgtctagtattagtttcttgataatgtggagtttatgaaactatatctagtgtcttgggttgggactggcctaaacccttaagcacttgcccctagatgccatgtagactcatttgctgatgtggaagagagagggaaggagagagtgaacgagccacctctcgtgcaaggggtgacctttatacacacttcaataaaaatgtgagagcattaaatttattgaggtttgtgtgctagaggtaacttattgtatagattacctcttaatttatagaaaggtgatagagatgaaattagaggtgacaaccactcaaattgctctaacagattaggatcacaccctgatcgaatgatcagcagcgatttgggcgccatgccgccatccaaccagcattgtgagcaaatcgaggaacgtatggcatgtgagacttcggcagcgacgaaagtgtggagattatgggtatcccatatctacacggcgatggtattcgaactgggtacaggatacctaatgtagatagaatatcttatctgtatcttgggtttgtttcttaacttgtgtatcaaggaaacaccctgagacttagtcggttacgactgtattttacctgtatcttcatattccgttagggatatagattgtcttttgtaatccggactccttcccatatataagggggggtccgggcgcctctaggggcatatgctgatttttcccgaatcatacaatcaataatacactcggcggattcatccccggacaggagtagggtattacttcttttataagaaggcctgaacctgtataaatcctttgtctccaaacccatacacttttctagcttgatagccacccccttttattattgccgaaatctagtttcgacagttggcgcgccaggtagggggagcgtcaagcttttcgccgaccagtgcaatgggtcctttctccggcatcgacgacctcgtcttcccacccgggcagacgtttcggttcggcagcctcgacttcatcaccgacaacttcggcaagatttctctctttgactcggaatcggaccagtcgggagagaaccggatctcagtcccgtttggattcccaaacgcggctgaaacctacttcaagaccatctcaatcgagtcggcttcaaaccactcggctgagatcgcattttctccaatgacaccagatcaaggtgatggggcttacccaccggtcctgatgaagctccccgacgatttagcggccgtctccaccacgacagcgtcctcatcccgtaggcctaggcggaagtcggcttcaacaccgatttcgcctagcttcagggaagtcggcgtcatcctccaaccactcggcacggtctcgacggatcagctagatgaccactacagctctcccaccgtcgactcgcgccccaccgacatcgtggagtacgacgaatttagttctcgctacaacgacttccacgacttcgacgacttcgacggaagcctagatgacgactacacccctctctactttggcgttttcatggccaataacgagacggaggagcaacgccaagcccgggagaccgaagagcgtcgccgactggaggaggagcaccaagcacaagaacaagaacggctacggcgtgagcagcaggaccgtgagcggatcgcgaaggaggctgaggatcgacgtcagcgagctttggaagcggggcgccgagcgcgtgatctcatcggccagcaagatgtcgaagggacaccggttttccgcacccctcaacagaatgcggttgccgcgatcaccctcctcgacaccctcctcaaccaaaacgagctcaatcgatccgaccacgtcgtcaacatcttgaaccagacgaagaccatgatcgcggcttcggtcccagttaactccgaaagcgtccacacgccgactggcagccgagtcccccacttccgatctcatgactaccgtcatccaagcctcagcatcaccggcgcaggatccaaccgcaggagcaggggccacgacgagcggtctgttcactcacctcccgaccttcatagggagcgccgagtggaacggcctcgctcaccacctcgtcgccgccccatcgatcttcgcgacacaatcatacagcgccgagcagctcgaggctaccatcactcgccagaccgccacgacgacgaccttgacggagtagcagccttcaccgacgacctgcgtcgagtggattggccagccggcttcaaaccgactggaatagagaagtatgacggcaccactaaccctgaatcgtggcttaccgtctacggtctcgcaatccgcgcagcaggaggtgacaacaaggccatggcgaactatttaccagtggctttagcggattccgcccgatcttggctccatggactgccccgtggtacgatcggatcttgggccgaattacgcgaccacttcatcgccaacttccaaggcaccttcgagcgtcctggcacacaatatgatctttacaacgttatccagaaatccggagaatcccttcgagagtatatccgacgattttctgaacaacgtaacaagatctccgacatcaccgacgacgtcatcatcgccgcattcaccaaagggattcgccacgaagaattggtcggcaaatttgggcgcaaacctcccagaacagtcaagctcatgtttgaaaaagccaacgagtacgccaaagccgaagacgccgtcaccgcatcgaagcagtcgggtcccagttggaagcctaaaaatacgccggctacgggaggaggtggaagtaacaaccataaggaccgcaagcgtaagcctgaggaacttgttgcaaccgctgctcactcttctcgacagcgttcgcgcgtcaacaccttcgacaagatcatgaactcccaatgcccgcatcatccaaactccaaccacgtggccaaagagtgcttcatctacaagcagttcgcggagcagtacaccaagtctactcggaagaactccgacgaggaacaaagcacgtcaaggaaaaaggacgacggcgacaccccggctggatttcaagaccaccgcaaggagctcaaccatattttcggcggccccatggcttatgagtctaaaaggaagcaaaagctgaccgaacgggagatcaatgctgttcagcccgacacgccccaatatcttcgatggtcagagatcgcaatcaggtttgaccgctcggatcatcctgaccgagtggtccacccggggcggtaccccctggtactagacccagtggtccgtaacgtcaagcttcgcagaaccctcattgatggcggcagtgcactcaatatcctcttcgccaagactttggacgatatgcagattcctcgctccgagttaaaatcaagcaatgcgccttttcatggagtaattccaggattatccgcaactccactcggtcagatcactcttccggtcacctttggcactcgggaaaacttccgcacagagaatatcagctttgaagttgccgatttcgagacagcataccatgccatactcggacgcccggcgttagccaagttcatggccgtcccgcactacacgtacatgatgatgaagatgcctggtccccgaggagtcctaaccctacggagcgacatcaagcaagctgtcacatgcgacaaagagagttgcgacatggcccaaacccgcgagatagcgtctgcccgagaggaaatccgactggctgcaaccacggtgagcgaaggagaagtgcccgctgccaagatttcaaaaagtggggaaaccgaagccgagactaaaaagattcccttagatccttctgatcctaccaaaactgctgtaataggcgccgagttagattgtaaataggaaagcgcgctcatcacctttcttcaaaataataaagatatttttgcgtggaaaccttcggatatgcccggtattcccagagaggtgattgagcactccttacatgtcaaagaagacgccaagcctattaaacaacgactccgccgatttgcacaagacaggaaggacgcgatcaaggaggaattgaccaagctgttagcagcaggcttcatcaaagaagtccttcatcccgactggctggcaaacccggttctagttcggaagaaaacagggcaatggcgtatgtgtgttgactacactgacctcaacaagtcctgccctaaagatccttttgggttgcctcgcattgaccaggtagttgactcaaccgccggctgcgagcttctcagttttctggattgctactcggggtatcatcagatccgactgaaggaatccgactgcttgaagacttcattcattacgccttttggggcatactgctacgtcaccatgccgtttggattaaaaaacgcaggagcaacttatcagcgcatgatccagagatgcttttcaacacagatcggccgcaacgttgaagcctatgtggatgacgtagtcgtcaagaccaagcaaaaggatgatctgatcttggatctagaagaaaccttcgcgagcatccgcgccttcaggatgaaattaaaccctgaaaagtgcaccttcggagtaccgtcagggaagctgcttggttttatggtgtctcataggggcatccaagccaacccggagaaagttactgctatcctcaacatgaaaccgccaagcacccagaaagatgttcagaagctgactggatgcatggcggcgctcagccgattcgtttcaagacttggcgagcgggggatgcccttcttcaagctactgaagaaaacagataatttccaatggggacccgaagcacagaaggccttcgaagatctcaaacaactcctcaccaagccgccggtcttagcttcaccacacccgcaggagccgttgttgctgtatgtatcagccacctcccaggtcgtgagcacagtcttggttgttgaacgtgaggaagaaggccatgtccagaaagttcagcgaccaatttacttcgtcagcgaggtcctggccgactccaaaacgaggtaccctcaggttcagaagctgttatatggtattttaattactaccaggaagctgtctcattactttcaaggtcactcggtaacggtggtcacatcattcccactcggcgatgtactccacaaccgcgaagcaaatgggcggattgctaagtgggctttggagttgatgtctttggacatatcattcaagccccgcacttcaatcaagtctcaagcgttagctgattttgtcgccgagtggaccgagtgccaagaggatacccctgtggagaaaatagagcactggaccatgcattttgacgggtcaaaaagactttcgggcactggagctggagtggttttaatttccccgactggagaaagactaagttatgtgctttggatacatttttcggcatctcacaacgtcgccgagtatgaggcgctccttcatgggctacggattgcaatttccctagggataaagcgtctaattgttcgtggtgattcacagctggttgtcaaccaagttatgaaagagtggtcctgcattgacgacaatatgatggcatatcgacaagaggtgcgcaaattggaagacaagttcgatggactcgagctcagtcacgttcttcgacacaacaatgaagctgccgacagacttgccaattttggatccaagcgcgagacggcgccctcagatgttttcgtcgaacacctttatacaccgaccgtacctcataaagataccactcaagatgcagacacccgtgacatagctatggttgaagccgactggcgagagccctttatacgatttttaacttctcaagagctccctcaagacaaagatgaagccgagcggatttcaaggcggagcaaactttatgttttgcacgaatctgagttatacaagaaaagcccttcaggaattctgcaacgctgcgtatctttagaggaagggagacaattgctgaaggacatacattctgggatatgcggaaaccatgctgctgcgcgcaccattgtcggcaaagcttaccggcagggttttttctggcctactgcagtgtccgacgccgacaaaattgtgcgcacatgtgaaggttgccaattttttgccagacaaattcatctgccagctcaagagctgcagactatcccactgtcttggccgtttgcggtttgggggctcgacatggttggcccgtttaaaaaggcagtcggcggttacacgcacctcttcgtggccattgacaaattttccaagtggatcgaagctaagcctgttgtcacgattacagcagataatgctcgcgatttcttcatcaacattgtgcacagattcggagtacccaatcggatcatcaccgataatggcacacaattcaccggcggagtttttaaagacttttgtgaggactttggaatcaagatttgctatgcctccgtggcacaccccatgagcaatggacaggtggagcgagccaatggcatgatacttcaagggattaaagcacgtgtttttgaccggctaaaatcctatgccggcaaatgggtgcaacagttgccatcagtactttggtctttgcgaactacacccagtcgggccacaggccagtcaccttttttccttgtctacggggcagaagcaatgttgccgagtgaagtcgagttcgaatctttgcgcttccgtaatttccgtgaagaacgctatggagaagaccgagtggacgacttgcaccgactggaagaggtccgcgaagcagctttgattcagtcagctcggtacttacaagggttgcgacgttatcataatcgcaatgttcgatctcgtgcctttctagtcggcgacctggttttacggagaattcaaaccacacgagatcggcacaagttatctcctctatgggaagggccatttattatctctgaagttacccggccaggttcatatcgactcaagcgcgaagacggcactctcgttgacaactcttggcacattgaacatcttcgtcgtttctacgcttaactttatcattgtatttccctattttgactgtcaacatcaagttttcttcttgccgttgtcagtcgggggctatcatcataataatggagtgtgattttttatcaattcagtttgcttacttggtttatcattgccttgtttggtttttctacttagtttgcgaggactgaaagtttttaatggcttctttgggttttaggctcaacaaagcttagcaaaaacttttaagaaatcacaaactttgcaagaatcatcaagcacagcataaatacaccagtattgtacaaattgagcctccatgtattacattcaaactcagtcggaatcagttctttcatcatcagattcatcattactcggctggaggtcgttgttgcgaaattgctccacaacatcactcgcaattttgtcagccgcagtttgcgcactactgataagatcaagggcagcttcttcgcttgtcccgtctgcaaatccatcaatggtgtcgatttcaattctcgggtacaaggattttgtcatcgccaaggccatgccagctcccatacttccagctttcttgatattcttgaaatatacttccggagcaacactcagcttgtcaaatatttcggttgcgtcgagtgcactcggaccaccattattgaggaacatggcttggataagtggtgcagcggcattggcgacgttatctcttgctccttcaagcctcttgatcttaccaaccaggacgtcaaactgagcttgagatttgatcttgcgatctacaaaacacatttataataagaatctgctgcattaaagagaggacagttcaaattgtcagctggcagtaccttcaacctccttcaaggctgagtccctttctgcagcaagttctaccttgtcttttttcaaggcttcaatctgtttttccatctgagccattctagtggcttgcgctgtttgaaatccaagtgtttgaggatacaattatgatagcataaatcaatggaacagatctggatgattaccttttgatgaaccacttagttcgaagtttgcatcctggagctgggcgattcggtcccttagctctttctctgtctttttggcgcactccttggcctcatgcagctggtccctgactgcttctagagttcccaaatgaggaaccagcttttccaaagttgtagtcttggcctcattgcgaagatggattctctgcatgatggatcatggttcagttctgctaaaaagaaaacaaagttaccgaaggccgtcactcggaagacttacatttacaatacgagtggcttctccgagcgctttcttcagctggcacacttcttcatcttctttttgacggtttatgactatgccggcggcttgtgaattctcgtcccaccatttgatcaagataggaggacgagagctgtcggtcgcctttatacgagggatttcttctccgtcatcacctgatagtcctgatgtgtttccaagacattagacggataaactgaggttatttaaatcgccattgtttgagaagacaactaacctgaagatgtacctagctgggcgtgaggtgatctttgttctttacccgaagacccagctatcgagtcgttaccagcctctggtccttgcgaagtcgtcgtctgcgcttctacttcggggatctcttgattagggcctgcgtccgactggtttccagtcgggggctcttgagttgttgccgtttcagttgttgccgactggtttccagtcggcggcaggtcactcggattcgccctatctcccgaagcatgggcgccagtcggctggctttcagccgtcggctggttttcagtggtcggctcggggtccttggatatgttctgctctgtcatagccggatcagggtcttttccagatggatctatatcagatggtttcctgcagagtgttctttcagtattcagcatcattttcatgagcaaaacatgccgaagcggaatcataccgagaggtctaatacctggaagatgttctgatctttggcattgcacggccagccagttttttcctgggcatggtacgctttgggggtttactaggcgagcccttatccccagatttatcatcgtcgccttcatcatcatcaagtaccagttttctcttgcgaggacctgtttgaccagccaatttagaggtctgaggttgcgggtctggtctgatcgttggccctccacctccctgagcggtgtgttggcgaggagaccggcgctgagagactggtggatctgacttcatcaatgcatattcctgcacaagatgctaccacggttaattaattcaacatgaagacaagatattatttcggtcataagttgaaggattcagatacatacctgcggaggcggattgaatgcgttgtatggcacgactggcagctggtgtgagtagctaacgacgatagcattcgagaatatcttgtacatcctctccttcatgattttaaagtctagagagtctgggtcttcacggtttggatcatgcttgccgtcgaattcgaatgctgtgcgggatctttccttgagtggcgccagtcggcatttgatgaagtgccgagtgatttgctctccctgtaagccttgttctttaagatttaacatgcgatccagcaactccaaggcttgtgctgcttcatctccgattggaagagagttccaaatatcttggtacactggaggaagacaagtgtacccgggaagagcaggctcgggattctgaacatagaaccagtttgcatgccatcctttgttcgaggtcttgaagggcatcgagaaatatttttggctcagagttcccctcagttggaatcctgcccccccgactacgcacggtttgttcttgtttggttggggcttgaggaagaagatccggcggaatagggcaaagtgaggtttgatccccaaaaaggcttcgcaaacatggacgaaattggcgatatgcactatggaattcgggtttaggtgatgcaagctgattccatagaaattcaagatcccccggaaaaattttgaggtcggaagagcaaagccgccgtagaagaaatgcgagaagactacgatctcatgtgtatcaggggtcgggaaagcctcaccgcacgctggccgccacccgatgatctccttggctgggagaacgccgtgcgccaccatctccttcaggttctcctccgtcacgtcggacggcgcccattggctttcgaagctttctctctcttccgccatcgatttttctcaaatgtgctgatttgattcgagggatggcttgggagaggtgaggaattgaggcggtggatcacgggaaggattttgatgcacttttcggaggtggatttggccggagttgtgaaccctagttcaccggcgcagcttttcactgtagcaaggagtggggaaaatggcgagagttccggcggggaagacgaagcgtcgcttggatataggatttttcagttaagggtatcggaggtgctaatgggcctaggcctgaacagtacttcagcccaatacttttaacagcgtggcccattgtgttccttagggacttaggcatattttgctttggcaatattatgcgcacgacagtgttgcccaatgctgatcaaatcctttttatgcggtaatataattctttggaattattgcaatgcaaattaaaaaggtgcccgacagaaaggcgttatgctgtttttgcaagcttttttaggctacaaaagctgtttgggttaactaggaatggcttgtttttattatagtcatttccttggtatgttatatacctattttcattatggtacatagtcatggcctaggctattcgacttatttattaccataatcttcataatacttgatgggtaatctttagagtttttattcggatgcctgtcaagtgtgttcattcgtgaaccttttagagtgtaaaccactcggatttcttttattatggctaaaaagcagtcggctagcatgcctatttaggcgccgcgtacgcttttgtcatataatgcacaattgtgttactatattgtctttcaactatatgtttagtttgttaactaatcacatagttgggggctacacctaattaggtgcatctattcgatgcaccatattctttatcttttcgccctttacagtccactcggcaggttttggcttgaagagtttgaagtactcggattatcatctttgagagggctacgatggtcgactgcaaaggactcgggggctactgtggagattatgggtatcccatatctacacggcgatggtattcgaactgggtacaggatacctaatgtagatagaatatcttatctgtatcttgggtttgtttcttaacttgtgtatcaaggaaacaccctgagacttagtcggttacgactgtattttacctgtatcttcatattccgttagggatatagattgtcttttgtaatccggactccttcccatatataagggggggtccgggcgcctctaggggcatatgctgatttttcccgaatcatacaatcaataatacactcggcggattcatccccggacaggagtagggtattacttcttttataagaaggcctgaacctgtataaatcctttgtctccaaacccatacacttttctagcttgatagccacccccttttattattgccgaaatctagtttcgacagaaagctcctccaatcggcgacaatttggacttccatcaagcggggccccagttgccctttcatcccaatcgacatcgattttacggatctctccagctcaggtattatttttgtcattcaagattattaactgcaatatattggttgtttatttccatgtttccatacaacacatgttagaaacagaagatcgccctaacattgttgaatgacatatataaataatttacgaatgatatatataaagaacaaaatgatgtttgatgaataattgcaagttatcccttctacatatttagttttttataggatttcttaaaaataatggatcagcaaaaactggagaacaaaacaataatccaaaatatgaagctgtacaaaacttcacgatgcgtagtccatgtggggaaaattgatgaataaatgttgtgttatgcattttgccaaaaaaaaaaaagaaaattccgagatgattgaatccgaatcctggagtagctactcctacagtagctaaccgacacctgtccacctccaattgggtttcgggtcttgcttcaggaaaagtatccactaacccaccgatgcagaaaataaataataaaattgtatttcgaaaaatcggtcaaccaaccgcaccatcattatggcctgaatgttctgcatgcaaggccttttgaatgttctgcatgcaagcctggatattctgcacgcatgcaaggccgtttaaccaggggagtcgttagtgttgatcttgccgccgggagctctatttaagacgccgacgagggtagaagatgcggtaggagtgagcagatgcatcaatggttcagcggcagaaatctaatggagcagaatccggtggtggcagaaggcaaaaactagccgtcgagttctgtcgcacagcagaagccagcggtggccggtggcaggaggccgaacaacggtgacgagttctgtcgcggagcagaagctggtagtggcaggaggcgggacgttgacggcgagttctgtcgtgcagcagaagccgatggtggcagggggcagaatctcattaggtagttctatcacgtagcagaagctggtgtggtcgcagatggcggaacctcatcggcaagttctgccatgcaacagaagccggtggtgcaggagggcatatataagtttaccgaaggaatgcaaggttttgcagaacacaatactcatctacttattggattgatttggctatggcagggtacgtgtggaagagtccaatttgtatatgttctgtctagttcttttctcctgtttgtgtgattagttgtgacggtgttttgcgttcatatgtcaggaatggttttgcacattccatggctgctggtgatcagagtgaagcgatgatcgctctgttcggaaatataacatccattctgatggaagtcatcctcttcccataattaacaaatgctatgaagagatgcgcatggtgttcacttcatgatagtcgcacaacattcaccatgtattttagaagctatgatgtagtaacccgggcacaacaggaatgcttcggaacatgtgtccttggagaacatgtagcccgtaggctaatgaatggaaagtattgaaatactcgctccatctacttttgatagtcatattttatcttagcacacggaccaaggataagtaattctacttatcatccatttaaacatgctactagtcattcctcgtaaacaatcaattcattaatatttacatttctcaatacccatgtaaccaatcatgtgtggaagaatggagagtcatgcgttaaatccgagaaagtcattaagaggataggttgttggattgaaatatgcctatcaaaaataaatttttcaggtttagaaatatgactatcaaaagtagatggagggagtaatggcttgctttcttcatgactatagattagtagtaggaagtgtcccaatatatgtatgaagttcctttttcttcttatcgagatgcaagtaatatttgagttgagttatatgtaacatctgcatgttggtcagtgcaataaaaatgagtacttttagctgattgtgttaagcaaactccctattgtcatcttaattgaaagtgcagaagaactcgatatagttcttgcagaatatagtctagtaaaatggaatggagacatcggaactgatgcatgtgagtgtatgtggctgccatattgatcagatgaataccagaggtgaccttctgggttcttgtagatccaatagatggaaaatatcaaatgaatacggaagccatgcgccttgctgctggaattctccatgccagttctttcaccatatgatctgcaacacagtcaccggcgagggtacaaatcttagttcaggagggttctgaactctcctcatgcagagaacgatttcggaatgatgatgttctgctcgtcgtcaacaatgggtcaattatcctgccttctcgctctggataaacaatatgaattgcgaataaaccatccgaatatctctcttgttagctcattgccgttcgaatttcatatctgcactagactcggaaagatttgtttgattttcaaatatgctgcagaggaggaacgatttttattgattaccaagaaaaatatatctggttaaatgaatcgggtgggattatacgagtacattaaacccgttaacagttgttaacataccccatgccagcgattatattgacggtggataggaagagagtagctactcccggtagtagcgtataatatatatatatatagacacacactagcaaatatgcccgtgcgttgcaccgggtaaatatcaaacaaatattgatgggtaagattgtttgtgtacttataacacatgtgcacaaaaatattgaatttgtacatatcttgcaaatatctccaaattttatacatacgagttgtgcaaatcgtgtgaattccgtattgtcgtattgatctagagcattactgatgagccatctatggtgataaatttggagggtgtagcccaatgaatttgcatttgctatatatgttagtgttgatatgtcactactacaaccatcggcgaccttccccgggattcaagcctgttgaccccgccaatgtggcggcgatgcagggtgccgagatgagcgccacggggctattcttcctgtccagggtcagcccccgctgtgtggttgctgcggtgctcaggctgttgaggcgaatatgaggcaccatccaataatgacgggagaagattaataaggccacaacactcaaggacgtggtgggcggtgtcgtggaggtgctcccggtaaacaagctggccaccagggaggacgcctataaggtgcggtcgccgctgcgcagaacgacaggaggcatgccagtggcggcagggagctaacacgatccattcaatcccgatccgagtcaatcaagaatccaatcccgcaccgtgcagatgtgtttttcttttccgcggggaaagcgatcaccgatggtagggacaaagtgcgtgcgagaacgcattctacaaagtctaggtcagtccggagcaggccaggagtccaagtttattcacaaagacccattctacaaagacccattctacaaccaggagtccacgtccttccacaccttttcctactctccttttttttttttctttcattgaaacctttcgctatatatttctagtcatttccagtatccatgcacataaaactgtatagatttctcacgtaaggtaaaaggcaaaatctttatatttactaaaaaatagaaaaacagaacacattttttttaattctaatttacagcagcgttgtatttagtcatgtcctattagagaaaaaaaatgaatttaacggaaagaaggtaggaaaaaaaaagagaacagggaccaaacaacagaagatttcgtttgattgcctattcctttgcattgagaacggcagataatgctcatttttgaaaacttttatatgggtcccatgggcatacattgaactgagagtatactactcctactttgcttttctgctgcacgcgtcgaccctttctgctacatgcgtcgaagccgagacaacggcgcgcacacgcgccttaattccgcacctcgaccttatcctttcccactttcctcccggtttctctcctcccctcgctcgccttctcggtttccttctatccttctcctcgcgctactctcaaccaacgacactctccctctccggcactccacctccctctcccccatcatgtctcttctcaacaacgagagtgagcgccgcccttcccatttcttctcccacccaccacgcatcagccgagagagagcaccgcgagtggataaacgcatccttatccactcgcctcctcctctcacccgtccctctctctccctctcgatcactccctctcatccccgcccccacccttctcgtctctcccttgtcggtagcagaggaggcggcagcgatggcgttaactgctcccgtgggctggatccgacggtggctgtggcatcggcggctcccgctggcgaatccggcggaggcggcggcggtgttgtttctggcaggcggattcggtggaggcttttccggcgggtggatccagcggttctctaccccctcgtcctcaccctccgcgcccaagcttgtcctgcggcggtggcatcagcgctcccacgggcagatctggcagaagtggtggcggcggcgtttctgatgggtagatcaagcggtcctccacacactccccctctgccccaagcttctcccgcggatccgccggcggcggcggcggcttctcccttggatccggtggcggcgacgacgttggtggcacccaccggcgatccggccaagggaatctgcctgacgccgccgacgtcccctcggcccgatccgccgttgttgttggttgtgtatttgttgtttgtatatgtgatgatgatgtcgttgttacgattgattttggggtttttatgtgatgatggtgttgaagctcccccacccccccccttttcctctcaaccactcttg

SEQ ID NO: 29654 - DNA, 10220 bp, Oryza sativa
  unsure (1)..(10220): unsure at all n locations
ctcgcacatctaaccttttgggttttttgcgaaccaaagggtaataagttgagcatttgcacccccaatacgattcccggagagagtgaacagttaaaaaatatatccacagtgagtcttacctcgggatggaaagcccgataagctttaagttcgcacagaggggaagagcgcatagccaccccatagcgcccggtgaacgcctttaaatatcctataaacaatgtggtgttccatggccacctccanatcaatatttatatttatgatcctatttatacatatatcagtatgcatatatatatatatatatatatattggcgacgtttgatgtcacgactacggtttttgcatagtatggggatcgttggtacttggatatatgcgagattgaggtaaaacagatggggacgaggatttttatacaggttcgggcccttaaattgtcaagtaataaccctactcctattggccgaagccggtcgttgctcttattcaccataatcacaccagtataatatttggggaagcctatctaactgttgtcaacttggtggtctgaagtgctgactcgtagtcgacaacagggtagccttactcctcgaatccgcatccggcaagatcaaagacagtgctatgtctctcctatcagtatccgtaaacaccataggggactagccatgcttatctctgaagtcgatatccggcgtcttgtcttggcgtatgttagcttgtatgttgatcttgtgtcttgatctattgttccgtgtcccctctcctcctagggggtcttgtatttatatccataggtgttcccttgtccaagtagtacttggaaaaccaatatggatacaatccgagtagtccttatcgtttccatgtagaactctattcatctttccttatgcggaactcctcctatatccgaaggttgtttccgtataaaacatgatatgtggtgggtcctgctgagatttaatcaactactattaggtatatggtatctataaccctgacacacacacacatatatagtagctatattatacacccctcccttagaataactattctacacccccctccccccatcagcccaactaccaagcccattcctccctccccccatcacgcgcgggtccacctccctcctgatccacgccctgccccgcctccccagcgcccgctcccctccttctcctaccagcgcgagcgatcgcgcgcccgtgcgcccggcccagcttcttcctccacagcagatctctctctttttttcttcgctttttctcctcctccccatcccgatttctctctctcctttttttccttcgccttttctcctcctcctccccatcccgatctctctctctctctttctttttttcttttcttcgttttttctctccaatctcttattttcatttctattttcgtttttagaacccatgatcttatggttcataacaaactcccctaaccaatccgccttatgacacgatttgatttgagatcattattttctttctatatatatctgttcaaaatttatgaacacaaacccgttatgttactataggaagtcatatcttgttactatgattcggtagtaacattatcgcagaactgcattgacacaatatgttactgcaaaatttataggccgttactgcgcaatgtataggtcgttactgcacttttagcagtaacatcatgatgaaattatagtaacagagaacatatggtagtaacggtactactgcagtaccactggttgtgcatagctaaaatttaaaatatccatcttgtgcaaaatacaagtgctaaaaaagtgcatgtgcatggtcacaagttaacacaagtgctaaaagtacttttctttgtccatacaaagatacgtagtagcaagcttagtacaagtaaacttttagaattctaatctttaaacaataatatctctcacatcgcatattattttttagaaccgttttcaccataacattgtaaaacgacgttacaacgagacaatagtcatgttactacacgatgatcgacacaaaaatgcttttataacgttattttgcagaaattagtcatgttactgcacattgatcgttgcgttactacgccgttccagcgacacgagaactaaaaaaagtaaatcccaatctttagagagcaatatctctcacgttatatagtatttttctaatctatccgcaccatgatgttcgtaaaaaaatgcttaacaaaactagatccatcatgactatttttcgatgttgttactacgagaaagttgtcctgttactgcacgatgaccgttatgttactacggaattcttgcgagacgtgaacttcaaagtggtgggcgggggagatagtcaatgttcggttcagtcatagatctcaccggcggtatgggtctatgaccttctgttgattaaggtggtagggggtacttgggccctagtaagggtgggggaggtggcattggcccatggaagggggggtgtagaatagttattctaggggaggggtgtagaatagattcactatatatatatatataatattcaagtaatgctattttatagtttacaaaagtaatctatttatctattttgcctttttttttcttattgactcggcacttcaagagtgcttccacgctatagaaaatacggactgtgaattacatgtatcgtgttaaataaaacctgcaattggaatatcacatgctttattttaatttttaaaatagtaataattataaaatacagaattatgtctattttagattctcactttaatattgtattaatttatttcccaaattaaaatttataattagcaagttgtacttgaatttggaaaatgaccaacatattcaacataggattaaaaatactcatatttattatacacacacatacgatccaacagatgacgaggctctctaaccgctgaggaaaggtactgccagcttgtcaccgccttcctcgtggatcgccaaattcgaagtttccaacgtctactccggtggcgacaaggacgggatatgggtccagatctcctagagttggctacaactctatcaggtggagttgccatgatatgtgtcattccgtataccccaacggctaggattaagccacgttaatgttaatatatacttaaaacaagtaattaaccgtgcaacagataaacttacatcaacaacatatcacaagatatttttactgtagaattatagaattaatacaagaatttcatacttcatctattttatttaaaaattatacatattataagaatttcatacttcatctattttattaaaaaattatacatattaatattgatatggttcgctgttgcatatatatgaaaacactatgttgatatatactgctgcttagagttgatcgactgtatgtgtttattaagaacaaaaagtttttcacttaattttttgttgagaacataatcaaaatagaggaagcgttgaaaaaactaattttcctctcaagctataaccattaatgttgaggagttaatttattaggtaaatttgatgaggcatgatctcagccgtaggaaacaatggatggtatagatttggccaactctacttgtagagttatacccaactccaggggatccagaccccaaaatataagacacaaccacccttaacccaaagaccaagaaataattattattatatcttgtagtttggatcatcctaaaaaatataatgccactggtggagaaacgatttgtactcccggttggaaacccccctatagtcccggttttccaaccgggagtaacaatccgggactaaagatcgctatctttagtcccggttcaaatacccgggactaaagatcgatctttagtcccggttgatgttaccaaccgggactaaagatgtggtcctggttggatggtttttttctttttttttcttttctctctttcttttcactgttcttttgcccaaacaatctcacatcaaacattcacagcaaatcattcacaacattatctcagatcaaacattcacaacaacaatatagttcatccaaatcattcacagcaatagttcatctcaaatcattcacacaatagttcatcccaaaacattcacaacaacaacaacatagatcaaatcacacattcaacatagatcgtatcaatcaacacagagcgaatcgcacattaaggaaaaaaagaaaaaaaagaaaaagaaattccacggtagcgccgcctccaccacctgccgccgcaccggtctccgcgccgggcgcagccctccggacgaggccaccgcccggctgcctcccccttcagatccggcggcagccggccgcttcccctccggatccgccgccgcccggctgccgcggcgtgaggccgccttcaccccaccgcgcaaggggcccgccgccgccgcggcgcgaggccgacttcgcctccgcccggccgctgacggaagagaggggaggaatagaacggggagaggaggaggaggaagagatgggaggaggaagagaggggaggaataaaacggagaagagacgggaggagtaagagataaggttagggaagagataagaatagaatttattaactcctcgatctcgtgcacgcctcatcctctccgccacatgcgtgcatgccgatcttttgttccggtttaggctaccaaccgggactagaaatagatctttagtcccggttggtgtcaccaaccgggactaaaaatagatctttagtcccggttgacaacaccaaccgggactaaagataaaaaagtagctctaaccttttgaaccgggactaaagataatctttagtcccggtttttattgcaaccgggactagtatagattttagctgaccgaccaaagatggtttctccaccagtgtgcatacatctaataggattagagcaagtttaatagtatagctaactaccagctccaattcatctatagccaatctaatagcccattcatacaatagttgcatactacactattaatacctggtcccacctgtcatacgcacactgcatcttggagtccgtgctacagctggctacaaatctgtagtccgctgcttctctctccttatttatctgcttaaaatatgtttgcagctggcttatagcctgctattgtacctgctcatcgataacatgtgagtggaggatttaaaataataataatttaatgaagaatatgtcatagttgattgcatgcttgcatgcatgccttatattatgaaacatcgaagaaaattggttatgccttatattatgtaatggagggagtacatccgtttcttatttagtgtattatgttgactctttatatgccgtttgatcatattcatatggttgaataaaaatacataagtattagtattttgtttgttgtcttgttttaaagtgcaaattatggttaagcttttgtactccctccatcccattttaagtgcaataataacttttcgtgtccaactttaagcatccgtcttatttgaagtttttttataattactctctccatcctataatataaggcatgtcaaacttggtacaatttttaaaactaatcttttgacttatatcttctcatacttctataaggtttgttgcaacaaaattataactatcttaaagtaaatttaaatgtcaatccaatgatattaattatagcaaataaaatttaatttatattataataattgttggtcaaatatttttaaagttgaatcctgaaatatatacacaccttatattatgggatagagaatgtagtatttttattgttgagatgataaaatataaatagtactttatatatgacttatgtttttcaagttttttttaagaaaataaataaaacggacggtcaaaattgtgcacagaaaattatggctgcacttgaaatgggatggatggagtatttctagtgttcaattcggctacacaaaacgaaatattcctgctaacggttttagagctggtttaacaagtactctcgggagtaaaatcatttcttaccagcacactcgggaaacgacgaggggtagcatgacagactgacttgatgatgaattgatgatagacgaccttgcgttggaaattcccacatgcagttactatttggttcatcactgcacacacgcgccgttgccatgcattccaagtttcgaaccctcggatggcgcgccgtcccactgctggttggtcggcaagaccttggacggcgcgacgtccactactacacaaatgctccagatgtcagaaatactaacggagcgtttaaactgagaggtgtaaagttttagtgtgtcacattggatattatataatgtatcgtatggagtgttcgggcattaataaaagaattaattatagaatccgtcagtaaatcgcgcgagacgaatttattaaatctaattaatccatcattagcaaatgcttactgtagcactacattgtcaatcatagagcaattaggcttaaaagattcgtctcgcaaattagtcacaatctgtgcaattagttattttttttactatatttaatacttcatacatgtgttcaaatgtttgatgtgacagggtgaaaaatatttgggtaggatctaaacatggcctaaaatcaacacacagtgttctttccacaaaaacatgcaccagcagagcaccatcagctagaatcggcacttttataaagaataggtgttgatttaaaaaaaaaaccagcaccaatacttgtccggtttttaaaacaatcgacacctttaattaatttattgtaggtgctagttaattaaaaactgacactacaaatatataaaatttaaaatcgactggaaaaatgtaaatttgactgtcaatgacacgatctattcagagtcaaatctactgtttttatttttacttatataagttaaattttataataatacattacatattaatttatcttattacaagtttttaaatttttgatattttatggatggcatgtaaatacaagagaatgtaccagcgagaaatgaagactttagtactatattttttttatttgtacttgtctactttaatgtagaagaacatagcgatccaatggatcactgcatgccacgtgtgattacaggctaaagtgtgtctcgttgcggatggtctgatgagttgaactgggactgctacgcatgaggtcgtgggccaaggccctttacagatgaggccgtgtgacaagcatgttctggcaaacacggtatcatgcttgcccaaacaatggaataatgaaaacctgataattaaagatagcaacctattatatagtcctccacataatgcacaccaggcacttgcgcagataaagtcgaagcatgtcacccatagataaataagctcgatcaactgaatgtctgaaacatcgaagacagtacgtagctaataggccagtcgactacgtacaacacatgcgcacgcatttccactgaaaaaacctactcacacgcgacattagctacggcgagcgggtaggcgaaggagttggagtactggaaggagacggcctcgctaggacccaaccggcctccgcccttcaccagacagtcgttgaagccgatacgctggaactggctggggtcgacgagctccgcggaggcaaactcgccgcaggagatgtggacgtcgtacaccgtgcacgccgtgcagacgttgatgatttccacgctgtaggtcgggatgccgctggggaggtgctccgcgttgttctggtacaccaccacgttctgctccgagcagctgtccggctgcatccgctgcatccagtggcgtccgccattaggagagtgatcttcacctgatgatcaacgcatgcatgcagggacattgagacaactaatatataaattcatgtatctaatgtatgaaatcagagggtttggtccttgtgtatatgagtatatagcgtactgatgttgagaagcttgttcatgttcaacgtcttggactgcatcgcggaggaagatgactcgccagagactactagagctgcattaaaatcaagatgatggtcacagagacgaagccaaacgcatgagaaactgagaaatttagaattgacagctgcataccttggctagctacgagcagcagcaagatgatggtcacagatgaagccaaacgcatcgtagtgcagtcggccattgccttctctgtataacctgcagctagatcttacctagatttgaaatagggtagcagttggcagcaaactgccaaatacttgctcaagctatacaggcatgcacttcacttgcctgccgggagtatataagttcaccaggccatctgctcatgcatgtttgcctctgcaaacatagcacgccacttgactcgggagaggcaatgcattaactgagaccgcgcgcatgcatgcacgcgcgcacaccattcgaacggttggcttcgtcccgcggataggtctcgatgccgattggttacccacgacggcatattgggtggactgccgccacgcgcgatgaagcggccggtggacggctgccactctatcgaagatgctgccacccggactgccgcccccgcccatagcttctactatggtggtgtttggatccataagtcctagggacttattttagtcttaggactaatcattttagtccataactgtttggttatagggactaaaagggactaaagtttattaaatgcgctgcacaatgaccatattaccccctaaaaccatacaaagtggactgcaccatgccccttgctgcagcatgctgtttgctgccgctgctagcactttacaagcaaaaccattgttgctgcatgacagcacaaccaaatgcaagccaaatcaatgtttcaccccaacatcacatgttttaatccatcataatttggacaaatacacaccttcagcaagccgaatcacaagcaataacccccacatcattttcatcatcaatatcacagcctaatcacagaaattcaaagaagctcatacacatctcaagttgttgaaatacatcacagaagtttcaatgttacaaattacaagcactcatggttcaattgacaagttaaaccaaatacaattcacaataaatttgaaccattcattacattcctttcaaagaccacaatccatcggcaacccagtcccgaaattggttcatgacacgcgagtccaaatcgtttgttggttcactagatggagcagaggttccacccaatggatcataattttcatcatggtcacaattgtcgaactctgtattagccatttgactgtctctaatgaaattatgaagtgctatgcatgcatggataattctgctttgtttttcctgcgagtagctaggtaaactaaacaaaatcctccacttgttcttcaagaccccaaatgacctctctatgacattccgacacgaagaatggcagtaattaaagtgctcccttcttccccttggcaatgtgctttcgttgtactcttggaatgatatgttatacccttgtatggtgctagataacccagcctatttgggtatcccgagtctacgagataaaactttcctggaggtggctttggaaacttggcactaaatctagtttgtgcatcattgaataccctcatgtcatgaaccgaaccaggccagccagcaagcacgaaagtaaatctcatatcaaagtcacagacaaacataacattctgactcttctccttatgtctattcctatgttgaacagcagctgaatttggcaccacaacttggatgtgagtaccatctattgctccaatgcaattatccaaatatggtgtgtactgtggagaaagcaatttcttatggactgttgtgaataagggatcttttggcctaatgatatcttttgcaagtttcagtagagcggtcaaaactgctttgaacttactatgtactgttctaagagacctaacaaatcggtcttgggcttgcctaactgattggggagcacctactatccacaaaaaaaagacccaaacactccatggaatctattttgtttgtggacttcaactcatatgattccacaagcacagaatgtaacctctcaaaaactggcctgtgcatcctaaacnnnnnnnnnnnnnnnnnnnnnnnnnntgatntcaggggcg

SEQ ID NO: 29655 - DNA, 1845 bp, Oryza sativa
  unsure (1)..(1845): unsure at all n locations
cgcgcgccaattgactaacattgagtacccgcgtctatcaattagggtatttgacttatcactttcagagttgaaagaattgagcagccccttcatgagcttcaccactgggctcttactttttttcccaggactagaagctgtggacacatcacagctgctactccctctcttcctgttgttagtgctcatggggctgttctcataaccatcccctacagctctttcccctctagctgtctcccctgcatcccctgcttcttcttctccttcctctccatcttcatcttcaaaaccagggatatatgctgtggaaccatcaactgcaactccttgaaacatctctataagaaaatctaagtactcagggttgccatggcaaaatttcttggcatcccccttctcctgtattgacacttaatcaatatcacataaaactctaaaatcatgtaaactagctcaatttttgacaactgcgtacctttttttttcccaccaagcatttgatgcaattatttctccactagcacttctaccagctccagtttgttggttcagccacacccaagcaatgtactaattctttagatgggtgaatctattctttatctgtttggttgaatgccttaggttagccctttggaaatatttggccttcaaattctggtaccctctagttgtccatgctccattaggacaatgcccatcccttatttcctcacgtgctatttcacacaatgtgtaagttttttcttctgtccaatttgccttgtcatacgtattctaggaaagaaaaacatgatttaaccctaaattaaccacatgaacaacaaatgacataatacaaatgcttagctcacggcatgcatagcaatatcaatatcatgagcaacaattggcatatttcgcaatagaacagaacaaacataacagatttgaaccatcgggggtttaccatgtgctgaccatcaggaccaaagtcctcttcgtcttcatcgttgccgtcgtcctcagacacatatgtcccttgagacgacgacgcaccgactcgctgtcctcctccgaagactccaaagtcaaaggcgggtggcccactgtgcgacatggatgtcccatgacctcggacgcgtccttcgctagacgatgagccaggaggaacccatcctcgcattcccctgccagatccaacgccattggtcaacgacctgccacggcctcgtcctcctcctctccctccacgacttctgccgcgtccccctccccccgctggaggaggacgtgatggggggactggatctgctccctgcccgaatcggaggtaacccaaggctacccggttgaatgatctgttggtaggaggcgaaatcggggaaggcgtcggcctgggagttcagattgaggccccccgatccccctcccccaaaatggatgtcggcgccagatccaccatatcctgaagatccctgcgagaagccgtagtcggagccgtccatgtggcccgctggagcttcattgaacgactgggagaagaaatcgtgaggattcccccccgccattgttgatgcgcgattcgtgaggcttgcgtgagcggcgtcggcttgcacgacaccggtgagccaagcggcgggcagaggactagctaggcggtgggggctaacgcagggagacggcggcgaggtgtaacgccccgattttcgttcgggattaaaaatcatttaataatgcatttcctagaaattaaataaaaatttaagcaatttattcgagtgaattaattggagaattaaaaatttgccttaaaaatcactggccaggaatattttgcaatattctttgtgccctaan

SEQ ID NO: 29656 - DNA, 6700 bp, Oryza sativa
  unsure (1)..(6700): unsure at all n locations
ggcttganccgtgccgttgctcaaccgcgccaccccgtggtcccggtcccgggtgggaccgattccccttgacccgttgacgtgtgggcccgccctgtcggcgccggcctctttgatgacgtcagcgcttaagctttttcctttgagaaaataaataataattgcgcaataaatcgagtttaattctagaaattcattcaaatggctcaaaacttctaaaattcatacctaattcattcgaactccgaattgagccattcaacttgcaaaattcatctaaaattgagctctacatgtttgtttagtttttatgtactgttttattgatttttattagagtttttcctcgttttgcatgccagtgtgtagaatccgtcgtttcgaaagtccgcggtcgcgaggaaaagagttcggaagatcaaagtgaagaagcaaggcaagtcacacattccccttgagcatgttgatcccaatttacaaatattttactgtttgcaaataaatatgcatgttttgctaattacatggggtcagggttttacctatctgctcgcttgtgccatgtttacttgatatctgtcctttgtcaaccatgggtaataaatcacctagcttgtgttactttgatgacctagctagaactatatgcttagccatgcttaattaccactagctcagtcgatgggataattgcagtattagacattctagtatcttgttgagctgcgtgctcgagacatctggccatgcttcatggtcgtaattatccaactaaaatgcgactgaatggtgggctgtgggtgcatggttttgctagtcgcacccatggcaattaaggaccgattcgcgggatgccctggaagaacttatcgtacttaccacaagccagcgtgggcaacggctgggcttatagtgtagctttcctctagctgacgcatccaggcaaggatgggcgtgatggagcggggcgggccctgcgacggcctctgtcgcttccggattcacctaggcacgagaggggactgcccgtcgcccgctagggacgggggtgaaacctgaggtgtggtgtgcttggctagagggggttatgtgaagggtcctgtcacggcctctttccggtatgtcgtggtggcatgtcggcgcacggtaacgtgtcgtggggctgtgtcttgtgggtacagttgtacacctctgatcagagtaaaactattcgaatagccgtgcccgcggttatgggcggtcgaccagattcaccgtgattagtctcacacttaataaatcgacccaatacactgtagttcaggtgggttggttgggcctgttcaacgtggtgtagcgttgatcagtggagatttaatgttactctaattactcaacagttttactgttttgctcaataaaatgttttacaaccgcctttatgcaaatagccacaaacaatccttgtatccccttgcacgtctgcatcgttggtgtggcttgctgagtacggtggttgtactcagccttgctattattcccccttttcagaagtgtagtgcttctgagctgaagacgaagttagaggaccaaggctcagaccccagttgagttttgcctgtggagtggagctgaagccccgctaggatcgcctttttccgctgctgctgctttcgtttcggtgcgaggactaagtgcctcttttgtaagtattttacgctttatttacgtttggaactgtatattacttgtcgctttgtgtaccctggctggtccttgacagggatttaatacacaaaatagtctggaaatttgggctaaatttctgggcgtgacacgagggcgcggggttgtgaggagcgagagagagacggcggcgagggcgcggggttgtgaggagcgagagagagatgacgcgaggaagagatgaggcgaggaagagagtgggcgaggaaatggatagggttggctggcgtgaaggggcagtggctggaagagagccactttttcccaataagcacctccatttgggacttctggactaatgcactttagtcccattttagtccctcctgtttggtactctagggacttaaagggacttaaagtggtgggacttcttttttagaccctcaaagaaacagggcctatggctggcgtccaaccggttggcgtggagaggagaaagcgattcttcatatcccttaaatagttacaaaaaatataaaaaataacaaagataaatgcgaatgtgtattaaccaatttcagtttaatttactattttataacttgtagaagtcgaatttgctgcgaagtgcgaagtggtatatatcatattaatttatttattataattcttaaaagaacataaatatttagatgtcataaaataaacaagagaatattttctcaagatgaatatttatttccgtgtagagtagtgagtactacatgtagcaagaaagactctctactataaaacaccacgtagaggccggtctgtcttataggtattgatttgcctaaaaccgacacctataaagaatttttccactttttatcgggatataattaagaagaaatatctatacccagtcattggtatcggtttataaccaaaaccggcacaaaaagtcatatgtgctagtttacaattaaaaccggcacctatgatgcgcaacttatatatatatgtatttttacctaactttttcatactaagttgaagattacctttatatgaaatttgtagtgttccacgagatctacaacctgatagttaattactttttgatttgaggtagtttgggtatccgaaaatatattgtaaagtctcaaatctatttggataagtgaattttcaaaatttctaaacgatctcagatggaggcaaaacctataccttttgactaccctcattagtactgctaaattggtgccgatcacatataaggggtttggaaccaacaccaataagagattttctactggtgactaaatcaagagagataacattagtgcatgcatggacaatataaatatttggggactaggagcgtttgcttcatgtattgattccaatgattcaaatcattttgatgaattttaaagctaactagtaatttgtccgtgctaacgctacggtgacaatatgtatcacatataaacaatcaaatcgaactgtaagttcttgtaatttgccaatgcaacatcctcttcgtccaatattattagtttggacgatttgtggtttagtttagccacatgacacgatggatcgatcgagtaagattggtatattgttctgggtaaaggtgtgcgtacagcttaattcctcacatgtgttgttgattgtttgataaatgatctgtcgatcccataaaccaacttttagctatgtttcttaacatagccacagttagacatatagccagcaattggcctttttttttttttgggaatagagggtgtatatttgcttgataagctacttgccagcagggcaattactgaagtaccagagagttaaattgagcaacccgattcattcagcatcagctgaacacataagtcagtttctcccaaaataatgcactatgaaattccttgcccaagattctagcaagtctcactacaagaaaaaccttatgtagaggctcttttgtagaaacaattttcaaaatgcatctaagttttgaagctctatagtctagagacactttttagaggcacttccaaaatcgtctaaaatatttctactctagagacactttaaagacatttttagcatactttgttaaatttatcttgtagagacatcttttcggcactttaagatttgcctgatatgtaaagatattttcttaaggcacttaaaacgatgtaaaggtatttttccaaatattaatatatatcaagttactagatataagtaacacaaatcacatatttacatgtaattatatgatgttgagatggttagtgcattgaagataaaaatggtcaactcaagaagtcatgagttcaaggattggtaagggttaatatttttctttcttttttcatattgatttgctatagttcccacaacgtattaatgcaaatagagacatcgtagttcgtagagacaattcaccaaaaggcacttatgagagactcttcaaaatgtctcaataacactgaaaggcattaaaaatgtattaatgcctctacaaagtgcctctatttgcatagagacatcttataaaatgactcttagtttgtagagacaattcaccaaaaggcagttatgagacactcttcaaaatgtctcaataacactgaaaggcactttaaaaatgtctctacaaggtatatttgttgtagtgtctatttgcaggcgaccccaaaactgcatataaagacaaattgtaagtgaagttaccttgactttccaactgtactacataaataactcccttaaaccacaagtcatgcaagaccatagatcttagggcgacgctccggtgctctctacttgtagtattctactacaagtagaattaatctcgaccgtttattttaaagggtagattagtaatctcttaatacagattaggggcaattttggcatgggatgatttctctgtctcggtcgcttgttcgcatcaggtccgacgcaatctcgccccaagcccctgacgccgcatcatgtcatcgctaccacctgtaaaaaaaaaaaggttttcgctactcccggtaggcggcggcgcggcgaaaatcgtcggcggcgctgccagtggctcggcgccacgaatcctcagctggccactcctcccacccctgacctgtctatccgttcccattcctctctctcttccccaccatgcgtgtgcgctcgctactcctcctggaaggcagcggcgcagtgaaaatcgccggtggcgctgccagtggttcggcatggcgaaatctcaggtggccactccttccacccctcacctgtctatctgtttccattcatctatcttccccaccgtgcgtgcgcgctggagagcgcaagtcctgccggcggcggcggttgtgcatcacatcccctcccgctgatggctaatctttgcaacgctcccctctacttccattccccttcgcaaagtgagaatggggcactagcttgtggcagcaatattccatcctcttctgcagagggatcaaagaacggcgacatgattatttgtgctggatgagaatcacccaggtcatagcaacatcagttatcttaggtctactctggtggcactctgatccctcgacaccaaaaggtctacaagatcaggtatatagatagcaataatcatgtgattcattttacgccaaagaaaatgcgactcatttggaatggtggagttggttactcagagagcttattaatgatatgtcagctcaggtatgcatcaagattagcatcgtcacacaattttaccttatgtatgcatgccagcttactgtttttcatagctgtgttttggggtttctttcatgtgtttactgccattttcacattcccacaagagaggaaactgtagtaattgttcaatagtttagagtggcattgaattgatgcagttgatgaaacgaacataattttattttgggtggttgtactgatttttattacttatgatgtataaatgacataagcttatatttgggtgcttgtactgattttttttttgtacttattcataggtgaggtctgacataatgaattcgagctatttgagcctagaggatcaggaagagtataaaatgatgggtaatgtggttttttcaagcgaggacgaaggttacaaattctatttaggctatgcaaagggcaagggttttagtgtgaggaaaaacaagttgaagcggaaggacggggagatcatatggaggcaatttgtatgttcatgtgaagggcacatggagttgaagcactttgagaggatagaccgtaaaatggagccacgtgacctgacccgctgtggttgcttagctaagcttgagatcgagctgaacgagaagaagggagtgtggtttgttaaggagtttgataaccaacatacgcacgaacttgcaaatcctgaccatgttgcaactttaggagttcatcgtgtgatgagtgattcttagaaagcccaagcggtcgagcttcgcatgagtggccttaggccctttcaaatcatggaggttatggagaataaccacgatgagttggacgaggttggttttgtgatgaaggacctatataatttctttactcagtacaagatgaagaatatcaagggtcgggatgctgaagatgtgttcaaatatctgacaaagaagcaagaaaaagatgcagaatttttcttcaaatacaccacggatgaggaatggcatcttagtaatgtgttttggccagatgctgaatcgcgtattgactatgctgctttaggtggtattgtcatttaccatagcacttattgtgcgaccaagaataatcatcctttcattcctttcatagtagttaacccaccatagaaggacaacaatatttgggtgcggaattctatccaatgagtccgtaaattcttactgttggctccttgagacttttttggaggcaatgcatcaagtgcatccaaaatcagtaataaccgatgacgacctagcaatggcgaaggctgatcaatttgtacataagtagcaaagngcca

SEQ ID NO: 29657 - DNA, 727 bp, Oryza sativa
tctcctacctccagctccatccccaaccgccgccatggccaccaaatcctcccacgtcgctgcctctcccgcgcgactccctctcccgcgcgtgcgtggacgcggtcgtcgcccacgtccgcgccgtttccccccactctccccgcaaaatccggccacgtcgccgcctcccgcatctctctctcctcccacgtcgccagccggtttctacctctctcgggctcgatcccgcctcccctcccctataaaaacattccccgcacctccctctccattttcccctctctcccgagccctcccgtgcatgaaaaccaccccgccaccgtcgcacctcccgccgccgctcgccgacgaccctccagccggtcgccacagccgctcccaccaccgtcgttccgcgcgaccgccaccagcggcttcgccgcgtcgtgccacaccccggcgtccgctccatttcccctccccacctccgaagtaccgtcgccacgtgcaccacctccttccaccgaagccgccgactccgccggtcctagccaccccaagtcgcgctgtcgccgccgctcgcttcacagtgccgaggagcaccttggccgccgcttttcacggccgggatcccgccggaacacggttcccctcgcgccggtacttccggccgccgtctgccggttctcgctcacggaacgccgccggggccgcctttccgccttcatcccgaggagcgccgacg

SEQ ID NO: 29658 - DNA, 760 bp, Oryza sativa
  unsure (1)..(760): unsure at all n locations
cgagagggnnnntnattggacaacttgttggtccctgcatttttaattcttgagaccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcggccaacatcatcttattctctatttgtattccctccatctttcagatacggatgtagccttggatgtgcccgtgcccaatgaagaggaagagcgcaacatgaaacgttagtacaaaaggtccggacacccacccagatcccaatagaattcgccaaatcctgcgggaaattgtaatcccattcaccagctcctacatttaattaacaagagaactattgtatttatctaacacctggattatctccacctttcatttgatccctatttatagatacgctcgcgtg

SEQ ID NO: 29659 - DNA, 13374 bp, Oryza sativa
  unsure (1)..(13374): unsure at all n locations
cctgtctataaagctggccagtgttggccaacaattacaattaaagcttgtgagaagtttgaagaaataccggaacctatatgttgtacagcaccggatagaagggagacttatatatccagaatctttaagattcttgccgttgtacattctgtccatatgcaagtctcttgctcttcgtggtggttacgcagatgtttctcttgatgaacgttgtgctgctggtttcagcatgatgatactgcctgcaaaaaagctgctcaattttatttatccttcattgtacagggttgatgaagtattgtcaatggtatgttatatttccttcatatacatcttgttaagttaaaacatcaatactctgtaaataaaatatgaaatgaaaaaaaaaataacttctagtgttagccttttttggatgggaataatcagcacaataacttattagtgttcaacaattagtttggaaggtctttactttgtggttttgagaggaaggttctgttttactttgaaactttagagctattaataattaataatgaaataaatgcatcagtcaccgagctgttttcgttggtacattagaaacacgcctttttcttctgtttagcttaagcactgtttgctaatgaaattgaattttccaggaaccagataggatcggtggatccttgaagcggttgccactaaccatgcagtgcttagacactggtggtctttaccttcttgatgatgggtttaccttcctagtatggttaggtaggatgctcccacctgaacttgtgaacaacattcttggagtcagcttggcaaacttccccgatctatcaaaggtacactttttactctctagtcaatggcaatgcttgctataaattcatcaagaagggcagagcatatttccattttattatgtcctaaaataaagtctcaagtatctctgctaggactgaacactttgttccgtaaattgaatctagttgttaatgtgggtaattccaaactagttttgagttacaactatgctaactgggatatcttgcaggttcaattgagagaatgtgataacgagtactccagaaatttcatgaaaatactagggaccctaagggagagggatccttcttaccaccagctctgccgcgtcgtacgtcagggtgaacagccaagagaaggctttttgcttctatctaacttggtcgaggatcagatgtctgggactagcagttacatggactggatactccaaatccaccgccaaacgcagagctagtcacgatgaatcaagggaatcgccgttccaaatttttggcttattgtaaactgctgcagattcagccgctgccagttcctaatctctcgaaacagttggaactaattcgcaagtcagatgtccagaatgtcttccccttagcagcagcacgctggcaagcaaaagttttattgttaatattcgtccctgtgattattttcctcgtgagtgaaaatacagatgttgtatgagaataattagggcaacagtgaccattggtaaggtatacaacttggtgttcttggaaatgtgctgtacgttttttttttccatttttgtttttattattgttcacatttctagtttgtgccgtgtcggtctcctggtatttttagttctccaaagtttgtcgtgtaaaactcatttttgactgatgatctagctgcatgtaatggggggagggctcccatttaactggtgttcttcggatgtctgttcgtgtcattcattttctgataccctgttttgattctggatgtggctactggttagtctcatcatggtttacgttgttacgaattgtagtcgcatttaaattcaaatgaaatttgctaagataaactcagtaaaaccaactactcgtgcaagagttactgacccatgaatgaagtgacggtgtctcgttgctttgtttagttccgcgagggcgaagctaatgatgttttgatattgagaaaacaaggtgaaaagcaaatattttgtacagggaggtttttttttttaaaaaaatattattgcttatgagctgaatacaccacttatatatgaaaaataatttgagtagggtttctccctaagaactttaggtgcaaaaagaccaaggaaaacccatgcacaaaattaaaaccatgcctcatgacatgtggttttgtgaaatttaatcttataattacggtcatgtggttttgtgaaatttaatcttataattaaaccgtaagttcttaactcaaaccgacagagctacacaaaaccagaactatgcggaaaacaatttaaacaaatggttctattaacaccttcttgtaaagaacattaaaaaaaggtattttctacagcatataaactagtgaaaagaaaaatggagaaataaaatatgtgaaatttcacataaaaaattaaatagtaatatgtactatgtagtactttaaaagaaaccaatgatagtaaccgtgagactcatatacttcatctttttttccttggtatcgtcaactcccaaatcacatgcgctttctcttgaaagtatcagttttccttatctccttttccgttgcaaaggcactgagtttatatttcgtagttgcaaaggaatagaaaattagtaaagtgagcgtagctcaactggttaggttctgtctcatagaagccgtccacatggatgcgcgcttattttcttttttaagaaaaaaaaagaggagagaggttttggactcgtagaaggaaaggcagccagcagcccagcgcagcaaagcgctgtggtaggccctttcccctcctcctccgaaaatgatggcggctcgccgtttttccgccgccacgccctcctctcccctcctcctccgccgccgcctcctttcctttcagccacagcccacggcggcggcggcggaggccgacgcgggcgcgggggagtgggtccgtcgcgcgggggcgctctcgcttctggggctcaccggcgccgtcgccgccagcgccgtcagcgacctctccgtcttcctctctgctccaggtcaaaaccctagaatcccttgcccaatctccattggagtattgtattgagcgcgtgattcgcctgttcgaactgacgattaggatggtgggggggattcggatcagctaacacctatcaacagcaatttgatttgaaacgcatgaccgatgaatctgtgcatccttcctggggagtatgagagctagcattcgcaacgtgtgatgatgatgttttgcttcgcgatttttttgcatcgagttagtgagagagagatggtttgggggctaactactggtggtgctcttgttgcagccaggcgatagagaaggcctcccagaaccagcaaatagtgaatgcgatcggcgcgcccatcgtgcggggtccctggtacagcgcttccatcgccgtgaatcacgcgaggcattccgtctcctgcactttccccgtgtcggcgcctcaaggaaatgggcttctcaagttcaaggctgttcgctcgggaggtagtatgtgatatattgtttttactacttggatgctggctggatagttgttaaattgacatgaattttcttttctgcactaaacttgaattaccaccacttgaacttttaatgcatactctgcatgaatgttcatttacggatggaatagaacatatttttttagtctgcatcatttatgaagtgcttcatatcatgttctcattgcatttggacgaaaagcaaatcatattagcagattcgtttatgatttgccttacctgatagcataatgatataggtataaaaactctctgactataggtacaaataatagctataggatatgatgaacaccacgtatgcatcaatagatctcataatgctaaggtctgaggtgaacttcataatagtcattatccaccatccaaatggaatattatgaatgattggccctgatctttcatggtaatatgaatccagaaacctcctcatttgttggcatagcttgcctcctttgatgcaccagtcaaaaacctagataacaaattcttatttccccctgcaaacactcagtgtgcaaaggtgaaaatagggattgtccagtgattatattcctacacctggtacaaaaccaaagatgaaccctagatgattcctcaagcacactcacaagtgctgccaatgccatggtggtttcctggtattttttttactcaaaatattcaatccaccctcttagacgcccattggcctatgacatttatagcctagcaccagcttccctagtttaagatcatatttgaagtcccttagaaacaaacaatatgagttctcctaaaaatcaacaggagtatgctattttgcacaagattggaggctgggttggccacactttttggatttggataaggttccagccacactcctaaaaatcgaagttgcttggacttgtgctcaaagtactagcgagatttgtttttatgggcttggttgcagtagattttatcgctgtgtttggattcattctgtttttgtataatctgttggattagatcagcttggaaggccaattactagagtactggacttgtggttggttcaatcctttgcttggtttttacacatttacactctgcctaaacggttaagtattactccttatgggctgataatacttgtcgttttggacaaggacacggttttcaaaatacaattttgaccactattttttattataatatatatagaaatatcaataaatatatgattttattgaagtacatttaagatcaatctatagatatggtcaccatatttctaagacaaatattttagatgttatttatagacaaatagccttgtccaaaacgacaagtattatcaacccggagggagtagtaaggtagttcctttattcacaaattttgactaccagtagagcttgggtagatgaaagatctatggtggcaagttgagagacacaccatgcaattattaggtgcagaatacaactgtgttatttcattgttgaacagtaaaacaactttgcagctacaaactagcctaccaaaaattatgaggttagagctattggatccttgcttaagtgtacaacgtagcaataaaaaaaaaagatggcttgtcaaatttcaagtagttggcacttcatgtttgaactttacccgaagcgctgcaaatatactcgcaccggtcagaactcagaaatacttgtccttctggatataccttggatccaatctttttaaaatattttgattgtaaatataaaaaccgtgcatgtagatttgtttgaaaagtattatcataatattatatatttgttttattttacaaatacattaaaatagaaattaatggtcaaagttgcattttgaagatagtgacaatgtccaaaaggataagtatttgtgactggacggagttatattttggtatttgaactaataagcaaactctaaaattctagttctcttaaaaaggttggttccactagggctaggtcagcattgctgtgatgcctacattggcctagtaatgctctttttctcactcaactcacagtaataaacttttttctgtgacaagaactatttagactaaacgttgaatgtagtttgtaaatttggtcctgtcggtgtttctgattgctcagtggatgattttcttggtatcgagacttaatgctcatgctaatgtgttgctactgatattgcattcctccgggagctgttagttcttaaatttatcacttcgagatatttcctccaatgaagtactgtctaactaaagaaatttttgttagacaactgatatcaatacttttgagtggctattaagtcttgatccatgttgtaggagcctaaatcttatcccgtcatgttcttattcttgcagatgagtcgtggttttcatttctgcagcccaatgactgggaaatactcctaatggatgctatccttgatgttcctactgacgatgggaaacaccaaacaattagggtaacaattccagacaacacagcacctcctccagcaattgattgcaaggcatgcaagtcccagccaacgctgacgccaccaccacctccatatccgtcacctccacagaagtgaattcgtctggagaaattcttttggtcccgaaatacctaccttggattagtcttgttcactctattcctcattgaccatgaaagaaataagtactgcagttggaccgagagaccacagattctttacttttgtttttgcaatgatacaacatagaataggttacctgattgttccccactcagcaatactttggaaggtggatccatcaatcactaaactagatttgctttaggacttgctagcgaggcagcgttttggcactcaagttttttagggtttatactacatgatactccatgagaatctaggttggttaattcagtgcttcttcctggttgtccaagccttctggttggcatgtggaaatacatcatactaaatactgatattatgtagcagtttgggtaggaatgtacgatttgaagttcaagaaatagcacctggggtcatttgttaaagctaaaaccaacgtcatcatacgtaaaaaggatacaaaatcaaaagactgaaaatattttagaagatcgttatcttgacgcctcttgtaggcattggagccatctttttcaacatattctagaactctgacaactgaagggaacattttagacaagcccatcaatgtttcataacgagagctccaacaagtgtcacctagcctctgaagagatatttcttgatagtcaccttcctgtaacaactcttcccttccaattgttttcctcacttaactcttcccttccaattgttttcctcacttctttttaatgatgctctcgaagtttttcttttctcttgtaggaactaccaacacattcaacaaaactgatatcatataaaaaaatcaccaacatcggatatctcacaaccaccaagttaagtttatgaccaaaacaatgaatataatatgctgaattattctcataattttagcttgccaaccattaaattcacctaacatattacttgctccatcataaccttagcctctaatttcttttagacttagaccaagatctgcaagtaagagataagaagccgtcatgtcctccacatgaacaataccaacaaattttcttttaacacctcacatttattaacataccgaagaaccaccaccatttgttctttgttggaaacatctaagacactcatcaaccaataagctgaacacatcattgccaaattcttccataatacttcccaataattcttttgcaaagcacttagtgatttctttgtgaattgttggagatagcatgtgattattaagtgaggcattttttaatgccttggcaacaacatcgttttgcttaatagtatactccaacaactacaaataatttcctttatttttggactgttttgattcattatgcccacggaaaggttgtctctgatgcaacaagtatcgacatatatcaattgatgcatttaaccggataagatgctcatttttttccgtttgggtttgtctgtgaaaggccacaggaattgactggtcttgtttcaatagatgctcacaattcttgagtgcctttatgtgaaaactattacagtcaccaaaatgagtcactaatatctctgtcttgttccaagagttgaagtcttatatgacaaatacatcatgcccatggtgattaccttttatgctaacatgagtcaccaatatcactgtcttgttccaagagttgaagccttctatgacaatgcttcatgcctatgatgattatcttttatgctatccctaaacaaatagcagcataaacagtaggctttgtcatccttttcgctatactgtagccaattagcatatttatcaaaccaacatggactgaatcgcctcttattcccaatcaacctatacggacactggaaataccatgtggatgatatggtccccatactaaataatttctccttaatgtgaccaagctgccatattgctcatgtagacttgcaactcctttgcggcaagtggcctaacgaagatggcggagaactcgaggcgctccccgatggaatccgccgacgccatagtgttcctcgtcggtggtgcgctcgctggagatctcgccggagcaaacacaagtgcgggagggggattccccaccagatgcgcaatgcgtgggagacggcgatcctcgacaattgtccacgcgcgtatcgactcggcttgggcccaaggtcggcaatggcgatacgggctctcgattcacagcccattcctgtagcaatggcctctctatccgaccgcgtcaactcgcgcaccttgactcctgtctacaacatctgtgggggatagatgtgagggagctagggcttcgtggaggttggaggagaggtgaaccattacacgaggagagggaggtagaagagtggcctaggcttgggattggcggtggtggcaggggatccaagtggaggagcacaattcacggtgattctcgccgcttcgcgaatgtggtatgaggttggtggcaaggcatggagtatcagggtggaggatagcgagggaggttctagcccaagcaggcgttctgcagcgacggcaagcatccttcggagccatctccacaaggcggccatgaccaagtggactggggtaactagcacaaggcctcgggaggaggagaaggtggaggtcaagctctgcccatggcgtccaagacaggggggatgcagtacaggccagtgcagagggcgtcgacagccttaggaggaggggaaggtggaggtcaagctccgcccatggcatccaagacagggggatgcagcacaggctggtgcagagggcgtcgatagagatgctgcccacccatgctgcagaaagcaagcaagcaaatccctaggtggaacaaccccaaatctaggccaatccccacgatggtatgcccctgaatactcaaaagactttttttgcaatagatgaaaaagctttggtcatgtggctagggattgcattgtctcagtttactgcatcaattgtgctaaagctactcataggaatgaggattgcatttttgataagcaacctagattggtagccaaattggttagatatgagccccaggtcttggttgtattctcatttagaacaccaaaccaatccctctcaaggaacaagctaatccaatggctcgtacacgtgctgcgccgatcgttcccgtgaacgccttgtccatgacattgaggctctgcacggcgcggcgacacgacagctgcacctgcgggtagctccacgagtggtgttgcagcaccttcaccaccaggtcctctacatagtcccacacctgcctgacaagatcgtgcgggacgtgtgcaatgctctcgatcttctggtttagtagattgtggagcaccgacctcagcatgacattggggaggttgatgcccttggtctcctcgagcacccgcatctcctctgccaagaatggctcatcgtcactcaccctcgtgcttttcaatgacgcgcgctgtgccgtggtggtggcggtcgcccgcgtacttgttgaaatctcccctgatgagcaccttctccagcatagatgatgtggaagaactccctcaccgcatctgccacggtacagagtttcggtggcatctggctgagctcgtcactgctatggctaagcttgtcgttgatctgcttgatgttatcgtttagtttatcttttcaagtttgtgctgcatttgtataaacatctgatgatgttttgtaagacattagatctataatacactatcatttgtgtaacatagctagtcttggataggggtttaatgcacaatttagttctgaattctggttatgaatatctgggtgtgacaattgtttcctggccaaggattaattcctccacctggagtgccttgagtaatgctttattcatggtggatttctcaagatccatgggtggattatgagaaagcaagattgttgtggaggttagggttcgttcttgggctctgggagtttgaagatgatggaagacaaagaggccaatgaatgagtaagtttattttttcgacatcatagcttctcgggtgtgctagagttgtcagcattgaatgagcatttgcgtagaggtcgagggttactgttagtgtcatagataaggtatacctcatatacatgtacttaccatgtctaggaatactgcatactgtcaatggagtagattcaacaactatgcttgtagagtatagggaatgttggtaccagggtatacacaagataggaataggaaaatgggagacccgagatttttacaggtttgggcccctggatgatgggtaatagccctactactattggacgaagccggtgttgcctttatatatcaatctctcgagtacaaagtatatagaggaaagcctaatctaggctgccagtatattggcgtaaagctcgagcatggtggtcggcggctagctgtagttggcttcctcgagtagtgactctacgagattgatggtggcttgtattggtttgtatctctcttggcttgttgggatgtgttggcttatccctcccttccttggggtcctgtatttataccctcaagtgtccccttatctaagtagaactaggaagacaaatatgtgtacgattcgagtagttctggttaggcccaaataggactatgtttctctttatttgagactcctctcttatctacttaagagttttgccatacgtatgaggtttgattccgtacaggatttggtatatggtggtccccgccgagctaagtacacatgtataggatatcccatatctaggacactgataacaatctgaaaattacacgcaagacgcgcgagtggtgatggatggaaggaaagctaggtagctagtggctacgctgatatccttttaaattttttttatagctatttgaataacatgtaaccaacgagggagggaatgtctcatggagagtattattatgcgtggcagctacacgcgaagtggagtactaggtggagtagtagttatcagacatggtcggtgcttgccgcgttaatctgtccatgatattggcgacgacttccctggattcccggagcagtttgatgcttttcttgagacagtcacgcttggcggcggcggcgggtgtgggcaccaacatccgctccactccgtccatgttattgcccatgacctgagcagcgagctcatcctcgagatccttctcagcgaggcgcttgatgctgtaaaggacgtgcagggccaagccgtcgatgacgcggagcacgacgctgttccagtacgcggcgagtcgcgccttgaggtcgaaggcctgcatggcgagctccacctgctccggcggcagctggtggaggtgcgacacgtcggtctctccgaaccccgggagggcgaccgccgggggcttggagaaagagcgaagctagcatcaaaacaaggggggtgcactaccattgagaatctagaaaatttcagtacaacgctatacattctagtgtttttaagtgagaaattaggaatttagggggttcatgtgcaccccccaaacactatataccttcgccactggcttggagcggtcctccagggcctcgcggagcctgctctggccatccatcatgctggtccaggtcttgatgtactcggggttcgccgtgtagttggccaccatctccatgtcgatgagctcgttcacgtaccgcgccgaccgctctcgcgccttgtccatgaagctctgcacggcggggcggcacgacggctgcacctgcgggtagctgcgcgagtggcgctgcagctccttgagcaccaggtcctccacgtagtcccacacctgcctgacgagatcgtgcgggacttgcgcgatgctcttcaccttccggttgagcagaacgtggagcgccgacctcggcatgaagttggggaggttgatgcccttggtctccttgagcacccgcatctcctccaccaggaacggctcgccgtcggtcgcggccgccgccgggagcctgcgcgcgaagccctcgagcatcttggcgaggcgcgccgtgccgtggtggtggcggtcgttggggtactcgtcgaactctcccctgacgagcaccttctccagcgacgcgcgcatctgattgacgatgtggaagaattccctcaccgcgtctgccacggtgcagagctccggcggcatctggccgagctcgtcgctgctgcggctgagcttgtcgttgatctgcttgacgatgtcggggagggaccgggcgatgattctcgcctggatctgcgtcagcctccgcgccagcgtcgggacgcccaccatggacttgtcgatcctggagagcagagggtgctccgcgaacagccgcgccttcgccttccgggccttcttgtaagtctcgtcgccgatgcggttccggacgcagacgtagcccaggccgatgcgcacgtcgtccacggtgaccttctcgagcaagccctcgggggccttgtcggacttggtgacgacggccagcgtgcggatgccggtgcggtccacctgctgcgacatgcngatggactcgcacgtcnggaagtccacggtggcgagagcacgtngaagattatgctttccctgggcggatgtacgccttgatgaatgcacgatctggtctagatggtttccgctggcctttacggcaccccggtgaagcccgcaagtcaacaggtgaagtcgncaccgccttctggcaacaacaggtgaatggccccttgaaaattccttgcccaaccgggaatttggggtgggggttttaatggcttgccaacctcgccttgaagaagcacccaccggccgcctttactcagacccaagcaagttctttttgtccggggtttgaaccaataaccagggcaccgtgtaaaatctctcccccccgaaagtttatccgccaaacaatcaaaccttggattgtcgttgaagggccccacccacacaaggtggggagttttccccccggtaaagtaaattccaaacggcccccggtacaaaaggcgggatttgttttataaaccccctggggcttctcagagccccctataagcccccccaattttccgtttgcccccgtggttttttcggttttggggggtgcaacactccatcggggaaacaataaaaaaaacccccccacccctttttttataaaaacataggccgggttttttttttttgggaggagggggcgcgtaaaatattgggggattaattt

SEQ ID NO: 29660 - DNA, 946 bp, Oryza sativa
  unsure (1)..(946): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaaaaacaatcatactttgggtttattgaagaaatctgggaaatcgactatggactcacaatgcaattcctcatatttaagtgccagtgggtaaaatacccgaacagggtcagtattgataagtttggtattactattgttgaccttgcgaatgtgggtcataaggatgacccttgggtactcgccaatcgcgtggcacatgtgttctatgtgacagaccttgcaaatttgaagaaagaaatagttctatcaggaaaacaaaagatcttgggagtagacggggtccaagatgtcgaagattacaaccagtacgatagtatgccactttatacgtaatttgtacaaaagattaagcttgtagaggcatcaactcagaagaccatgaagccttacatgcacaaggacggtgtggggaaaaatgttaaagagtaattgtttgttctgtaatgatggtatgtagggggctatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnat

SEQ ID NO: 29661 - DNA, 1007 bp, Oryza sativa
  unsure (1)..(1007): unsure at all n locations
gagaaaaattttgtanacccaacatcttgctgtcctgcaagtcgactctagaggatcccccttggcaacaccatctggttgaacgtacgacatatttggttcatcgaatggtctgtcaaccttcttaattcgcataggaagatcagtaaacaatggtacatcgtcgaactggatggaatcattggggtctttgatgttgtcgatgccgacgatctgttgttttccggatatgacaataggttttctttcatctgaagggtccttcacataaaacacttgagccacacgctctgataaaacccatggatcatacttagggcctgttttactgtgatcgactatcgttagcccgtagtcatcaacggaaacccctattgtgtctttaacccattcacaacggagcacagggatctggatgtttaggccatagtccagttcccttatttcttgaatggtcccataatacgacctcttttctccactcgtgtcaatcgcttcgacacggatcctactgttttgtgcagtgcttttcatgtccttcgtagtcgtactcaaggtaaatccattgatgtcgtaaccttgccatgaattgacaatacttgaaggcccacatgccagtctttgtaaagtaagttcctccacagaatcaccaactggcaggtttagatctttcaaccaccgaagaaagcgacgcttgtgctctcttgatatccaatcattggaccggcctgggaagcaggctttgatttcttctaggtgtcgctcaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 29662 - DNA, 5649 bp, Oryza sativa
  unsure (1)..(5649): unsure at all n locations
nggtgtcagaagtccgccacgaggcacgtcggctaagcgtgaagnagaaggtggcgtagtcgagcgggaactcggcgagtcggactgccgggccgagtcgacggtggggcccgccctcgccgccgtggctggcgtggtgacgatggtgcagagcgccccgtgggtggcccccagcagtgtggtgtccaacgccggtatgaggtggccctgcgccatgagcgggacgaacacgaagtgcgccgccgcattgatgcagatagctcgtgttctcgctggcgatgtattgctattgcttgtgcagctagctgctgatccatccatatgtgtgtgtgcatgctttaaagagagacgtgacggccggtgatgtgttggatcgtttgtttccatatgccggcgcgcgccgccgctgttgccaccgacggagctggcggtgacgacgtcctcaatgtcctgcagccactgctcgccctcggccggcggtgtccgacgtccggtcgagcaccaacctcgcctcgccgcgccgccccttcatcgccagccatcgccacgacggcgtggatggtccgcatggcgtcgtggaagcgggaggtgcttcgaggccattgcggacgagctggaaggaggggatagagagagaagtgagataggagagctgacatgtgggcccaagggtatttttgatattttacgcgatttctctctcctcttcaaccggaaattattattttaatcagcgcggtgtccactggcaaattaccacgtttatggagtgttttccccccaaaagtgagtttggacttatcctagagataaaacacacacaagcagtgtcctgtaacaatgcctgattctaatctctaacagaggttagtatctctaaccgttataagttcggagcctagcaaagcaagaatacccagctcctcaatttgtttactgaaacactcttgctaagcgccctcccttcagattaagatcgaccgtccctcttctccatgtcaatagtgagcaccgcagtcggctctgctaccctacccaagtgccgcctacgcgccccccattctcgatagccaccaccactactacaatagcaaatttttgcgtgcggttgtttcgcccgtctggaatgattcgtctgggaaaatcacgaaaatcaaaatccaaaaaaaaaataaaattacaaaatcctaaccctaaccctaggtcgaacggcggcggcggcgctgctcccgcccgccacctcgtcgtcgttgtcggcagcggccccggtccgcccaccgccacctccccacgtttgtccgccgccgccgagctcgctgcttcatcttcgtcgtcggcagtggcccacgtccgcccgccgccgccgtgtgcacgacgctcccggccgccgcgtcgtcgtcggcagtggcccctgtccgcctaccgccgcctccccacgtctgcccatcgtgagcccgctgccacgcgcatgccgctcccacccaccgccgccgcgagcccgccgctcccgccagccgccgtcgggcccgccgttgagagccgccgggaggagaagaaggaggcgtcggccatgtggtgagaagaagaaggtgagagagagagagagagagagagaggaaaatgagaggaggagaggaaagtgagaagataagggggagagagagaggagagaagggggcccagggggagagaagaaagtcaaaattttttttaataggatgggagggaaggctatttttctgtgcgggtagattaggaggcccgcacgcgaaaatagggtaatttttgcgtgcgggcctgttaagtaacccgcacatgaaaattgattttcgtgtgcgggcaacgacccggcttcgctccccccatttttccgtgcagtccaacttatggactacatggaaacaaaatggggtggcgtccaggaaaatcaatcctgtagtagtgcaccgccacctcctcccccatgtgagcactgtgatctaccccccacctccttagcatcgcccaccctgatctagttatttcgacctccggggtgccaggtccggcctccccaaggcagcgagaagggacgacgacatgcctcctcattccccaaccacgtccgcccttttcacagcgatgaggagggatgctattgtggggtcacggtacccgggtacccacggttgggccattgggccgcataacatagagagggccgcgtaggtctgagtttatgcagtgcatgtgtggctagataaggcaaccgatcttatctcatgtaaatagatggtaggttcctatattataagtgatttgttacctaccataattggccgcctccaagtatatataaggaggaccgaaaaccctaattcaaggaagaggacgatacgttctacgtgctattcacacgttatgctgcggatacttagatacaaatctaatctcatacaactggacttaggggcgttggcgcgcgaccagccccactccccctagtctctatactactactatatactctactactatgatatatactactattcctatatacatatgtatatacatacatgtaactttgtatacgtacatacaaagtttatatatatgtatataaatataattttctatatgtatatattttataaaaaatatatacatgtatacaaactttgtatacatacgtatacaagctttgtatacgtgcatattaaaaacaaaaaaaccgagaaagaaaaaaacatgtatacaaagtttgtatacgacatatacaaactttgtatacgtcgtacaaacatataaaaacaccgaaaaaatgaacaggaaaaccaaaaaaaaccaacaggaaaaccgaaaaaaaaccaacagagaaccgaaaaaacgaaccggtgccatgtggcccttccccatcgcgccgttcagccctccccctcccccatcgcgccacgtgcccagtcgcgcgcggggggcgccaattagcaatttcgactggactagggcattacccctgagagcctgaatcagtataaactctgtgtaaccatatctccttaatttcgtgcaccctataaattatattgcggatccagagaatcgactgttgatacgccaggtagaggggcgctagatcaatcatcaggaggagatggcttcaatcaccgattgataccgtcgacgagatcgcgttgatggcataagcagcgcaggacgatgcagtgcacgcctgcgacgtgctatcctggccggggtggcgatcgcgcaagtcgtggacgcgtcacgagctggcgcgaccccaggctgttcatgtcggggcatgcaggaaggcgcggtgggcgacgcagctcgccgaccgcccttctcgtcccgtgcaacctcccgcatcatgattcatgcttgcttccccgcgcggccccggttgatgccgcaccttgccacgcatccgcttgaccgtcgtcggagctgcttcaatcacgcatatgcgtcgatggatctggcgtcgatgcacgagattgatcggcatgcatgcacatctggcaaacagagtgcatagttgatcgatacatgcatgcccattgcatctacaaaattagtttttttaaggctaatctgagattgttttgcttgtttgcatgtcccatgcgacctacgcactactggaaaaagcattttcgccgacgttggcaaaaaattttcgcaagcggacatacgcttttgagcaaatacctcgccggtgaaaactagaaccggggaggagttggccgtccgcctacgaagatcggttatcacaggtggaccacataaggggccgcccgcgataatcatcttcgcaggcgggatacttataagcgccgcctgcaatcttcgcaggcgggcagcttatgtgcgccgcctgcgaagattgtttttcgcaggcgctcattatgtgcgccgtctgcgaagaataattttcataggcacccgttatgtggtccgcctgcgaaaatgtcactatatagtcttttttctccccaagccctgttcattctatccggtgtttctttctcctaaaacaactaaaatatagagggggggggggggaggttttgaacttcaaatattggggaatttttctacggtggttagatctactcatttccactctatgtatacattttttaagcttttaaacctcaatttgtgatggatctatgcatgcaaaattgtgaaggaaaagctccatgtttttttatttactttattttgatatgtttgtgtaggcttttaacttcaaatctcagggggatttttctacgatggttagatctactcatttccactctagatatgtaattttttttatgcttttagaccttaatttgtgatgaatctatgcatgcaaaattgtgaaggaaaagctccatctcctaggtctagatctagacacatagagaagaaaattttttatgtatgttaatttggtcgattaaaaaaattatttgtgttatgatgatatgattttgttagatttttctatgatattaatttagtatgaaattaaataatctttgttcttatgaatagtgctatgtcatttttagtgaaccctagaaatttggtatgaatagtgtaaatatttgttggtcattttttgtagagatatggacaggcggcaatggatgtatcattcgccgaggtatttggctttatatagggaagaaatgtaaatttattagtattgtgaaggcacacgctgaacagaacaatatgacgaagataatttgtctatgtgctgattgtaagaatgaaagggcctgggaagatgttggtaaagtaaaggaacacttagtaactcgtggatatatggaaaaatacgaaatatggacacgtcatggcgaacaagaagtggccgggcctgaaaaagaagttccgacagaagttgaagacatggtgtacggcgttggttgtggtgaagacaaaattgatctagaggaaatgttacgtcatgcagaacctgaggtgctgattgggtcggctagaggtttaaataactttgaaactttacagaaagcagcgaaggaagttttgtacgaagagtcaaagggctgtgacagtgagttctcaacactacggccagttcttgaacttatgaggttaaaggtgagatatggattgtctgatagtagtttcgacagtctacttgaactttcgaagaacatgcttccgaggcgtaactcattaccatacaacacatatcaagcgaagaaactcatatgtcccctttcacttggtgtagaaaagattcatgcgtgcgttaatcactgcatactgtacagaaaagagtacgcttctttggatgaatgtccaacttgcggtgctagccggtacaaatcaaatagaaatactttcctagaagcgtctaacatattcaagggaactaagagaaaaatcccgcagcgtgtgatgtggtactttccagtcaaagaccgcattaagcggatatgctcaaatctaccagatgcagatctaatgcgctggcatcaagaagggcgcaagaaagatgggatgctccaacaaccgacagatgctcatcagtggataaactttgatgctaagcacggggatcctctaaaatcaacctgcnggcnntctnggaaggagaatgatcagtttcagtggcgcgcg

SEQ ID NO: 29663 - DNA, 7712 bp, Oryza sativa
  unsure (1)..(7712): unsure at all n locations
gacggtgaaaatgatatatccttaatctcnnnnnnnnnnnnnnnnnnnnnnnnnnnnnnnntacttgagagaatacttcacagtgaaggccatcatcttcgtgatcattaacgattaccccgccatgttttcagtttcagggcaaattaaaggtaaaacaggatgtgtgatctgcttgaatggaacgtactataggtaccttccgggttccaacgagtttgtgtacatgcagcaccggcggttcctacgcacagatcacaagtaccgcaagatgaagtcagaattcgatggcattgaagagagtgatcctccacaaaaatatacatccggggagaaagtatgtgaaatgacagagaaaatagtttgcgaatttggaaaagggactaagaaaccttcaaagggtacaaagcgcaagaaacctgacaagaccaagaaaccagaagatagaaagaagccaggtgatcaactccctcccccattcaagaaacattcaattttctttaagtacctcccgtactggaaagatctagaggttcggcatgccatagatgtcatgcatctagaaaagaatgtgtttgacaacgtaattgaaacattgttggacataccatagaagactaaggatggtctgcaatcacgacttgacctagtcgagatgggaattagtgaagagttacaccctcaagaaagagagaagaacggcaaaatatatatttcaccagcctgtttcacaccgacacctgaggagaagaaatcattttgcttatcacttcgtgatgtgaaagtgcccataggtttctcatcaaacatcagtcgactagtctccatgaaagatttgacgttatctagttataattcacacgactgtgctgatgcgaaaaacatatactggcctgggagatctgcttagctccagtgcatgtccaaaggttgatgacatgcgagcgtgccagtcagtttgatcctgcaactgacaagatatgtaaaaaacagataaaaaaagccgattggctgacaagccgatggagtaattccagccgatagccgaaattagccgatgccgatttcagtcgatgtcgatagggtttttagcaatcggctatatgtccaatgtagataatgatataaaggcgatcggctgatgatgataaacaataataatatagcaatataatccagtagaaaccaatctgattcgaagggtaaataatacgctggaggtccgatgtcataaaatctacaagattagataaatcaatgaaacttttgttgtcatcggctaaatccaacttttatatatatatatatatatatatacatatatatatatatatatatatcatatgctatccttataagctgatgcaacatccagataacttatcggctagcaccccgataaaacactagcatgaacctatcggctaaacaagacttatgttatcaacaacaatctagtaggtcgaacctaaccgatgcagcacgagattgtatatgataatctaatactagatgagccgatagatctgtctaatgtgatagatataacaaatctatttagaacaacattatgattgtagagatatatcagctaagatagaagatcagacctaaccgagacagtcccaactaaaccgatgcgtctctaaacacaatgcaattagagatggaattgagatatcaggtaggcaaatatatcaaccaaaccagagcgatccaagagatcgaagcagccgatagattcaccagggccggcggaacgtaggacttaccccttcgccggagatcgaactgaaccgatgcagccccgtgtcaggtgccaaatttcaagtaaaaacctcaggaaagagggtggcgatgcgccgagagtattattgatcgagagataaattacaatgaccccgggtttacatatttatacccatgggtagatactagtccttgtaggacaagaaagaaactctcctaaagataaaaggaaaacataaagtcctaatcggacactaaacacactttcctaaagataaaaaggaaactaacagactattcctaattaatagataactgccatgctgcatcctcattgaactcggttactcttggataagctttctttaatagattaatttccttaaccgaatatagtaagaatccgactatggcgacttgataactcccatcgactgattccaggactctgaagccgatactgattttaggccgatgacatcctcgaggtttaccaaatttcactgttaacagactgtcatgtcttgctcaccgtgtttcttgccattgcaataagtgccataaaaccagaacatttgaaggttgctatcacaaggttgtgctgcttttttaatgcaatctcacagaaggtcattagtcatgatgagttagcaaatcttcgtacattcgcacatgagacacagtgccaacttgagatgtgtttccctccatcattttttgatatgatagagcacctcatcgttcacatagtgccccagatggatgcacttggcccattgtacctccatcaaatgtggtcatacgagcgttacatggcggttttgaagggctacgtctgaaatcatgcccatccggagggatcaatggttgagggttacagtacagaagaggttgtcgagtgctgtatcgattacctcaaagatggaaagacaattggaatacttgctgtcgacgtttgatgtctcgactacggtatttggacagtatggggatcgtcggtgctaggatatacgcgagactgaggtaaaagagacggagacgaggatttttatacaggttcgggcccctgagcggtcaggtaataaccctacatcctgttggccggagccggagttgcttttattcaccataatcgcaccagtacaatatgtggaatagcctatctaactgttgtcgacatggcggtctgaaggtctgactcgtaatcgacaacagggtagccttgctcctcgaatccgtgtccggcgagatcaaagatagcgctttcatctctcctgacggtatccggagacaccgtaggggaatagccatgcctatccctgaagtcgatatccggcggcgtgtcttggcgtatgttggcttgtatgctgtggcttcagttgttccgaatattgtggtggttgttgattgaggtggatctcgatcgtggtgaccatgttgatcgtgttgatcgtctcctggtcagtcatccccctcctcctagggggtcttgtatttatacccataggtgtccccttgttcaagtagaacttgggaaaccaatatggatacaatccgaatagtccttgtcgtttccgtgtagaactctggttgcctttccttattggaactcctcctatatccgaaggttgcttccgtataggacatggtatgtggtgagccctgtcgagatttagtcaactactattaggtatgtggtatccataaccctgacagtagcccccgacttcaatgcacatgaacggattcctattctcgaccactgaccatggagtaactattatcgagctcacgtgaccgttctcggtgagtttagagataacgttagacttcctttatcagcctcgtgcgggcaccgaaagggtttgtctgagtcaatctctgatgtcaaccaaggaagtatagagcagacgactaagtctcccatcttgctgtaatcgaaaatttggattgaagtcaagaaattttatctcggcgggtacaccatctcttcattccgtattccttgtcgagatccagcaaccgttctcgagcgatcgagaaggcgtagagtctgcgacggagccttgtcaacatttgtcgtactcgccttagtcgatcttggtgtagaactatagagacatgagttttcaacaaatgtcgaatagaattttcctgaaatcaatactcataaaagaatatcaaatagaaagagcccccgagcgaatgctcaaagggtgacatgttataatatgtatggtaaattaaaaatgaattaaatttaccgaccaatgttttgtgtatgagcgtcttctcttttaccgacttcgactagtcagtttgttgagttatgcactctccctagcctctagccttgtcgtcggagaatcgttctcgagggacaaggctcttggacctttgaactgcctcggttgaacaagtactgatcctagcccccagccgtgaagttggaaagttaatttccgattacgcggcttggttaatacgcacggggagaactcttacacgaccacggctgacatggtctttcgtctctaaagaatccgacaaggccttatcggctccgggcatccccagccgaagatcccttaggttcctcggaggccttgtcagcatggcgtaaagggacagtaggataggtgtcaacgctaggtgtcatctgggtgagggatctctgggtaaaacacttggcgatcttgtgtacctgataccaactttgttggagtagaggtagtaggagagtcgctgcaccactggtggaggaccaggcagtagtcgtgactcgaccacttgaagtggaaacagtgggtgaatcgctacaccgctggtcgagaaccagaggtagtctaaacttgaccactagaagtatgggtagtgggagaatcgctacaccgctgattgagaaccaggggtagtctaaactcgaccactagaagtaaaggtagtgggagaatcgctacaccgctggtcgagaaccagaggtagtctaaactcgaccactagaagtaaagatacgagagatcgctacgattgactggttgagaaccagtgagcaggtgtttctcgatcaatttgaagtcgtccgaagtcatggtgcgaggactgctactctgctgccgttcgaagatcaatcgtagtcgtacctcgaccatctgaggttgcggtgcgagagattgctacgtactggttcgaggaccagcaaacgtgtagagttatctcttgaacaccaatgaagtttgcggtgcgagagattgctacgtactggttcgaggaccagtgagcgagcagaattatctctcgaacaccgatggaagcgctagagttggtttgttgcaagtgtatctcatgtggccagcatgactcacgtacccaacttatagcatatacggatgtccgttcgcaatcatgtcaggtgatcaagccgacggcgttcacgaggaattattcgttaacaaccttctctcgagtagcccagcgatggccggtgctatgagataggtcgtcggtcttcgttggcaggttgggcgcgatggctctgcatttgtcgagatcgttctcgataatgcggcgtactcgaccacatcctactcgagtgctcaattgttcctttgtagatacatgccgggtgtattttgtcggtccagccgatgtcgtaggcggaggtctgggcagttgattctccgcggtgttgacgtcttgaagtttggtcgatctcgagagaacgagttgttgacgacgatggttccgatctcgtcgggagacgtactgtggtcgagttagatctatccatagtcgaagtcgtcgagtagcttgttgtcggagactccatctcttgaacccatctcgtggaaatcctagagcaccaaaatccccctacctagcgcgccactgtcgacgtttgatgtctcgactacggtatttggacagtatggggatcgtcggtgctaggatatacgcgagactgaggtaaaagagacggagacagggatttttatgtaggttcgggcccctgagcggtcaggtaataaccctacatcttgttggccggagccggagttgcttttattcaccataatcgcaccagtacaatatgtggaatagcctatctaactgttgtcgacatggcggtctgaaggtctgactcgtagtcgactacagggtagccttgctcctcaaagatagcgctttagtctctcctgacggtatccggagacaccgtaggggaatagccatgcctatccctgaagtcgatatctggcggcgtgtcttggcgtatgttggcttgtatgctgtggcttcagttgttccgaatattgtggtggttgttgattgaggtggatctcgatcgtggtgaccatgttgatcgtgttgatcgtctcctggtcagtcgtccccctcctcatagggggccttgtatttatacccataggtgtccccttgtccaagtagaactagggaaactaatatggatacaatccgaatagtccttgtcgtttccgtgtagaactctggtttcatttccttatcggaactcctcctatatccgaaggttgcttccgtataggacatggtatgtggtgagccctgccgagatttagtcaactactattaggtatgtggtatccataaccctgacacctgtacctcaacacgtgggtagattgactggcagggggacaataggaaagaagagatttgtcacccatgattacaaatcattttgagaagctcacttcagcattcttcatcagtttgctatcattgagccttacatcgatcaacatatcgaattactaagagctaacaataagggacgcacaaccgaatggataatgaaagaacacaagcgtgtcttcatagattggttgcgagacctagacttacctgatggagaaacaaccgagcaaataactatgaagcggttggcttgtggtccatcaactacagtcaattcttgggagggatatgacattaatagatacacatttagtacaagagcctgagatagtaagaccgtaactcaaaacaacggtgtttgtatgaaggcaattgattcagggggaaaaacaatcatactttgggtttattgaagaaatctgggaaatcgactatggactcacaatgcaattcctcatatttaagtgccagtgggtaaaatacccgaacagggtcagtattgataagtttggtattactattgttgaccttgcgaatgtgggtcataaggatgacccttgggtactcgccaatcgcgtggcacatgtgttctatgtgacagaccttgcaaatttgaagaaagaaatagttctatcaggaaaacaaaagatcttgggagtagacggggtcgaagatgtcgaagattacaaccagtacgatagtatgccactttatacgtaatttgtacaaaagattaagcttgtagaggcatcaactcagaagaccatgaagccttacatgcacaaggacggtgtggggaaaaatgttaaagagtaattgtttgttctgtaataatggtatgtagggggctatatgtactcatattgcacattattatgtttttactcacaatgcaattgttatgtgcacttatcatctttattataatatttatatggacttaccatttttattatattttataaaatcaattacatttttaaaatgttttttattaagtttttaatattttgtaacaatttttgggaaacttatcatctttattacaatttttatatggacttaccatctttattatattttagaaagtcaattacttttttaaaatgtttttatcaagcctttaatatttcgaaacaatttttgggaaacgtaccatctttatcacaattttaatatgggctcaccatctttattataatttataaagtcagttaggggatcctctaaagtcgtcgtgcgggcntgctcggaggggatnctcagtgaggtgaattcaaagggcg

SEQ ID NO: 29664 - DNA, 5703 bp, Oryza sativa
  unsure (1)..(5703): unsure at all n locations
gcgggcctcaaagggcaaaggtctatctcttcttttttgggaccgtcggtaattgccggttcttcaaggaggcgtcggtgcttttttaatggtgggcggagcacatgccccttggttcgaaggtggtcatcgggtgaacattttcgtagtctagtccgagtgacgtcgtcgaccgctcgtcggcttcgagcgaacatgtgcatgtgggtgtttatatatgtgtaaggggttggtattttttttttatcaaagggctctaaaccatccattttcataaaagaaatgtcgcagtttcagcagaagaaaatgaaagcagaaatctcgttctgcgtctagagtttataaaagcaacaacagtcattcaacagttgtctgtgaggggtttgtatatatggatggaatgggaatgaggggtcttatctgttgattgtgggtaatacgggtggtatgggtgcatgtaaataatatatgggtgagtgtgggtatatgttcaaattttttttgtacaccatgtggggaagatatgttcaatttttttttacaacatgtggggaagatatgttaaaaatttttttgtacaacatctgggggagaaatgttcaaatttcttgtgtataacatgtgggggagatgttcaaattttttttcctatcatatggggggagatatgttcaaattttttttactatggcaacatagtggtctatgtgaattttttttttactatggcaacgtagtggtctatgttcaattttttttgcacatatgacaagtaggtggtataatctatttttttatgataagtggcctcgataatttaaatttgctactttttatggcctcgatattaattatggagttcatttttatgtttgaagtacgaaacgatggccgatagtactaaaggaaatgaagatcaggctgtaggggaggtggagtcttgacaaccgccagttgagccgtcccttgctattgtggttgctccgcaaccaacggtgctgccgtccgatgggtccgacagcgacgtacccaacgaggacgatgagtactcgtcaccaagtgatcgttgtccaagcccgaaacggtggtaaaaggatgagggtgaacaaggtgataaggactacattccccgtgagaaaggggtaggtacaattaagatcgtaattgtgtgagtgataactagtagtgagtagtaattcgaaagtttcatacctactcgtagaaaacggggccacggagatcaaaacggcagccgaaaaagaaagacaaggcacaagaagacgcggtcccagctaagtccaccggctcgaagaagaaagataagacgcaacagccgaagacacaaccatatttcgaagatctgcacaccatatatcatcgggaaaagatggacgtcaactatatcggtgcttagtgcctgtgagtatgagtgtacattaattacacgacggaatctatataatacataaccatgtgattattactaacaaactttttttgtaggatgcaatacatggatgctaagaagctaaaagaacctatcggatttctagatccaactaggatatgtcaaacacagcataccgggcagctatcaccacagttagagcagctgaaggacaagactcccgaagagatagctgaatacaagaagggattgcacaagcagaaactgattaatgtcgcacagtacattgggcgagccttcttgcactttcaaaataagaaggtcgtcctggccgcttataattttaagtaagtccggtatacatttctcttatacatatgtgtcttattgtatccatgactaactgcactgttgttaatatgtagcgatcattacatcggtttaatcatctacccgaagcactgcaccgtgacagtcttggaccctctcgattactctcatgactcatacaaacaatttctaacaatcttacaatagtaagtgattctgacacttgcatgtctgctatgaatatattataattaaatctcctccttaatgtgaaacggtacaaaatccatacagtgcgtacaagtactacaagttcaagggtggagaacagattcgatcaagggagaagctgctagtacatacatattggccggtaatactccactcacttaatgtattccaattgtttcactaattgcaaaatttaactattttcttctatgatatgtcatgaagtgtcacaagcaacctagaggcactgtcctcagcgggtattacgcatgcgaattcctaagggttaatgggaggtacagggttaacccagaggatgtaagtctctagactatatggattagacaacttcacatatagatgatactaatatattgtgcttatttccatgcatgcagttgccaagggaggagcaacaaacaagctttgacaatacagccattaaaaatatccagcgcgatctctaccacttcatccaccgtgagtgctgtcatgtggaaggaaagttcttcgacaaagagggtgccctagctacaagtgacaaatacaaaaatcttcgggagtgcagcaatgctatgccataatgtaattagatagcgtatttgaagtgacaatgtaaaaaatattataatattttgacgatacttttcccttttgcaatatatgtagatttctcagtatcaaaagcttgttatttactaatattatttatgcaacaattaattaattaattgaaaaataatttatgagaaaattattattgtaacaaatttcaaatatttgtacctatcttcgcaggcggcatttttttatttttgcaggcggtcatgctatattttcgcaggcggaccatatagctgttggaaatttggtcataattcggcatattttaatccaaaataacaagataataaacatgatatttacaatgggatttgatccagtgataatggtgaatgtaatcaacatgagcatgcttaatgtagaataagcatcaacaatcacataataacacaatgttgacattgcgatgaacatcaacagtaaaacttctaattgaaataatgtaagaagggtataccccaagaatggtcctccgctggagtttgaggcagtattaccttcggtgatgttgacgggagccctctttttcttgtatccagtggtggcggtgtctccagtgttcgacatattggtgaaggtgaagtagatgttgacgaacagtgagtagtcgcgccttacgcttccaaaaacctgatcgcccgcccgttcgtgcaaacgttgcaacagcgcgtggttttggaggcctactcttccaatgcgtgtgcacacactcgtcgggatgggattaccgtagcagcaacagcgttggaaaatggatgaaagtgtgtctcactttctcttttgggagatcaaatccattctcattttatatgagaaattcaagatgaagagtaagagtcatggaaatcggaagagctatagagtaactaattctcatcaattagccattaaccattctccactatacaaccatcaaccaaccgtcaattatgagtaattgatgtaggttacaaatggaataggaagaggaatagagcaacttattgtgatcaactagccatgaaccatcctccactacacaaccatcaaccatccatgaagtaggagtaattgatataagttaccaattccctaatcaaatggattaattctcaaaactcttgatcccattgatatcccataagaggatgaatacacatgaattcctagcataatgagccttggaatttatatgatttaattgatttaattggatcaattacccaattaaatctaacaatccccaccaaatttcaaggctcatgagaatgctctctattccatagcagcttttatataccagtgttttggtgaagactgttaagttgaactttcacctagaaaaggagctacaccggaccacaactgaacaatggactatgccttgaattgtcagtcttgtgcagttaggtttcactcaattccataactgatactaggcaaccgttagtattccctcaggttggagcttataagtcatactccaggcctttcatgagtatctagagatcacccaaatctcatagactgtgactagtagtcgaactcatataggtgtactccttctaatatgttttgcaggtcaacatctctgcttaataaaagccgaggcataagccatcctaccacacagagtagaagagaagtacatcatgaaaatgagcccatttaagggtctcttctctcggttacacaatagtttgtttcgccatccaaattcacgggatctccgatcacaatggacaggtttccactattgtgcaactctaagtgggtttcaagcccatttccctcgatgcactgtctatcacattacgtggtagccccttggtaaactgatctgccagatttttagctgtctggacatagtccagtgctatcactccagagtttttctgctttctgacagatttcagtcttctcttgatatgcctagatgacttcatgttgtcctttgaactattcactttaataatcactgtttgattatcacagttcattaggatagctggcattggtttttcaaccatcggcaaatccatcaggagttcacgaagccactcggcctcaactgtcgcagtatctagtgctgtaagttctgcttccattgttgacctcgttaagatggtctgcttgcaagacttccaggaaacagcgccacctccaagtgtgaacacatatccacttgtggcttttatctcatcagcatcagatatccagtttgagtcactatacccttccagtacttttgggtacccggtatagtgaatagcatagctcatagtgccctttagatagcgcattactctttccagagtctgccaatgatcatctcccggatttgagacaaaccggctcagcttgcttacagcaaatgagatgtctggcctcgttgcattagccaagtacatcaatgaaccaatgatttgagagtatctcagttgatcccttgctattcttcggtttttccttaatagcacgctggggtcataaggagtaggagctggcttgcagtcactatatccaaagcaactcaaaatcttgtccacatagtgggattgcacaagtgtaatcccaccctcatctcctctcagtagcttaatgttaagaataacatcagcctctcaaaaatccttcatttcaaaactcttggacagaaagtccttgaccccctcaatcacattgaagctgggccccaagatcaatatgtgatcgccatataagcccaagataactccttttccctcaccttgcgataggacacacatttatcaactttgtttcccaccaaagccacgccgatgtgaagtgtgttgccacaacttctcaaaccacctgcttatgtgcctgctctaagggcataccacgtagtttacaaggtacacaccatttcctcctggactcttaaacaaacaccgcttggggggcacactaaactcccccctcacctcttccggttggaaaaccggttaacgcccatcgagggcggaaaacaatatagcttctcaaccagatatctccatttcggcaaacggccacgctgaaggtgcgaacaatactactcttttttggtaaccttggccaaacctcttgtctttaatgccaaaaggcaagtttctgtaacctttgcn

SEQ ID NO: 29665 - DNA, 2906 bp, Oryza sativa
  unsure (1)..(2906): unsure at all n locations
gcgcgccttgaanatgagnttctgcttcgagcangtcngcaggnngactttagaggatccccagaaagtccttgacctcctcaatcacattgaagctggtcccaaagatcaatatgtcatcgacatataagcacaagatcactccttctcccctaccatagcgatagtacgcacatttatcagcttcgttcacaacaaagccagcagatgtaagtgtggggtcaaacttctcatgccattgcttaggtgcttgcttaaggccatacaaggatttcaacagtttacacaccattccctcctgaccttttagtacatacctgtctggttgatccatatagatctcctcctccagctctccgtttaggaaaactgtcttaacgtccatctgatggacgagaagaccatgagaggctgccagagcaagtagtactcgaatcgtggtcaagcgggcaactggtgagtaggtgtcgaaaaaatcctcgccttctttttgggtataacccttggccacaagccttgccttgtacttttcaattgtaccatcaggcctaagctttttcttgaaaacccatttgcatcctacaggcttgcacccatatggacgctcaacgacttcccaagtatcattagacataatcgagtcatctcactgcgtactgcctccttccagtagtcagcgtcaggagatgaatatgcctcttctatggttcttggagtgtcatccacgaggtatacaatgtagtcatctccaaaggattttgcaaccctttgtctcttactcttacgagtatctacaatgctatcctcctcaggatttccctcaagcgtttgctcattgtgttttatcggtgcaaagtgctcatggggtaaaacaggttctagactagacgtgctaggtgtatttttcatgggaaattcattctcaaaaaatatggcatctctggactcagtaattgtaccaacacgcatgtcgggtactccagagtttactattaagaacctatagcccacactgtggatagcataaccaaggaacacacagtctatggtctttggtccaagtttacgctttttggctataggtacatttaccttggccaagcagccccatgtgcgtaggtatgagagatttaatttcttcctttcccattcttcgaatggtgttacttccttatgcttcactggaattttattcaggacatgacaagcagtaaaaattgcctcaccccaccattcattggaaagtcccgcagtgtctaacatggcattcaccatcttagttagagtgcggttcattctttcggctaccccatttgattggggtgaatagggaggcgttctctcatgaataattccaaactcttcgcaaaaggacgtaaactcattggaaaaatactctccacccttatcagacctcaaccgtttgattttcctttcaagttggttttctacctcagctttatagatcttaaagtaatgcaatgcctcatcttttgttttcaataggtacacagcaatatctagtgcaatcatctatcagtgtcatgaaatatttctttccccctttagtcaacacgccattcatttcgcacagatcggaatgaactagttctagtggtgccaaatttctcgcctcaaatgccttgtgagacttgcgaggttatttcgattgaacacaagtatggcacttggaacctttgaccaaagtgaattttggaattaaactcatgttagccaaccgcgtcatacaaccgaaattcacatgacaaagtcgcgaatgccacacattggactcatcattatcgctaatatggttcacaacattattattattattacacatgtcatccaaagaaaaacggaacagacctctgctatcataaccttttccaataaaagttccatatttagatacgacacatttattggattcaaacacaagtctaaaaccatctctacacagtagagagccgctaactagattcttctttattaaagggacatgctacacgttcttcagctgcacggtctttcccgaaataaacttcagatcaaccgtaccaaaaacatgaatagccgcaagcgacctgtttcccatcaacaaggaggaacctctcccgacctgataagaagaaaacagggaaatatcagcacacacatgaatattagcaccagtatcaacccaccaatcaggtgaatgaaaaacagagagaactgtaggtaaaaaataaccgtaccccgatgttcctccgccctcgctaataaccatgttggcagacttcttgtccttgcgatcaggacaattcttcgcccaatgcccaggcttaccgcacacaaagcagtcccccttggcctttcccttgcctttcttcttaaaattggttgtagcctttgggttgacatcagcttgactttcttcttggtgattgtatgggatgcgtgagggttcttattttgcaccaaattggcgctagaacctccctcgaatttttgccccgttgttcttgatctggcctcntcttacacccaagagccatgagatcataacacttgactttggctctgtggttaaagaagagccaagtcgaccaagaggtggtatttgtcataatgcaaccggcacaacttgtccgcaaactacagtggtgtcttaagtctttgtaactttgaattaggagctgttcactacagacggcataaacaatttgagnattgaactggtcagaaatacagtggttgcgggtggaactccgactggctaaaggctcccaagtcttctctaggtgtggctgcccctcctctttggagggggcactgtaaggttccggaaagaaatcgaccttaattatccctctcgggaaaaggggttcttttgggccgaaaaataaaatttgcttttaccacag

SEQ ID NO: 29666 - DNA, 2671 bp, Oryza sativa
agaacaatgcatcgcgtcaacaacagtagtgcacgtcttttcatatctaataatagaactatcaaaagcatgtggttcaagtgttgcagcaaagccacttaccgaaaatgacctatcaggtttttggattgttggaaatttggtcataattcggcatattttaatccaaaataccaagataataaacatgatatttataatgggatttgatccagtgatagtggtgaatgtaatcaacatgagcatgcttaatgtagaataagcatcaacaatcacataataacacaatgttgacattgcaatgaatattaacagtaaaacttctaattgaaataatgtaagaaggttataccccaagaatggtcctccgttggagtttgaggcagtattgcctccgttgatgttgacgggagcctccttctccttgtatccagtgttgccgttgtctccagtgttcgacatattggtgaaggtgaagtagatgttgacgaacagtgagtagtcgcgccttacgctctccaaaaacctgatcgcccgcccgtccgtgcaaacgtcgcagcagcgcgtggtttcggaggcctactctcccaacgcgtgtgcacacactcgtcgggatgggattaccgtagcagcaacagcgttggaaaatggatgaaagtgtgtctcactttctcttttgggagatcaaatccattctcattttatatgagaaatggaagatgaagagtaagagtcatggaataggaagaggaatagagtaactaattctcatcaattagccatcaaccatcctccactaaacaaccatcaaccaaccatcaattatgagtaattgatgtaggttacaaatggaataggaagaggaatagagcaactaattgtcatcaactagccatgaaccatcctccactacacaaccatcaaccatccatcaattaggagtaattgatataagttaccaattccctaatcaaatggattaattctcaaaactcttcatcccattgatatcccataagaggatgaatacacatgaattcctaggcgttgtgctataggcggaccggccttccggctgggaagatgtgtttcccctgccggcgaaaatgcttttcctagtagtgatggcgtgtgtagtcgtggccatgcgcacacaggtgcgagggccacgcactcggacacgaccaggtagacagaagacatgcccgtcggtagccgcgcacatgggcacactgtcgccatcgcatcgatatttccaaattcggtcgttaacaatcattttgcacatgcgccggagatgttcgacgtcgccgagtggtctccactctggccgcctttgtgtcgtagcagcctagctccatcgcctccgtagtcagccatcttcgagttgccgagtggcaaccgtgttcccatgtcggccacatctgcttacactgccgattgcctgaacaatttcgcggtcggctgcctccacgccaccgcgtggtgaacatgtccccgggctagccggcaccaacgccaccatgaggcttcaccgtctatgacgccgcacatgcttgggggcttcggccttctcctcgttgacgcggcccgacactacaccctagacggactactcccagggcacgatgccgcacgctcggggtattcggccttcgcacggctgaagcaacccgatttcgcctggggcatgtctccgtatgcccggggcaagacaccgcacgcccgggggcttcagtcttctcctggctgacgcggcccgactacgccccagacagactactcccgaggtatgatgccgcacgcccgggggcttcgtctttcgagcgtggctgaagcggcccaattttgtctgggcacgtctccgtacgcccgaggcaagacaccgcatacctgggggcttcagcctttacatggttgacgtggcccgactacgcccggggcacgtactctcaaggcacgactccgcacgcctgggggcttcggcctttgcgtggctgacgcagcccgacttcgcccgggcacatctccgtaagacctgggcacgacgctgcacgcctgggagctttggccttcacgcggctaactcgacccgacttcgccaggagcgtgtgcccgtatgcctaggggcttcgcccttgtacggctcacacagacccggctactctctacccgactacgtcactgttccgtatgccctggggcttcactcttgtatggctcacgcagacccaactacgcctccacattagtcaatcacgtacccaccgactggccggctccggggcagctgaagggcttcaccgcctccccggttgttttcaactcatggaatactaagtaatctaattcactttttatatggtattttcatttgagtaatttattttacttctgacttactgtttagttggtcacccaaccaaacataaagtcaagggctgcacctattaggtgcttcaaactgcatgttcatttcctcctcttaatggttgcaaaagtacttgagtagcacaaactctgattcgtgaagctctatttcctcgcacggctcacacggtcaaggccatgcttaacaccgtatgcccgggggctacgccactcactgcacacttacacggtatggctacgccccataccgtgcggatccagagtcgcaaatcaacgcacg

SEQ ID NO: 29667 - DNA, 8864 bp, Oryza sativa
  unsure (1)..(8864): unsure at all n locations
gggcccccaccctctggagtggccccccccggcgcaaaaaattttataaaaaccccggggttttttaataagggccaatttcttttttcccggtttctctgagggtattttaacaaaaaaccctttttttttttaaagggcccggtataatttttattggccgggccccggcccttttttatttaagtgtgccctttcttaataaatacccccgtggttttttaaagggtgcactgggggggagggcactcaaaaggctcctttttggccccggcccccctttggggttgcccctcctgtgggtttcttataagcggcatttgttgtttaggcacaccctgagggcggcttatcggtttggttgcaacggttggtgggaatgctccacgttgtttctttattggctaccatccattgccaaaacacgccccttagttgtctattcggggtcatcccaagtccgggttttttaaactggttgcttagccaccgtcgggtccttcatcccatgttgcctggtccctctccaccggctgggggttgcgtctccagattgtttccttatcctgcgtcggggtactttgtcccttgtgcgggttggtcctttcccccccgcgagcaaaatacgtccccatgttggccaactttgtgatcactaactggcttcctcacctccatggtttggctggttccattggatgaggcaaatcctctagggtttgtcttactcaaccacacgctgttgggagttcatgttcttgactctccacttgcttgatgcttaactaagtatagagtcgggggctaatgtgggggacacggtacctaggtaccaactgttgggcctttgggccgcatagcatgtggtgggccgagtaggcctgagcctatgaggagcatgcgtggctagataaggcaaccgatcttatctcatgtaaatcgatggtaggttgccagattataggagatatgttacctctatatagggtgaaccaaaaaccctaattctggggagaggacgatacgtgctacgtgctattcacacgttgtaccgcgcatactcaaatacagatctaatctcatacaactagactaaggcattacctctaccatttttgttggcggctaccttaaactagccgccagcgaaaagctatattccctggcagttggcgatcgccagtgaattgaagatgctgcatcttcactggccattggtctctagcaatgccggtggccgcaaaaaaaaaaccatttttgtattagtgaatttatccaatgcattgtttctacttgttggatcagataataattttctttgtccatctctctcctttgattttatgttgtcgatactgccctcccctccaatgctcttttacttgcatgataatgtcagattcaagacaccattttctctctttaattgctgacatgaaaaatcctatgtggcaagattatttgtctctcttctctttaatatttctctctctactctttaattgcttgtcaagtgaccttgtcattttcgaattaaggctgaatattcctgtcagaacccatgcaacttttttttagacgggtcaccggggggcgaaatgcccacctaaatatattacttcaaacggtcttacacagggcaaagcttctgctacacaagcgcagtagtcctggaggataagagaaagtatacagggaaaaacaaggaagagaaacacaacagaaacacaaccaccccgaagggcacctgagccacactagcaggactacgagagagagagagagagagagagagagagagaaagagagagaggaggtgtttgatgtttttcaccaacaagatcacaaaaccacaatcctaatctgagctaaagctagctccctagcctgacaacatctactctacacgcaaccttcaagcaccgggagttgaattgtcagaaggccatctgccacgcacaagccgactcagtttccggagattagaggttgtgtatgtcaaagaccacctgcatcaagccatcaaaacccgatttcattgtgttgaaatattgatcaatgctcgccaacgccctttgggtaaaggatgccccagaagagggagagcaactaagggttgctgtaaaggccgcacacatcaaatcggcttcaatccggcattagcaaattgccaattaatacaacgcccccgacgccccaagggagaaggaagccccaatggtgggatggtcgctgaacattgtggacaaggacacccaagcaaagaagatgaaaatagaacaaggagcaaagcaaaagaggtaagttgggaggcagcaattgcaatggtggaggaaacatcatccacgatggttgaggagtcataggttcactgagaaagccaatggttctaaccaacttgcagccccaaactatcaatcattctagcatgccaaaatggaagaaatctgaggaggaaaggggaaactgcatactcgtggtttatggtggatcaaggtgaaggtggtcgaagcaaggcaagaaacaacaaccaaaatgactcaaaccaaggaaactaggaggaacactaacactggttagatgaaaagacaaggcaaggtggaccaaaggcgtcgaggataggtgtaggcaggacacgatggatgccaggggacaaacaggtagagggcacaacaatgacgaggagaagaagccacccgagggttatggcaggggatttccaaatatgatgccttcaagaagaaggacgacaacaagaaagaagacgccatcgtacgctgtggaaaccaaaaggggttttcaacccagagcagggggtaaagccagccaggacactagtcagatagctcacgcggcggcggcacggacgctagcggcttgaagacaccatcacacaccgcccccatgggcaggtcagggcgccgctgccaccgacctcccagccccaaccgagtagatctggccaaggagtaagtggatctagacaaatcggccaaggaggcgaatgaacaggtccagcttcaccggcggcaaagaggggttgcgcgtaagcagtcacgagggtcgaagatgtctccccttggacaaccctatgccgccggcagcgccaggctgctgacgacgtgcgagccaccgccccatcgccctcttcaccggatccgcctgccgttgcctttcctcctcgccggatcctcccactgcgcttttgagctctcgccggtggctttgaacttctccgcgactgcccgacgctgccagcagtggcaatcgtcaccgttgtcctcttagcaaccgctagctcctagatcccgcgcaggagagcgttaatgccctcgccgccgccattcatgctgccgtacgttttcggtgtctggctccggcggcggtgaagcgggagggagagaggtggggggtagaggtgcaagcggcggtcgctgcccgtgtcgcccaacagagcttttgagtggaagcaacggcggactgatggagccagtacccatgaaactttgcccttgtacatgcaatgacgcacttccagaaatcaaaagaaacatgggagacaaagaggatattcttttgagtcaggaggaattggatattagatggttttataggaatagattatcttcaattatgagagaggaggaaatcaaatggtatctgagggccaaatctaaggatattctagagggtgattctaatacaaagtattttcacttggttgcaaatggaaaacataggaaaactagaatttttgaactacaagatggtgaccaattaataaatggtgatgaaaatttgaaatcgcatattaccacttattataagggtctttttggtcctccagatgattctcctcttcagtttgatgagagtaaatttactgacattcctcaagtttctcttttggagaatgaggctctaacacaaggaatttactgaagaggagattaaggaggctattttccagatggaacataacaaagcaccaggtcttgatgggtttcctgctgaattttatcaagttttctaagatgttataaaatttgatttaataaacctttttaaggagtttcataatggtactttacatttattctcgcttaactttggtactattattcttttacctaagtgtgtagaggccataaaaatttaacaatataggcccatttgtctacttaatgttagttttaagatttttaccaaagttgccacaaatagagtaatgagtgtggcccaaaaggtaattagtcctacccaaactgcttttattcctgggagaaacattatggaaggtgtggttattttgcatgagaccttacatgaattacatcgtaaaaacatgagtgcataatttttaagattgattttgagaaagcttatgataaggttaaatggtttttttgtacaacagactttgagaatgaagggcttctctcttaaatggtgtgagtggatagcctcttttattcaagggggacatgttggtattaaagttaatgatcaaattggtgacaatttttaaacttataaaggccttagacaagaggatcctctatctccaattctctttaatatagtagctgatatgctagctttacttattaaaagggctaaagataatggctctattaatggggtaattcctcatttagtggatgatggtttgtctattttgcaatatgcagatgataccatcattttcttggagcatgatttacaacaagcaaaagaatctaaaattgatcttatctgtgtttgaaaaattatttggagtgaaaaattaattttcacaaaagtgagttgttttgttttggtcaggctaaggagtgctatgatcaatattctagtatctttggttgtaagttagggtcttttcctgttaaataccttgacattccaatgcattttaggaaactgggtaataaggattggaaagttattgaacaaagaattgagaaaaaacttagtagttggaaaggtaaacacatgtctgttggaggtagactggttttgatcaattctgtcctttcaagtttagctatgtttatgatatctttctttgagataccgaaaggggttcttcaaaagattgattattatagatcacgtttcttttggcaaggggatgatcataagaaaatgtataggctagctagatgggatattatttgtcaacccaaagatcaaggtggtttgggggttcataatttagagattcaaaataaatgtcagttgagtaagtggttatataagttaattaataagaatggtgtttggcaagatttattgaagagaaagtatctttataataagtctataacccaagttgataggaaacaaggtgactcccattttttgtcaggactcatgaaagtgaaaaacactttcttaagtatgggttcctggattgtgaataatggggaagaaacaagattttgggaagataaatggctaggtaatatggcctttagagataagtattcatctttatatgctattgtcagaaggaggaatgcttctattgctagtgttatggcctctattccgcttaatgttttctttaggagagctttagttggtcagaatctaacactttggcatgagttgtgtgcttctattgttcatttccagttaaataattcttctgattattttagatgaaattatcatcaaaatggtcagttttcggttaaatcaatgtacttagctttaattaataatggttacattgataggaataagtttatttggaagctttaagatgttgctaaagattaagttctttatgtggtacttgcttaagggagttgttttaaccaaggataacctagcaagacgaaattggaatggcagcttgagatgttgtttttatatgaaaaatgagactattcaacatttgtttatggattgtcattatgcaaaatttatttggagagcagttcagttttcttttggattataccttcctagtaccatatctcatatttttgatagatggcttcggggggttgacatgaaaaagagtaaactgatatttgttggtgcttctgccttatgttgtgcactgtggttgtgtaggaatgatagggtttttgataaatcatcatctatttcctatatgcaggtaatttttagggcaacatattggctccggttgtgggcacaactacaaaagtgtaatgaagatgaagaattcctgattgttgcatgtcgtaagtttgagacgacggttatgcaactttttgccaaccatggatggagattcaccaacaggttagaataatattatccttgtcatgtttggtttcctttatttttggttggtgtgtttgcgttatttttttcttttaagtgtactaccttgtaataattaactgtagctctcttgagcaaaagccggaatgtttcattctattatctttacagcgcagaaagaagaaagtcacgcgagttggtctttttaaagaacaaagtgacaacttttcttagggtgggaggaaatctacgtggaattgtactagaattgaccctagatggcttgcggggtcaattatcactgataggagtatttgattgggtcgcatgtgattttttttttgtattttgaaaattatatttttgctatgtcacatggcaagttattttcgacattacataaatatttacagtcaatagcttaccatgttaccttcagtgaatggctagattgtttgttttaacaattggttactgaacgatttttcagttaaattataaaagatttaaaaaaatggttgcatgcatggttaaccacttgagagagagagagagagagttcatgtcaacatcttcggatccactaattcatttggtcaaaggcaaactgatatttcctcgcgcaagaaaaaaatggtattatggtaaaatcaaacttggagggcctaccggtgagttttttcaactttgcacagacaacaaagaacgaccagtgcatcagtgcatctccacagctccagttcttcgctagctccacagcctccactcttttccctttttccttttcttttgattgacgttgtgctgcctaagttggcaccctttatcaagcccaaaaaaaagccttttacaaagacgagattctcattcagctttggcaaaagttgcgcagaaaaaagattaccattcggcttatataaagttaacaaattaaagtattggtatctgtcctttcttattccagccgaaaaaaagaattacttcataaaacctttggttttgaatatttcataaagttaacaaagttgtagaaaacaatactacatcagttccagaatataagtgaacacggttattaagaaaataggtagaattaaataggggaatgttgtgattggatgagaagtgaaggtaaatgggaaaattaaatggtggagggttgtgattgatcaagaagaaaatattggtggatacgtaattatattttgtgacaaattctaaatcgtaaaagtgttatattttgggacgaagagagaagttgttattggtcgaatagctattgaatttgaatatataagttccaataggttatagatggttttaaagctgtaattatatgcaaaagattgatgtcccaatctctgcaacgcagactaccccataaatataaatatagatggtgtgccaccatcactgctacaaattcggtcatccttgacaggccatctgtaattaggggtggacaaaaagtttggccttgtgagctcggctcaagcttggttcaggctcgcataggtcggctcggctcgaaagccaaacaagccaagcccaagactgcttcctagctcgtttccgaaacaagccaagcccgagctggctcacgagccgctcgtgagctcttttgactcaatagaataggtcatatacaaaaaaattgcacatttttgaactatttattggttgaaaatgataactttgattgtcatattatctatttatgtgttgtgatgatatattaaagaaaaatataactttattacgcattctatatggtattatgttgctcgatttctcttagacctgcttgagatttacttgatgccaggctcgcgagccagctcgagctggttcgagcccattatcaagccaagccaagctgcagttttagctcgttgcttgtagcgagccaagccaagccaagcttcccttgtaccaagctttcacgagccaagccaggctcggcttggctcggttccacttctatctgtgatggtttctcttaccggttggaggggggttattacatccccacggtaaggcgngtnccaaaacnctttctgtagtaaagaacgttgaaggcggaaggagcggcgcggtcattggaagcggtaacccccccgatggacgcggtgggcgtgccgagccgcccgacaacgacgtgaccacacgggagttgggaggcatctgcgtcaagcattctcctgctggatgccgacgcaatccgcaaaagacgacagatgaggactgactggactgcgactagcaagcggtaacaacaggcagtgcatgtgtgtactaacatcaagcgtgaagccaacaagcaaatggctgactgacagaacactgctgtaaataagcacgcatcgacttcttgacggacggtggggcggtcgcgaatggcccaagtacgactaccctccccacccattcgtacggacggagcgcggccgctgaggatggggacccgaggggctggagcccttctggccctcgagcgccccccgtcgaccgggctccaacttcccgtcctgtatacatgccaaggggagaaaaaaagagtcggatttaatcttgacttaattaagttgctgcacactatgtga

SEQ ID NO: 29668 - DNA, 13791 bp, Oryza sativa
  unsure (1)..(13791): unsure at all n locations
cggcgccatgaaactgcacctgccaatcccannngccngcangtngagtttaaaagaccccccggttacggtttgatcttggtttccgcacggctagttacgttttccgtgtgttttgtaactgaacaaaccaatgcttaaaaaaatgttaaaaaacataaatgtgtgtgaaaattgacgataatcaaaagaattcatatgatacttgcaaacctaacttttggatgcaaatacaaaaattcagcatgtcctttactatgttatggacttcgaagcaattcaacaattcatagcataataagtcaacaacgtcaattcaacaacctcacatttcaaatcataatgatgtccatatgtagcacccacccaccctatatatattttctccactattgggccttaatttgctggataaacagtgcaacttaaaggtccattgcattatttttttaccattttctaatgtactctcggttttaccatcaaatgttattttatattactctttttcatcaaatttctttaccatccgccactacaaatcaagaactacatccatgtttttttcgatttgttttggaaattttgaatttggttaaaattcatcaaaccctaccgccggtaaccattaccgtacccccacggtaagagtggttacggcagtaagggaagccctgcttatgacccatcaaagatatttatgacccgtcatcgtaatagctcgtaactacgacacatcacacatatctatgatctatgatgagtggcagttacgaaccctcacacatgagggaatatatttaaatcacaacctttttttataaaatttgataaaaaaatgtgtattaaaaaaatgtgtatgtagtcgaatagacagactttatgtaaaagttgtagagttaattttataattgataatatttttatttgagatcgtttagatgtctgaatatgcactaagtgatgggatctattttgaaaaataaattttaaatttttcagacagacttgaatggagataggccctatatcaaagttgtagacctcaatatttttatttgagattgtttacatgttcaaataagcgttacaaatgatgagatctattttggaatttttttttgaattttttaaatgatctcagatagagacatgacgtatatcaaagttatatagctcaatgagataaacaactttctaattgataaaattttcatttgtgatagtttatatgcctgaatatgcaatatggggctattttacaaccccatcattaggcatattggaggaaaaagcaaaacaacataattacaaatgaaaaataatttgtgcataaaacttttatatacgtgttcttgacgatataaaagcaaaggctcaaatgctgaaaactaaactacaatgaataaaatcctaaaatcaactccaaatttaaggttgaaaatttaaattttggctgataagtataagcataagcgaaaagatgagggggccaactcggaacacaaggttaatgatcctaatcaaggggaagcggcaaccagtgctggagcaagagcatcccatgaggaaggtgaatacgttagcttctcacaacatactcctccaacaaaccctgctctaacaccggccgagcatttgacctatgtacatggattgctggaccaaatccccaacaatgcaacgaccaatccagatgcaacagcttggttggaacatatgaagtctatgacagccaacctcgatactacatttaaaactgtgaacaatcaacaaagagagggatgacattcagcaaatcaccaatctcccgcaaggaaccaagacggtgcagaaggccaaaataatgaagtcagaaccacaatcaagatcaatctatgcctcgatgatggagaacacgcaattctcctccccccaataatgatgtaggctcccatcaattgcccattttatccaaaatggcttattagaaaattaaaattaatttataagtaaaacttctgtagatttattcgtagcgacttaaaagccaacattaacaaaaattacgttaaaagcatttcaaaatcaatttcaaaattaagtttaaaaatttaaattttggtttattctttgactgtttaggccaaacgatgaagctgatagacttatgtcaacacctcaatggatggagggaaaagcgcgagaaccaaaggagtaatgaggacaacggttgctgacatcatcgtaacaatcggggcctcatcctcacaatgatgacaacaaccgtggtcgtcgtgagaactgcagtcagcatagcaaaaatcctatatatctatacgattaatccacacttactgcagttaatactaatttgctgccctcttattcatccacgtcatcagttaattggcgtcgttggatcagctcagaccagctaataccaagcgttggattatatattgagcaacccctctctttaggtgtgatatggaggcccatttttgtctggtaggcccaactgattccgatgtggaataagttcacttcgtgactctcaaaagtgatcgaaatctaatctgtgaccctaaaccacaaaaccggatatctcgacccccaactcttaaaaccggtgcaatttgactccctcggcggttttggagggcggttttactaacgtggcacctatgtggcagtattgactcgatcttctgtccacgtggcgttgatgtggcgcttaggtatcattagaattaaaaaatatgtgtgggacctatttatcattcaaagcaaatttgtgaacccactgacatgtggggcccacatattatcctctctcctcttcatcctcctccctctctctctccctcctctttcttgttaggaatatctcctctcactctctaggtgttaatcacaaacacgtaaattctctttggtagacacacgcacacaagaatattacaagtagggaggaagaacagaggtggacacataaactacatcttgctttctcggcaaccatgccacatattttcattcatttatctagtacttatgtacacaaaagagctaccaactccactcatgcacgacctattctctaggcactaacttcagcatgcactgcatggatatgtaagcagctcacacgactaacaacccaactaactcccactaatacacgcacatgcagtaactaatcactagctcatctgcgtgcaatcatcaagtaatggctaactacgtgactgactcagtgaccacgtacatctgcacatacacataatgtgcagcaactaattaagtcaagattatatccgacatctcttctctccccttcgcatgtctgcagggacgggagctggagcgccggcggcggggggcgctcgagggccagcgaggctcccgcccctcgcgtccccctcctccgcggccgcgctccgtccgtgcgaatgggtggggagggtcgtcgtacctggaccatccgcggccgccccaccgtccggcgaggagacgatgcgtgcctatctgcagcattgctctgtcagtcagccctttgcttgttggcttgccgcttgatgttagtacacacatgcactgcctgttgctaccgcttgctagtcgcagtccagtcagtcctcatctgtcgtctcttgccgattgcctcggcaaccagcaggagaatgcttgacgcagatgcctcccaactcccgtgtggtcacgtcgttgtcggccggctcggcacgcccaccgcgtccatcgggggggctgccgcctcccccgcccgcgccgctcctcccgctttcaacgttcactactacagaaagcgtttttgcatacgggcggaatcgatcttcacatgcggttggccggcccgcatgtcgcagccgtatgcgaagatatattttcccatgcggttgacctaagaagatcgcatgcgaagatctattttcgcatgcgggcgtcttaagtagaccgcatgcgaaattcaatttccgaatagctaaaataatatttattctagcattttggtgagatgtgtctcgtaattaatattaaattattgagggatttattatcgtatttcggagtagtaagcatataagataagacaagtgccgcagtaacaaacatgtaatacataaccattaattcaatcgtaatttacatacgaatatataatagcaagtggcacagttttttcatcatgttattgcatatgtataagtagtgtacatgttattgcatatgttctttctcccactctctgagaggtttaaatttgtcgtccattgtgagttcactctggttgtcgtagaagagacctcttgcgttgcagacatcacgaaggatgaatcggcagaggtcagcggccacgttcaagatagtagtgtcgttgaatcgttgtgcaatatatgggatttcggggatctgcacacagaaaggaaaataaaatggtactcagtgagaagtgtgtgcgagatgggtttctttgtagagaagagttcgatgacctgctcggttactggttgttttgtaccttccatttactctgagcatctcgcacacgtaataaccacacaagttggttcctggtggttgtttgtagcactgcgatataattatggggaccgatctcagtagatatatttagtatatatgtactgttcgataattagttgtattggtataaatttgatagtaccggccagccagtcctgacggataacttcttctgggatggaatatgtactggtccacctcttttgcggtagtacttgtgtgctctgtttgaaggaaacaattgttttattagtagttagaagactggtgatcgacctaaacaatttatagtaatgaaatgtttatcacttacaaattcaaaatagtgaggaattccataaatgtctccttgtcatagtgtgcggggtccaatgatatgatcaattggtctttcggatatacaaggaataatatgtagtggtctctacatataagataggcttattggagacagaaaattccgaagaagataaattaattaaacaaaaagaagagagagcttacgtgaactggtaggggaccattaagacatctttgtcggcgtgcgccaacattgctattgccaagtatgttgctacttctagcttcttcctcttgtgcaatgtcttcacatattcttccttttcttccggggtcttgccaaccaattgctcgcagtcttctctcagctctacggtgtgttgtgttttgcatattcttgttggatcgacgtatccaacctttgctccagttctatcagcttcgtggaattgcatactgtacaatgaataaagaagaaatgagcggccgtttccccctcatccgaccgccctctctcactcccaaccctatataaacgctcccgtgcctccctccgccgtttccgccactcgtcgctctctctccccgccggaatcgagctcgcgccgtcgctctctctatcagccgtcgccgccgagctccggtccgccgccgtcgtcgccccggaccttctcccgtttcggcgtcgccttcttcgggttcgccgcaacctcgccgacctcgtccacctctccgtttcggtcgccgaccgccggaacgccgccgtccccgtcgacccgtgccgcgccgccgccttcatccgctccggtcgccgttcccgtcgtcgccgtcgacccggggtgagccgtggaccgccgattcgcttcccccttccctcccctctctcgggcgccgatccgccgcgccggtggtcgccgacggcgaccatcggggcgcgggtgcgccgccttcgggcgcgtcccgcggctgccatgtggggcccggccgtcagccgcccgcgccctcgggtgtggctgacgcatgggacccacggcgccggccggtgtgaaccgggtgcgcccggtccaccgtggccccactcccgtggacccggtccgcgcgccctctcccttcggctgacgcaataaatccattttaaattaaaatttaaatgaagaaattcgcaaatattcatttaaagagcatataaccttcaaatggccataacttggccatttgaactcggaattggaccgttcaagtctctaatttttccttaagaagtcaagaacccatttttgtgctttgtttctgcttgttatatggagtttattagagtaaaagccttttcttttccgttggtcgtgtagacgctgcagcttcggaagatccgctcttcgtggaagttgaagccgacgtttggaaaagcgagcaaggcaagtcacatcatccttgaacatattgaatcccagtttataaaattatgttgctttaaattattgcattatcgctttatttaaattcccgcgttatcactgttttatctagccatgcctatttacctttgttatgaccttattattattgttattgttattattaccttgttcaccttagattaaacaaaaccccaactagtggacactctactcatggtaccactagtatgattttaggtagatgcttcgctgtttaattaggtaacattaggtgattttacaactctagactttgggatgttcatatcacctggacactatggaatggtttggttattgtggaattggcttcacaccgctccttctattcaaaatccccaaaatggttttaggctgggctcggggtgcatggttttgatagtagcacctcggacatataaggaccggtcttcgggcctctgttgcaaagcactaccgtacttccacatgtctagtgggtaaggcttagtttgtggctcagtctggttataaacaaaagtacacggatggagatggaagaagtcgggggtcgatggacatctctaggacaaatgaaggctacacgagctgcggcccggtagtcgagatgtcatggcacagggccggtgtcctgctgctaggggctcagtcctgcctgcctgtcctgggggttccggccgtaggtgggattgggtcggtactcttgtctatggctaggatgggttggaaactatgtcacgtcttccgtctgtataccgtggtggtatgtggcacgtggttacacgtgaggaagatgtgtattagtggttaagatgtacaccatctgatcagagtataatctattcgaatagccgcgccactcggtaatggcaagccgagcaatgtaccaaagttagtgttttaattcttaaaacctgcttaacaattaaaaggtggaatggttggcctgggttggcttgggacgagctgggacccagggtcgggttgccagttcggtctgaatcatcgtaggccttgggttaaggcaggttcgtgtgggttcacggccttgataaataatattgtatagttctagaatcgtgtttactaaatagttttgagcaactaaatatctttaaatgctatttactgcaaccctaaccctttatagtataactcctttgtactcccttgcatttattctgcacttgtgggtgtatcttgttgagtacggtggttgtacttagtcttgctcaatttttcccaaacccagaagaggagcccctggaagatgaaggctttggtgtctagctcgtgcctgccgtcaagcgcctgtggtcatcgccctagtcttccgctgtttctcgtttgtctttgtgtgtgctgggcctttgctgcccatgtaataaattaactatttacgcttccgcttgttaaactctgaattgtatcaacttttggtgtaccttgcctcctgggacaaggattaatgcacgcacgtaaggaacacccgttgggttatttccggtcgtgacaagttggtatcagagcccccttgaccctaggacgagccttagatcccaagccttagcaatattttcaaaataaaaatcccttcttatttgtgaaaatcctctagtctctctctgtcctgctgcttcatttatcgccaaaatatgacctttaaaatgttgcttttctttttgtttttgtttgtagatggccggcagcgtcagccgtcgtggtctggacatgactggtttcgtcttggagctgcggggcatgtgcgttgtcctggggtatccgcatggagtggactaccagggcaggccgctcccggagcaggagggtgacgatgcagagccccatgctgcttgggaggttactgcagtgatcctcactggctctcccgagcggacttcgttggcagtcaccgcgggtggagattctttccccgccgcttgccagagcgccgctctcctcgccatcggcactcttcaccagggctacccggacgagttgcagcactcgccctaccgctaccaccctcgtcgcggaggagcccgcgacttcgccaccttccgggatgctagctcggaggatgacgctaccatcatgcacctggcgcgcatggtggaggcgtacgatgcggctcgtatcgacttccatcagatggtgcgtcgtgggatggtcgagaacaacatgaagatcctggagctgcgtcaggagaatctgcagctgaagaaggacctagacgcagtggaggcgcagctgcatcagctcaagatcacccagggagaggtctgtcgccccaagtgtcgccgcgtctgccgcagccagaagatcaccgcccgcaagagcacctccaggcccgagcttgttcgtcagtccctggcgtggacttgcttcgtggagacccctcgtgccgagcctgcgcccgtggttccccaggagggggaagcctccggcgttggtagcatggaggatgcgctgttgctcaccttccgtcctggcccgtcgcagcggtagacgagcagttagtaggcttgcgcgtgtgttctttctcgtttgtcttcttgttggagttgtgtggggcatggttatgccggtgtgtggtgtaactgtgtcggagcctgtctttattttatttgcttaagcaacttgaactttaatgaaccaatttaatagcagtaataaattcaagaattatggtagtcgtggatggttagctttaattgtcagctctctctgtttgctggttttgggtggggttttcagatggtgacgaccaggaaaagtgctgccaccggtgagggcaaccaatctgaaggcagcaaccacaaccaccagggcagcccacctccacttcatcttccgcttccaccaccaccaccagacaccaacgccattctcactcaaatcctcgcccagcaggccaacatgatgactgctttcctccaccacctccaaaatccgccacaacagaatgctccaccaccacccccacaacactctaaactcgccgagttcctccgcatccgtccacctaccttctctagctccaacaaccccgtggatgcgttggattggttgcatgccgtggggaaaaagctagacactgtgcagtgcagcgatgaggagaaagtcatcttcgccgcccaccagctgcaggggcccgcatctctatggtgggaccatttccaggctacgcagccagaggggcagcctattacttgggcccgcttcaccgctgctttccggagaacccatgtgcccgccggagtcgtggcccttaagaaaagggaattccgagagttgaagcaaggcaaccgctctgtgatggagtatttgcatgagttcaacaacctggcccggtacgccccgagatgtacgggaagatgaggaaaagcaggagaagttcttggcgggaatggatcctgagctgtccgtccgtctagtctccggggactatccggatttccaacgtctggtggacaagagcatccgcttggaagacaagcacaaggaactggagtcacacaagcgccgcttggcgaatttccgcaaccaacagggtgctaaccaaagggtccgctacaccaatccctatccagggggatcctcctcgcagcaggaacaacagcagcagcaaccacgctccgcgcctcgacctcaattcgtggtgcgcgtcccacagccgcagcagcagcagagtcaacaagggactcgtgcgccccgtcctcctatgccaactgtgcagcctggtcaaagccgcagggacgctcaaggtccgcagcgtctgtgcttcaactgcttcgagcgggggcactttgcggataaatgcccaaagctgaggcgtcagcaaggccaagcgcctccccgctccaacaacggtggtaaggatgtcattcggggtcgtgtgaaccacgtgacagccgaggacgtgctgacaactccagacgtcatcgttggtacgttcctcattcattccatccctgctaccattttgttcgactctggagcttcccactcgtttatatctgtgccattcgtggggagaaatcagttgggggtagaaaggcttaggaaccctctgctcatcaccacccctggaggggttatgacagcaaagtattatagtcctgccgtccctatagaaattcaggggattccttttccctcggatctgattctgctagacaccaagagcttggatgtgatccttgggatgaattggttggctcaattccaaggagtagtggattgcgcgagacgcactgtcactctgtacccagggccagaacaaccggttgttttctttgcacccccaacctctgtcagtagttcagaacttcatcagataggactgtcagaaatccccatcgtcagagagttcggagacgtgtttccggaagaactacccggtatgccgcccaagcgagagattgagttccggatagatcttgctccaggaaccactcctctatacaagcgaccctaccgtatggcagcaaatgaactggctgaagttaagaaacagttggaagagttgaaagaaaaggggtatatacgtccgagtacttccccctggggtgctcctgtgatttttgtggagaagaaagacaagacgaagaggatgtgcgttgactacagagctctcaatgaagtcaccataaaaaacaagtaccctcttccccggatcgatgatctgttcgatcagcttaaaggtgccactgtattctccaagattgatcttcgttccggatatcaccaattacgtattcgtgaagaagatattcctaagaccgcattcaccacgcgatacggactgtatgaattcacggtgatgtcattcggtttaaccaatgctcctgccttcttcatgaacttaatgaacaaagtgttcatggaatacttggataagtttgttgtggttttcattgatgacattctggtatactcacaatcagaggaagaccatcagcaccatctccgtctggtgttgggaaagttgcgggaacatcaattgtatgccaaacttagcaagtgtgagttctggttgtccgaagtcaaattcttagggcacgtgatatctgctaaaggagttgctgtggaccccaaaacagtgaccgccgtcactgattggaagcaacccaagacagtcactcaaattcgcagtttcttaggtttggcaggatactaccggaggtttatcgagaacttctccaaaatcgctcgacccatgacacagttgttgaagaaagaagagaaatttgtgtggagcccgcaatgcgagaaggcgttccaaactctcaaagaaaagctggtttcctcgccagtgttaatcttgccggatactcgcaaggacttcatggtgtattgtgacgcttcgcgccaaggattggggtgcgtgctcatgcaggacggtcatgtggtggcctatgcctcccgccagctacggcctcatgaaggcaactaccctacccatgatttggagttagccgcggtggttcatgctctaaaaatctggcggcattatctcattgggaatcgctgtgaaatatatactgatcataagagtttgaaatacatcttcactcagtcggacctgaatcttcggcaaaggagatggttagaactcatcaaggattacgatgtgggaattcactatcatcctggtaaggccaacgtggtcgctgacgctctaagtcgaaagagccattgcaacactcttaacgtccgtggctttccacccgaacttaaccaacagatggaagccctgaatctgagcgtagtgagtcgtggattcttggctgcgttggaagccaagcccaccttgctcgatcaaatccgcgaggctcagaagaacgacccggacatgcgtggactcctcaaaaatatgaaacagggtaaagctgcgggtttcacagaggatgaacatggaaccctatggaacggaaatcgggtatgcgttccggatgtcagagaacataaacagctgatacttcaggaagctcatgaaagtccttattccatccaccctggcagtacgaagatgtacttagacttgaaggagaaatactggtgggttagtatgaagcgggaaattgcagagttcgtggccctttgtgatgtgtgccagcgtgtcaaggcagagcaccaacgaccggccggacttctccaacctctccaagtaccagaatggaaatgggatgaaattgggatggatttcatcaccggacttccaaaaacccaaggtggatatgattctatatgggtagttgtggatcgattaaccaaggtagctcgatttattcctgtgaagaccacctatggagggaacaaactagccgagctctacttcgctaggatcgtgagtctccatggcgttcccaagaaaatcgtatctgataggggaagccaattcacctctcacttttggaagaagctccaagaagagctgggtaccagattaaatttcagcaccgcgtatcacccgcagacagatggacagaccgagcgtctaaatcagatcctagaagatatgcttcgcgcatgtgtcctagatttcgggaagacctgggataagagtctcccctatgccgagttctcctacaataacagctaccaagccagtatacaaatggcaccttatgaagcgttgtatgggcgcaaatgccggacaccgctattgtgggaccaagttggggaaagtcaagtgttcgggactgatatcctgagagaagctgaagcgaaggtcagaaccattcgggataatctaaaggtggcacagtcccggcagaaaagttatgcagataaccgtcgccgtaacctggaattcgcagtggacgattttgtgtaccttcgggtcacgccattgcgagtgtgcacaggtttcagacaaaagggaagctcgcacctcggttcgtgggtcctttccgtatcattgctcggcgcgaagaagtcgcttaccagttggagctgcccgcctccttgggcaacgggcacgatgtgttccatgtgtcacaactcaagaaatgtcttcgagtgccatccgagcaggccgactcagagcaaattgaagttcgcgaagacttgacctacgtggagaggccagtgaaaatcctggacaccatggagcgcaggaccaggaaccgggtaatccgtttttgcaaggtccaatggagcaaccacgccgaggaagaagctacttgggagcgtgaagacgagctgaaggcagcccatcccgatctcttcgccagttcttccgaatctcggggtcgagattccgtttaaggggggtaggtttgtcgcgtcccaaaacgaccctaaaatacatcctctaaataatgcttagaataattaaaatccgtgtgagagcctcccccaattaaaatgtgcaaagttaaaagtcaaataaggcttggaggatttttgtatatttcctaaaagcctaaaatgcgtaaaggggatcctctagagtctccttgcaggcttgcnagcatgaggttgttcattcaaantcaaccca

SEQ ID NO: 29669 - DNA, 2664 bp, Oryza sativa
  unsure (1)..(2664): unsure at all n locations
gaggttgaatttgatcatatnnnnnnnnnnnnnnnnnnnnnnnnnnnnnnnnnnnntgattccctccctctttccccccacttttccctctctctctccatcggattcgttcgggatcttttcccctaaacctcgccggcgcatcaatggcggccggatcttccgcggccgtttccccctcatccgaccgccctctctcactcccaaccctatataaacgctccccgggcctccctccgccgtttgcgccactcgtcgctctctctccccgccggaatcgagctcgcgccgtcgctctctctctccgccgtcgccgacgagctccggtccgccgccgtcgtcgccccggaccttctcccgtttcggcgtcgccttcttcgggttcgccgcaacctcgccgacctcgtccacctctccgtttcggtcgccgaccgccggaacgccgccgtccccgtcgacccgggccgcgccgncgtctttctccggtccggtcgccgttcccgtcgtcgccgtcgacccggggtgagccgtggaccgccgaattcgcttccccttccctcccctctctcgggcgccgctccgccgcgccggtggtcgccggcggcgaccatcggggcgcgggtgcgccgccttcgggcgcgtgccgcggctgccatgtggggcccggccgtcagccgcccgcgccctcgggtgtggctgacgcatgggacccacagcgccggccggtgtgagccgggtgcgcccggtccaccgtggccccactcccgtggacccggtccgcgcgccctcttcccttgggtgacgcaataaatccattttaaattaaaatttaaatgaagaaattcgcaaatattcatttaaagagcatataaccttcaaatggccataacttggccatttgaactcggaattggaccgttcaagtctctaatttttccttaagaagtcaagaacccatttttgggctttgtttctacttgttatatggagtttattagagtaaaagccttttcttttccgttggtcgtgtagacgctgcagcttcggaagatccgctcttcgtggaagttgaagctgacgtttgggaaagcgagcaaggcaagtcacatcatccttgaacatattgaatcccagtttataaaattatgttgctttaaattattgcattatcgctttatttaaattcccgcgttatcactgttttatctagccatgcctatttacctttggtatgaccttattattattggtattggtattattaccttgttcaccctagattaaacaaaaccccaactagtggacactctactcatggtaccactagtatgattttaggtagatgcttcgctgtttaattaggtaacattaggtgattttacaactctagactttgggatgttcatatcacctggacactatggaatggtgtcacgcccggaatttctatccaaaattccaaacgcttacatgtgtgtgaaccctcgtccaggaatcagccgaggcacacaataacaaattgataatagagtacaaataatactctaattaataagcgaataaaatgtcattacagaggtagatagttcttctcaatcaataaagttctaagcagcggaaattaaataaacggcgcagacggctccactccacaggtagcttgaccaaggctacacctaatcctccacaccatcagcctcattgtagaactcttcttctgatgaatgattgcaaggtgagtatatgacatactcaacaagccacgcagcaaatatgcaagtgcacaggataacaaaggatggcataatatggttgtatttgcaaaagcagcatttagcaaacatttgagaatttgataaaacagttaagtaattaaacaatattaatccaacgctatacaacataccctgttgtataggcccaaccattctgaacaaccaccccggctgcacagttctatctccaaaccaggaatgtaccattccaaaccaggagctaatcaaattattaccagtttaagcatcttttacaatgatgagaggtgtgagactaatcacgaaagacattgttagacccgcccataaccgcgggcacggctattcgaatagttatactctggccagaggtgtaccactgtacccacaagacacaaccccacatcatgtcaccatgtgcctcaataccaccacggtatctcggaaaggagttgtgacaatacccctcgcataacacaatccactgcagcccaccttactggatcatantcacccncntatnnaacagggcatggnactcccagccgacccncgtgggcttnatctnncgcacttctcaagctggtgcccncgcatgaaccatgctatacaaaagattaagccgttgnccatgctggctgnggntggaccgataattgttcacaccggaactcgtggaccgggtcttattggnatgagccggaccataaaaacatgttgccccaaaccaccattataagttttaggtggcacttanntaataactaatacgcatggccttgggaaccttcaatagacctctggaaaataggggggctttggtttccatagggcctagtgttaagcgggctatcattggtttatatctttgcccacttataaaggccacttgaaattgtacccccgtgta

SEQ ID NO: 29670 - DNA, 8817 bp, Oryza sativa
gcccgaggaagacgacgactgacgggtgggccccacctgtcagcgacagcgcgctcgcgcggccggctccgaactgggctgtcttgggctgagaagaaaagaagggattttggtccgtctttcggcccaaagccaaaagagactttttaaaacctttttcaatttaaattatttcttaaatgcaattccatttattaaaaatactttcttagctcaaataaatcccagaaaaatctaggaattatagaattaagcaaagtatatatattttgaattttcagggtgtgacaaatggtttggttattgtggaattggcttcacaccgctccttctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggaagaagtcgggggtcgatggacatctctaggacaaatgaaggctacacgagctgtggcccggtagtcgagatgtcatggcacagggccggtgtcctgctgctaggggctcagtcctgcctgcctgtcccgggggttccggccgtaggtgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaaggtggaatggttggcctgggttggcttgggacgagctgggacccagggtcgggttgccagttcggtctgaatcatcgtaggccttgggttaaggcaggttcgtgtgggttcacggccttgataaataatattgtatagttctagaatcgtgtttactaaatagttttgagcaactaaatatctttaaatgctatttactgcaaccctaaccctttatagtataactcctttgtactcccttgcatttattctgcacttgtgggtgtgtcttgttgagtacggtggttgtactcagtcttgctcaatttttcccaaacccagaagaggagcccctgaaagatgaaggctttggtgtctagctcgtgcctgccgtcaagcgcctgtggtcgtcgccctagtcttccgctgtttctcatttgtctttgtgtgtgctgggccttcgctgcccatgtaataaattaactatttacgcttccgcttgttaaactctgaattgtatcaacttttggtgtaccttgcctcctgggacaaggattaatgcacgcacgtaaggaacgcccgttgggttatttccggtcgtgacaaggcgacggtggtgcaggagcggcagcagtcattgcctgtgatgaggatggggttgaagatcctgctgcaggaaaggccgcgctcaggattatgtctctgcggtgccacaagataaactgattcactgcatcaccgagaagttcaatcccctcaagtgtaggtatgtctagttccaaggaaacgtggttgctatggaccttggcgacctgtatccttgcgtaatcctcagggattgccgtgttgtggaattgacgtccgggtattgcaaaacccattgcaacctccttagtctttccagcgcgaccgattggtacgatgagactgcacggaggtggtccagttatactatccacagggaaggtagttgtctgcactgagcctacactgctgggtacattagttgtttgctgtgcggattgtgtgggttgttggctatcaaggaataaccttggaaaggctgtcgggttttcagctgccaacgagtagaagtgttccttcacttgcgcatagatcttgtccgataggtgttctttgtatttggctctcttcttataacttggtgcgtcttgtggaaacccgacctttcaacttgtctttgaagacaaaccccttacacgttcagagtgttcagccgtccccaacgccgcagtaagctgatctcgctccctccgtgggacgaactgtcctgatctttctttctcgactatctgctgcaaattagtagtcacttcttctatgtctggagtctcgaatagtatgtctccctcatccgagacttgacctgtgctacgcgcccaaacccagttcttgctacgttcaaccatggggtctaccagcaggggcttaccggccgcggcaaatctttgctcgatctcccgccattgatcgacgtgaccagcgtatgacatttttttcctcaaagccaatgcttcagctgttgtatgatccgcaacaaacgtgtcccagtcagcctgcgatatatgtccataatccgtaaacggtgggagattcttctgaacataatcccgatttagatcggactttcactgtcgccatcgatctcccatctttttaagtgcgtaatctctccccctgacctctgatccaggagggaacacaaaatacttctgcaactcattccagagaagtgtcttgatgttgtcgtccactgtttcccacaacttgacattaatgggacaacgtgtcctgactagagtgccacatgcgttgctgaacttggaccgcactatcggtggctcgacgggcttcccatcctgatcgagagcaatcacgttgtaagtttccttgggtaatttattcttgcttctctcaccacatctttttttcccactcccgcctgcacttgtagatgtctccgtacgttcaggtgcagacgtagcggtgtccatctcaacttcttgctctgtcctgttcctctcggctttacgtttcgagcggcgtcggactaccatctgcaaagaataggtaactctatacaccattaggttcatgtcacatcatagttagggaataatacatggctaacgattttcaacacttacggcctgttcgataggtatgtagtccggatcatcatcgcggggggcgacttgtgttatttccattggaaacgggtcacttggtgtgcgccacgtttcttcactagaagcgtctggctgcttattgctaccggaattttgaggagcgttaccttcttgaggcgctattggtgcattcgatggaaccttttcgttcgacatgttccaacttgacgtaaaagaatttgacataagtcccaattttacgtaagtaccaatttaacgcaatttcacataagtctcaatttgacataagtcccaatttaacataagtcccaattatacataaatctcaattaaacataagtcctaattatacataaatctcaatttaacataggtcacaatttaacttattttcacataagtcccaataacttaatttcacataagtcccaatttaacataattctcaatttaacataagtcccaatttaaacataagtcacaatttaacataggtcccaatttagcatcagtcacaattaaacagaaatctccatttgacataggtgccaatttaacaaaagtcccaattatacataaatcccaatataacataagtctcaatttaaacataagtcacaatttaacataggtgccaatttaacaaaagtcccaaatatacataaatctcaatttaacataagtttcaatttaaacataagtcccaatttaacataggtgccaatttaacaaaagtcccaattatacataaatcccaatttaacataagtcccaatttaaacataaatctccatttaacaatccacaattaaaccttctcaaaattaaacaatccacaattgcacatatcacaatccacgatgcacaattaaacaatccacaatccacaattgcacatttcacatttctttttttaaaagtaaatgttaccgagcgacggcaacggcgagggggtagaagtcctggcagcggcgtcggcgacggtgaggggcggggcgacttcggggaggagccggcggtagcggggacgacttggcggcggggacgacctggcggcggcgacggcaacggcgaggggggagaggtccgtgcggcggcgacggcgacggcgaggggggagaggtcctggcggcggcgacggcaacggcgaggggggagaggtccgtgcggtggtgacggcgacggcgaggggggagaggtccgtgctgcggcgacggcaacaacggcgaggggggagaggtccgtgcggcggcgacggcgacctggcggcggcgacggcgacggcgaggggggagaggtcctggcggcggcggcggcgacggcgtggggcggggcgactttggggaggagccggcggtggcggggacgacggcaacggcgacttgggaaattttggcagcctggcggctagggtttcgctggagccgggacttagaaaattttggctccccgcgctccctatatataggcgcagatcatcgcatgcaggcggcttaagggaccgcatggaaaaaatatctttccatgcggtcgacataagccggccgcatgcgaaaaagatctttccatgcgggctgttaagccagccgcatgcgaaaaagatatttccgtgcgggccataaagccggccgcatgggaaaaagatatttccatccggctggcttaagtcgtccgcatggaaagatctttttaccaaaaaaactcatattttttttctctaagtaaactgtccatatatatttttttcccaatatttcgccacaattatccattccaaatgtttttggcactaagaaaactcatgaaaattgctcaaaactcgtaatcaaatgttacatgctaatgattacaacataagggggacctaaattcatgcacgtacatttggaacacaatgagaactaaaggttacgaaataactatgacttaataaccttggcaacaccatctgctcgaacgtacgacatatttgcttcatcgattgttctctcaaccttcttaattcgcataggaagatcagtaaacaatggtacatcgtcgaactggttgtaatcattggggtcttcgatgttgtcgatgccgacgatctgttgctttccggatatgacaatagtttttctttcatctgaagggtccttcacataaaacacttgagccacacgctctgctaaaacccatggatcatccttgtggcctgttttactgtgatcgactatcgttagcccgtagtcatcaacggaaacccctattgtgtctttaacccattcacaacggagcacagggatctggatgtttaggccatagtccagttcccttatttcttgaatggtcccataatacgacctcttttctccactcgtgtcaatcgcttcgacacggatcctactgttttgtgcagtgcttttcatgtccttcgtagtcgtactcaaggtaaatccattgatgtcgtaaccttgccatgaattgacaatacttgaaggcccacatgccagtctttgtaaagtaagttcctccacagaatcaccaactggcaggtttagatctttcaaccacggaggaaagcgacgcttgtgctctcttgatatccaatcattggaccgccctgggaagcaggctttgatttcttctaggtgtcgctcaatgaatggctcaacgatagcgagctgttgaagaacgctgttgtgtgccgcggacacctttttgtaatcattattgaagaactgcttcctaccaacagtaccccttccagacaatctaccttcatgtcgatgaacaggaatgccaatggcattagcatcctttatgtagtccatacaacactcgactgcctcttcagttgtgtattcctctatcaatgatccttccggatgagcgcgattgcgtacatagcctttgaggatcgacatgtaacgctcataggcccacatctgatgtaagtataatggaccaagttcaataatctgagggacgatgtgaacgatcaaatgctccatcatatctaaaaatgatggtgggaaatacatctcaagctgtcatacagtctcgatggcaaatgtctgaagcggacctaattccaaaggatcaaataccttctgcgaaattcgattgaaaaagtagcacaactttgttataaccacctttgtgtggactggtttgactgcccttatagcaattggtaggaacaccgttagcaacctatgacagtcatgcgcattgtatcccgaaatggtcaaatccttcattgatactagctttctgatgttcgatgtgaaaccagtaggcactctaaccccttgtaaacatttactgaaggcttttttctcttcaagtgtcaacgagtaacaagcaggaggaatctcgtcttaccatttggcagcactactgggtgaaggtcatgccgtatggacaaatatacaaggttgttacgtgacttcaatccatccttcgttttactcgggatgtccagcaatgtgccaacggtgctatcaaacacgttcttctcgaggtgcataacatcaattgcatgtcgaatctctaggtccttccttgaatctaaatatttgaagaaaattgagtgcttcttgaaaggcgacgcagtaccgttgtcaccatcagctttcttcctctttactgtcttcttctttccctttccatatacaacattaatcttctttgttatctcatacacgtatgtaccacctcttgctactggggcagtgtcattctccactgtattatcgaacaatctagccatcttacggtacctatgtctttgtggtaggaaccgtcgatgtcgcatgtacactgtcttcaaagacgacgtcaggtatctgtatgaagttttctccagacatatcagacatccagtcttccctttaatctgcccagataatgaaaagtttgcaggtaggtcattgatggtaacgaatatgatcgcacgtagattgaagtgctcccgcttaaactcatcccatagtcgtaacccctctttccaaagctcctccatgtcctccatcaaaggctcaaggaaaacatctatgtcgattccaggttggtttggaccttgtatgaggatagtgagtagaatgtactttcgtttctgacatattcatgttggaagattatacattgtgagaaggactggccatgtgctgtgcgagctgcttatgtcaccaaacgggttcattccatcagtgctcaatgcaaaccttacattcctaggatccttagcaaattctgggtgttttgcatcaaatgtcttccactggcgagcgtcggcgggatgtcgaatcataccatctattttctggctctcttgatgccatctcatcaactcagcatcagtcgggtttgagtacagacgcttcaggcggtccttaattggtaggtaccacatcaccattgaaggaatcttcccgcgcttacccttatcagaatctggatcggtacactctgaatctacgggcccattccccattttataccgacttgtgccacacgttgggcaacattccaattccgcatattctttacggtataatatgcagtgattcttacaagcatgaatcttttctacaccaagagataaaggacatatgagtttcttcgcttgatacgtgttcgatggtacaaagttaggcttaggaagcaacacacgcaacaaactcatcagatcattaaaacttgtgtccgaccatccatgtttagccttcaatcttagaagttcaagcactgaacgcaagactgtgaaatccttatcacatcccttcgtttcatcgtaaagaagatccttcgatgccttctctaatgcctgccaattctccaatcctcgtgacctgcccgctagcacctctggtttaacatggcgtagcatatcctctaaatcaaaactaccatcgaaatcatcactatcggtggaaacatcgacaaccattctttcacgcgacatgtcttcgattataaaattctctgcctcattcatctcgaaacataactcttcatcgtcatctttcggattggcgaattccctgtgataggttcaaaccttgtagttggcggtgaatccgtactccattatgtgacccaatatttcaccaggatctaccaacaatttctgattcttgcaatgacggcacggacaaaagatctttgtcatattctccctcaaagcatgcgccttagccctgatcaataaatttagatgccttccttataaaatatcggcttgcgtcttcacatttcatacatccatgacgactgatccatctattatattaaggcaaaaagtttcaaataaaaaattgaccgaagttttcatacaaaggtttaatgcattgtttccaaaaaaaatccaccatcctgtacctggttgtccattgatacatgcaaaattgcccataaacttatttttgagcttgatttgcaaaataatagacaaaacttgtaaaatttaaaaaactccctttccccacgaatttacaaaaggggcaaataggaggatgaaggttctacctttggttgggtcaacaaaatttcggttgaacctcccctaatgggcttgttaggaaaaaaactttttttaaaggcaaactggcctgggagacatttggccaaattgattggcccttaacaccctggtaaaaacctttcaagggttttagaacccctttgaaaaacccctgcaaaggcctttttcagggcccttaagggcctgcctattttgccctaaagagccttgtttggttataaccct

SEQ ID NO: 29671 - DNA, 2769 bp, Oryza sativa
  unsure (1)..(2769): unsure at all n locations
gcggcatgaaactgagcttctccttcgtccagcncgncgactttagaggatcccccctgtcaaagccacaaagtaaagaccttccaaactaattgcggtacactaataagttattgtgctgattattcccatccaaaaaaggcttacactaaaagatattttgtttttcattacatattttatttacagaggattgatgttttaacttaacaagatgtatatgaaggaaatataacataccattgacaatacttcatcaaccctgtacaatgaaggataaataaaattgagctgcttttttgcaggcagtatcatcatgctgaaaccagcagcacaacgttcatcaagagaaacatctgcgtaaccaccacgaagagcaagagacttgcatatggacagaatgtacaacggcaagaatcttaaagattctggatatataagtctccctcctatccggtgctgtacaacatataggttccggtattccttcaaacttctcacaagctttaattgtaattgttgccgaacactgtccagcttatcagacagtgaattttcaacagctgcaacatataataagtcaaaactatgaacactcaaataccatatatactggcatttacaaaatggcaggagcataaatctagtactaaccgattctactcaacaatgacacaatggcaccagtatctgcttgacgatacatttcaccaagatctgtgaccacaggtgcagctgctgtatgcaccctgatacgcctttcaccagaagaggatgtatatctggtggtggttaagaacaactaccacttcatacaatatatgctgctaaaaatgtatcaaacagctaacaataacaaatatcacacataacagaatcttctaataataactaatatcgaacagctaacaataacaacaaagcagtactccagtgagtcatgcagataagtattgacacatctaaatgcactcccaaaatgtttgggcataaacagattttacaagtttcatcaagctatcacaagttaagggatgtcccaaacagcctatgctaatgacaatttgaggaaaggtgttaacagtcaatttgtcaggttaaattgtccatatgtaacattatttttttctaatctaaatgaagatttgaataagagtgttgcataaccagattggcaggaaaggatacagcaatgccacttggaaatatacagtctgtgtggtcattagggtctcctctaaagaaagttgcattgcaaatgctttatcagagtcaacagctggaagtgctaataagtcggtggaccttagcatgaaatggccatgataagttgtgaagcgcacccctgcaagcagacatcagtttgtaagtcattgaatgttaagctgataaataaaactttaaaatattgtcagctcagaaccttttccacatctgatacgcataacagattcccatgcagtttcccgtgtaaggtctctgctaagctcatgtttgagtttatccccatgagtaactgcctggaaggatggataatggtacacctgaccaccagtgtatttcgccagagaacctacagaaatgtagcaaaattaaagaacatggttaattgcaatgcacctttccaaggtttggcagaaaaatctcacctaaagaagctatatcacagtatttatcactgaaagaaaatatgtccactgcaatttgatttttcgtgaactcagcagccatctgtttataaaaaggatcttctgggactctgagagaatgctccttatctgttccatatgcacggacatcatctcctcgaagtctcaagcgaccaacaccaagagatggtaatgtgctctggaatacaagtaacttccctccaatttgactctacaaaagatatgacacaattatccatatctgggtagtgggtacaactaatggtagcagaagcaattgtaggaaaattggcatcttaccataaccatgaatgctgctttaagtgctggaccaagagcagattctacatttacattgtcctggaacatatttggcaagctatcgagaaatgaatcgacaacatgtctagagtcaaccaaattaaccaagaggtcatcaggcaacggcaggaaaacatcatccaaatcagcgaccaccatcatttgaggttgtgacaaagacgactgatacaaccagataatacaagtcatgtaagtaacctcacataaattgaactaaatttcagacgctagtatattattgcagagcaaatggataaaaggatagatggatataccttgaaattatgaaagtgcaatgtgctatcaaaagttaagaatccaatctgtgttcgtggaaaccttgggaggtcatcaaggcatgatttgatggtctttgcaacaacctgaaagaatgcaagcattgaatttgtttgaatccaaactacaaagcataacctataagaatatgctgcaccactagtacatattatgagttacagagaaaaatatgatcccctaagtgattgaaatcaaactgcaaaacaaatagcacatacctcaagcagcccgcttcgaactgcagatacggacacatcaataagaaagaaataggagggtggcattggtggccgcaccatatattcagtgggagcaacaaactctactgttcccttagaaagctcaggtctttgatctgcatcatatcttctgccgctnnnnnnnnnnnnnnnnnnnnnnnnnnnnnnnnnnnnnnnnngaacttcaagttctcaaccag

SEQ ID NO: 29672 - DNA, 9088 bp, Oryza sativa
  unsure (1)..(9088): unsure at all n locations
tatcttctgccgctaccatcaatgccacaaaaatactctccagganctgaatataaagaaaaaggaattagtttgcgcaaattgattacggccaaacaagtgttaagaagtaacccagcactaccgcagcaagttcagtattgtgaaaaatcatataacagaaggctgtcctttacaaatcaccactatttgtatacacaacagtcagtgaaataaactgtcaccttctatataatacatatgatgcaccaactaatttttctgtcataatactacaatcgctggcattgaaaaattgcctctttgcagagtagcagtctgtccattatagtccgtttagcttgctcctctgtctcggagattacaaacacgataaatggcctacagctccaccatagaatatattaagtaatttataagcaaccatgatcttataaatccaattgtctggcagcaataacttgcttcagattgaacaggacatttaagcttaaggatttagtctctctctttttgtttacagccgcttatgaattttacgagtgagttattatgataacaaattccatattagaataggagctatatgcaatgcctaaagaagaagagtcacgtaactacaacatgtattttatgcctaaagaagccaagcatttctttactatgttttcctgtcatggcacttgtgacttttcatctctagtaacaacctaactagcatcttagtccaaaacggatacatatgggatgggggtaaattgatatatttcttcagtgccatactattccagttaataaataggatatgctggtacatactcattccaaatgcgataattctcaaaatactagagaaatttgatccagcagcaataagcttacttggattgttaactacactgtatgaaaacagcaaaggtataaataacttgaatatcctaattaaagaaataaattttaaaaagcagcttctggaagagccttttatggaattatatgggccggatctcgcaactccaaatataactacatatgcgaaatcaaaccaagcttcttaagacatccaaaatcttagatgctttccattcttgctgtacgcatttactttcgatattgtcaacttacatatatatgtcatgggtgttaccatcgaagtgttatattttggataagaggtcatataaagcactatccatacacaagatgccactgactataagaaaactaaattgctcctttcaatccagtggaacttccttctgctgatgagagactttggataagagttcataaaaaagactagccagtttcaaggtcaggaagagaaaggaaaatgctgggtttctaacaaacacagaaacattccttataaattttccgctttgatttcgatatgaaattgtttgtattcaatgcattgatttgaagagtttggtcttccattacagcaccccttaggaaagaggggtacatgcatcagatttttgaaagagcgctactgctaccctaatgaatacttccatacattctaaagttcaactgtaacataaaaagtttcacacccaacttttttcccattttagaaaagcaccacaacattatgatatgattcaatcatcaactaattccctatcaaaatatttttattaatgggacaaattatcttacttttgcagtattgataaaatgtaatttgaactattgaagaatactttggtttgaaacagcacagccaaacacatagttagttgaacataactacaaattcatcttttattgtaggatacatatgttgctagagctagagaaatggtcagcagaatagacaaatatctgtgtgccgatgtactctctatcggaaattcaaatattcagtacacattgaattattgagcttaaagaccaaaaaataattaccatcattgagcagcgtgcaaagattgcagcgccatttccttccagcatccgcgaatgttgcgtaagggtttatatatgttctacatcttcggcaacggatgacaccagctgacccaaagttgataaccggaacctcctgagtgatgagaaacatgaatgtcagaacaattctttgacaaagagggtaaaagataaataaagtgcctaaaagtcattaccccatcaggtgattctgcgagaggatgtaccacagccccaagaggcagatgccaccttgagaccaacgactgggatgctggaattgcatgggttgtcagccggaagtacctcgggtggcagttcaatggatatgcctccaaaaccttagttggttcctcgtcaccatccaatggccttggcagccctttgacgtcgacaccaggatcaagcgatcctggtgcagaactaaccgagagcgactggaagtcctccactaagctctggagggtgccccctgtaggaggcccaccagtcgcatatgccgcctgattgccaaaacccgccataggagggggcggcatggtctgcactggctgctgaaatgttggtcgtgacatcgggaactgttggtttgcaggaggcggaccaccgtaaaaaccttgcatgggcgggggctgtgattgtactggcggtggtggcctcacatacgccgagggtggagccataccactcgctgtaggtgactgcacgagcgaaggcggagggcgaaaaggcggctgtgcggatgcaaaagggccctgagacggcggcacgctggcggcaaaggggccctgagacggcggtggcgcggtgccgaatgggccctgagacggcggcggcgcggtgccgaatgggccctgagacggcggcggcgcggtgccaaaggggccctgagacggtggctgcggcgctgcggcgaagggaccctgagaggacggtgcactggtgaaggggccctgcgggggtggtgccgcggcggcgaaggggccctgctggggcggtccagcgccgaaggggcgctggggaggcgggggacccctgtacccagccattgccgcaggtggcgcggccgcgaacggcgccgcgggggacgcagcagcctgcgggggcggcacgaacggcgcgcgcggggcggaagcagcgccgaacgacgagggcggcggggcggcggtggcggcgccgggcacgaaggcggagacgggcctcccgggcaccccctgcggcggcctgtcgttccccatcggcggctgcatcgtcgggcacctgcagcgcggcgaattgaggaagggatcaggctttttttttctgtactcccttgatccgcgatctgatcccgcttcctcgggcggatctgaacacacgcagggtagtaggagaggggggcgaggtggggggggcttaccgggatcggaccgcggcggcgctccggcgagatgggggcggaggcggaggcgcgcggcgaggagggaggcgagggagatggagatggagatggggttagaagtagaagaagcctagaagaagaagaagaagaagggggatggatgatgacgtgggtgggtcgtgctcgtagggaggaagcgaatagtagggctactcttctgctgctgtcacgcgttgcacggattcgccttttgattccaaatcttacgattcatctatctcttacttttcctcatgaaaattcgatcttctcttatggttgagagttgatttttaagttttatcaaattgttatgtcataaagtattcttatctggtttcatcaggaaatatgttaaagtatgtaaattgcttgttttggtacagtaacttgactagtttataactttatatgaacatggaccaaaacaatccatgcgagcgaaattgatctaacgtggggcaacttggtgacacctttgcgagttagcagttgctttgttttgaaaaataaattgcatagcagttgttttgttttgaaaaacaaaatccacactctatagttcaagcaacctacaagacattgctatacgatcccggtaggggtgatgtcccgatcttcacggcgtaggatcaagaaccgataactagcctcaaagagaccaaaataactggctgcaagcagccaagataacagtgcaacctaacgatcgtgcttgaagccaaccaccgtctctattacggcaacctgaatagagggttcgcccaaccacactctaagttactaaccaacacaacttggaatcaatcgaggaaaaaattctcaaaaggaccagaagcaccaattggagggcgtcgatcgccgcttctgtaatctcacaaggaaatcacaaaagcaaagggatagagatctctctctgaatttgctagcacacagctaaacaaaggggttcatattctcattgtcaaaaagtcctctaaatgataaaacataggggatatttatactaggaacaatcctcctagataggaatgaaaggtcttgggagtttacaggagtccaggacataggctagctcaaaggtcacttatacaataagtgaattcccgagaggactcacgcgtctgtttggcttctgagcagttctcaatgatttgtccataactccttattgggaagttgaaattatgagccgtttgttagaggtgaaactagacttaattatctttccaaccatatatattaagcacggagaaagttgactggttgggtcgcacgagccttggaagttgagcctttgcagcgtaaagccgtaaaccatcttcttgttggcgtacatagctactggttgagcatgggcggattcctcctcgacgtaacccttgttgtcctcaacgtaacctatccttcttggcgtagtgataatgttctcgggcgtaaaccttagcaatacaaatgtagagcatttaggtagtataaaattctcactaaaatttggattaagttgagcaaagagcgagttcacctcttgttgtattttcctagcacggttgcgcgtaattggacatgatatgcttgatcgttcttgctgagacgtaatccatcacttggtttatgtcatcttcattttcttcatgtgatgtatgacgtaaaccatcacccttgtttacgtcaagtatagctgggatgtgctcatcatcatgtgacggaggctggggcatatcacattgcatcataattattattgttgaatgctacattctgcaaaactaaaagcaagttaatgtgctcatgtatgcacaactacaaacaattgccagcatgcatatgtttcattatggtactacacattatatcattttttgcatgtgtgttgttttgtactaggttcgcacgagctatgcaagttattgtacttgaatgagcactttacaagttgttgtacctatttgcacccacatcacaagttcatgtatcgggagagcgatttactcttttttattttagggaatatgttgaactatatttaatatctaatgatattgtttctgataaacttacattgaacggtaacggatacggtttagtacttgttcttatacgttgtttattttcgtgtattgttaactcaaaatcggctctttccttttgttttcttttgaagtctcgatttttcatccaagtgtttcattatagtataaggttttaattgttatttgtacactttggttatgagtgatttaaggatgagatatcttcttggactctaaattcaaattgagctacacggaagatacattttatgaaggatgtatatcaatatgaaagagcattggaataacgattacctatactcggtttgaattagttgtgcggctgtagctattggcggctcagaaaataggcactggcgcatgtttaatcgtgtattaagtactatagaattttgtggaaaaccatatttgatgaaagtcatgcatatggcttggaggagaactcccgtatctttagagatccacccctacaatatgggaagtattatgtcttctaaaagaacgttggactaaaaattatccctattgcacaatcgtgcatcccacccttagacctccgtctccatcaccaacgctgctccacctctacctctagcctaccacactgtagcctggtgtccgccacctccacctttagcccgacacacagtgcaccacctttgcctccttgcatcctcacacacaccaaaccgcgccgcccacaaatatgtttcatgttgccaagaagtgaagaggaaggactaaaggtgggttgttcgtcaagcctagaacttctatttggttatttgctagttgctattgcttgatgcactgtcatagtttgtgacttgtcatgtgaagttgagaactaagttggaacttggaattgttatgttgcaagtgcatggtgcttctgatttattgttgctacttgaactaagacaaaacctacgtttgtgttccctcattcatcatttgtcttcctaacggtatgaatgtaccctttttttcaccccatcagtgagagagaagagaaacaactttttttttgaagaaaacgatggtaggagttctaccaaaatttatagaagaagagaattgaccctgtttataaggaaaaccgggcccgaaaaccatacaactgcacagttttgctatagggaaaccgacaaaacctcacacagaagacaaagtgaaaagcctgtggcaaaacaactatgaaccatagaagtgaccgaggaaggagcaagacctttaaggcgaagcctccaaggagggaaccaacgacagaagccgctgctaacgcccgtccaaaaaaggactaggttttcacccaaaggaaaagagagtcaaacaagacgacacctccaaggaggatacggcacccgtaggtgtcgatgtcaccgaacctggaaaaccaggtagggctttcgcccgagactcccaagaaaggtgcaggacctccaacagctagagcgagagtgctaagtgttatcgttgcccagctcaacagctaaacccgatacagcagctccaactccgcctaagcactaaagctctagcacaacagagggccaagaagccctctccatactcgtcactacgaccggttcactaagacacagggcacttgaagcacaagcgaggccaaagagcccgaacaacaaacaagctggaccaacttcatggacgaacacaactcctcaaccacctaaagactccacgaccatggtctggaagcagaccggccaacagaagggaggagcatcaaggaaggtgaggaggtttgcctcgccggaagaggaactgaaagatgaagccaggttaacagagacatcggagtcttccatgttccgacgagatcgaggcggaggcatctccacccagaatcgttgggcttcgcgggagcacctcttgcaactgcgacgatcgcttccaactttgccaccaacacagagaagagttggggcgagcagagcaacagaccatctagacaacttgcagggaggtggcaacagaggtgggggtgtggaggagggggcggatgccactgagaaggcaccggagttgccgacgcgccccaccgacgacagccccaccggaccgccgagagggggacgcgcgccgccacgcatgcgccagccttctgcccgcacatgtcagccaccgccacccacacgcgccggcctcgccgccgacacgccccagccggagtagcagacgcctccgccgccggtcctacgccatgccaacacacctgagattgtcatgcactaacacaattgcccgaactctcgtagatgatggtaggggctgtaggatcgaaatacaagaaccaaacctaccagaaagggacgaatggtaggaacaccgaaaacataaacttttagcggaaataaaaatttaccctctaacctgatgaagtcctcggcgtagccggtctgactgcatgctcgcctccggtcaaaccgtcgggatccaaaaaacatgtattgacgaaactctagctagtgcgctagcttgccgcggcgagcgtccatggggatggggatggaggtgagtttgaggacgggaaacaccacagtggtggcttctgctactgctttgactgcatgctcagccaagaatgtcgcgaacccccgtgattgtgcccaacgtgcccttgtagttgtcgtcattacctcgccttgccatgctaccaatgtcgccgacgtcaagttcggcggaggcgaggtagggcacggagatggctaaggttgccggatccgatggtggagaggttgggaatgaaaatgtatgaggccaactgcggtggtgaggtcgctgatttgttccaaccagcctgatcatggttgctgctcgaagtgagaggagaggggagaggaaaagagaagaactgtcggtcacctcctcacacatttgatgctgcctaagtaagtagagatggggaggagccactggagcgagcgaagccaccggtagaaaaagaggagggaggagggagggagaaggaaaagtgggaaggagagggaggagactagggatcggacgtctgatccttggcaaaactccgaacgatgtttcactggatataaaaaagttgtttcagatgtttcactactcagtaaaatttgtttcaataaataaatgttttacatgtttcattgcttggtaaagattaaagaattgtttcaaccaaatataacatcagaaaaggctaattgcaacatcagaccctgtatgtgcaacatcaaagaagacataggccgataaaacagagtgaaacactctaagacaaccaaatgcaacaaaagaaataactccaccaatgtaggccaatggcgtcttgctccgccttatgtgcaacctcctcacagtggcgttgccactttcggcgagcttggagctctctctggcgacaacgcttaccactcaaccttgcacgaagcctccttgcggcgccacatccacaaagcctcctccttgtgtgcctccactgctgccggagagctcggagccctctctagcaacagtgccttctgctccactccatacaaagcctcctcatggggccgcagccgctaccaaggagctcgaggccctctccgacgccgctgctacccaagactcctagccgnnnnnnnnnnnnnnnnnnnnnnnnnnnnnnnnnnnnnnnnngttagtcaaacaaatcgtt

SEQ ID NO: 29673 - DNA, 37019 bp, Oryza sativa
  unsure (1)..(37019): unsure at all n locations
ccagaagttattcacccggccgtgggccacaaaagaaaagggcgtaaacagggtccctttgagncccaatcacaaaaaattctccacatgggcgcagggtttttccctcttatggcacctctaaaggggggagcacttgggagttggattttttgggacaacggtacccataacgttgaaaagcctccttgggcgacatatcaaaagcctcctctggtggcctccgtcgccgggaagttggagccttctaacaaagtgcttttgtctcactccaaacaaagcttctaaggggccacaagcgcacaaagaagctaaggcttctcggacgcgttggtaccaaaactcataccggcagctcctcctggtggctccacactgnagagttaggctccgncaagcgcggaactttcctaaagaggacgttttcacttccttgcacacntcttcctggaagcggtggcancaatgagtttgggcttccacgagattgattcctctaaacaagcgcgattcataaaatcagataaagggattagggtagaggaagatgaaatgggaagaaaggcatcggtgcacaagctccgcccggatggttgatatgaagcattttcgaaaggaaagaggagggaaggggaaggaaaagagggaaagaggccaaataccaaaagaatatatttttttaatgcactgaaggattaattagtggcttatattaaatagttataaaattataatatcatctttataaatcgatgaattgcaatggcatattttattttcaatgacaatatatttacatggtacttaattagggtaatattaatccgggactattgtatgtggtgccacatttttcaataataaaaaaaattcaaatcttatatcgtaaattccatatattaatactataatttgaaatcttagaacattaatatacatttttcatgctcatgaattaggaaagaaattaattatatattcgattaaaaaacatattagttgaatgaaagtataaaaaagaaagtataaaaaagttaggaaaggtatcccatatccctgcgtaatttgtgcctaagaagaaaagattgaggaaatcccccgtccgctcgccgtggactccgactcctcgcgagttcgccgccatcgccgatccccatccatcccgcgagtagagcagagcagcgccgcagtcgttcgtcgccctgctgctgctccccgccgctggtgaggatccatccgatccgtcacacgcgtcctttttttttccatgtattttttttctcgaatctgcttgcggattaaccctagcttctgttctagaaattatttgccttaaaatcttaatactaatagcactttgtttgctcccaaaaggattggggggttcaactgaaccctccatgttcccatgttagatccgcccctggattcagtacttatagcactgcatttctgattggatgtgtgtgtcttcatgaagggcttgaggaaatcccaggattgcgctcgctggcgtcgcgtggcagctccaacaagttgaactgtattgcaggtttcaggtaacttgttcatcttttttaacattatattaagatatgaatgatgtcccttgtgcaaacatactcattgatgcatcttatttttctcaactctatgtttggtttaacattgtttatttgggatcccaaattgtttagatagttcagctgaatgacatgtgtattaccaaccatcaacagattggaaagctatgctatcatatatagcaaataactcatcggcaactaggaaacatgttaaaagttaaaacattgggaatttatgcatgtatgctgggagccactaagcataggtcttggacttaagaaggaataagatacattaagatatcttgtctctctcgtataagttcatcatttatgcttagttacttttaaccctctgaccgcagcacactcactgttttttttttgtgccgtcagcacactcactgttgattggatgtgtgaaatcaacttaatagctgttgattcaatatatgcaaagtaatggtcttaattgaaatctgaacccatgcattttattagaaatttgaggctgcgttgattgaaggtgaaaagctgcttcttatgtataaaactgttgaagtttgttagcctctacatttgtctgcttgcatcgtatgggcattttcttatagcaaactgtatgcatcatataattatagtcccaatgctgaatgcagatgcggcaattgttagatatgtgcactcaatgctagttttaacttgctgttacttttcagtgatccttgaacaagcttattgaagatgccaaatgcagagagcagtttgttcaagatgccaactgcagatgcaaatattgctgccctgcacaaggaatgggacgatgcattgtgcccaatttgcatggatcatccccacaatgctgttcttctgctgtgcagttcccatgacaaaggatgcagatcctatatatgcgatacaagctatagacattcgaattgcctagacaggttcaagaaaatgaaagtagaccacaatgacggttcgtcacagcaaagttcatcgttgcctagggacataagtagccaaaatgtaccccagagatctcattttgatcccactggagaaatccaaacaggcatatctgaatcccatgaaattttcaatcatcgagatgctatccaaagctctgctggcctatctggacagcagggagaaaatagctataatcaagatctagatttgactttggaagctcagcaaagagagagcagtagcactgtggagtcaagtgaactgacacgcttgaaccaattggcatgcccattatgtaggggcactgtcaaaggctggaagatcatcaaagaggccagagaatatttggatgagaagtcgagatcttgctcgcgggaaacatgtgcattttctggcaactacagggagctccgtagacatgcccggagagtccatcccacaacaaggcctgctgatgtggatccatcaagacgccgtgcatggcaccgcctggagcaccagcgtgaatatggtgacatactaagtgcaatcaggtcggctatgcccggagcagttgtgtttggtgattatgttgttgaagggggtgacatgttttcacctgaccaggaaggaggcatgccaaatgaaccaagtggatctttgttgacaacattctttctgttccatatgatcagtagtagtccgatgagatcaggagatgagataagaggctcatcgaggggcctgagaaggcagaggcgccgttatttatggggagagaacttactaggtctccaatatgaagacgaggacgaggacgatgaggaggaaaacctagatgaagatgttcaaagaccaaggagtcgccggagatttgtaagatcaaggtcggaggagcgatcctaatgcaccacctgggtaataaaccttcgttgctcgttgtgaaattcgatcaccatgaatcgttgatgattccttgcatgatcctaaaaaaatgtcagtggactagtggagttgcaggtggtctgctgctttgaatggcaacatattgtgttcatccctgcagtagaagacccgaggcaaatgggttaattggattatctaggtgcattccatccgtgttgtgttcacaaagccttctgtaatatgatgtaaagaatagctgaaattggcatgcttagggcttgacacttgctcaaccaaaaatgctcttaagctctgttggtgttgtggagatgcatcataagcagggctgcctcgtgagcagtttggccatttgttgtatagagtatctgcaaatacattgaaccgaatttgttcgtgttgctgctgttctactttgaaatctttgttcaatgggaattttagaatcaaatttcgtccaaatggttgtgcgcgtttgacaaaccgactgaaatgctcctcatcaaatgcacatgtggtgtatttacttcatttgattgagcaagaatgaatcaactcactgataagagcatccctatcttttactgttgtgaagctgatataccctgacgctgcaacctttagaagaatagtttccatatttatacaacactaatccttctcttctttgtattatatttgcttataaaatacaaggtctttttagaagaaagagcacgagtcgtcagatgtgtgaggatctatgacagacttctatacacacacgatgagttattttttgcaaaatagcctatcacgcgttaaatttttcgaggaaaaaacaagaaaaacagtgcacgaatgggtgttatcaccggaggattgttgccaatgtttgctgatgattatctgattatcaatttagatattctgccttaactgtagcgctaccaagcattgaacacgcagtgacaaacaaccagctgattaatcgttattggcaacaaaagaaaggaagaaaccatcaaccacttacaagtaatcaagtagtacaacttaataatacagataaactagtccatgtaagtttgcaaccagttaaatactttagggaacatatgcactatacaaacacccaattaatcttgcctttccttgctggaccaaaaatggttttgcaagtgccaagactacaacttcttcactgaccaatcaagcttcttatttcaattgcacggcataacgatctggattaatataaaattgtattctccatgcttgcctctaaattttcctacaaatgaaaataaacatcatcagaaatatgtcaatataatgatgcacagctctccaaaaaaaaggtcaatataataacagcagctacacactatcggtgttcatgtttgcattactgagccaagccctgcaccttgtgtcataactggggattccccagaaaaatagaaaaaaaaatcaagcatgccattttttagtctgctttctatatttttaattattttcaagagtggttattgaaactcggtgataaccgtgaacttgtgccgtaaccgagtgccagacttatcctcttaggtttttgccttctttttgtatcatctgtaatttgtttggttttctgaatactgagctatcacaaactcatgtattccgatgactgcgtagaaaacagctcgaatttggacatatagaccaaaacagacacactcgggaaccaggaaaatttccatcagaagcagctacacaataagattgactgtcctctttacatgccgcgattattaaaagatattacttaggctcagtttatggttgctatgctatgccatgctaattgtgcttggtttttaagttgctgtagagatgtacatttatagtcattgtagtcgtcttacaaatcaatgtaaagttagagaaaatatgttaagcaactgtcatgtctcccacaattgcttctgctacttaaattaaaagaaaaaacagtctaccaaatgccaaaactactagaagcagtcacactaaataaaattatcataatccacctcaatgtcaaacggaaccttagttgatatcacacagctttaaataaaaatgcacataccattgatttgaagtcatcagagtgtctagctcctgttccaaaaaacaatagtctagcttcatgtgtcgactctgcatttattccctttttggcacatcgtgcactttccttttcttcataaaaattaaaatcgtccagaagtgacgtttcctggtcataatccttgaaaattttcaacattttcagaccctggagtaggccaatctacataacgtgaaaaaggatatcagatcaaaaaggtttagaaactaagaaattacaaaattaagtcatatgaaaacatattaaagagagcacggataaatgatgtgagatatagcattcattatcagatagcaccgcctttgttcacaggaggaatctcagtacacctgctaccatggaatttattacagaataaacttatcttgaagtgatgtgctatgtaccaaaataggggaaaccatccattttctaaatgaaacaaccatacgtgatggaatttttcagcacgaaaaaacaaagaagtggatgcatggtacctcctgagtgtccctgctgaaagtaacaattctgttgtcattattttcaagagttatatgtttgaagagcctattcggaatgtcctttataatgtgccaggttacagggaaaaagccattccatctatctagtttccaaaagtccatggtcttcttgaaatcaacagggcctaatatctcagccaatcctacaaactggccactggaattaacctgaaatagggaacacaaagaagcaactatcttgaaattttgccaggggatgaagggatgcatgatataaaatagccatagtaccatccagcgcaaaaggtgtgtaattcaaactttcagcagcacaaagtatatgtggtggattaagtctctctcttctggagaaattcatcacaaaatttaatggcagatgtatctgcaatgtaatttcaagtaaaattgccttttaaggagatcacacgatacagatgaaataatcaacccgtcgaatatactaataaagatagcaaatatttagaaagacagaaaagtcaaaaacgtgctagtaaacagcagttcaatctcataatagaaacttgccgttatgtcaactattttgctcaaacatccattattggagatgggttttaagcgtaccagcacgtgctcttgtttcttgtatgaaatgtattttttttttccacgtgtaggttgtagagtgatagattacactatctatgtaactatgctgtcataattgtttcataaccatttggattacatgcaagaaaatgaggacacatgcccttaagggcttaaaatactaaaccatgaaaataaagggccatataacaagaatagaatttgatcactaaccgaaaagaataggaagacagggcactttttgcccttttccttaattaaaatctgagcttcacgaaaagctgcatccagcttattgttcccatgtggtgtacttgcccaaacattgtatttgatacctttatgaatatcatcttcactatatgactttatcataaagaacttggcttgttcatactcaactataaagtctggtctgttaaactgatccctacggaccaaaggacttctgatatcttcctgtatcttggatcttgttgcattttccaatttgtttgcacggggaccacgaacttgctccaatgtatcatcagaatgtttgcatacattatcgttcttaatagtcctatgatgatcagatcttgtgacagtatgtttgcctgtgcccatcttgaacctctgattagtagcaatactactgacaaaactgtctcttgagtaacgattgccatgagaagcacctcgcccgtagtttagctgtggatgtgcctcagcatcatggcaccattgacgatgatgcaaaggtatcctatcttggtagcactgatagtcagagttagacagcgatggaatctcatcaccgtaattttgtctacttgagcgtgcgttacaatggcgagaaagtgatggaatctcatcaccataactttgtctacttgagaacgagttacaatggcgagaagaaagcgatggaatctcatcaccataactttgtctactcgcgtagttacaattgcgagatagtgacggaatctcatcaccataactttgtctacttgaaagcgaggggattctagcaccatagttctgactagacagagaagggatctcatcaccatactgcatccctcttggcagtgaaggtccccaattgtcaaaactccattgacttgaagaggaagtagtctcatccatggaattggcctgtctaggtatgtcaactatctgttttgatgataaaactaaaattagtaaacacccatatacagtctttaatcgtttaatagacatgccaaatacagaaactgtatatatagacaaaatttattgtgtagtcaaagggatccacaaccatacctcactgtggtgttcaatagattgaccattgctggttcgaaaggcagtagattgattggatcttctggaccagcgttcttctgaatgataatctaaggtaaaatcagctttaccttctgctgcatacaaccttcttatgtcaggactagcagaaggatatgaagcaatgtgatctggccttcgctcaaaggttttgcttctgacgctcatgttcccaactacatctcctgacccgtctggagtacttgacactgattctacttcagaagaacttctccaagaacaggttgatgaagaaaagcaagactgctgcctacgatacccacttcccgatgacatttcttccttagaatctgtatttgacccatgggaaatagcatggttggattctgaaggcggctcttgacaatcctgagaaagggaagagttgtttgtatgttgttaaacaaaattgctatgtttggatctagggcatgctatccacagatttaatggttgaattaactcatacttgtcttagcacataattactgaacaacgattttgttcgctgtgctatcttagtcaagtacacatgatcctatttctgatggagtgatggtacaaccagaaatctaactacagatttatttataaaccaatcgcgccattagtacaacatctcttgggtcctattagtttctttacttaactgctccaaagtatttatagtttagaaagatatataacacttcaggtaatctggtcaccgatagcagattaattgaagagattgtgttgtataaaaagaggatgagtaatcaaagaacaaaccgatgccaggtttgatacatcctcatttgcgagagacataatttgggtaccatctttgcatttcatactgttacctgcagaatgagaaagaaattgtccacagagtagaagtagaacacaaattgactgtctgagctattcagaaattattactatcaaaaagttttggaaactaattacgatggcacatacatggctgatatgaagaagtcgaatcttccccaccaactgcatcatcattcctatcgttgtttcttgtgaagccggaagaatcaccttctgtgtgcgataacgctgacatgggcggatcggaaggttccttcatctgccaagtaaaaacatgttaataaacagcggcgaaagcaggaatttgtgcgcggttaaataaaaaaaccttaaaactgagcaatccaatccattattaaggttgtaaatatgggacaagtgacatgaagacaaaattcgtttgattttagatgttccccatgagcagacaaaccaaagttcactgggtagtagtattaattaagccgaataccctaatacgtttagtgtgattttgcaatgtaactactgcttctacagatgaaggggctcgattattcccagccaagaacctgctatggcgacagtgctatctcaaatcttggactgaacgatggatttgggcaaaatacgtgcacaagaattgaaccggggccatacctacctggagcctcaacggtgggttgctgaggagacgctccgagacggcggcgatgcggaggcggcgatgcggcggcggcgacggggagtcgcctggtgtgaggaggggtctgggctagttttcttctctttttttgggggggttttatttattgagtatttgtctttttttttacgcattacggattacattaaacggcatgttttctatactgtttaacggtataatctctttggcccagttgtaaacaggaaatagctgcagcaactttattgttaaaaaaaatctccccgacggttaaattgtttttttaaaaagaaactttatatatatatatatatatacacaaatttataatatttaatacgtagttaatgtactaatgatatttctacaaatagatatatgcttaaatgaactcagtcttagtggtactgcgtagagaacatttatctactattataaaaattgaagatatttttgtcggtggtttggtacgtcatctgtgtatgagtcgatttttaagttcgttagttttttggaaatacatatccatattatctctactattataaaaattgaaaaaaaatttgccggtattttggtacgtcattcgtatttgagtcggtttttaagtttgttcgcttttgaagatacagattcatgtatgagttaaattttaagttcgtttgtttttggaaataaaaaaaaagtcgtataagaaattaaaaaaatatccaagcgaattctcacagtaaatttcatcctagctaaacgtataacaataataagattaaaataaaattcacccattacaacgtacgggtattttttctagtttttttttaaaaaaacaactaatgaaatttataattttaattattttttatatgtgctcttaaagtaaccatcgtaacacagttttagccttttagggctgacaaatgttgatttatatttatttataccactcaacaaagagtttatatttgctcatcaactgcctttctttggttgtgtgagttttttttctgaatgcatgagtttggcttccactttaggaggagcctatgttaccgagatacggggatacaaatacgtagtatgatgatacaaacataagccattttttaaaaaataaggatacggtgatatgtttatatatatagacacacacatgtaaattaaaaatacatacagaaaattaattaacctctccaaagaaatagcaatacaatactagtattggtactgccaattccatatattaattttgttcagttcctctaactatctcttactataataatctcttataataaatcaagttggtgaagtaattaagcttgccgactgccaattattcaagaaaaaaaatactactactagactagtgaactgatccatcatggttacaatatcaattctaagtgtaggctacacaaatagagccagcaactagaagatttcaccaagtggaaacaagagtagaataacagatttcaccaaacacaagtgaaaatgtagttcatagtactacacaaatagcacatgtccagactctagaccagaccaagggtacagatctaacatggaaggcctaaagatgggatttactcacaagggaatgaagggaaaacagctcggtggtgatgggctgacgacgatagggttcaatctttctttttggatatttgtatcggggttgccgatagagttgccgatagaacgaaatttagttccgaaaattttgataaaattcagttaaatttgaacaaatattgccaaaattcatgaaatattaaaaaaaaatcaaccgaaataatattgtacctagggagggggtggttcccgataggaccaaaatttcgaaaatttcattccggaattttgaaccctgcctgatgatgttttttttttctgcttgccggcccgcagaggcactgctatggcggatgggagaccacctagacccaaaaccctgcctgcggcggagaaggtgcctggtccagtggaggtgaaagcattgcaccacgcctgctgacagatgtaacacatcctaaacgattatagtattaggatgtgttacatcccgtattggttggtttattttttatgggacgaaggaagtatcagataagtatttataatcgtttgatttatttgcaaatcaagaaaaaaatggatacgtacgggatatgtatcagagtgtatccttatatgtatatgtattcgtcggtgtatcagatactgatacgtgacatgtgtgtcatatcggggtaacgtagggtgtggagccccgatttaattaaacactactaaaattcttttggagaggttcaattattcaatattttataacttataaaatgcacaattacatccctaaacttgctaaatatatcatcgttggggcataggcgcatagcgcgcgcacactgacgtgacatacatatataatatggacaaacttctaatccaaatttgcagtactccctccgtccataatataagggattttggagggatgcctaagtgtcatatccctccaaaatctcttatattatggaacggagtattaggattctcattcaaccatttatattttaggatggagagagtggtgattaagtggagcccacctatcattttctatttttcttttgttttctctctctactatttccttcctccctcaagtaaatcgttgatggtgttctgcaatggttttggcaccttggcactgcaagtctgcgacagtatgactagggacatttaactttttatcgcttttaagatgtggcaattaattatttgtcattcgctgtctatgacatatgagccctcatgtgtttatgacatgtgggtccagtgataattcctatatcaccacttgtaagagtggcaaataattaattattcccacgagtggcaaataattaattattccctatgactaatgggtgttcgagttatatactagatccgctcgccttgtccatcaccaccgatgatgtgccatctctgacttcacaccatgaggaggaagagaaaggatgagtgagagttgagaagaaaaataaaatgaaaaaagagaaataaaaagaaatagaaaaaagtgggtaggaaagatacattgtttatggatgtaaatatacatttgacaagtttatggaaccattacccagtataaaacctcttacaagtttaataaccaatttggtttcgagaaacatagtacaaacgcaggtgctcacaacgcgcgtacccttgtctctatgaacgtccttgtattttgctcatgatttaattagttgagagttatagaaaatcaaagatttgtacaacatctacaagaaaaaaatatatttagacatagtctgacaaaaaacaaatcttattatacaattactatgcggagtagtaccatttcagaaaaaaaaagaaaaaaagaaaaggaagaaatgctagcacaaatctcgatgcacgacgaacgatgtaagatgcgtagcctttcctcctccctgtctttcatttcaaagtagacaaggcgaggaaaaaaaaattcctccttttccccgtcttcccatcgctcgccggcgaccgccatgaactccggcgagcctcctgcctcgtcctccctcggcaatgccggagaggaggaggaggaggacgacttctactgggacgccgaggcggaggccgagctgcaggccatcgaggccgcttacgccgccgccaagcgccgccgcctccccgactggccaagccccaacccggtcaccgcatccgcatccgcatccgcatccgggggttgttcccccgcgccgccatgggctccctctcctcccgctttccgaggtgctcttcttggctttcccccctttctttgacatgatatgacgtttaatttaaagaatccctttttattcctggagctggatcgatttcatgtctctcgcatcagttcttttagggtcatagggattaatgtttcttggtagtacaacatatgcatcgttggggggtaaatttctcaattttgctgaaatgaaatgccagctccgtgtaacatttccttctcctgaggaaatagtcagaaatattgaagaatttgttttctaggttcttttgacaggaatcagggatttactggcattgccgtggttaatttctgaggtcaatgtagtttatgtatatcatccttcattttgattgaaatgggtattctgcaggtaatgtgaaggcaaggtaccaaccagtaatgttcaatggcagcatagtgtactgcaggaccccttcaaaagtgaagaaagccacaagggacattttatgcaaaattgaaaccatgaaggcctctggccaggtttctcttggattcgatctcgagtggaggccctttccgagaagaggtttgctgtttttcctaaatcctaaccaaatctttaattgcattttcagcatgttcagattgagcaaatgtgggtttctggaatcaagtcttcttttttgaaaaaaaagaaagcctcaaactcttgcaagtaatgatattgacggaacataactgatggggtatggattttgcaggagatccaccatgtaaagttgctgtaatgcagttatgcatggagagaactcgttgttatgtcatgcacatcattcactccggagtgccacctgtactaaagtctcttttggaggatagttcgtccgttaaagtaaacacagcttccctctttccctgcagataaatccccatttttcccacgcacgggttaacatgttttcatcatgcaaaccattgtttccatgtcagtgcaggttggaatatgtatagataatgacgcaaggaaaatgttcaatgactatgatgtccatgtacagccattgatggatctgtcaaatcttgctaatgccaagttaggtttccctcctaaaagatggagtcttgcttcattaactgaaatggtcacatgtagagaggtaatatttatggtatcaagcattgttctctttgcccagttctggtagcattgaataaaaatgtgttctttctgttcagttatttatgtttgtggtctatgcattacagcaagttcggttgcacaactagttaaatgatacaagttcacctaatatttggtaggatctcttaaatgtatttcaaatacaagcatttttcttttgaaggttcttgataagttgatatacctttgattagtttatatctattagtggctcaccactagtccaatacatgttctccatccctgccctcacacagcaagacgttaaataaaacaatgcaaagcccggtgttagtgatgcggtaatcagttacatagaaacacaaccatgtcggctatcaaacttgttttgacacattatcatatcatacagaaataaaaaaagagttttggcaactggcacctgcagaaaggcgtagctattgtgtgtatgtatttgagtgtattattgtatcatgcacaaataaaaatggatggtatggttgtatgcctgtggtcttctaaaacattttcacacccaaacctagggctccttaaaatgaatgggtaaacctagtgttttgtgttaaaagcgcctgaaaaatttgggttttctaaaatttaaattttgatgctttaatcgctgcatcttctcgtctatagttgccgaagccaagcaacataagaatgggaaactgggaggcatatgttctctcaaagcaacaacttcagtatgctgctacagatgcctacatatcttggcacttgtatgaggtatatgagtgtactacttacttataaattatttttttctatccctacagtcttgacagccaattctactcttgattaggtactgcagagtctcccagacaataatgttgaggttgaaaaggagacaattacagcagcatagatgcaaatgcataaactgaaaagtgggttgttaatctatttgattgctccctaatgttctgcatcttcacttctcaaccaggttggcatcatgaattcacaaatattttactttacttggagaattctgaatttctagtgatggcttatttttcacgcctgcaattattccttaaatgtcttttcctacttattttatcaaaaggcttgttcattgttatatgatggagattttacataccttttatatatatatatatatatatatatatatatatatatatatatatatatatatatatatatatatatatatatatagacggtggatggccatggagcccgggcaccatggtgcccctaacaaatttactatatatatatatatatatatatatatatatatatatatataatgcattagtcctactgtttcgctgaaaaaaggattttacatgacataccttccaatgatctatgtggtatttagttatatcatctgaattttaaaatcttgagggaatcagaactgctgtttccccttggtttcatagagaagcaaagaaactgctggttctaatttggaccgcagaaaatttccaacatagaagtaatgattttagtgacaactgacgagctatatcaaatgttcagaacagaaacttatagtcattccgtttcttttccttttacattatagaataggccctgttcttttctccaactaaagttggattaaatcttggatactcgtggcacgcttttcgaactacttaacggtgcgtttcgtgtgaaaactttctatatgaaagttgctctaaaatatcatattaatctattttcaagtttggaataattaaaacttaattaatcacacgttattacaacctcgttttgcgtgaaacacttaatcttcatcttcatcttcagaacattcaaacaccaccctagtttctcattgcttttggaactgagtttatgcttgccatgccagagttcgctagttgtgtagcagacaaaatctcatgaatgtcgtaaaaaaggtcaaaattttggaatagcaccttattttcggaagtctcttattccttttttttttaaaaaaaacatcgttttattgttagttgggtctatagtaagttcatcccagtgcacaagtaagtctcatatcatgaggtactatatgttggcaatcctttgttatggtatgtagaactgagatggacattaatgtgtaaattgtacggatttactccatgcaggcatgaactataagttgattcatccttgttagttactacctgcatattcatttgatctcagattcccagttgatgaatgcagtatgcattttattctgtaattatctgaagaagtacaaatgtataacaacagttgagatgccatttccaactttactagggaggtcagacgaaaataggctggtgaaattgttataaccttgtctagaaatgtgaatattgtatcgctatgtatgcagggttgagtagggatatcttcatcagaagtcagaaccaaagcagtatggaaccttcttgaacatgcgtcaaaaggcagtgcgtaggaacatacctaccattgttgtaaattgtgctaagatgcgattgctgaacttttcagctgctgttatctggaaaaattaactgtgtactttttagaccgaattggaattacgttttattttattttttgtgaggaagaatttgatttattttgtcaccttggatgaaaattaagatttttgtgacacactttttaaactgctaaacggtgcgtttcgtaccaaaccctaaaccctaaaccctttcataccaaaactttctatacgaaggttgctctaaaatatcatattaatttatttttcaagtttgtaataattaaaacttaattaatcatacgttaatatcagcttgttttgcgtaaaaaacttaatcttcgtcttcaggagaaaagatcgccttaccttagtgtgtcaagtattgcctttctggctggcattgttttctattatctctgtccaaaatataacttgtattagattagacacatcctagtactgtttgttcagatttgtaataatagggtgtgattaattcggttatattttaagatggaggaagtagtgtttattgatcagcccattgggctatattcttctttaatccaggaatacgttggtcttctgacccacttgtaatttgtcctgggcttcaagccattgtaagcccactagttctctcatctgtttgcctgtctggggttgtcatgtaagatgggttagccaaatggcccagacgaagaggtgaaatggtgaattgacatattgtgaactaatgccttctttggaatgggtgaattttgcggggttttgaataaaataaactaacgccttgtttagttccaaagtttttcttcaaactcttaatttttctatcacatcaaaacttttctacacacaaacttctaatttttccgtcatatcgttctaatttcaaccaaacttttaaatttttgtgtgaactaaacacagcctaaaccctgtgaaaaccctgcaattttttgcgttccatataaggtgcccaaactgatgctccaagattgagcatgacaataaggaaaggaagggcttattcactttattgtcaaagtaaatcttaccatttgttagtaaagctaaagattgacaatgcccaattttagcaaggttaaagatgtgaaggtgctatttggtttgataccttatcaagttttgatgtagttttgtgagtggaaggttctaaaattataaatttttggtagaattggtaaaggctgcaatggttatcttgtttaattagaccctactaaaatttgacaactgataaggttgcaatgataaaatcttattaatttgttaccctactagaatttgggcatttggcaatgccaaaatatgatggtttattttggcaatgaagtgataacccggaaatgcacttctatattgctaataatgagaaaaatactcatcattttacagtaacagtgagattaggcacctaaactccccttaatcaaactctgagatggcccattcaaccatgcaagaacagtaattttgacggcacatacatatcaccggcatatactaaactaaactcttagatctctttgaaccgtcctaaacgattaaaccgtcaacatctgagctcattgttcttggggctacgtgacacgtatcgattcttattcttaatatatcattagaagcatgccgttgcaaattaatattagttacaattagaacttgacccaaatcaaacatttgagagaataacagatatgcttaatttggtctcatgctactgacagtgttcatgggtcggctgcgcatgcatcattttcttgcatagttttagtgaacaaattaaaacagacacactttggtcggaattttaccagtcaaagatgcacccatatggatactgctagatatccttggattaatttctgatctagtttcaaacacaaatcagtgtgctaagaaagcatcagaaaagaaaaataccatcagagaatcacttgggttaaagattctcctagccgtctaagccacatggaaatgcagtagtaacaataataaaatcacaaaatggaatctttctctccatctcaaccgtccacttgttgccggcgcacgtgtcaggcatccatgcatccatctgggtcacctgcattagtactgaactactaatcatgatcagttcttcacatggatttctgttggtcaaagcaagccacaaacatctcccccatgaaaaaaaatgagagatagaaaaaagaaaaaaaaacaaagagaagccaacatggcattgtgatcttctgctcaagatttggacagaggaatcatttttcttttgaacatgctgtgcccatgccttgtaaaaagagcaggagagaaaaaaaaaagatatgttttgtgtgttgttgcaatcgggacagggagaattcttagtattggagcactacctctgccgcactagttgtttcttgcacacttagagtactagtactccatccctctctgaaaaatgtattgacaatttcagtactagtggagccaacaacagtgacaattaatttgaaacttgcaaaaataactaacttttaaaaaaatggtgcatggtatatctaactgagattgacatcagtattttaccaaaattttcagacaatagaagtattgtctttacttgctggacttgtttttatgcttttggattgctcaccaagttttgcaactttcttcattaagaggtttacacagctatgtttttgaaccattttggccgtctttatgctatatttgtttcagatgcttcaaaaatttttgaagaccaatgacatataggatgacatttatttgtttaatttatctagctttttggtgaaaactttcatatatattcaaaccacatgcaagaaaaaacataaccttttctagatactaaaatatatgttcagaacaccaaaagttaaaatgaactaacttattttgttgtgagtaaatttgatgcaacaagttcttgcaacaaagaaagattttgagtggtgtttctaacaaacaaaattaattactgcagagtttctagaggcagaatctattgtatagtgtatattaggttcagtatgtggtctgaatcatagtataagttagtggtgttaactggtttggtctggctagtcattcttactgccaacaaatcttgtcagccagctagctagtactcagattgggatttatgatcctgactctgttaagaaagcttgagacaaatgcttctgtgaaatgactcccaatcatgatttgcctctatggctctgtctttttgagaccatgcatgcattcttgtcatggtatattcttccactactactggaggacacaaatcttgcttgtgaggtctgttcagcatgattatgtacattagagggcaatgtgactttgctccaacatctcacagtgatcactcatatatgtggtacctgataggttcttggctttgagcacacaaactatatatgctgtcatctctatctgtatgctaaggtctccatggtacaatgatattgcatgccccacttcttccatatatgctatggtcatagcctgtcatttatttgagtgtgtgatgtttagtgtgtcatcatcaatcccatccatagcatccattttgttcttgataagttcatcaatcttggtgtaagcatatatcccaatccaacgtgtcgttttctcgtgcatctaactaaattatgattagctgatacaaagattaatttgagatgatattaaataagatatatctctgaagaaatgcaaatcaggtatagtggagaaggcaccactgctggttccctctttcaagcccaccagattggaaatcaatgcttgggattaacttctgaagaaatcaccattttgctgcacctagtaaagtgacatttttctaggtccttaaagagaaattacctctcaatttacattacattagaaagatattgggaggtaccagaaattaatctaaaaagtgtggtaccacctcaagaccagagtaaaaatatagtaaaataatttactttgccgcttaatctcagcacatgaaaactgtaactagttgtggcatgtacatctgctattccattctacgaaataaaaagcctgttgggggcaggccttctaattctctaaaaaggattagttgaaattccctaattgtttccacaagaaaacatactttccttttgagagccagtaaaaacatagccacaaaaaatggttgtgaacaataagaagcaaaatgtttttaatgcacttgctatagttaaacgatcctcctataattcttcgaccccaaggatcgcgataatgtactgaagttctttgtaacgttataaagtttccttaactctttctgtagcttcataatgttcactccaagcgatttgaggttatagcatagttgtggttgaatctaaaggatctaggataatcaaatatccttggaagcaaatcctatggtaagcatggcagtagaatccaaatctgcaaatgttgtggcaggaatagggtcgatcaaatcgttcataggtacataaactgcttgatttgcttttgactctgaataacggtgaaatgatctttacattagtagtatagaacgcatgacgaaaaaaaagaacagataaagttcatagagcttgcacaagcactgaaagattctcatttttacagagatgtaatatgcatacaaatacctactatttttccttctcagatgcaaatactttctagctacgcttttatttgcactaccaggtttttaacgtaaactgtacgtgtatgcatgtgttaaatcttccatgaaccaggtcgaatttgatgtttgaacaaaatcttttgttggatttatgtcacgcctagaaccgttaatttatttgccctaggtttagagacttcgaacatgaatgcgatgcaaattgagctcattttttctgcacagagatctagtatagatctatgttctttgccattaagttatctcatatttgtttgtcaagctcacattgagttaatttgtatcttgcagagattttgtacatttccccattagggaaagagggaatgaacccaagcacatgagaatcctaccaagtgcattgaccaacttagaaaacactctactaaaatcaaagaccacaggttcattacgaataccagatgatttgggcttatccacaataaaaaaacacaaattaattagctactatacttaatgtgactatataatatgaatggctatgcttatcctgcatgtgatgcacctaggagtagttgttatttgctagaacaagatgaaaaatatatgcatttttgtttccatatccagacttgcaatctctcaaaacggcgcagtgtctttcacttaattgtcacacaccagagagtacatatcgatttgtgaatccaaacaaattaataaaatgtaagaaaagaagtacatgcaattgtttcaaagctcatggggtcatgaggctaccacatgacaaacctccatatataatctgactgagattctcaggcactcaggccttcatatggcctgaaaataaactaagtataattagtctagtgtcagcgccgaactaagctaattttgtgtcaggcttagtggttaaaataatccaagaaccgcagaacaatagtggttaactcataattaaggggaaaattgcctgtaaaataatgagggcatatttaatagctatcacatggtagttaaaccgttacaaccgaccaaaaaaacagttggtatgaggtcaagctccttggggaaagagacaattttccagcagtcaagctaagctaggctagtagtctcatctcacatccatcaaatgaactacttaattaaggacttaattatatgattaaaatggaagagaagagaaaacaagcagccgctcgtttgggattgatggatagatatataggcaacttacaagcatgatcagtacaccatggatatgaaaggcctggtcactagtatatttgggggaggctctacttacatgtttgagattggggtttgtgacctgcgtgaatgtgctccaaataaaatgattcttgggaatccgtgacgccatgtgatcgatatagatgttggtgttaagttgtgctcaaacggctaacgactcaaatttttatcctcattttgattaagggagtaccctttggtacttaattttatattagaatttagaaaaatagaaatgtaattgtattgtgtgagtgaagctgtaacatcaaatcagttgaatttatatgactaagaaaaaccctttgtctttggcaaacttgttcctatatttttttttattacatggaagatgccagcacacacactttgctcctctacgtgtacttcatactaacacatctataagagtgcattctctaacacatacttaaagagacataaaccaacaataatccctacataaaccaagattaatccctacattttgaaactttttcatttttaattttaaaaataaaccctttttaaatatgaaacttttggtcatgctagttagatcagcatgaccaaattaaacaacgttatcactccaaaccctcatggcgtggcagtgttgtttctttggcatggctaaatggtttatatttgaaaataagtttttaggaaggctcatttttaaaattaaaattaaaatgttaaaaataataaaaagtcaatgggtggagtcataccttaaatgcttcccctctcgtggatattgttgttcccggctatttgcattttcccaatcatctttagtagtaaaagatactaggaaattttaatgaactaaactaaatctcttgtgaaaatcttgaattcaaaggagccctaaaatatccatcaatcttgcccctttgttgcaacctcgtaacgtatgcccacatatcctaacctaaatggaaaaattgtgcacatacatgtccccctccataagcctttgtactcatggttccatatttttggaaacaaaagaaactcagcggtcactgatagaccaagcttcatgaatttcataccccaagcaaatgagtatattttacaaaacctaaggttttggggcatatgtaacacaaaagccttaggttttgcaatttgtttcatgaaatcccaaattttgttgtaaaatgtttcacaaaaccccaattacaagcttatatcattaatttgactaatatatttatctaaaataattgttaatatattttttactacaaataaatgttatttgcttttcagcaaccgttgatcattgtgattgatcatttatgtgcatatttaaccaattattatgccattatcagttacgattatgttaatttttgtgaagtgcaaaattcagaaaaagaaatgaattagatgagagatatgtgtattttgagtaaaagattgatatttaaacaattatggttaaatttgaagattttatacattaagaaaaatgtcgccaaaagagtgtccaacccaagggctgaaattttgaccagaaatattgaagcttgaagcgaggtcaatgaataatgtgtcgttcttcaaattttaaatattttttcatttaaactataaattttcaatttaaaaattaaaaattgaaaattttcaagttggaatgttaagttttgaaatttattatccatattattaaaactagaataatgaagggttaattagatctatgccattgcaaatatgttgatttacaaaaataccattactattcactatatcggctatgtgccgttggaatttgagaaaattggagctatgccactctatcacgatgtctgtcaaaatttccgttagccccaactgcatgtgagacctagccgtcagttccttcttcttcaccttcctttcctctcttctctttcctctacctctctccactctctccccgacgctcatcatcctccaccaccgggagagctcagggtttgccgccatcgtcgaccttctccttagcgggagggctcgggagccaccgctgtcgccgtcgtcaacctcctcggcgggaaggctcaggagccactgtcgtcactgctttcgtcttccactccatccgcggcgggagggctcgggagccaccgccgtcttcgaccccattcgcggtgggagggctcggccaccactgccgtccttgaccccatctgcggcagcggtgacttcgagtttgcggaagctgcatggaagccgacagtggcgccctgtctggcatagcggggccatcagtggggcggttggggcaacggcggcgcgcggttggcgtggtggcgaggtccgatggatgtaggtgttgccactactaatactagtggtggtggttggcatcggtgtcggggacggagaagctacggtggttgacggatataacaaggcgatgacagaaacgtgacgacaatgatattgtttcaattttataaaatttcagtgacacgtagtagataccacgaattgtagtgatatttttctgaatcggtatatttgttgtgatatgccccctaccccaaataataaatattgcatttggcgtgctgtatgaaatgagatcaattttacaaatatttcctcagccaaatatgattttgcagtgtacgttgaacatatatttttggggggaaaatagacgagttctaatctaatgactaccattttgtcaactgcagaaaacagagagatatagactaattagaaactaggtgaatctaactacgtacaggatatatatcagaaattgatgatattagccgaacaacatacccttgaaattagtcaagaataataataattgcctcctagaatctgaactaccgaaaaaacattccaatgatcagacactagagcactactagctcctttgctaccaactaaaaatctcataaaggtgaatgtttgtagtatataaatctttaagttaggatccgatgggacttgaatagatcatatgtatacgagctagctataatatatgcatggcgtatgacccaattgtgacctatttcaaaccaagttgttggatgcatgatagccattggatatcttggttatgatcactacaaagttctctgccatgttctcatatgcatgatatgcaattagctgtgttgactcaattatttgtacatgctaattattggccgtatatacgttagaagatcacatggcggcgtcaaatgctcaatgcaagagctatcatatatatatgtttgagtgtttagccaactgagtagttgaattggttcttttgtttttggagaaaaaataaattgagggaaaggactagttgattctggaagagatagaagcttagctatactcttgtccatgcatgactcagatgataagcatatggctgcaagtgatggcttcatgcatagatgtacacatggatttggaattaaatactgacactttcccattaccaatgctttccaggcaaaaaaaaactaatcttctagtgaaacttgttaattaagactcgcccactgaaataagggaacccgccatatagggcaattcccaagtgatacttattcatgaacaggaaagcaccattaatagtaactctaccatcagaattcaaattctagtttgcataaacattgttgtggtgtgtatttctagttggtgtagaggctggaagtaataatttcatgatgtaaaaaattgacttcgatatcaatggtttgcccaatacctaattaaatcatgaaattaggtatttaacaccctattttctaatttatacccataaataatgatggttattacaatgtggcataataacatctatattgtttagcatgcttgatgacaagttggttatattagggagatggtatggataaggtctctcatttttcccaaggtcaaagcatggagagactgccttaagcatcacagaaagccatctcactatcagcaggttccttctatgtgattagtcatctccttgcattttgagtagctttatggagaagcatatgtatgccagtctgtggtgatgtggacatacatgcttcatgttgttcttgctgatccacaactccgttctatgtccatgtaatcgcggataaactaatctgtttcacaccaggcataatacaatatcgttctctctttgatttctctctcgaaacacatcacatacacagacactcaaagtatcacttgcacacaaacttacgatgcacactctatacacaccaactaacaattttcacaaaaaaattctaaaaaagatgtatatacactttaaatagtattacatatatatgtaaaatcttagtttcaaattcattatatttcagatataaaaaaagaaaaagtttgacaattttaagagtatatataggggtgaaaatgggacaggtatttcccgattgcccgcttgacctaaggctcgcaggaggaatatgggagaaaaaaaaagatacctgttattattcgagttcgaatccgaattcgttggaaaaatatgggttaggatacgagaagacatgtatccgttcgtatgtcccctattataaaatatgtataaaaatttattatgaatccacctaaaacatgataaaagattggttaatcactattttacgtgctcataggtaatattgcactcttttttcttgatgtatctttttaaatactttaattaccttatatatatatatatatatatatgtgtgtgtgtgtgtgtgtgtgtgtgtgtgtgtgtgtgtgtgttatccggcactacctatacccgactccgaatttaaaagaaaatatgggttaggatatgaaaatgtcataatccgtacccgtccgttttcacccctaagtatatagttgtcagaattttgtgtttttacagctcaaatataatgaatttgattatgagactttgcatatgggcgtagtactattgttagtaagtgtaatatttttatataatttttaataaaacttagttggtgtgcatggaatgtacaccgtaagcttttgtgcataggatgcattccctatatacaatgctagttttatggccatcataggagttgttcattacaactacaatatcattagcaaaagctattatgaattcttgaaaatatgtacacattttttcatcataaacgatccaatgcatcagagagatatttgaaacacaacaacgactttcttcccaatatggtgatggggacatccttgtacacatatagttagcattactctattttgtgaatgaccctactctaattatgtgtagagtatatatattcaataatcaaactttttctcccctatgccccacggaatattgagcaaggcttaaacaaatccctctacataaagtttctgggattagcttctcataaacaaacatagaatgcatatcacgaagtccctaaagaaatgatcatttgtagtgattgcatgcaaagcaccctccttttcgagcttggctatgaaaaggctccaaattagtgcgttgttaatgcaaaagggctctttcatcggtgattacacttttgagctaatcccatagccatgctagggcaagcacgtagcaagtgccatctatgccatgaaggaacatagaagctcatccatctctacttggacggtgacgagcatatatagtttgaaaaaaaaaaacagttgctatatatgcatatattaagagcagtatctttcatccttacatcacacatattctctttgcaaatcctatatgattattgtgaaatatatagatagttgagccaaactccatgacacgtggcttaggtttttctatgcattttaaaaactaaatgcatatttaatcctatgaacttcactttgcacttagctgtgcatagttcaccttaaattaatttgtgcaataatattttgcacttatgaataatcaaattagggaaaatgttacaaaattaatgatggtcaatatttctaatttacaatttaggcgctgttgttataaattaaggaatacaatagaagatattttttttcagaaaacttatttttgaagggtggagcaaataattcatttcaattatctaatgaacaagctaaagggaacagtgtatttcttatttattttgatgctatggaatttcatggtctccaaggtgaactttaattttttcatacattttataacattatattaatatatactaaaatattgcataatggtgcttaattaaaaattagtaacctagctacttctaatatagtttcatgtagccaatttagataattttaggctgagtttgattctgttgctaggaggagctacttactcatttatcgtgacacatttttttgcgaaaactttctatactcaattaatcgtacgctaatcactcatcttgttttgcgtgccgcaatcaacgtagcctatcctctgattcaaatggaaccttaatcatattaattgaaggctttaaattatgaaagtttggagtagggatattaggagatcagataaaaatgacaaatatggaggttcatggttcatctgatcgatatatagaaattaacaatatatagattggttgctaaggtactgtccaatcaaatatagtttctcgtgtgcatttccagtccaacaacaaaatgagacacattgttgatgctgatctactgtgaatttaatttcttcaataatttacaaaggattccggctggtttgtaccccaagtataacccaccttggaaccatacatggacctagttacctatcttggaatcaacacaaaatgatttttgtaatgatgttcccaagtatagaaactttcatgcatggagtgtaagaaatttctatccgtataggtcggcgattctggacaatcatgcgagtggccgcttcccaagataattaattaagagcgatagccttttagcgcgtgccctatactcgttaacgccactaaaaccctagctaagctaggggtttgatattagtttataattaaccctccagcacaaagctttaagggctagctcaaaaggctaggtgatcaagagagaacacaacttccgagggcggtaaccgaccacggtgatgagctagctacgttgtacattgtgcaccatggcagtacacaagctttcttcttgtttaagcagtggatttcctagggcatggcagaggcagatggaggaacaccagctatagcctattgtgagagctcacttttccatggctgggattaatttcttggagatcacaagctcattatttgtaagagtgcccaaactaattaatgttaatttttgcatcaacttggccaattgcgtcatgggtgaggtgtcttggaagggttataaaaatgtccatgccattggcaagctaagctcctacgtgttccttattctagggtttgccaaattaaagggtagccttgtgcatggggtcggtggctccctaaaagagataaaacaaattaactgtgaatgatatccttttggggttatcaaaaggagtgtggatttagggaaacaaggcctcttgcacatgctaccctcttatgcatgcacaatggcattcaattgttgcaaatgcattggctaatttgttgtatccatgcaaatggattcatatgcatggcccatgcatgcatatacacttgatgtaattaatctatttatatgtacatctacccccttctcctttccctaaaagtacaagctacatatgattaacaaatgcaattaatcaaccaaatagaggctaagagatgttaacctcgattcagtcaatcgatcacttgtgtatttaggccgaaaggcgtacgttgcatttggttatatataagctcatgatcatgtatggggacctatctatctctctctctttctcaatggaaattaagcatatatggtcatgcaagttcatgcatgaatgtaccacacataattaacctagagtgacaggtgtcgaaagatcttcggcacaccaacctaatgattgcactgatgattttgtattcatatatttgagaaaattgcgcctcaagtcttcaatttaatctttgacaaataaccatatatttaattgtcatgtgagaagccaaaaatcatgctatatatataaacaaaatggccctttcattaagctgagatgtcaacaacaagggcaagtgttgtatatgtcgatgtatatatagtatatgcatgcatataaacttgtgcaatcaattaattttttttaagttgaagataaatatattctcagggttcaagtatcaacacatcgatcaagcaagtttttgcgttgttcttggacgcgtttttagttttttttttgttgagaagtttattaattgtacacatatatatagttttgccccctaattaagctagatgtcatgcactacttactatctactctacgcggaagaatctctgaaagaaagctgtgtttatttcctctttgatatgtgtaggataatcaagaagaatattaggtgcaaaagaggcctgtgaactgcactgttgtcatccaggatgaaaacaaaacagaaaagatccaatacataatgttatatatgttaggtatataaggtatgggtgcactagcactactcctgaaacaaacaaattgagcactagataattaattaaactaattggaaacttagtttttaactaatatttgaagaaagtcaagctagcccagttgcttaattagaatttgcagataatgagatgacatggcaggggtatgggaggagatgcaagtgactgagttggtatcacctttttagggctagctagctagatgtggccaattcagcaggaagctgcttggagctcttcaaaatttggacgcttgaaagctcctttttgtgtaaaaaaatatgtctgcgtcataccttttctttgtcttgcttatttaattttcttcttgataaatataggtcggcagatgtaatatttttgcaccaacgaaggagacacatcggatatgaagctgctcagcagctgctggttatatttagacgagtataactgttggactaatatgcatggatttacaggtaaaagagaagatcgtgcggtatccaaatcagaattaacaatggaaattattttccagtaaatttcacaacactacagctactttgatcaatctatcacaaaactacggatttaatgtcagttttatcacctttgtaacatcaatattgtatggacataaactctaaaatgtgtaattctctgataatttcatcattaaatctgtgatacgatatatatattaaatatgtagttctgtgatgataaattttgtactaaatctgtagttttgtgatacacatatttaaatctgtagttttgcaatagtttgattaaagtatatgtagttttatgaaatttaatttactctattttttactaactggttttgatatatctaggaaattctagtgaaatttattggccggaaatgcactctaccatcaagctaagaggcatccatgcatgcatgaagtgaaacatgtaatgttcttacttgttattttggataccgacattatctcaagaagacgcgaatattagggaaagtcctaatatcaaataattaaaaggagtgaggctttaaacccaggtcgtctagcccatcaccttgtagagctagccggaatactctgggcgtttctccaccgacattatctccagtgcagatttaaagctattagaatataactacacgatgttatttttcatgaaaatcgtctactagtatgtttttacatactaaatcttaatattttttttgcatatttttattttagttatgcataagatttcgagatttggctgcatacgtcatagatgacgtctgtttgtaaacacagagatcaacgtaactcttttgtattatcttacccccatccaattctaaatggtgcatgcatgcctagatacgcatgcgaatataacttttcgatctcgatcatttggaaacgtacaaggctatagcgcgttgtaaacgatgccatatatatttgaataccaaccaactttcactccatatatctacagttagaccctcagatgcccatgacaaacacaagagttgtacagcaaagcttttgagctgtgcatgcctttctcctagtttattggagatcctcagaacgagatcatgatttgcacaaaagaagttcacaaagttgggagaggaggaggagaatttttgggtagttggtaagctcaaaggtggcatggtgaggtggagacctcagcttgcatattgaggatcaagatgactagcaacaacacacactagttggatagggaatcacaaaaaaaggcatcatcagctagcttgatcacagtttaatctgtgtctgcatcgatcactagatgtacagtgcaaatgctggcaatgcactgtaaaggaaaagggacccatctgcaggttgctgcatgcatgcatgcaatgctgactagctatcattttacacttggaatttggtgattggtctccttggaacttgcactggatggtggtggctgaacctttaacagcatggcaccagttggtaccccttttgtttccctgatcgattgttttcatgttacacacggtttcatcagagtagtgtatatcacaagggtgatctctagctgcatgatgctccagcttggcagtgacatatatttgacacaacttttttgaccatggaaagtgtttgtgtgcaaattaattatcaacaatcaatctgtggttgttgtgctgtgctgtgttgttatgtatattctaactaaattatatgcaaaatagtttccaatttttgaaaatgatatggataaaaagtgtatttttatattatgtctaggaaaactaattgctatttgatatccactgttgtgccaacttaggcttgagttctgaacagtttctcagttaggccagctagctacttcatcgtttatcatgagcacattatatttcttaaactgctaaaccatgcgtattgtgcataaaatttttatatagaagtttcttaaaaaaatcaaataattacattattcaaattcataattgtttgtatctaattaatcatatgataatgaccttcgttgttttgagtgctgctggaaatctccagcaaacctcgcgaacaaacgcatcgttagccgtccatgcaaatgcatatacaaaatatttagttaaaaatattaaatcatttaggagcctgatcatactttgagataatgagaaaactttgcctgatgcatgcttattttgtcttagtttgtataacttcttagattgtaaacctcttcccggttgggaaaaagaagagtaaaactaacataaaattcagtatattaatagaaacaaagtttgaaccctcccattcaccagccaatattattactgtgaacctttctcatataaacaaaattgtctatatatttatccattacttaattttcaagttcttcttatggtttgcatttcagcagcgctgctggacggtcgatctcctccagaagcatggcattgatagtcactcggcctgccccttttgcgctcaggagcttgagatgacgaattacatcctcctcgactacgtgttcgctcggcaggtctggctccgtatgctgtcacctcctagctgggctgcctctctcctccccatggcagctggcttcaggaatggtggccatcttctagggcctgtttacctgagtatctccgtgctggcttcgactccttggtcctcctgatctcttggcaactgtagaaggaacgaaactccagggttttcgactctgcactctcttcggtctcagtggttctagagtccatcctttggaatggccatctatggtctttagctagcgttgctactttggggatttcatgggagtgtagtttggcttcgccccctttccgctgattggagttacgtttagccatcgtagtagtttcttcccttttccttggttttgttttttctcccttcccttggcataagccggtctttccgattgcgttgtgtaaaaaaaactcttttattctaatatattgacgtgcaatacttttacgcgtccgcgaaaaaaatccgttacttaatttcatttctcattcttaatttgcattttaccactcattttcatttgtgataagaactaagcaaacttatgtgtaagactttcattttcaaaagttttttttaaataaagtaatcttaaagacttaaatagatatttaattttataaaaattataccgtttagtagcttaaaaaatatatggtaatccacatatattctgtaagagtaaaaatagtagtgcacagaggtgtatgcacctccaaatgtccatataacctgttgccaactccctgaaactcactttcatatcatgattagagcaggtacaatagcaggctattaatcagctataaacatattttaatgagataaatgatgagagagaaaagcagcgggctacagatctgtagccagctgcagcacggacttcaagacgcaatgtgtgtatgtcaggtgagaccatatattaatattatagtaagtaactattgtatgaattggctattagattggttataaatgaattggagccaatagtgggctatactattaaacttgctcttatgaaactactcattcttaagtagtaattacttgcattgagaagacattttcagctccattaatttatcattttagcacaatttctcagcagggaatatcatcgataaatagagtacaacggtaacaacaaccatgcatttattgctcggaatatacgcaggtgacattgtgacagggggtgaataacaaattaaccaacgccatgagcattcatgcttagttagttacccttattgaccaaacctccaattaacaaggtagtttaacacacatcatgctcgcttaactgcagcaaagagttggaatctcaatatatacaaaaatgtgtagcttcaaacccatgagggctggggaatctaaccccctaaccccaaacagtgggctgctggtgtacgtgcctagggcatcaccgcatgtgtttatgcctcatcactaattagaatcttaatttctctctcatcaagccaacgagaaaaaaaaattacttaattaattaaggccacaaaatcagttcgaaaattctctcgtgatttcgccgagcccagaaccagaaccaaaaccagagctcgagctagattagttaactaacatgcctgattcaaaaaagggagttagattctatatatcttctaatatcattgattaccctttttttttcctacgctaagtatgcttatgatgattctctctcttccatcatcacacacactctctcaatcgctttctctctcttcttccttgctctctcatacaacctctatttaagcaccccttgctcacctcctatccaccaacacaaatcacttgcaaaaccaacacaaacacaacacaagcaacacacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgggagccgagcttgaattcgccctaatgtgagtccgtcatcaagcgg

SEQ ID NO: 29674 - DNA, 753 bp, Oryza sativa
  unsure (1)..(753): unsure at all n locations
acgttggcgcagccgtttcaagcagtgcgccgccgtagtttaagctgtcgcggtcgctgggaaagaccgccgtcgtgcttggcaaagtggccgccgtcctggtccgccctatcgttgcgtcgaagaccaccgaagcatcgtcgcggtcgtcaacccgaaggtagccgccgcttccttcttgtcgcagtagtcgtccgttccttttccaccgccgttttggtcaccggtgtgttcgccgcgttgtcctatacgtgctggtgccctcagttggtcccgtggaaccgccgttcgccggcgagtgtccaccgcccgagccgttttattcgccgagccgccgcagtagtcggtgatgtcatcgttgacgtcatcgggatcttctcccgtgagccggtcatggaccgatcgattttgacggtcagatttggatcggatcaatttcgcccgtccgttcgcgtgaaccgccgcccatgcgcccggtccaccaaaccatagcccgctgacgcaataaatccccttttccttttcaaaaataattcattattgcgtcataattcaatttaaaccgatttaagtgttttaatccgattcctctcccaaacttcataagtaacacatctaagctccgatttagttggttcaattctctaataaattctaaaattgagattgaccattaaaaatatccacatgtgctgctctgggnatactctaaantnngcnnggtgcgagtacgaggtacttattccagcgcgc

SEQ ID NO: 29675 - DNA, 700 bp, Oryza sativa
  unsure (1)..(700): unsure at all n locations
gggcctttaatatagacgnactccaancgcncactttgagtacccacagcactcaaattcgaatttcttaggcttggcaagaactatcattgtcatcgagaactacacaaaatcgctcacccatgggcatttttgaagaaagaggagagattttctgtacccccatgcgagaggcgaaccaaactctcaaagaaaagctggtttctcgccagtgttaatcttgccggatactccacggacttatggtgattggacacttccgccaagatggggtgcgtgctatgccggaggtaatgtgtggctatgcctccgcagctaaagctatgaaggcaactaccctaccatgattggagtagccgggtggatatgctctaaaaattgcggattatctcattgggaatgctggaaatatatactgacataacagtgaaataatcttcactcactcggacctgaatcttcgcaaaagaaatggtttgaactcatcaaggattacgacgtgggaattcctatcattctggtaggcccacagggtcgctgacgctctaagatcaaaaagccattgcaacacttctaacgttccgtggttttcaccccaacttaaccaacagatggaagccctgaatctgaaccgtagggggcgtcgacttttggctgcgttggaagcccaggccacacttgctcgaccaaatccgcaagg

SEQ ID NO: 29676 - DNA, 9321 bp, Oryza sativa
  unsure (1)..(9321): unsure at all n locations
ccccaaaagcggagtgcggcacttccgaccataaagtgcttcgtaaggagccatctgtaaactagcttgataactgttgttgtatgaaaattctgcataaggtagattcttatcccaacttccaccgaaatttagagcacaagctctcaacatgtcttccaaaatttgattcaccccttcggtntgtccgtctgtctgcggatgataagcagtactaaagttcagcttagaacccatctcttcctaaagtttcttccaaaaatttgaagtaaactgactgcctcgatcagacactatcttcttagggacgccatgcaaacacacaatccttgccatatacaattccgctaagcgacttccggaataagttgtctttaccggaatgaaatgagccactttggtaagtctgtcaactattacccaaatagagtcatggcctgatgacgttctgggtaaaccagtaataaaatccataccaatttcttcccatttccattcaggaatcttcaaaggttgcaacaaaccggcgggtttctgatgttctgccttgactcgctgacaaacatcacatactgctacgtattctgcgatttcacgcttcatacttgcccaccaaaatctttccttgagatcctggtacatcttagtactaccagggtgaatggagtataaagtatcgtgagcttctttcagaattgcatcctttaaatctttgttgtcggggacacagattctctcacccaaccataccgttccgtgctcatcctccaagaaaccaatagcttttcctcttctcatattcttcttgatctcttgaatatcaggatcattattttgggcttctctaacttgatcaattagagtgggcttcgcttctaaagctgcaacgaaacctctaccgacaattcccaaatttaatctttcaaattccttgcataattccaatggcaactgtcgtccttctgtagcattgcaatagccttttctgctaagagcgtctgctacaacattagcctttcccggatgataatgaattcccatgtcataatccttaattaattccaaccatctccgttgtctcatgttcagatccggctgagtaaagatatactttaaactcttgtgatcggtgtacacttctgtacgagtaccgaaaagataatgacgccaaatcttcaatgcatgaacgactgcagctaactcaatatcatgagtagggtagttcttctcatgcggacgtaactgtcgagaggcataggcaaccaccttcccatcttgcatcaaaacacaacctaacccaagtttggatgcatcgcaatacacttgaaaacccttctttggatcaggcaaaatcaaaataggagctgatattaagcgacttttcaattcttgaaaactctgttcacattcttccgaccacttgtacttcacatctttctgaagcagtcgtgtcatgggcttagcaatcttggaaaaattctctataaacctccgataatatcctgcgaggcctaggaaactgcgaatctctgaaactgtctttggttgcttccaattggttacggattccacgttactaggatcgacggcaactcctccggctgagatgacgtgaccaaggaatttcacttcggacaaccaaaattcacacttgctaaacttagcatacagttgatgttctcgtagcttctccaatgcaaggcgaagatgttcctcatgctcttctttggttcgagagtagataagaatatcatcaataaagaccaccacgaacttgtctaagtattccataaacaccttattcatcaagttcatgaagaaagcaggggcattggtaagtccaaaagacataacagtacattcgaacaacccatacctagtggtaaaagctgtcttaggtatatcttcctctttgattctcaactgatgataccctgatcgaagatctatcttggagaaaacagtggcacctttaagctgatcaaacaaatcatcaatcctgggtagtggatacttattcttgatagtcacatcgtttagtgcacgatagtccacacacattctctgagtatggtctttcttttccacaaaaataaccggagctccccatggtgatgaactcggtctgatgtatcctttctgtagcaaatcatctacttgcctcttaacttctgccaactcattagctgccattcgataaggtctcttatggatcggagttgttccaggtaccaaatctattctgaactctatatcccttttaggcggcataccaggtaaatcatctgggaacacatcagaatactcccggactataggaatctcttccaaagttatctggttcagtcttgaccttaaagactcagatgacaatgcatgaacagttacaactcgaccatcatagctgttgagagttacttttctgttggcacagtctatcacacctttatgtctggctaaccagtccatccctaggatgacatcaaggtctttggattctaacaagataagattggccagaaatggtactcctttaatttctattctgaccgaggggctacgttgcaaagagagtgcttgattacttggggtactaaccatcaaaggacgtctaagatcttctacttccatcccatgatttcccgcaaaactcatagataagaatgaatgtgtagcaccagaatcgaaaagtactgttgcaggaactgagttaacaaggaacgtacccaaaattacatctggagcatcttgagcttctgcagcagcgacatgatttacacgagccttggatactggtacagcagagttactctgggcagggacaaccttcacgcgacggggcttcggacacttgtcagcataatgtcctgggtctccacagttgaaacacaccacgggcttgctgccttgctccctcttggcaggttgttgctgtactggagctgcaacaggacgtggagctttattacggatgttgttggcagcattgttgatgaaaaactgacgttgcggacgaacaacagacgaagaacctacctgtggcatagactggggtcctaaagtaagacgcggcttctgaatatttccctggtgtgtcttgaattgaccaatccgacgtttcttctgctccatgcgattatacttgtcctcctgacgaatagccttatccactaatttctggaaatcaggataatctccaaccatgagtgggtaagaaagctcatcattaagtcctcccaaaaacttctcctggcgctcttcatcattgcgcacatcttccggagcataacgagcaagacgattgaactcgtgcagatactccgtaacagagcgagatccctgagtaagcgacctgaactccttcttcttgagagacactactcccgatggtatatgcgtctttcggaaagcagcggtgaattcaagccaagtgataggttcagcagtagtcctgttaaggcggaagtgatcccaccattcagaggcagggccatgcaactgatgtgatgcaaaagataccttctcctgatcagtgcactgaagtaaatccaacttcttctctatggcatgcagccaatcactagcttcaacaggattagtggtactagagaaaacaggcggcctcacacgaagaaattctgctaacttgttctggggaggtgcatgattattcccttggttttgctgattctgaaattgctgcatcatcatgttcataagctgtgtttgttgagcaagaacttgagcaagagtgggattctctccattgttgttattggggttgttgggaccattcccattgctacgagtgttcaccatctggcatggacagggcacaagaagagaaaacggggaaaactacttaggacagagaattactttaacttttattgatcttaactgagtttcattattacaaactgaagactctcacaccactaaactcaccaacttcctaacactcaaaagcaaacaaacgcatgcacttacatcccaccactgatgtaaatcacatgcgagccacacacaagcaaactttaagcaagcaaactaacacaacgatctatgacaacgacttaacaagtcactctagttcttccaagcatcggaggtcgattgaaggctcgtcttcatcatcttgggttgctacccactcaatcttggaattgttgcgcttagattcttcttcttcatcactacttaagatgatgaccggaggatccgcttgagctggggcaacttctttctccaccacacgaacctttggcgccagttgatagcgagggacaaatagagctctcttccttgcggtaagacgaatcctggccttctgcggcggtgcttctcccttcaatgcggctaattccttctccaaacgatccaccttgtcttctaacttgcaaatcttaccatgattccggtcttcacgatcttgagctgctaacacagtctccgcacgactttcatccatagcccacaacatctcaaccaaatgtcttgtggtaacataattctcaattccttcagtctcaagataactgccacggtcacttccctggggttggcgaggatggtaacgatactcagtgtcggccaattgatcactgtagcgatcacggagctctcctatggcgatccttgccacctcctgacatgcatggatgtagtttcttcctccagcttcgaacatcactgagggaatatcttcactattgctgttcaaggtgactttgactcggcacttctcttcatgacgatcatgaggaatctgggtataaaaaggggcagtcccaaatccaatgacaaaggacatcgtacgcaactcctggacaaaaccctcaacaccaaacaggtactcaggcttgtaacgcggcatctaaagacaagtgaaaggagggagttaagacctttatccaattaatagcacaagtttttggattaatttgaataaagttagaaaatcaaagtaaaaagggaagtaaataaagtaaaccaagctttgcaaaataaattaaaacatttggaaacgaggtcacaaattttgtaattttgaataactggtttcaaaagagatgaaaggaaattataaaatcaacatactaaatttattttattgcagcaagattaaataaaacagtattgtaaaacttttgctgataaatgagccattagtacagtaatagatgtacagtactaataacactggaataaatttttaatgaaaaccattaaaaaaaaaattatgaagtgcatgtgccattagtttggttaattaaaagagaaagggaggagaacagttctacttttccaatatttttcagagggcttctttgggtaaccatttggtataacctagggtcaaaggggctctgataccaacttgtcacgcccggaatttctatccaaaattccaaacgctaacatgtgtgtgaaccctcgtccaggaatcagccgaggcacacaataacaaattgataatagagtacaaataatactctaattaataagcgaataaaatgtcattacagaggtagatagttcttctcaatcaataaagttctaagcagcggaaattaaataaacggcgcagacggctccactccacaggtagcttgaccaaggctacacctaatcctccacaccatcagcctcattgtagaactcttcttctgatgaatgattgcaaggtgagtatatgacatactcagcaagccacgcagcaaatatgcaagtgcacaggataacaaaggatggcataatatggttgtatttgcaaaagcagcatttagcaaacatttgagaatttgataaaacagttaagtaattaaacaatattaatccaacgctatacaacataccctgttgtataggcccaaccattctgaacaaccaccccggctgcacagttctatctccaaaccaggaatgtaccattccaaaccaggagctaatcaaattattaccagtttaagcatcttttacaatgatgagaggtgtgagactaatcacgaaagacattgttagacccgcccataaccgcgggcacggctattcgaatagttttactctggccagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgcccacaacccaccattatcaggttttagttggcacattaattaattaactaatcacgattgaccatcgtgaactatcaataagccatcatgaaataatagtgagtcattagttatcccataagtgtactaatgtttctaagcagggctaagcaattgtatctaatatctagttgaaccaatataaataaagctcaactagtcaaattgtaataacccaaggtatcaaggaataaggtaatcaatgtacaaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttccgcgaaaacggactctccggaaacgacggaatctaagcaaaaagaagcaaaatcaccaaaacagcacataaacaagcatgaacagtacatgtggatatttttaatgtgtagatctcaattttagaaaaaattagagaattgaaccaactaaatcggagctaagatgaattagttatgaatttttaaagattaaatcggattaaaacacttaaatcggtttaaattgaattatgacgcaataatgaattatttttgaaaaggaaaaggggatttattgcgtcagcgggctagggtttggtggaccgggcgcatgggcggcggttcacgcgaacggacggccgagattgatccgatccaaatcggacggccaagatcgatcggtccatgaccggctcacgggagaggatcccgatgacgtcaacgatgacatcaccgacgacggcggcggctcggcgaagaaaacggctcgggcggcggacactcgccggcgaacggcggcaccacggcaccaacggagggcaccagcacgtagaggacaacgcggcgaacacaccggtgaccaaaacggcggcggaaaaggaacggacgacgacggcgacgagaaggaagcggcggctaccttcgggttgacgacggcgacgatgctccggcggtctccgacggcagcgaaggggcggacgaggacggcggcgacttggcaagcacgacggcggtcttcccgagcgacggcgacggctgaaacgacggcggcgcacggctggagcggcggcggcgacggcaaagctagggcacacggcgctagagctcttccggcgacgagaggcgaaggcgagggctgcgacgggtagaggagacaccgggggtccttttaaaggggctcggaggcggcggcgaaggcccacggcgacggcaacggcgaaggaaaccttcggcttggagagagggaaaaccgatccgaaacgaactcgtctccgacgctttccaaagcgatttaaccaaagattccaaaggagaaaaggtagaggagatcccggagattgtttcccctctaacaaatcggccggagaaggaaaggaacggccggatttggaaagcggcggcgacggcagctcggcggcgcgaaactagggtttcggcccgaggaagacgacgactgacgggtgggccccacctgtcagcgacagcgcgctcgcgcgggcggctgcggactgggccggactgggctgaggagagagaagggattttgggccgactttcggcccaaagccaaaagagactttttaaaacctttttcaatttaaattatttcttaaatgcaattccatttattaaaaatactttcttagctcaaataaatcccagaaaaatctaggaattatagaattaagcaaagtatttaatgaaattttatctggcccaattttatattggaatttattaattaaaattagattttcttttcaagacttttaaaattatttctaaaaattccatttaaacaacaatttatatattttgaattttcagggtgtgacaaacctaccccccttaaacagaatctcgtcctcgagattcggaagaactggcgaacaggtgcggatgagctgacttcaattcatcttctcgttcccaagttgattcttcttccgagtgattactccacgggactttgcaaaaacggataactcgattcctggttcttctctcacttgtttccaggatacggattggtttctcaacataagtcaaatcctcttggacttctatctgctcaatattagcttcttcggtaggtacccttaaacactttttcaattgcgacacatggaacacattatgtactcctgccaaagattgaggtaactccaactgataagcaacctctcctgttctactgacaatcttataaggtcccacaaaacgcggtgccaattttgctttggtatgaaaacgatgaactcctcgaagaggcgtgacacgaagatacacataatctcccttttcaaaactcaaatctctgcggcgattgttggcataactcttatgacgagactgagccacacgcaatctttcttgaatgagctttacctttacttctgcttcccttacgatatgcggttcgaaaacctgacgtcttccgtatgatcccacaaaaggcgagtgctgcacttccgaccatacagtgctttcgtaggagcccatctgtaaactaacttgataactgctgttgaatgaaaattctgcatagggcagattcttatcccaacttccaccgaaaactagagcacatgctctcaacatgacttccaaaatttgattcaccctttcggcttgaccgactgtctgcggatgataaacatgactaatgttgatctaagaacccacctctttatagcgttctgacaaaaatttgaagaaaagtgagtgtctcgaacaaactactatctttttggggacgccatgcaaacacacaattttg

SEQ ID NO: 29677 - DNA, 2085 bp, Oryza sativa
  unsure (1)..(2085): unsure at all n locations
aaaaatcacttctttcagagagtgtttcacacaacaaataacaattttttttgtagttggggatgggccccctccagatattggagccccccaacacccgttttatatctttataagtggtttcacaggggtaaaagtgtttctccggggtggcccaaacaaatttccgatataagccagggtgtgttttaaggggtgtcgtgcccaaaccagttgtggagaaaaccttctccgcaattaagacccacacggtggattttgagaacgccctctttcccaagaaaaaaggggccggttcccgtaaagggaagggtcgaacaaaagagcgcaaaagaatctcacaggggaacccgcgggtatcataaatgccgtggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttacaaatcaccactatttgtatacacaacagtcagtgaaataaactgtcaccttctatataatacatatgatgcaccaactaatttttctgtcataatactacaatcgctggcattgaaaaattgcctctttgcagagtagcagtctgtccattatagtccgtttagcttgctcctctgtctcggagattacaaacacgataaatggcctacagctccaccatagaatatattaagtaatttataagcaaccatgatattataaatccaattgtctggcagcaataacttgcttcagattgaacaggacatttaagcttaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 29678 - DNA, 1310 bp, Oryza sativa
  unsure (1)..(1310): unsure at all n locations
ccgagtgattgccagtgagtaatcacacttactataggcgcgcaattcgagactcggtgacccgcacagaccngctcttttggccttccggctttcgctcggtgcagtgcacctacaagcgaggtggtatgtgcttcactcctcggcgtatgtgagggccaccacccggcagtacaatcacagaccccggccatgcaaggtttttacgggggtccgccttctgcaaaccaacagtttccgatgtcacgaccaacattttagcagccagtgcagaccatgccgcccccttctatggcgggttttggcaatcaagcggcatatgcgactggggggcctcctacagggggcaccctccagagcttagtggaggacttccagtcgctctcggttagttctgcaccaggatcgcttgatcctggtgtcgacgtcaaaaggctgccaaggccattggatggtgacgaggaaccaactaagggtttggaggcatatccattgaactgccacccgaggtacttccggctgacaacccatgcaattccagcatcccagtcgttggtctcaaagtggcatctgcctcttggggctgtggtacatcctttcgcagaatcacctgatggggtaatgacttttaggcactctatttatcttttaccctcttgtcaaagaattgttctgacattcatgtttctcattacttaagaaggttcccggtattaactttgggtcagctggtgtcaatccgttgcccaagatgtagaacatatataaacccttacgcaacattcgcggatgcttgaaagaaatgccgctgcaaactttgaacgctgttaaatgatggaaatatttttgggccttaagctcaataattcatgtggacctgaaatttgaatttccgaagaaaaaacaatcgcacaacagatatttggttattttgctgaccatttttttagcttatgcaactatgttatccacattaaagaagaaattggagtttgtcaactaactttgggttggtggcgtgtcaaaaccaaaggttttcaatggtcaaaaaactttaataattctgaaagaaaatatttgcccttaataaaatattggaggggaaagcgggaagaaaaatattaagggtgggctttttaaaaggaaaaatggggtggaatcttttgttaccggcatcttaatgttgggatttttatggggcggacggcttttaaaaaggggaggacccttttttagagggggnggggaacacaattcaaataggtggaaacaaatcttttaaaaagggaatattagagatttcttgtaan

SEQ ID NO: 29679 - DNA, 747 bp, Oryza sativa
  unsure (1)..(747): unsure at all n locations
cggcgctcttaaaaatgacagtaagtatgnctgccntgcaacnnnagaggaccccagatggcagcaaatgaactggctgaatttaagaaacagttgtattagttgaaagaattttggaatataccttccaaaacttccttgtggggttcttgggtgatttttggggggaggaaagacattacaatgaggatgtgccttgactacagagctctcaatgaagacaccataaaaaacaagtaccctcttacccggatcgatgatctgttctatcagcttaaacgtgccactgtattctccaagattgatcttcgttccggatattaccaattacgtattcctgaataagatattgctaagaccgcattcaccacgccataccgactgtataaattcactgtgatgtgattccttttaaccaatgctcctgccttcttcatgaacttaatgaacaaagcgttcatggaatacttgtataagatgttgtggttatcattgatgacattctgctgtactcacaatcagaggaagaccatgagcaccatcttcgtttgatgttgtgaaagtatctgaaacatcaattgtatgctaaacttagctagtgtgaatactagttgtgcgaagtcaaattcttaatgcacgtgatatttgctaaaggagttgctgttgaccccaaaacagtgacccgcgtcaatgattggaaacaacccaatataatcacttaaattcgcagatttttaggcttggcag

SEQ ID NO: 29680 - DNA, 748 bp, Oryza sativa
  unsure (1)..(748): unsure at all n locations
atcgcctctaatcgctacccgtgacgtacnccttncaaanncgaggancgccaaatggggaggcaccacattaacattgaatttatcctcccgtgtttatttttatcataatctggaacggtacactctgaatatgcggttgccatttccattctatagcgggggtgccacactttgggcaacattccaattccgcatattctttacggaataatatacagcgattcttacaagcctgaatcttttctacaccaagacataaaggacatatgagtttcttcgtttgatacccgttcgatggtacaaagataggtttaggaaacaacatatgcaacaaactcatcagatcattaaaacttgttgtcgaccatccatgtttaacctttaatcttagaatgtcaagcactgaacgcaagactgtgaaatccttatcacatacgttcgattcatcgtaaagaagatccttcaatgccttctctaatgcctgccaattatacaattctcgtgacctggccgctagcacctcttgtttaacatggcgtagcatatcctctaaatcaaaactaccatcgaaatcatcactatcggtggaaacatccacaaccattctttcacgcgacatgtattcgattataaaattctctgtctcattcatctagaaacataactcttcatcgtcatctttcggattggctaattccctgttatacgttcaaaccttgtacgttggcggagaattcggactccn

SEQ ID NO: 29681 - DNA, 743 bp, Oryza sativa
  unsure (1)..(743): unsure at all n locations
cggccctgaactcacctcnacatcccacangccngcangtngattttagaggatccccggaatggttggcctgggttggcttgcgacgagctggctcccttggtcaggttgccacttcggtctgaatcatcacaagccttgggttaaagcaggttcgtgtgggcgcacagcttttataaataatattgtatagctctagaatcgtgtttactaaatagctttgagcaactaaatatctctcaatgctggttactgcaaccctaaccctttatagtataactcctttgtactcccttgcatttattctgtacttgtgggtgtgtcttgatgaatacggtgggtgtactcagtcttgctcaatttttcccaaacccagactatgagcccctgcaagatgaaggctatggtgtctatctcgtgcctgccgacaagcgcctgtggtccgcgccctagccttccgctgtttctcattgagctctgagtgtgctgggccttcgctgcccatgtaataaattaactatttacgctttcgcttgttcaactctggattgcatcaacttttggtgtacctagcctcctgcgacaaggattaatgcacgcacgtaaggaaccgcccgtgggttatttcccgtcgtgacaaagccactgtggtgcacgattcgcaacaatcattgactgtgatgaggatgggttgtagatcctcctgcatgaaagccgntgctcaagattattgcttttgcgga

SEQ ID NO: 29682 - DNA, 2729 bp, Oryza sativa
  unsure (1)..(2729): unsure at all n locations
cgctgcccttgaanatgaanancgatgacgnacnccgtctgaanannnganttaggaggaattgtgcaggatggtccaggaataagcttatgaagcaacacaacgcaacattactcatctttatcattaaaacttgtgtgcgaccatgcatgtgtatccttcaaccttagaggtgcgggcactggacacaagagtgtgaaacccttatcacataccttcgcttcatcgggaagaacgagcttgcgtgccttctctaatgcctggcaattctccaagcctcgtgacctggccggtagcacctctggtttaacatggcgtagcatatcctctaaatcaaaactaccatcgaaatcatcactatcggtggaaacatcgacaaccattctttcacgcgacatgtcttcgattataaaattctctgcctcattcatctcgaaacataactcttcatcgtcatctttcggattggcgaattccctgtgataggttcaaaccttgtagttggcggtgaatccgtactccattatgtgacccaatatttcaccaggatctaccaacaatttctgattcttgcaatgacggcacggacaaaagatctttgtcatattctccctcaaagcatgcgccttagcctgatcaataaatttagatgcttccttaataaatatcggctgcgttctccacatctcatacatccatgacgactgatccatctaattatataaaggcaaaaaagttacaaataaaaaaatagaccgcaggtatttcatacaaaagtttaaatgcatttgtctccaaaaaaaaatacaacaatacatgtaactagtatgtacaattgattacatgcaaaatttgcccatcaaaacatatattttgaagctagattttgcaaaaattagttagaacaaaccttgtcaaaatattaaaaaaactccactttccaccaacgaaatataacaaaaatggagccaaatgaaggaggatagagagttcttcacctttcgtatagagttcaagcaaaaatttcgagttgaaaacctcccccctaattggtgcttgctttaggagagagaaagcttcgttttcaaatggtcaagctcgggcctggaggagcatatatggccgatcatcgcatgcggtcccttaagccagccgcatgcgaagatccattatcgcatgcggctgcttaggacagccgcatgcgaagatcagccgcatgcgataatgggcctattttcgcatgcggccgtcttaaggagccgcatgccctaatatatgcggccacttaagacggccgcatgttcgcatgcggctaatcaacccgcccccggggggcggtttttgcaggcgccgccacaagcggcccgcatagaacctaccgaccccctcgtacagaaaaacgatttttgtagtagtggttgccgccgcaggtgcagaagaagccaccgccggatgccgccatcttcgaggggatgccgacgcgagtcgcggtggcgagacgcaggcgacccttacgcgttcgtgggcgcggcgggagaacggcggaggccggtgcgtcgtggccggcagagagggcgtggagcgcagcgatggatagtgcggtggcggggccgaggatggcgaggacacggccgttctcgtggctcgttttcttccttccgacggccaaccttccacggcggtctcgatctccgccgccgccgccgccgctccggccctcacccgcacgcctccgtcaccgctccagtgccgctcctgggtctccgtcgccattggcccccgtcccacactcgcggagagaaagagaggggaggatatgatttatatgagccccacgtgtcagtgggacccacccatacttttggtgaatgataaatgggtcccacatattttttatttctaataccacctaagtgccacgcaaacgccacgtggacaaaagaccgagtcaatactgccacgtaggtgccacgtcagcgaaatcgccctccgaaaccaccgagggagtcaaattgtatcggttttaagagttgggggtcgagatatccgattttgtggtttagggtcacggattagatttcgatcacttttgagggtcacgaagtgaacttattccttctgacgtcgcccaaccctaacgcgtggcgacccgagaagccgagagcccaagaggccaagagcgtcatcgtccgtctattcgtttgtgcactggtggagaaaccatctttcgtcggtcggccgatttccacaatagtcccggatgcaataaaaaccggggctaaagatgatctttagtcccggttcaaaagggtaacgggcatatttgatctttaatcccggtttgtgttaccaaccgggactaaagatcatctttagtcccggttcgaatgctgtcaggtcatgtcaggcccccccgggatctttagtcccgggtggctgatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggngtggtttagcatcccgtnctgttgacgctcttcagcgtgccatcgaaacattctagcatttccctttgttcctgaacaaacgcctttagccgtggtattattaggaaataccacattacctttacaggaattcttttcttt

SEQ ID NO: 29683 - DNA, 3746 bp, Oryza sativa
  unsure (1)..(3746): unsure at all n locations
caagtctaacgcgcaggcttttagggaaatatatgaaaaggttcttttgtctgtcccgtcatggcaagaatcaaaaattgttggtagatcctggtgaaaaattgggtaccataatggagttcggattccccgccaattccaaggtttgaacctttcacagggagttcgccaatccgaaagatgacgatgaaaagttatgttccgaaacacataaggcagaaaattttatagctggcacggtctgctgtaaaagaatgttggcatatgtttcgggggggaccttatgtcccggtgggaggcaccaaccgggactaaagatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgttttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaagaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtacggttttttttgactcatgtagatggatcggcaatggatgtacgctaaccggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgccagggaggactgcgaaagtgaaaaggaggcccataaattggacaagatgttggaggaccacagaacttcgttgtacccaggttgcgagcaggggcacaaaaagttggataccactctagagttgttgcaatggaaggcaaaaaatggggttagtgacaaggcatttggcgatttattgaaactcgtcaagaacattcttccgggggaaacaaattgcccgagacaacgtacgaggctaagaagatagtctgcccgttaggattggaagttcataagattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattcctgctaaggtgatgtggtatttccctataataccacggctaaggcgtttgttcaggaacaaggggaatgctagaatgttgcgatggcacgctgaagagcgtcaacaggacgggatgctgagacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctccccccctggctatgcatgaagaggaagtacataatgatgccgattattattcaaggccccaagcaacctggtaacgacatcgacgtgtacctaagaccactggtcgaagatcttaaacagttgtggaagaaggaaggtgtccccgtgtgggacgaggacaaacaggagaagtttaacctacgagcgctgctgttcgtaaccatcaacgattggcctgcacttagcaacctatccggacagtccaacaaggggtacaaggcttgcactcactgtatggatgaaacaaaaagtacgtatcttaagcactgtaggaaagttgtatacatgggtcatcgtcgattccttgcagcaaaccacccggtacggaagaaaggcaagcacttcgaacgtaaggccgaccaccgtacgaagcctaaacatcacagcgggaaaacagtgtttgctatggttaaagatcttaaagtagtgttcggaaaggggcctggaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaaggagaaaggaagccattactcgagtccagccagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagctatgtgcattcatgaacgcaatttcgcagaaggtcatcgatccggatagattagaagcccttcagaatgaagtggtgcaatgtctcgtcagttttaagttgatatttccaccttcatttttcaatataatgacgcatctgctttgtcaccttgtgaaagagatccgtattctcgggcctatgtacctacacaacatgtttcctttcgagaggtacatgggcgttctgaagaagtatgttcgtaaccgtgcttgtccagaggcaagcatcgccaagggttatggaacagaggaggtcatcgaattttgcgtagaatttatcgaagaccttcgcccaatcggggtacctgaatcacgccatgaagggagactacgggaaaagggaactctcggaaggaaagcaataatgacagtagacaacaatttattccgtaaagcccatttcactgttctgaaacactcttcattggtagctccttacatcgaggagcacttggctttagttcgcgccaggaacatcggtaagtccgatgcatggattacacggcatcacattgatactttccccgcgtggctacgacaacatatcatgggtaacgagtcgatcaaccaacaacttgccttcctggcgaggggaccgtttgggtcgatcgcgacattccagggatatgagatcaatgggtannnnnnnnnnnnnnnnnnnnnnnnnnnnnnnnnnnnnnnnnngatntatcaagntntcaaacacg

SEQ ID NO: 29684 - DNA, 1883 bp, Oryza sativa
  unsure (1)..(1883): unsure at all n locations
ctgaatgtcanttgtananccnncatcnngttaagnatcctcnttgtcgcatgccggcaggctcgactttagaggatcccccgatcgaacgaacgatagcgagaacgaacacgtcaacgtacgttgtccgagaacgtgttcgagaactataacgatcgaacgaacgagagcgagaacgaacacgtcaacgtacgttgccgcgaaaacgtgaacaagaacgagaacgatcgaacgaccgagagcgagaacgagaacgatcgaacgaagacaagcgagaacgagggaacgaacgtgaacgagaacaagcgaacgaacatgaacgagaacgagcgaacgaacgaggacgaacgttaacgtgaaatgcaatatatatatatatatatatatgttacttcgcatttatcctaatacatctttttgtatcttgtagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataaaattattttattgcaaattagacttagtatgacattattgactacggaattggtgcgactcctagcaattgactattgtagtcttaattagacttagcatatacgcacgaaacacttagcatacatgactattttagtcttagcatgtaatattatttgagttttaatataagattactttatttgtaattagacttagtatgtaattattgactacggaagtggtgcgacaagtagcaattgactattgtagtcttaattagacttagcatatacgcacgaaacacttagcatacatgactattttagtcttagcatgtaatattatttgatttttaatataagattactttatttgtaattagacttagtatgtaattattgactacggaattggtgcgacaagtagcaattgactattgtagtcttaaaacataaatgtctcgtgacttagcagatgtttgttgtatcaacagatggctgaccgcgatgaggaacagatattgtacgatataatcgcggagggaagcagccagtactggaatgaagaagaggggaacgaggatccaaaccagtacttgaacgaggaatggaacgttgagagggatgcggaggggaaccaacaggggcacgtggaaaggtatgtggaggggaacccatgacgaggaggctagtggtagtcaacacttcgtttgacagaagatggcacgccgcaacgaggtgcaacgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacggacaatggttgacctcttagggccaatttggtctgatggcgcatatattaaacaaggcctggaacctgtcaaacaccgttggagggaaaccctgtgggggggnnggaatataaactccttatgagatgcctcccagagttatatcggggagctggctctcccttttgtttccggggccaaacacagaaagaaaacaccgggggctaaaatatccttttatact

SEQ ID NO: 29685 - DNA, 756 bp, Oryza sativa
  unsure (1)..(756): unsure at all n locations
gcgcccttgaaatgacatctacttgccgcangcctgcaggtcgactttagaggatcccctactaccgcaaaagaggtggaccagtacatattccatcccagaagaagttatccgtcaggactggctggccggtactatcaaatttataccaatacaactaagtatggaacagtacatatatactaaatatatctactgagatcggtccccataattatatcgcagtgctacaaacaaccaccaggaaccaacttgtgtggttattacgtgtgcgagatgctcaaagtaaatggaaggtacaaaacaaccagtaaccgagcaggtcatcgaactcttctctacaaagaaacccatctcgcacacacttctcactgagtaccattttattttcctttctgtgtgcagatccccgaaatcccatatattgcacaacgattcaacgacactactatcttgaacgtggccgctgacctatgccgattcatccttcgtgatgtctgcaacgcaagaggtcttttctacgacaaccagagtgaactcacaatggacgacaaatttaaacctctcagagagtgggagaaagaacatatgcaataacatgtacactacttatacatatgcaataacatgatgaaaaaactgggccacttgctattatatattcgaatgtaaattacgattgaaaataatgggtatggattacatgtttggtactgcgggacttggcttatcttatatgcttactacttcgaaata

SEQ ID NO: 29686 - DNA, 1277 bp, Oryza sativa
  unsure (1)..(1277): unsure at all n locations
acgtttgatttganatcctctacnccatgcaaggagggcgactgtagaggatccccgaatcggtaacttatatcaattactcctaattgatggatggttgatggttgtgtattggaggatggatcatggctaggtgatgacaattagttgctctattcctcttcctattccatttgtaacctacatcaattactcataattgacggttggttgatggttgtctagtggaagatggttgatggctaattgatgagaattagttactctattactcttcctattccatgactcttactcttcatcttccatttctcatataaaatgagaatggatttgatcttccaaaagagaaagtgagacacactttcatccattttccaacgctgttgatgctacggtaatcccatcccgacgagtgtgtgcacacgcattgggagagtaggcctccaaaaccacgcgctgatgcgacgtttgcacggacgggcgggcgatcaggtttttgggagcgtaaggcgcgactactcactgttcgtcaacatctacttcaccttcaccaatatgtcgaacacttgagacaacggcaacactgcatacaagcagaagaaggctcccgtcaacatcaacggaggtaatgctgcctcaaactccagcggaggaccattcttggggtataaccttcttacattattcaattagaagttttactggtgatgttcatcgcaatgtcaacattgtgttattatgtgactgttgaggctaattctacatgaagcatgctcatgttgattacattcaccattatcgctggatcaaatcccattgtaaatatcatgttgattatcttgttattttgaattaaaatatgccgaattatgaccaaatttccaccagctatatggtccgcctgcgaaaatatagcatgcccgcctgcaaaattaaaaaatgcgcctgcgaagatagtacaaatatcgaaatttgtacaatattaatttctaataaatgtttttcattgattaactaatggtgcgtaatattattagaaaatacaagctttgttctgacaatctcactttattgcaaaagggaaaggttcgcaaaatattaaatttttaacatgccacttaattcgctttaattcattagggataaattgcccactccgagaatttgttattggcctgtatatggcaccttttgcacaaaatttttaacaaaaaactcccgcggagaatgtaaaatgcccctattttaagggggtgtggaaacgggccccccct

SEQ ID NO: 29687 - DNA, 1617 bp, Oryza sativa
  unsure (1)..(1617): unsure at all n locations
agggcgatgtgttatatacntnttattgagaaagagaaggcgccctccacaagatatttataaaaaaaganaccggtgtcgcgccccccatatcgtgttacgcagaaaagcacaaaaatataatatttctttagatcacgcgggggggtggggggcccaccccgcgtaaaatatatgtttcgcgcggaattaatatattatgtgcgcacttatagaaagaggcactttacaaatacccagtccgtcacccaacggggggtaatttcttttcccggtatatgggatattcttattaaacacggttaagggtaaaaacccgggctataaaattatggcccggccatatgattttcggctttacataggcgtttaaacaaatagaagttatggcgttaaccatattttaaaggccaaagatttaatgccagtttatttcgaagaataatttgttgtctgtaataaattaagtggataaatcgtaataagcaaatatatgacttataattaataaaaattccaatatatatatatacttagcatatatatgaatgatattattatattggtaaaaactctaattaagatatgtatgtacatactgcatgatttaaaattaataaaaattgtaatcatcatatatacttagcgtaggaattatattaaattaaatgctaaaaactctaattaacatatgtaaatgccacatgcatgatttaaaccttttaaaaattggaatagtcatatataagtagcatatgaaagatagtaaattaaattgtgaaaaactctaatatatgaatgataattttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccatacatcaattgatttatatggataatcaatacatccaaaatagtttacatcgtgtacacaataattacggcattacatcggcggtgacggttgaccgcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtctttcacgaaaaagacttgcgttacatcattggcaaggacaaaaggttcgtccgagtatccaaccttgttaaggtcaacagtnnnnnnnnnnnnnnnnnnnnnnnnnnnnnnnnnnnnnnnngaatatcgatnttcaacgcgcg

SEQ ID NO: 29688 - DNA, 753 bp, Oryza sativa
  unsure (1)..(753): unsure at all n locations
gagcnacttgaaattcgattgatatccgatcgaaacangccgaattcgagctcggtacccttgattaaagaactggctgctgcttaccatgctgagtgtgtggcatgctgtaaagagcttttgcagctccagaaaaagtgggaggaggtctgtatctgtccttctccaaaatggcagataatcccgtgatttacattcctcgcattattttcaaacggaacatatgtaacacgaatcctgctcttccttggtcggttgtgcaggagcagtatgttgaatttaagatgtctgatgaagcgccaaggacgttgacagtgaagtcttccaagcgcaggaaaaggtagctttagaaggcatgaatttgacaggagctttagatgttggaagttaacagaaagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatcccctttcttgattaactactcgttcccttcggccgttcgcttcgggaag

SEQ ID NO: 29689 - DNA, 7574 bp, Oryza sativa
  unsure (1)..(7574): unsure at all n locations
gctgccccgtgaatgacggatcgcatgaggcgcaacccgagctcggttcccgtttcctgctccctgcccgccgatggacgccactgtcccgtacattctcttgtgcttgttttttatagcatgctctcaattttgtgcttttctttggtaatcgtagtataaactcctccagagttgattctgagcctttcagccatggcgatctggttcttgatgatctgattgcatagatttggtctcttgtggaggggaaaatgttttccggctgagcggcaatggcaggtgtcggctacacctagcaagagtggcagtgccagctgacaggcgaacacagacggatgacacactcaaactgaaggaagtagcacggaatgaagaaattcgcagtcctgatggcaaaatttgaaaggcttacgggccagtgaattggatggaaaatactgaatttctcacctacctacctagtcaaccagatttatctgaaaaaaggaagaatggatgtattcaccctgtcaggctagtgttacgaatccactccatgtgatttagtgaattcctgcacaagcaaacaattcttcctccaacactcgatacatgagtatttggggatacaaatgggggaaaaggaatcaagactgagaatcagcagtaggttggagaagaagacatagctagagattggagaagagaagagagatacagaggttgaagaagagagagcatcggaaggaagaagtcaagtttcatctgttctgttctgttccctccccatttgttggctctgctccttttgtagtggctggagtggtcggcttgtcgccggattgggcctagccagccctgagctcaatatgcataccaatccggcccagttacatgacagctagttgctacatgaacaagatactgttgtatatactattgcaatgatactcctctataactacctacctagaagaatgaatagcacatccctcaggaagaagtgtataatcagcaaccatgtaagtttcagtagagaggcagaaccaaacaataagcaactttgcaagggttaagagaaagtatggcgggatatttgtgaaaagataatattttgttctgggaattatagcaaaagaatctggatgggagtagtgaaaaggatgtgtggggagataagaagtggacctagcatctgtgatgaagaaaagatccagcactctcccatcaggtgtggtggagaccttcactctacgaattgtgagttccagttcgcacagcactcgtgtcacgtctgcaaagcacagaagcaagcagctccaaattaggcctttttctagtaaaatatcttcactggaagcacttaaatattttttttagggcttagctcgctagtaatcctgagctcctaagtcttgtgaggaattgaagcaacattttgaagaaatgaagctgaagaaaaggtttatggctaaactagtaaatcagtttgttgcaaagagattggggcatatgaattggttgctaacttggtaatttcattcatcattgtgtggtgagattagggctcaaaaaagtaaaaggaaacccatggggcagagaaatgaaaagaaaagaaaaggtagtgagtactccaccatgcaagaggcccatacggtcgtagcagaagaatttgagcaagaagatgttgggagagggggcaggtgcatcgtggtcgtggaggtggagaccagcggcggcgaggtggtggttgtcgaggccgaatggcgcggcgacagggcagagctggatcaacctgtccttgaggaggtcccatctcattgccatggcgcggccgggccttgcaaccacccacagcacgatgtagcaccacctcccatcagtgctcatgtctacaatccaatccaatccaatctcttctcttggactgctataatgaggaaagaagagggaatactagaggaatgttatatattttacctcccttgacgatgttgaggccgaagaggaggacaaggcggcagaggtcgcagccgaggcccgtcttgtcggggcagctaatggtcaccacggttggctcgccggcgacatcgccgtgccggacttgcaccacctcgtcgctgggattcggaatccccatccaattctcaatctccactcactcactaatagctagctacttgttgtttcgtaggagtaccctaataatagatggaaattaatcttggattggaggacgctcgcatcaaatctaacaaaggatttgattgatgtgttgctaattgcgattgcttttgcttgctccaaagtccgaacaaggaggaggtcgtttggtcgtttgggcggcggcggcgggtagagcggagtcaagagcaagagcgaagcgagacgaggaatcttcgaggtggattcccccctttcccctccctctcttttcggatttccggccacttcctatattccaatttaccccttttttttttcttctttgccaaaggcattttattttatttatttatttattatgagatttgacaaacagtaatactgctctctctctctttatatatatatatatatatatatatatatatatatatatatatatatatatatatatatatatatatatatatatatatatatcataatggaattcattcccgttaattagctaggtcaaactttacacatactccacatataattcattaaatcatactcttactgcgacttggtgccggagaaaataaataaataaataccgtggtagcttggaaattggactggaaagtaaatccaactttagaatccttcacagcacgcatttgcgactaaatccactggtcggtcggtcgtctccgtctatatatgtgtgtggggtgatatttggactttgcaatgcaatgacgtgacgacccagccaccactaacctactactagtacactcgacgatcatcatcgatcgaattgttgctcacttggtccacagcaattccaacataaattcattcggtatatacgtactattctccatatactcggcacatgcacattttaatcattaagtacttgttaattagagccacatgcaaacatacttcctctataaaaaaaaatctagatgaagatttgacatcatctaagactataaatctggacaaacatatatccagattaattatcttatgtggtaataggttagtttttttaatgacagagagagtatgcagtaatcttctttcaacaatatactcaatcaatgaccgccccggtaggttaagtaagggtaggtcagatgcaaaagtataacatatatttacactgtagacgcgtccagtaaattgcagctggagtatatatatactccagtatctaactaacacatatcgtcctgcatcacatcactttcttcttaaatttaataaaattattaacggcatgttagttagaaacagtaatattgcatcttgcaatatcttaaccaactcatcaaactattcaagtgaaaaataaaatcaccaaaactcatatagttaggtttcttatgatggaatcagtccacccggatttaaatcctagacttatatgggtactcgcacatttatggctgtgtttatttcacgctaaaattggaagtttgtttgaaattggaacaatgtgatagaaaagttggaagtttgtgtgtgtgggaaagtttgatgtgatggaaaagttgaaagtttgaagaaaaactttgaaactaaacacggcctatggctatattcttttagtgttagccgacatgcccttgacattgagacgtctgtggtgacttcatcgatctcaatgtatatcggctcaatcttttaaatgtgacttcgtcgatctcaatgtataccggctcaatcttttgaatgtgctcatagatgtagggtgtacgcgtgttttaaatgtctgcatttgtaccgtatttaaaaaataaaacccgctcgcaatttagatgtgatatttctaacatacatatatataataaaatcgatagtgaagagaggatggcaacgtagatatattcatgattggagggatgaaaaaaattaggattttaaaaacataagagtaggaaaacgggatatattcaaaagcaaaacatacgattggattgccgtgacatgttgaatcctatgaaaagtagagtcacgggattgctaaaaatatgtgtttggatggctcacaagaaaaatataggatattttagattacgtgttacttaaattgagtaagagcagagggagaaagagtgatgttgctttggaattcccataggagaaagtaacttaggccgagtttagttacaaactttttctttgaactttcaacttttccatcacatcaaaacttatctgcacacacaaacttctaacttttccatcacatcgtttcgatttcaatcaaactttcaattttggcgtgaactaaacacacccttaaaatccaatggattgggggcattggaatgaattccaaaggatttttgcaagtccaagggtgcgctcgttcccacgggcaaccactcccgccacatcgtttttttcgcgcgtgcttcgcaagctgttaaatagtgtgttttttaaaaaaagtttatatataaaagttgtttgaaaaattcatattgatctattttttaaaaaaaatagctatacttaattaatcacacgctaatggcctgctccgttttttgtgccggaaggattttcctgtcactctcgatcggggcccaaatcttacaaaccaaacaatcttcataggaaaaaaaatcctaaggattccaatccttcactgtaacttttttaaggcacaattaacagacgatagcttattggcacatacataaagcttaattgtagcttctttttgaaggtataagaagagacatcgatctggttgtgtgactctaccagaacagcttattattattattattttcgtggaagatgtgctgtggacggtacatttgagtttgacagcgaaatagtggaggaaaataattaagcaaggccgccactgtgacgacgacgatggagttgataattagaggaacaagccaagccacctgcagctgggtgcacagtgctactggatatggtaacgcgggctccagaagcaagcctgcacatatatatactcgttgatcgttgataatagatgagattaagcagcaagcaaagaaacagaaacagagtaatctagtctatatagagtataaaaaatgttgttagttacctctcctcgatcttgatgaccttgtcgtcgtgtttgtcaagacggaatgctacgactaccggccttgaatgtgccagttcgtttgtagtattaccagcagctgctgctgccgagctaacaaaatcctccggcctgggtgcatttgagcattctatttgggactgtactagtggtggtgcattatcatcagcaactctgcaattaattaattttaagccgaagaagaatgtataattaataaatactgaatgtatgaatgtaatcgcgctagcaggtgcaggaggagtggccggcacatgtatatatacgtacttgagcttccctgctgcattagcattactagtactgattgtaccaccggaaaaacgatcctgctcatgaggcagctgctgcttattgacgagatgagacagaggagacagcaccggcgacaatggcaaagactcaacctgctgtagctgctgcttagcagccgcagccgcagccgctggaatgggaatggaggagccgcaaccgcaagcgatgagacgcatgagcaggttggccggcttcaccctgtaaatcgacatggaacagcttcttcttcttctgctgctgttatctgcgcctcctgctgattcttcttcatcatcttccagcatactcctgaagccggaatattcggccattatcagtgactcgaggctccggctgctgctgctgctgctgcctcttcctcctgccgctccctgcttttgggcagatggcgccgcaatcgatccagtaacagtaaaggagctgtcgtcatctgtctgcgttgccgccgacgcaaccaccacagctgctgcaggcctgcgcgcctcgcccactacttgcttctcgtcctctttctctttgctgttgttattatgggacgagctgctgcctgaagaagaggcagaggaggaagaagatgacgacgacgacgatgatgaatgtggctgagtcctacaggaggaggtgcattggtcatcgccaacgacgacgctgttggcgttggcgtcggtggaagaagaggatacaagagagacgtgagcagcagcggcagcatgaggtggcaaagagtgatgagcgctgctgctggtggaggtgatcaagggatggtggcgaggaggaggatcgatgaggtggtggagatggagaagggaggccttgaggacgtagtcgtggggtcctgtagggagcaggaggtcgtccgggtgggagaggtcatgccacacgtagccgccgcggtagctccgcttgcacgaccacgagtacatggccgccatccccttacctcgcagggcgtccagccgccgcgtcacgtctcgcagccgcagctgcacatgcacttgctcctcgccgtcgcccacctccacctccatcaggtgtgggtgctccagccctccctgccggcttcggcacagatagtacaccaccgccaccttcctcctcctcgtcttcttcttcttttcacttgtcgtcgtcaactcacctgctgctgacttcttgctgcgcccaccaccaccagcttctgcctgcgacaaccacgacatcgatatgatacaaagagatcaggaggcagagagagcctgtatctgtatgcatgcagatgcaagtggaataatattttggattgtcgatgacagatcgagctcgatcgatcttcttttctaactgtctgaacaacgatatatatacaacgtacgtaccacgcacaataaagatatatgatgtacctaccagtacatgaatgatcatcgatctctgtttaatttcacacgctagcttgctggcttcttcttcgatcggccagccagcccactagcgtacatttcatccctgtcgttacaactgcgttttaatttcttccatagtaccactacatactagtacaagctaagctaagctttttcaacaacaataattaagatccaatatactcaattcaaatcgatggaggatgcaattgctcgcttgcatccagggaggggagaggagaggtggaggtagcgtactcaagtgaacgacaagcagtaagtaagagcgtagagtacgtacgtacgtctgacaattaagccgttacaaaagtacgtacgatacgacacagttggtggcgcttgtatatggggactgttactccaactactccctccgtcccacaatacaagagattttgagtttttgcttgcaacgtttgaccactcgtcttatttaaatatttttttcgaatgtaaaaaacaaaaagttnnnnnnnnnnnnnnnnnnnnnnnnnnnnnnnnnnnnnnnnnnnnnnnnnnnnnnnnntagaagtcgaacgacaaccatc

SEQ ID NO: 29690 - DNA, 1247 bp, Oryza sativa
  unsure (1)..(1247): unsure at all n locations
ngccgtcatacacgcagcccgcttgctcacgctgttgtcacccgcgcgacaagcaccgatgtcgtggtgaacgccgacggcccacgctggcgcctggcagcggagttggtgtttgagtgcaagacgtgcaacaagaggttcccgtcgttccaggcactgggtgggtacatgacgagccacacgcggctacaggcgaagctgctgagcgaccccgccgctgcggcggccgagaaggacagggcacacgtccacgagtgcgccgtgtgcggggtcgagttctccaccatcaccgctctcactgtcattctatggtctggagagcacgaggaagagagggagaggtggaggaggaggaggctggtggaagaagatgaatccctgataggtgaggcctatatgggttccacttttttttacgctgagtgccacgtaggacgaagacctagtcaatataccatgtggacatgacaagctaaaaccgacagtatatttactccggttttcggatttggggaggtgttatacctggttttatggctgagggatgcgaagcgacgaaggcaagaatgagggagaaaaaatagacttattgcatacatatatagagtagctagcagctgttgggtaacggtaacgcaacgcaggcccagagagcaagaattgaagcaaccgcatgtatcccttcccaccacatccttgatcaaggaacggaagcactcaaatctttgctcctacgcatgcacccatcaattcatatactctattgatccaatgctgtgttgatttgcccgatgcttaatcgatcagagacaatgaagcaacacgcgggctagctagtattagatcgacaaggaggaaaatgaacaagtgcaggtctagcagtagcagtagcaatagcagggccttgtatgctctcctcctcacttctcttatactaacagtaataatattgtacctcccgccttcacctgatcctgtttcccaatcccaattcgaattcgaccaactaaagcttgacgatcatccgccgccaccgcagctgcaccgccgcaggacgaagcggtgcgccgagcacctcaggtgggcggcttccttcgcctttaaacacaatgccaccctcttgctcaccgtcgatcgcaaccaggccgccggttgcgccaacttcnnnnnnnnnnnnnnnnnnnnnnnnnnnnnnnnnnnnnnnnnnnnnnnnnnnnnnnnnnnnnnnnnnnnnnnnnnatcaccgc

SEQ ID NO: 29691 - DNA, 1769 bp, Oryza sativa
  unsure (1)..(1769): unsure at all n locations
cggcgattgagngtcgagctgcngannnnnnnnnnnnnnnnnnnnnnnnnnnnnnntgtgatatgtcaagaaacaaaattttcattccgggaggggagtacggtgacgtgttggaccactctcaaatcttttatccattggaaatctccaacatagcatatggcaaaaaagactacatccaccgaaacaagcgttcccacggacattcgtctgcttgaaaggagatgcgagatggcccacacttttacatatcacatgcgctgattaaagaataccatcaagcgatacattggcgattaacaaaggtggctcaaagataaaatcactcttaatctaattaacttctcacaagaacatactgactctttgcttttaacactattaggaatattgcgggattcgggatacacccccaaacatctgtatagactatactcccttcgtcctcaaataaattgtgaatgagatgggatctaatacagtgaactcttatatatcctcgatgctaggattatgggactagataatatttcatataattttgggctactttagttcaaaacgaagggagtgcttctactactaaagtatcctccatcatgtttttgttaaaagaacagtgctcatactctatcgaataatcataagttatttttaaagaataatactcatcacaatgcgcattaacattgcttctctgcaatgcgcagagagggagagacggtaaataatcatgcttttctggaaaaaaaatgtaaagaaatgttatcattataactaacacggtttcagtgtagagcatcacaaaatacttctcctacctactatcactaaaaaacccatttttgttgctggatggcaacatagcaccatctgatcttggtagacgcaatattattcttactccctacttttatttcacatgcagagatttgagcttttcttaagagtagcgtgcaaattaaacatattccttctgttttttttatgaactaaggctgcgttctttcaggggagatagaggagattgtccctcgttttccgcacgcacgcttttcaaactactaaacggtgcgttttttacaaaaaatttctatataaaagttactttaaaaagtcatattaatctatttttaaaatttaaaatagttaatactcaattaatcatgcgctaatggctcacctcgttttgcgtatcttcccaatcttctctatctcctcctcaaacacagcctaactaacgtaatacattttgggatgtaggagatattgtttcaaccagaagtttaaaccatttatctgtatttttttatgtagacaagtagtatatctcctcctcaaacacagcctaactaacgtaatacattttgggatgtaggagatattgtttcaaccagaagtttaaaccatttatctgtatttttttatgtagacaagtagtagtagctccatactgaaactgttactcaatcagctcgtcagaaaccaaccaaaaaactataattcagtagtttttgctagcaacagtaacaagaagcataggatgattcagcacaagcatagatagtcatgcgatacgatcccgcaggatatgcaaaataacaggagcagcatcacaaattaacaaaaaaaaaagcttaatctcccaaaatgctctcataatacacgagtttggcagtagnnnnnnnnnnnnnnnnnnnnnnnnnnnnnnnnnnnnnnnnnnnnnnnnnnnnnnnnnnnnnnnnnnnaagcgagtcatcaaccctggg

SEQ ID NO: 29692 - DNA, 1410 bp, Oryza sativa
  unsure (1)..(1410): unsure at all n locations
ccccaccagatccatttgtttaatgtacgaagacccaccacagatggtgcttccttattaagttacgcaattacttacaagcatcttccaaagttgaccttacaaagtatctccattcagtcttaatcaggcaggcaaggtcaggtataagccgatgctgaactccccaacctattggcaggtcaatgtcatgcctttctcacttgcttcgttcacatgcgtgcactgaggtacttcccggacacacccttcacctgtggggcaatgcaacataacaagtggtggccgccccctgttcatttacacctcgaactcaccatcgccaacatattacattcgccatgaatttgatgcaccacccagctcccccttttagcccgccctatctagatcgtcaactaaattgcagataatgataagcacaatctggccatcatgcaatgctctctactcttaacctcaggattaatctgccatttcctatatctcacaaaatccaaacaaaaactggtgtactactaccataccagctagagaacattttgaaatgctcagttatcttgcattttgctttttctttagcacggctacatgtctgtaatagctgattcattgttccacccattgtcatgtaaagagtttttgtgtaatagcttttctgtaagggccaaaactagcatctccaacaaatagtgtatccattaaaacaaccagttgcatacaactgatttctatgaaagatttgctaaccattggcataaccacatataaagcgtagaatggagagaaggcccagaatattaaaaaaggtgcacaaccatacctgctgagcatttttaagcaccaatttaccaagtgtccgatggagaactgcatataccaaatataatattcatgagatcagttattacaacagaaaacaagctcttttaaccatgaaaaatctagttttaacccaccactgcagtcaagtaaaagcactagtatttcgtttcacagtatgtggttattttcttccttttggttgctatccttggtccttgctgctattttctttatggtgtggtaagtccataggtggcatgaattttcaagagattttgttttgttacatgtttcagttcaattattttgagttcatgagtgaaagatccctttagcttacaaaagcaggaatactaaatatctcctagagttcaattcaagtatattttaccatctaggatactgtggtgacgaagaaggttcgtgatgatagatccaggatgaagagaatttgcagttatgttgacaccctcatcctgttaaaccaatgatgatagtcaatannnnnnnnnnnnnnnnnnnnnnnnnnnnnnnnnnnnnnnnnnnnnnnnnnnnnnnnnnnnnnnnnnaggcgttcatacgccg

SEQ ID NO: 29693 - DNA, 1323 bp, Oryza sativa
  unsure (1)..(1323): unsure at all n locations
cgcatggtttgattgttgactnnnnnnnnnnnnnnnnnnnnnnnnnnnnnnnnnnnnnnnnnnnnnnnnnnnnnnnnnnnnnnnnnnnnacagaacgcatgcgtttcaatttggtatctctaaattgatgaccgatcaatcgggtgcccctatatacagcatattcttagtgaatcattattgtagggcttgtgccaaattaagtgtgaatcaacaccgaatacatatagcgtgaatcaagctaggccccacgttagaggtctgtccggtagtacattccctataataaaaaacggattcctctctatggaattggtgataatagttaattattactggtgatcaaccaccatgcacatatgcttcatgcatgatcaactaagcccactcgaatttatgcatgcaaataccttttatatcatgctacaacctatgcttgtgtctaaacctaccataacatatgaagttgcgacttaagctcctttctctgactcgtaccgagccgtaactctccaagcgtactgtaccaaatctaaaaacgatcttcgctgaaatgtaattaactgacatttacttcatccatcttcattttttttaaaaaaagtgcacatgcacgtaccacacttttacgcccgctacacacccacgttgacacgtcctggcaagagttcaaagataaagtcataagaaaatacgagcacatatgttatgttcggacttacatcgggctagaccataagaaattgattttaacatatgggtgaaattagactccttcgtcctaaaataaatatacttctctagtttaaaaggagcacactaatctaagatggagggagtacgtaattgattgacatgatctctctagtatttaataactttgaccatatgcattggcttctcttagtatatgctgtcccacaaattatttgtcccaaaatcagattaacttggtttaaaaagtatgtaccttattcatagtcccagatttatgttctttctaaacgtgtagatcaaatattcaaatatagtcttccattttcatagagcaatgatatataacataatatttttttagaaattttaatcaactagcgtaatgcctaatgcccgtggtgttgcaatggatcttcttttttttttaaaaaaaaagttcattctatatgtttttaaagcctctaaaagaagttatttctattgtctaatatgtcatggagtgatgaaaaattttataataagggtnnnnnnnnnnnnnnnnnnnnnnnnnnnnnnnnnnnnnnnnnnnnnnnnnnnnnnnnnnnngaagtgaaagtcaataacctg

SEQ ID NO: 29694 - DNA, 769 bp, Oryza sativa
  unsure (1)..(769): unsure at all n locations
atggttgaatgcagctcgaatnnnnnnnnnnnnnnnnnnnnnnnnnnnnnnnnnnnnnnnnnnnnnnnnnnnnnnnnntatatattctagtgtaaattggtaactcgtttttagacactttctattaaaaaataaatacaaagcagagaacggtatgaaatgtatacaatggtgccatagctttgatatacacgcactaattaaactcagctctacctagctacatctaatcggaaaaaaaagcctcccttatctacataatagcttcccttcatccacaataagttcaaatgcgctacaaaacaatctgcaataaaaatatcatttaaatgatctccaataaataacttctgtcgtatcaccagtaatgaaaaccacaagccctttagtgttgtactgttgttgtatactccatccgtttcgaaatgtttgatgccgttgactntntannacatgtnttgttctttgttttatttaaaatatttaantaattattaattctttttctatcatttgatttaatactcaaaatatttttatgtaagcatataacatcacatatttcacaacagactttgaataaaacaaacgttaaacatttgctcaaaaggaaaccgcgtaaatctttgtgaacggattgagtattctaactgggtcgcactagagcggcttgtgttaaaatatctggctttttgtcgaagttttttagagaggtcttccaataaaatttgtgtaagtttggtaaacagcgccttgaactgaagaggcg

SEQ ID NO: 29695 - DNA, 762 bp, Oryza sativa
  unsure (1)..(762): unsure at all n locations
cgacgggatggatcgcttnnnnnnnnnnnnnnnnnnnnnnnnnnnnnnnnnnnnnnnnnnnnnnnnnnnnnnnnnnnnnnnnnncttgacttttttaccctaaaatttgtgtctggactattttctcatccaatccgtatgtcctctgtaataaaatctcgcgtgccataactattttctcatccaatccgcacgtcctctataataaaatcaatagtctggctgctgatggtgatgatgctgacttgtgacgagtagtccactgactagggtagacagtactaggacgaggcaacagcgactgcgttgtcccacccacacatcttgcggttgcgcggcggagagagagattgatgatgtcttcttggttgttccggcggagtgggccctcgggcttctcgtgggcctccaccgccgaccaagtcaccgccgggctctccgccgccggcctcaccgtcatcgtcaccggcgcctccagcggcatcggcgccgagacggctcgcgtcctcgccatccgcggggcacacgtcgtcatggccgtccgcaacctcgccgccgcgcagcccgtgcgcgacgccatcctggccgacgcccctgccgcctccctggacctcatggagctcgacctcgcctccatggactccgtccgcgccttcgccttcgacttcgccgccaaaggcctccccctcaatatcctcatgtactagtactcctctttcaatgccaagtacaanatccctcatttttcacgttagaccagca

SEQ ID NO: 29696 - DNA, 2990 bp, Oryza sativa
  unsure (1)..(2990): unsure at all n locations
cagtgggcaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtattaaattcttaatcaagctatttcaaactaacaccgctagccatgcagtctatactagaatacactgatgtcccatgatatcaagtataccaattaattcgatctggtttttctcgatgatttattaatgttttgacttgttcacattactactcttttggtacaatatagatttccaagcatgatcataaacgaacttgctcctgaattccaggtgtggaagataccccccagtggtgaaaacagctgtgcctgtggatggtacatttgagcatatagttctttcctgcaatgccacaatggaccatgccattatttggatcgagaggcaaacacaaaaggcgttggatgtaagaaaccgtatattgccaacctttgtttctgtggattacaacttacaagcatgtagcacaggcgtttttacatcccattgtggttgagacggcgtcgttagattcatcttgcaagttgcttgttaaatgtctgatggtgaccatggctgtgcatatgaacagttgatgcttgagaaggagaagacaatggaggtgccatcggagcagaggatggagaggaacgagagcctgcagagggagcacgtagaggagcacaaggcagctctgcgcagggctgtgacgctctcggtgccggacgctcggtcgccgtcggcttacggcacctttcgcgagcagccggagagaagcgagagcttcccgccggtgtcagcgatggccaggcagcgtatgagctggaacgacctcatcgagcgggtcttcgacagggacgagtcaggccacattgtgctgcgcagctcaccttctccctagctgtgcctgtacattccattccatcctctttcttcttcctttccttaccctggtatgcaccttttcatcatctctttttatttttttatgtatatgcaacttcaacttctgctgttattttttcttccttattattcattcatggtatctaccgacgcattttttgctgtccatatttctcttgtatgtatatctgcctagtggtgggtacgcttttccttttgttttacatctttttgtgcccaacttgtatgctcacactagaaagaagaaaacattgttttctagaggaattgtaagccgttgttataaaatattcatgtaaaatatggggaaaactcagagaaattctcggtactgatgagcaatgcaatgttttgacagtaagaaacatgcatttctcatacactgtagaaaagacccaaaaaaaagcacatgtatgtattgtatacagccaagatcctcgagtgacattccaccaacaaatacaaacacatacaccgcgagaacctttgctaactccattaatgtcgcttgctccatgataaacatgcatcagcacattctcttcaatacagcctcaaatctttcagaaggataccacctgctcacccaatcctcatctcatgacaaatcaaatatgtctgccgcatcgaaagaaatacacctgcttccaacctcattccgaatgaaaccatcaattttctgcatgacaactctttgccaagggtatgctttacaccatggagccaaaccctctatagttcaaaaatctgctgatggtatactacaacaacctacgaaacaaaaatggcatctctgttcccccatcataagccataaggcctatgccaattacaatggcatgtatatatatgtatgtatgtaagaaccctgaacacaacttatacctgtagatcgagaactgcttcacctgcaaacaaacatgacaagattcataagtctgaggtttacgtcaggtggaaccactgtcagtaaacatggtctgctaagccttaccatgcattctcttaacgaaacgctcaaattccaaaaaattagctctctcgaagaggactttggtgagcctcaggtacgtgaatcctagtaaatgcctcccatctggatcattcagtggctttgcattctccaaaattttgttaaagccatctctatcgtagcaaggcagagcattctcactagctactggtatgccagcatcccatgcagcatttagcacctgaaaatcgatacgtccaattgataaggcattgacataacaacaagatagctggtctcagctaaacagaaaaaaaatacattagcctactaagctgctaccaggtagatgagaaagcaaaacagcaaccatggctaggatgatggaaagttccctacctgccatacaaggccctctggatctgcaaaggcctcaggaaatacctcatgctgatccatagtgcgcagttcaacacatgtaaagttcaaagctgcaccatgttttttcaggacagcagcaattgaggcataaccatcacggttgcatgggttataaaacccagcagtcaattcagcagcatgactggcagttttgtaccaccagtgtacacctgaaacctgtcataccacaaagtgtaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 29697 - DNA, 1760 bp, Oryza sativa
  unsure (1)..(1760): unsure at all n locations
ggtagagcagnatatttaggtcaaaacccttccagnggttgatgccagctctggcatagncaacggtaatgaagcatactntggcttacacatccatgtggacagtgctgctaaaatgaaaggaccagtgacaccctgaaaatgtattcacattccacttttagatcactgtttatgatcaacacactgatccagagacattattgcacatattttctggagttacctctatatccacatctgccaaggacaaaattgttttggcctgatccaacgtaagctgaagagcgtgacaaataaattcaatgctatgagaaacagttaaagtccagcgcatgattaattattatgtcatctatataaggagttgttactcaacatgcatgcatatggactagtatagatgcacatgcacttcatggtgtcaagataacaaaaacagaaactagacagtgaaaaatgcatgctggcggtagagtattcttcacgtgaaaagtacggaagcatttaatagtcaacaaagcttcaatcagtgaaaacattactcaatttaataaataatattgcgattgaacttaatagaggaagatggtgatgttatgatgggcatttcattcaagaataacttactttgtcccagaatgcagcaatattgtctctgttcttcaggaaatcctacagaacatcgacaaatgtcactgcttgcaatgaatgactgaatggtaacagggaatagcttaaatactagaaacgaagtttaatatagtatttagttgtactgacaagtccatgtacatataatcattttgtatgaacaccttttctatccgaatcccccgataaatgtaatcttagccaaaacaaaaaagggaagagataaaagaggaaccttttcaatttggagagttcggcggtgaacacgggtatggcgcctgtagttgattgaggagcaaaattccctgggacacttggtacacttttgcaactgaagcttaggaggcgaaaacaatggccatccaggaagatctgcgacaggggaggacctaacgttgggcattgctgaacccgaagaaattgccactgttagcaatatacacgcaatctgtcaaaggaagaaatcgagaagaaaccaatccaaatccggatgtgttgttgaggagggagggagggaggagggggggatttcgggagaggaatgaatgaatataccttggattggattggaaccgaagatgagaggcggcggcggcggcgcaggaggaagggaagggaagggaagggaagggaggatcgatcggaaattcggtttgcagatgggatgggtacagaacagtaccctagaaccaaccaaccccaaatgaaccgcaagggcttcttggtcaattctcccttctctcaattgaattgaaattataataatttctcagtaggaaccacattttcttttaaaaatattgtatatatctttgtttttttaaaaagctaggtttgtttcagtttaaaattattataatttagttttttgagctagattactataagctactcccttcgtccaaaaaaaaaaggcaaaccctagctattttttggacggagggagtagattataataagatgtgagctgtttttatttctatagattattggatgcatggaggctaatgtctataatactcttaattaatttggatatcttgtgttactgtatattacaagtctatattttgagtggcttaaaaattattaattaataaaacatt

SEQ ID NO: 29698 - DNA, 1774 bp, Oryza sativa
  unsure (1)..(1774): unsure at all n locations
nnaatcggatacgacctactataaggcgaattcgagctctggaccctgctatgaatgtagaatccacagaaacaaaggtaggcaatatacggtttcttacatccaacgccttttgtgcttccctctcgatccaaataatggcatggtccattgtggcattgcaggaaagaactatatgctcaaatctaccatccacaggcacagctgttttcaccactggggggtatcttccacacctggaattcaggaacaagttcgtttatgatcatgcttggaaatctctattgtaacaaaagagtagtaatctgaacaagacaaaacattaataaattatcaagaaaaaccagatcaaattaattggtatacttgatatcatgggacatcagtgtattctagtattgactgcatggctagcggtgttagtttgaaatagctgaattagtaatttaatacggacagcataaatggaatgatatgttatttgcacgtcctcttggcacaataaagttcaacaatcaaagctactagcatagcatctcttctatgtctaatagacctgactactatcaaaatcctaccaaacaagccattaaccttttaatatcagtacagtcagcaaattatatatttcaagaggggcctcaagatatttttgagttgtaaaacaccaaacaaacaagaaaaaagggagtacctgaacatttttctctctacaatgtgatatatccgacctggtgcataaagcctccttggatcttttaacatagcatcttcaggtatgcaagtgtccctcaaacatctgatacacagcaggcagggcaagctgcccaaaaagaggagatgatccaagtttaaacttgtttgaacccaataagctggaaggagaaatgaagctacatccaacttactgcatagcattgctacaagcagagaaacagaaaaaatcggatcaaccaccccatcccaaactaaatgtcattttctatctccacttttctaactcactggtgcatttgcactgtccatcagatcctctatttccttcctcaagtcatactatacatatcagctattagctgctaattgcttgggtcaagtcagatactagctgtgattactgaagtataaacagagaaactttctataactttgaaaatcacaagtaaacggcatcaacttctttaggtccctacaaagctcttacatagacatccaacaagaaatattgtgcaatcgcataagtttcaggcaattattagccacacaagccagcttaagtaataactacatcagttagcaaatgaaacaatggatgagcacatatgttaccgatctgcctatggaagccatctcgacaattggaattaacaagcagaaaggtagtgatggtatttactgtaaaaggataattaaatgtgactgtaatcatatatgtgatagtgctgccttgtatgaccagtgtacaattgtgtaacgctgcttttgtaaaagattggtgggcatgggcatatatgtaccatagaattgacttacaaatgtcttctaaaggagtggctgtctgaggcaagaaatcatcctgtcaataaggagcgataattattttgttgagacagaagatgaagaatgcagatcaagtgtgatgtggtaggaatggtgaggaggaataagcaagtatagcaggaattgaaaagggnnnnnnnnnnnnnnnnnnnnnnnnnnnnnnnnnnnnnnnnnnnnnnnnnnnnnacaggttccatcaggcgtcaatcgctcg

SEQ ID NO: 29699 - DNA, 1053 bp, Oryza sativa
  unsure (1)..(1053): unsure at all n locations
nccgccatgaaagcggcgcttgctaagncggttgtcaaggagaagggcgtagtcggtctccctggcaaggttgagnccgcgaaggtcgagnacgatgtcgaagttggggtggtcaaggtaaagaaggtagggggtgacgcggccgcgggtgtcggcgtaggtgcggcggcggacgacgcagcgggcgtcgagggggtggcaggggtggtggtcgtagttggccatgatgaggcgtcaaaggcgcgggacgggggcgaagtcatcggcgaaggcgaggccccaggtggcgctgtcgcggtcgccggagtgaaggcaccgcttccacgcccaccgcgcgcatcccaggcagtagacgcattccagcagcgggagcccgcaggcgagagacatgcctctgccctggaggcggagccctgctctgcacgattcgagatcactactcctcagtcctcattctccactgagatcgctggagtgcgtggagcgccgccattgttgccgccggcgccgcggattggagttggaaccgaaccgaatcgaatcgaaacttggattcgccgtttgttcgttggtttggtgttcccggcgtccaagaagaagcgagaatttgatttggtttggtagaatgaatggcagtgggtatttcgctcgctcactcgctcttgttgtctcttttaggagagcttctatggacgaaatggggatcaactccaactgtacttcactcactgttaactaggactaggagtatatctgctgctaataagcactgttgacaattccatccaacagaaccacttgatcgaatcatatgctaggaggaaacgacctgagagagcttctattgtcacacttaaaatatcatcgtatcgatcattcaaagtcgtgtatacgtacctactttggatccttttattttcttttccatctacacctactcgtactctctctatatataatagcacaagnnnnnnnnnnnnnnnnnnnnnnnnnnnnnnnnnnnnnnnnnnnnnnnnnnnnnnnnnnnnnnnnnnagaacgtgcaatcaacccg

SEQ ID NO: 29700 - DNA, 773 bp, Oryza sativa
  unsure (1)..(773): unsure at all n locations
gcgcgtgatgagacgcctnnnnnnnnnnnnnnnnnnnnnnnnnnnnnnnnnnnnnnnnnnnnnnnnnnnnnnnnnnnnnnnnnnnnnnntcatttgggtacctatcataaacgggaatgccaggggacgggataccatcccccaacgggatagctcctcttccaacgcaattcctgctcactcgctgccgttgccgttccgcgtcgccatcgccgccacgcccatcccacaccgncgccgttgctgtaccctgccaccaccgcgcccatcccccgtcgacaccgncaccgncaccgngcccatcccccaccgncgccgttgctgtcccccgccgtcgccgcgcctgtcccccgccgccgccgccgccgcggtttcagtcctcgtctgcaagggacggctgcaggggaccgactgcgcgtgtcgagatgctccttccccaacgggatgcccagctatatctagtaggaatcacctgatacctggtaggtatcatccaatacctcgcaagtatcacgcgatatatggtagaaatcgtctgatacttgacaagtatcacatgatacctcgcgagtatcacgctatacgtggtagaaatcatctgatacatgacaggtatcacatgatacctcgtgagtatcacgcgatacgtgattgaaatcgtctgatacctgacaggtttcacatgatatctcgcgagtatcacgcaatatgtggtagaaatcgcatgatacctgataagtatcacatgatacttgcagggtaccgagctcgan

SEQ ID NO: 29701 - DNA, 757 bp, Oryza sativa
  unsure (1)..(757): unsure at all n locations
ggcgncattgagtgacaatcgactctcaaagggngcatncgagctcggtacccaatttcctcatgaaaggcttcttatgctgaaaaacattcgactgactagggcaacattttggttcatccagtaaccagtatggaatcaatcatttttcaaaactgcattggaaggacctcggtcattcatatacatattgcatatgaagtaacatttttgcaacaatagaagaagttctgccttttctggttataatcttattactactgaaacatgaatggtcctgggaatctggctcactttataagcaaaaaaatcactttgatagcttaatttggttcaagtttatatcatctgatatcgtccacatcaaggagatttattagcaccagctgaaggataaaatacattaatagtgaaggaggaaaccaatgctcttaccttcttagaaataacattactcattaacttctccgaaaggtgtacctgtaattacaaagatagggaataagtttgtgtatgtctggaaatatatgatacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcaaaggg

SEQ ID NO: 29702 - DNA, 7946 bp, Oryza sativa
  unsure (1)..(7946): unsure at all n locations
cgggctttgattgccattcacttaggccgaatccgagctcggtacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagtttcgtcaattcaagatgtggcgcgcaagcttgctgattatgctaaaattgtcacagtatcaactagttctggtaagccccttgcctttttaataattttgtaagttactattatttatttatttcaatcgtcagtttctgcaaaagtggaaaattgagagggtttggggggttagtattgtattgaatcgcattggtctttcttgtgttgttagatgccatcaaagatcaagatcgccccctgagcaccagtgaagtattgtcaccggatagtaaagaggatgtatttgtgccagaagatctgttccttcctgggactctgtattacctcaagagggacattgaggatataaacggtgtagaagatgagtcgtatacactctggagaggtgatgccggggagaattttcagaggatactgttatctggcaatctgatatccgatcacaaatgtgaaagcatatattacgccctgagggatgtgctcaagactctgccgccccaggaatcaggatgacaagtagaagttccttttcaagctttttgcaggataatctccatctattctgtagtttgtcatctcgatacaatagaggaaagcatatttttgttgctccttagttctcccatgggtaaaggcgaaagtctgccggctttgggggaaatagaagaatagagcttgttgtacagttttgtgtgtgtgtgtgtgtgtgtgtgtgtttgtaagggaaaaaacaagaataatagagaagaaatgcttaacactatcttgttgcatgcagtgaaagacattgcagctggtgtagttactttgactaattctccccaagttttggaagaaattattactgtgtgaaagtagggactaattctccctaagttttggaagaattattactgtgtgaaagtaggaacacataagtaggaatctgctcgttgtgctagtcaggtagtagctactgcgttcttcttagggtaacacacaaggaacacaaattgtgagtgtgtaatgtgttgttgttcggctagaatcagtcagtttcagagcaaggcaatagctatataacattgagggctaagagcatagttataaataaatgttttctaacattggattgttattgatacaagaagaagaacggaacaatgtcacaaaattccttgtaaaaggaagaaaatatactctagtaagtaagtaatctaatataatcagttggcgtggtcgtcggcgagctggccgcagtcctcgatgaggacgcgctcggccgtgccgccagagccggagccgacttgctccatcttctcgacgacggtgtatccgtcgacgaccttgccgaaaacgacgtgcttgccgtcgagccaggtggtacgcgtggtgcagatgaagaattgggagccgttggtgtttggccctgcgttggccatggagagcacgcctgggccggtgtggcgcagcttgaagttctcgtcggcaaacctgtcgccgtagatggactcgccgccggtgccgttgccgcgggtgaagtcgccgccctggcacatgaagttgggtatgatacggtggaaggcagaacccttgtaatgcagcggcttgccggaggcgccgaggcccttctcgccggtgcagaggcagcgaaagttctcggccgtcttggggacggtgtcggcgaagagctccatgacgacgcggccggccctggccttgccgatgaggatgtcgaagaacaccttggggttcttgctcgccatggcttagcctggaggctagttcagttcagttaatcaaatcgaacgaatactcctactactccattacatatatacaatctccataacatgctattactagtgaagtagaagcaaacaaagattgataaagaagaacaagtgaagtgtggacaacatccatccatcccagatgcctaatggaggcggcaaaggtgtggatggagaattgacaaaatcgatcgatcttgcacaagctttgagctcattaggccttttgattactcgacgcctaaaagccttcgatatgtgcgcaccaaattaaagcagcagcacgcaaaggaggaagaacccacctggaactggaaggaggagatcggcgcgtcggcggcggaaacaatctgatgaggaggaagaggaaggggacggctcggcggcataaaaagacctcaggaaagagtttagggtttcgtccaatgggcttaatgggctaggcccttttgagggactttgttgggctgtgcaagtaacaagcccagcccatttcccccaactaaccacttctgccttctctctcctttcgtgcaaaacagttctttttcgtccggcaatacaagatgtcagaaatgtggcgtgcattcaacctccatcgaccgtgcccatgctgcgccttcaggttttcttcctgccgtgctttgggtttgggcgttctgaaatcatcaaatatgatgatgcaatctttagaaatgtttttatttgaaagcatttaaacttaggctgagtttagttccaaactttttcttcaaatttccaacttttccatcacatcaaaactttcttacacacacaaacttctaactttttcatcacatcgtttcaatttcaatcaaacttccaattttggcgtgaactaaacacacccttagtaagatgtttatgttacttcaaacaatttagacataactgaaaattgaaacaaaataaaaagtaatcgcctcgtaattgatggtgtaaaacttatgatgggaaagcacaagtggcgtgagggtggagacgtggatgtatgacttcatccaccagggtttaaatccacccacgaatattatgtacctgatagggaacgtatttacgagtgtggtggagtttgtttcgcgtgtgcgtctaccatgtaataaaaaaagtgtgtgagtgtaatgtgatgtactccctctgtcccaaaaaacctaatcctacgtttgaatccagacatagtgagtgtgcatcttctgtacaataaaaaaaacttacataacaaaacctacctactttcttgaagagatgcacaaaaagaaaaatctgataaagcaatttccatcgtcccggttaacctgaggtaaaaaagggggctgctatataacggaatcccgttttcgaacaggatgatcccgagtaggtatcaggtgtgatacctatcaggtatcagacgattctacacaacaggatgatcctgagtaggtatcagacgattctacacacgtttcaggtgatacttgcaagtatcatgtgatacttatcaggtatcatgcgatttctaccacatattgcgtgatactcgcgagatatcatgtgaaacctgtcaggtatcagacgatttcaatcacgtatcgcgtgatactcacgaggtatcatgtgatacctgtcatgtatcagatgatttctaccacgtatagcgtgatactcgcgaggtatcatgtgatacttgtcaagtatcagacgatttctaccatatatcgcgtgatacttgcgaggtattggatgatacctaccaggtatcaggtgattcctactagatatagctgggcatcccgttggggaaggagcatctcgacacgcgcagtcggtcccctgcagccgtcccttgcagacgaggacggagacggcggcggcggcggcggcgggggacaggcgcggcgacggcgggggacagcaacggcggcggtgggggatgggcgcggtggcggtggcggtgtcgacgggggatgggcgcggtggtggcagggtacagcaacggcggcggtgtgggatgggcgtggcggcgatggcgacgcggaacggcaacggcagcgagtgagcaggaattgcgttggaagaggagctatcccgttgggggatggtatcccgtcccctggcattcccgtttatgataggtacccaaatgataccttgcatgtatcgtgatgatatctaggagatatcagtgagtgatgatacttgtacttatccgggatgatacttatagggtagtagtgtatcgacgatttattttcatgtacacaaatgatacctgataggtatcgtgatgatacttacaaggtatcaatgatggataatacttgtaggtataagtgatgaaaaatatttcagagtaaattttcaaagttacactaaatgaagcaatcaagcaaatttaactaaaaaagattaaaaggaaaaaagaaaaaaaagattgccaagcatggcttagtcaacatgtcattgcctagtttaccatgccatgcaacataacaatcgtactagtactacacacaaaccacaagatgatgccatcgggattcgaaagggtgcaacgtgtaggcgtggcatgggcggggccagcattgagtaagcaacgtcgtcttgtgatcgtgataaagcgaatactagtcaagcatgcgcgtgtgtgtcgtacggatagtgcaatggggatgatcccgttccgatcactaccaacggtataccggtctctagcatttccgggtaaaaaaacatagtcccggttaacatgagtgggaaaaaaaacacagtttcaacaaggtaaagtcaaatttgagccttaatttattttttcgttaaaaaaaaaagaaactgacgccctcaccaaaccggcgatgaatgagtgggggtgttgtcgttccttaagggctaagctgttggaaacaaacaatgcaagaaaactgccatttggtaatattatgtatatagtccaaaatgcaattaaactaacaaaaaaatatttaattggatttagtagggatgattgatggatgacccaaggaaagaagggaggaaggaaggagcgaagagcgaaggttgaggtgagcaagcattgacaagtggaagcaggcccacgctgcagtcggtcaaacatggcagctcctccaccagccaaatcgcgtccagtcaccacctcttgttcggttcttccccatcaggccatcacccacccacgcgcctcgctgacctgccctcctgacttgccttaccattaaaaagcaaggggagcacaagcattattacacaaagcaaaagcactagccatggcagcgtcgcgctacgaggtggaggtgacggtggcctcggcgcgcgacctcaagaacgtcaactggcgcaacggcgacctcaagccctacgccgtcgtgtggatcgacgacggcgccaagtgctccacccgcgtcgacctcgacaacgccgacaaccccacctgggatgacaagctcaccgtccctctcccgccctacacccgcctagacgacgccgtcctctacctcgacgtcgtccacgccaacgccaccgacggggtcaagcccctcgtaggctccgagcgcctcccgctccgagacgtcctcgccgacaccggcataggcgcccgagcctcccgctccctccgcctcaagcgcccctccggccgcccccatggacgcctcgaagtccgcgtcgccgtccgcgagcccaagcgctactacgacccctcgccggcgtaccctgctccctaccaccagcagtcgtcccgtgacccctacgcctacggtaacactacaactggtggctatggctatgcctatggcggggcccctccggctccgtactccgcggcccctcctgctggatacccgtcggcctatggaggagcggctcctactcaacctgcctatggctccgccgcgccacctcaacctgccgctgtcagctatggagcgcctcctgtggatgcaaagaagaagagcaagatgggcatggggggtgggctggcggttggcgcggcggccggcgttcttggcggtctggcgctggcgggcggcgccagctacctggagaacaagtttgaggatcgcgtggcggagcgggtggaggaggaccgctacggcggcggcggtggtggctacgacgactacggcgatgacgactattaataatttatatgatattcgaattgcacttgcaggggagtcagattattgtaattgagtcttgtgtttttatcatccttgtcttacaaatcaatatcaaattaaattaaaactcgtgtgtgtgtgtgtgtgtgatcctagctagctgggagtatatctcgatccgtagagttccggcgtcgacggtggcagcgcccactggttggcgtcgatgtaggagacgtccatgaagggcgcggcctggcgctggtcaagctgccgcgcgtaggacaccctgccggtggcggcggtggcggatccggggccccagcacgcgtactccgcgaaccacacctgctgccgcctgccggggtcgccccagtcgttccacccctccgccgacaccacgttgacgaggtacgttttcgcgaacaccaccgtcgcgtacgggccccacgccctccccagccacacctgtcccgttcccaccacgctgtaccgcacgaacgcgaaccccgttctctccggcgacgacgccctcccctgtgccgtcacgctccccgtcacttgctttatttcccgtagcgctcgccatgggcacggagcttatggtgcaacccacgtagagggatcgtgcgttgcccaagatgaagtcgatggagcccttgatgtagcagccgcggaacaggtgccgcccggactcgtccagcagcgtgtcctgcgcgctgtacaccccgcaccagtggaacgccgcctcgtcgccggccaccctcagagccaccgcctgcccccctgcgtccccgggctcgggcgggggcgacgtgttctggaaggtgatgttgtaggcgacgaaggcgggggcgaggacggtgaaggtggcgctgtacacggtgctgccgccggtggagttggaggtggcgttccaggcgacggtggtgttgaggttgccgcggccgtgcagcgtgagggccgtcttgttggaccacaccaccaccttctccctgtagatgccggcgtccacggcgatgagcgtgcgtgtggcggcgtagtcgggcaccgcgtccaccgccttctggatggtggtgaagttggcgcagccggcggcctggttgcgatcgacggtgagcaggagggtggcattgtgttgagaggcgagggaggccgcccacctgaggtgctcggcgcaccgcttcgtcctgcggcggtgcagctgcggtggcggcggatgatcgtcaagctttagttggtcgaattcgaattgggattgggaaagaggatcaggtggaggcgggaggtacaatattattactgttagtataagagaagtgaggaggagagcatacaaggccctgctattgctactgctactgctagacctgcacttgttcattttcctccttgtcgatctaatactagctagcccgcgtgttgcttcattgtctctgatcgattaagcatcgggcaaatcaacacagcattggatcaatagagtatatgaattgatgggtgcatgcgtaggagcaaagatttgagtgcttccgttccttgatcaaggatgtggtgggaagggatacatgcggttgcttcaattcttgctctctgggnnnnnnnnnnnnnnnnnnnnnnnnnnnnnnnnnnnnnnnnnnnnnnnnnnnnnnnnnnnnnnnnnnnnnnnnnnnnnnnnatccatgc

SEQ ID NO: 29703 - DNA, 1814 bp, Oryza sativa
  unsure (1)..(1814): unsure at all n locations
gaggattgattgctggtcnnnnnnnnnnnnnnnnnnnnnnnnnnnnnnnnnnnnnnnnnnnnnnnnnnnnnnnnnnnnnnnnnnnnnnnntgcgttaccgttacccaacagctgctagctactctatatatgtatgcaataagtctattttttctccctcattcttgccttcgtcgcttcgcatccctcagccataaaaccaggtataacacctccccaaatccgaaaaccggagtaaatatactgtcggttttagcttgtcatgtccacatggtatattgactaggtcttcgtcctacgtggcactcagcgtaaaaaaaagtggaacccatataggcctcacctatcagggattcatcttcttccaccagcctcctcctcctccacctctccctctcttcctcgtgctctccagaccatagaatgacagtgagagcggtgatggtggagaactcgaccccgcacacggcgcactcgtggacgtgtgccctgtccttctcggccgccgcagcggcggggtcgctcagcagcttcgcctgtagccgcgtgtggctcgtcatgtacccacccagtgcctggaacgacgggaacctcttgttgcacgtcttgcactcaaacaccaactccgctgccaggcgccagcgtggcccgtcggcgtccacgacgacgtcggtgctgtcggcgcgggtgacgacagcgtgagcagcgggctggcgtgtatgacggcgacgatgacacgggaagactgctccatcatctcccgctcacgcgcgctcaagacgctagcctttccccttcatctactccaaaacaacggcgcacggtgtgcggaaggcggcgcctagcgagagaggagtcagtgactccgcaacaggcagtgggcggcgcatggcgggagaggagtcgacggcgtctgcagaagcggaaggaagcggggcacgaggttgtgcacggtggcgggagatagcttcgccatggctcccctctcctttcctccgttgctgcgctgctctgccacacgccgacgccggcctcctgcggcgcctcaacgacctgcttgatctcctcgaatcggagctcggcctccttgatggagttagaggtacgcacgagcaccgcgcgcgcgtcccgcgtcgccggccgccggacctcctctcccgcctcgccccgacgatctcctccccaccggacggccggcttgcccagagagagagagagagaggaggaggaagggagaggagggggaagaggtgtgcgctgacgtggtatcctgacatgtgtggtctacgtgggtcccaagctgactcagccgccacgtaagataaaattagggtcaaaaccactgaagaatctattgtgactggttttgattagttgggggatgccggatatctggttttgtgtttggaggatgattttgtaactcgatgacaagttgagggaccttggtgtactttttcctattagatactacaagcccatcgagtaatattattgtgggccgtctcggcctgacccatatcctcgttcctaaacttgttaggagtagagtattgagtatcagtacgtaccattgtgtgttttaacgtactaattaaatggtactccctccgtcccataatataagagattttgagtttttgcttttaaagtttgaccactcgtcttatttaattttttttgaaattattatttattttatttgtgactagctttattatctacagtatnnnnnnnnnnnnnnnnnnnnnnnnnnnnnnnnnnnnnnnnnnnnnnnnnnnnnnntgttaaagagcagncagataataaccagc

SEQ ID NO: 29704 - DNA, 1142 bp, Oryza sativa
gcggcctttgattccgtgaacttcgggtgaattcgagctcggtacccctttcactcatgaactcaaaataattgaactgaaacatgtaacaaaacaaaatctcttgaaaattcatgccacctatggacttaccacaccataaagaaaatagcagcaaggaccaaggatagcaaccaaaaggaagaaaataaccacatactgtgaaacgaaatactagtgcttttacttgactgcagtggtgggttaaaactagatttttcatggttaaaagagcttgttttctgttgtaataactgatctcatgaatattatatttgttatatgcagttctccatcggacacttggtaaattggtgcttaaaaatgctcagcaggtatggttgtgcaccttttttaatattctgggccttctctccattctacgctttatatgtggttatgccaatggttagcaaatctttcatagaaatcagttgtatgcaactggttgttttaatggatacactatttgttggagatgctagttttggcccttacagaaaagctattacacaaaaactctttacatgacaatgggtggaacaatgaatcagctattacagacatctagccgtgctaaagaaaaagcaaaatgcaagataactgagcatttcaaaatgttctctagctggtatggtagtagtacaccagtttttgtttggattttgtgagatataggaaatggcagattaatcctgaggttaagagtagagagcattgcatgatggccagattgtgcttatcattatctgcaatttagttgacgatctagatagggcgggctagaggggggagctgggtggtgcatcaaattcatggtgaatgtaatatgttggtgatggtgagtttgtggtgtaaatgaacagggggcgggcaccacttgttatgttgcattgcacccacaggtgaagggtgtgtccgggaaggactttagtgacaacaatgtgaacgaggcgagtgagaaaagcaatgacatggagctggccaagaggctgtgggagtccagaatcgaccttattacttgacctgacctgacctgatttatggacttaatgagagatacttttttattgttgaaagtttgagaagagtgccttgtaagt

SEQ ID NO: 29705 - DNA, 780 bp, Oryza sativa
  unsure (1)..(780): unsure at all n locations
atgattgatgcccgtttgtgatnnnnnnnnnnnnnnnnnnnnnnnnnnnnnnnnnnnnnnnnnnnnnnnnnnnnnnnnnacaagcatctaagcatcaggcgttacaaaactgcatatgatgaaagtttattgtataccaaatttatcgttccatgatagatccaaactacctagctagataacaacttaggtcaaaattaacatagcttgaccgcacatctcccaggacttgacatgttattgactggaaggagtataatagcattcgttcttgaggaaccttattatcttagctaagtgacaatttgaattgtaaggcgcgcctcgcaaccttgacagtgtaagcactatgacgaagaaacaacatccacgtatcatataaatatactatgcatcaaagtgatacaccaagggataatcaaagattaatttcaatgctaaattttgttttggtagtggtggtaatagatgagtactttccagatgagttactaaccttgctccccgatgaagcgattcaaggctgcagaaactttctgccttacagatcgctgtaactcgagctgcatgttcatacaagctttcaacattctttgcatatgactcatgccctgctgaagcctagccatatcagccnttaagtcattaatagcctcccattnctgcaaatacaaaccaaaagaaaatgagcctttnnacacnatatagagcaacagtgncccttgcatgaggatgagaagctgattgtgcacctattttaaaaaaagtgcagctcaataa

SEQ ID NO: 29706 - DNA, 1671 bp, Oryza sativa
  unsure (1)..(1671): unsure at all n locations
cttcagggtaccacaaagaaagaatgattttggttcgaagatcccaagttttgtgggctttttttttgaaatagtatgtatgaagaatgttcatttttggtttcagatttcgtatgcacgattctatgccagccagaatgggagctgtgaggtagatttgtttgctgtgcaatcagatgggaagaagatcgttgaccagcacaagcaaagagcgctgtgttgtcggctgaggacaaagctccaccgtccgttgcgcgtggcattggtaaacagaggccctgacacggaactgctggtggctaacccagtggaggtgtcgggcaagggtagaccgctggtgttttacgacatcacccttgctctcaagaagcttcacaaacggatcttcttggtacgcatttcaacttactactgtatctgtataacttacttgcatttgtgccttgagtcctttaccatcgattgattgacgacacctgttgcatgcatgtaggctgagattggtcggcatgtggtgggtgatagggaatgggaggtttacagggtgcaccttggtgagggagatcattcttcattgcggagcaagattgttgatggagtcaccaacatgctcatgggctgggacgacactcctccatcctaatcctactagtagtagttctagttagtttttttatggaacacacgtcctttgccttgtacatagttggtagtggctgctgtaaattgtgtgccttgttaagtcgttcgtggtagaatgcgttggcagtagctagctttgactaatcaatcagcagctaatttcagtctgtttagttagggagcactcccctctagttgtatcactatcaaaactgaatagtgctcaagttatctaacaggaggaaatgcttactcctaattactaaagtggtagtgcccgcaattagtaagcaagccagtgaaccaattgaatgcattcattcaatagccttgttggcaaatggagctttggttttgagtagagagttgactggtcgtatagctgagggccaacatgcacgacactcgtctcttgtccaaacacttgacatatggcgcattggaatgatggggccaggctcttgtttatcgggacgggacgggagtactccactccactggcaagtccaaggcagggcagctggtgtagtagagagaggggtggaatcgtgcagaagttaccacgtcattcctgggcggctgccgcgtgttcacccgtatgtgacgtgccgcgcccccgcgtcgccatggacatggaaatggtttgcagcttcaacccataaatgaaaggaaaggagaggagctttggtaaataatccactgacttgaagcagaacccaaataagccacaggttgacgtaggtaaatggctccgaagcagaaggaggcagcgaacaagaagaagaagaagaaggaggtggcagtgttggtgaaaaccaagaccaaggtggtgcagctcaccaccaccaccgcggagctggagctggagcccactgtcactgtgcaggtggacgacaacaagacaggtgcagctgcagatgagacccccccgttgtggcgcttganaagcaagagacgccagaccccaacgagccccaagcggcnggagcgaaaaagaagaagcgcgcgggcatggaagaaaaagagtag

SEQ ID NO: 29707 - DNA, 2040 bp, Oryza sativa
  unsure (1)..(2040): unsure at all n locations
atggccatgatttcagtannnnnnnnnnnnnnnnnnnnnnnnnnnnnnnnnnnnnnnnnnnnnnnnnnnnnnnnnnnnnnnnnnnnnnnnncgcgcggggcatggaataaaatagagtatgaggaggagaggcggtgcattggagtatggcgggtacaagaggtacgtgtggcgcgtgctgaagcaggtgcaccctgacttgggcgcctccgcccaaaccatggacgttctcgacatgatgatggccgacatgttcgagcgcctcgccgacgaggcctctcgcctcttcaagctctccggccgccttaccctcaccttccgtgaggttcagtccgccgtccgcctcgtcctccccgccgacctcgccaaccacgccatctccgagggcaccaaggccatctctaactacctttcctaagctagctagtctctgtttcccttcttttaattgcttcagtttgcttagctcaacagagtatgtacgtaggatcgattaagtgcaggggatttgaagctttagttgtagcctctgtacagagctactagtagatcagtctgtaatctcccttgctagctaatgtgattgtgatgtccagtcagtactagtacctgtttgctgcttaattaccgtcctaacaatatataatttggattatttttcagcaaattaattaattaaatcactgcacgtacacacatgcttgtacagtgatggattccgtgctagcttaacactacagttgcaaccagggtggatatgtttgtataggaactagctagaagggacgacgtactcttaatttggcgactagtaattagatagagagtccgtacgtccagctaattaatttagttgctgggttgggtcagtccggaagaagaaatggtgttgatcctgcgggagtggaggaaggacttgtggttgccctctgcggaggcgaggtaggcaaggaacgcggccatgtcggtgtccatgtaccgccgcggcctgccccgctgctcgtccaccagctccgccggcggcccgatcacacgctccgccgccaggctgtgcagcgacgccaccgacacgcgcgcccgccgaccgttcacgcgcacacggtgcagcacgctccggtacagcccgttgctcagtatctccaggtggtcgcccacgttcaccaccaccgcgccgggaagcggttccaccaccgcccacccgccgccgtcgccgtagctcacctccagccctctcacctcgtcctgcaggaggatggttagcaggccgtagtcggagtgcggcggcatgcccagcgtcagctccggctccgggcacgccgggaagcagttgaccatcatcatctgcgacccggcgtcgcactcctccagcagctggcggcggcaccgcacgatgcccagcgcatccagcgccgcctccatgagctcccggaacagcctctggcacgccgtggcgtacgccgcggcggccggcctgaggtcgtcgggggcgtcgggccaggaggggaggacgtcggcgaggcggcgcgtgtcgcggatgagtagcttgaggaagtcgcgccaggagaggacggcgtcgttgagctggttgaagctggtgccgtagcggacggcggcgcggatgtcggcggacatgtagcgcttacgggcgggcaggggaaggtcgaagaagaagcggcgagcggcgtacagcatggcgtcggggggcacgccgtggttgagaagctggaagaagccgtagtcccggcaggcggcgtggagcgcggcgagctgacaggggtctcgagcacggagggcggcaaggtcgacgacggggagcagagcaggtggtgtgacgtagcgggcggggcggtcggcgggcgggaggacgtagcgggcgggcagggtggtgatgccgctgtcgcacagctgccggacgcccagctcccactccgacgagcctgagccttcgccgatgttgnnnnnnnnnnnnnnnnnnnnnnnnnnnnnnnnnnnnnnnnnnnnnnnnnnnnnnnnnnnnnnnnnnaggcgttcatcacgccg

SEQ ID NO: 29708 - DNA, 18912 bp, Oryza sativa
  unsure (1)..(18912): unsure at all n locations
cggggttctcagctcgagggcggcaaggtcccctccgggaacaaaccaggtggtgtnctaaccggccggntcgttcgcggccgggaggacaaaccggccggccagggatgttnaaccnctgtagcacagttgctgaacgcccactctcactcttgcgagcttgagctatcgcctaatgttggcttctctgcatctctccagnatggccattaactaggtctgtctaaattaaattagggtgggagtagatgattaaaagtgggagtgcgtctggcttgcttaacaagtcattgattagccgcgtgtatttatagccgtccacccggagcaaatgaaatcatcttttccttaattccccacttctccctcctcttcccctcgatcatctctcccttctaatcccacagggcggccatatctggggaactattctaattcctcgaggagatgttctctcatttacctaaaaaccatctaaacggttatacattcatacaacacataaatataactccacaaaatcttgagtccaaactcaactcatacgtcaagatattaaaaaaaagacaaattcagcctatgaatagtagggtactgtttatatctaaatttgtctttattgtttctcgatgtgtagatcgaatttaaacttgaattttggtggactagtaggtatcattatactatacattgtcaattttttttagaatttttcacaactatttgcatcaaatttgaaagaaaaaggtatacgaggggatatctcctcgaggaattagaatccgctcccccatatatgaactttagctgagaaatgcccaggggtcttccagctagctccacaaggtggtgggctagacgatctaagttcgaagcctcacccattctaattatttgatattagatccttccctaatatttatgtcatagatgaactttagcactgtggttatcgcctttttaaagttcatgcaattgttaaagctattaatcttagaaaatcttgtaaattcctaacattatacaattcaatttgtgcttcagtcacccacctcttccttctttcttctccggtaaactcctgggttcaaggtggatgtagggagaggaaaagaggggaaaatcgccaggcttaaagggatggatgtgggaggcggtggcccgacgatgggaagtggatataagcctgcgtttgcggcggggcaaattgaagcttgtgattaggaggcggcaactggtggtggcggatccagcgatgtgaaattgtcgaggctaggagactcaccaccaccaacttggggaagagtatagggagggggttacatgtgtcattgaccccttctggtcaaccggcgaggccgggaggcatcgtgtggaggtgcatgagctcacaactcactaattggggtgacgtagggagtgacgagaggggagaggaagggttagggctaaaggcacggtccataattatcaatatttgttaggtgttttatgtaaataccctaaagttaaatgtctcattgaaggggatagtcattttcaaagatcattctccaaactaaacatattgaaaaacgggtttgcccaaacctgacccatctagcccctcaaaccaaacatatacttaaaaaggttgggtcaacacatcatgagattgatgaaatcactatatatatctcacggttaatgtaacatatcaccaacatgaaataaaaattaattttgaccaacaatacacggagaaatccattcacattctacaaagcatttcttgtcactcaaatatatctatacttatcttagtaaaagatatgctaccatcatcccaactaccatacaaggcccacaaaaagtgagggaaggctttacatttttcctatatatccacacaatctaagatcctacatgcacatgaaaaatatgttagtcgacccttattataaaatttttcatcactccatgacatattagacaatagaaataacttcttttagaggctttaaaaacatatagaatgaactttttttttaaaaaaaaaagaagatccattgcaacaccacgggcattaggcattacgctagttgattaaaatttctaaaaaaatattatgttatatatcattgctctatgaaaatggaagactatatttgaatatttgatctacacgtttagaaagaacataaatctgggactatgaataaggtacatactttttaaaccaagttaatctgattttgggacaaataatttgtgggacagcatatactaagagaagccaatgcatatggtcaaagttattaaatactagagagatcatgtcaatcaattacgtactccctccatcttagattagtgtgctccttttaaactagagaagtatatttattttaggacgaaggagtctaatttcacccatatgttaaaatcaatttcttatggtctagcccgatgtaagtccgaaacataacatatgtgctcgtattttcttatgactttatctttgaactcttgccaggacgtgtcaacgtgggtgtgtagcgggcgtaaaagtgtggtacgtgcatgtgcactttttttaaaaaaaatgaagatggatgaagtaaatgtcagttaattacatttcagcgcatatccttctttgatttggtttgatatactttgggagttagggcacggtacgactcagagaaaggtgcttaaattgctacttgatatgttaatattaatttagaaacaagaataagttctagcatgatctgagatggatttgcatgcatcatattcagtgggcttaatctatcatgcctgcagcatctctgcatggtgcttgatcatcagtaattactaattattatcaacaattcgatatattggaatctgttttttattatatggaatgtactcccggacagaccacaaatgttgggcctagatttattgacactatatttattcagtgttgattcacactaaatttcgcactagcactataataataatacaataagaatatactgtatatatgggctaccgattgatcggtcattaatttagtgcttccaaattaaaatgcatgcgttctgtcctggatatctatctctagcaaagtagattagtagagtagcaaagcatatgcatatgcatgattttgcctcagctaggcttccgaccagacatgacttaaccatgacctaaccgcacgaaatattctacacatgcacgaattaagctccctgacttttttatatgccattcctagctgctgctactagctactccctccatcccaaaatataagcatttttagctatgaatctggacaaatgtaagcaggtacttccttcatctccaaaatataggccagttcccaaaaaaaattcccaaaaacatcacattaaatcttttaacatatgcatggagcattaaatatagattaaaaaactaattacacagtaaggtgggaaatcacgagacgaatcttttgagcctaattaatccataattagccataaatgctacagtaacccacatgtgctaatgatggattaattaagctcaaaatattcgtcttgcggtttccaggtgagttatgaaattagttcattcattcgtgtctgaaaatcccttccaacatccagtcaaacatcctacgtgacaccaaaaattttcttttcgcgaactaaactagcccatagtaatttttagcatttaaattctattttaaaaatatagttatttcgttacctaacatcttatctcaaccaattacaactatggctgatataaatttttcagctatttactctttttaatcaatcacgttatttcttatttagtctcacgtagtttcttagtacctatgttttgctttaaaaatacttatattttagcactgaggaagtagtagccacactggcatccacgccttgatcttttttagataatggaaatggattacatttccggcttctgtcataagacacacagccataagtttaatagtaataaaaaggtaatataaaagtaaatcaaaatgagaaataaggtgatgggacaaatccccaactcctctttattattgactagcgttaaaccacgtaaaatattttagctagcaattcttatggaactacgccacccatagtggaataagagatccttggctaccgattccaagagtgtagcaccattgcgcatagtatcctgctcctcctgtggtagcattgtagaccaaaagtggagccagtaggaagacatgaagataacctgcatagggttagataattgtttaccattaaaaactttatcattgcgacaatgccaaattgaccaacatacagcactagctccaattagaatcatcttcttaatggacctagttacccctctaagccaattaccgaaaatgtttttggcattacggggtgggggatattaaaagcaaaaagcacacatctccaaacaaactgagcgacatgacactcaaagaaaagatgttggattgtctcttgtgcatagcagaaagaacaatgtttgtctccccccattttcttttagccaggttatcttttgttagaattactttcttgtgaagaaaccacataaagaccttgatctttagtggaattttcaagtcccacagaattctctttttgatccgaacattacagttcatgatcgcggcatacatagatttgatggaaaattgaccattcttatggagcgaccatacaaagcagtccttttcatttgacagagttatattagctagcatgaggatcaaatcgttccactcgattagcttttggccaacaatagctcttctaaaagagatatttagcggcgttgtgctcatgacctctgcacagtagactgcttctttcgagccacattatataatgtagggtattgatctttgaaagcacgtgatcccaaccacgtgtcttcccaaaatcttatgtttgtcccattgccacatctaaaagaaccaaacctaagaaattggtctttgactttcattaaaccggcccagaactgagaaatacctatcttgctggacataccagaaagaggtttaccctttaagtatttatttcgcaaaaagtcttgccataggccttcaccattaaacaactggaaaagccatttgcttaataagcagctattttttatatcaaggttatggacacctaggtccaccttgatcttttggtcgacatatgttttcccacttagttagtctatattttcttttacggtcatcattactccaaaaaaaacatgacctaaagtaatccagtctttgaagcacacctcgtggaatttcaaagaaggataacataaacaagggaaggctcaaaagaactgagtttagaagggccaatctcccaccatatgacatgtttttgcctttccatgtgctgagtttcctctcaaatctatcttcaactcctttccaatcaacattccggagtttctgataatgaataggaataccaagatatctaaacgggaaagatccagaattacaaccaaatagttatctatattgatcctccacttccttggctttcccaaaacaaaaaatctcacttttatgaaagtttattttcagccctgagagctgttcgaacacacataggatggctttcatatttttggcctgttcaaggtcatgatctagaaaaattactgtatcatcagcatattgtagaatggacaaaccatcgtccactaaatatggaatgactcctctaatttgaccatcgcctttagctctctcaatgagaaccgctaacatatcaaccacaatattgaaaaatataggcgacattggatccccttgttgcaggcctttgtgcgtttgaaaattattacccaaatcatcattgacttttatacggacacttcctccttcaaccattttagaaatccaatgacaccattgctgagaaaatcccttcatgcgtagtgtttattagagaaattgccatttgactttatcataagccttttcaaaatcaattttgaaaataaccccatccacgccttgatctatcaaagtatcgatcgatccacagtgcttgattaattgaccgatgaatgcaaagacagccgtggcccgtacttgattaattgagctatacctatatgatagtgagcacagtgtaaattaagatgcttaaaatttacggcaaaaaaaaactatatgtactgcaggtacacacgcatggatactggatagatcactgccctgtacgactcgattggaatctgtattatctgcatggatgcaaattaagtcaaataatcgttcgctgctacgaatagtactagtagctaggtagcaattaaaaggtttcatgcctgcgatgcaccgtgactatattgtcttttgcaaccgatccatcgatctgatcgtgagttgaatacatatgcaaagtcatgtggttttgtcaccgactttttcatattcgttttacagagacctctcatgatcttacattcttaaaattccaaaattgcgtcgcagtggtcagctggtaattaagaacaataccgcatgtacaattgcaagatctgtcaaatgaaccaaacacacgtcgcaattaagtcctagattcaaatactattcgatagcgggggcagcgaatgaagatgggtctcttcaattgtgggagctttagatagatgcaatgcactgttcggtgacagacagactgacagagagtgatggtgcagcgcatacaatcttgtgtcaactgaattgaattggaatggatcgaatcgaattttgcaaggcacagattaggccctgtttagttcccaaaacaaaattttttacgttgtcacattaaatatttagacacatgcatggagtattaaatgtaggaaaaaaaaaccaattacatagattacatgcaaattacgagacgaatcttttaagcataattacactatgatttgacaatatggtgctacagtaaacatttgctaatgacagattaattaggcttaataaattcatctcgcggtttcttggcggaatctgtaatttattttgttattgaactacatttaatattttaaatgtgtgtccgtatatttaatgtaacaaccaaatccaaaaattttccccaaataaacaaggccttaatatcaattatcactgctatgttatcaggcagacagagagacaggctttaatattattattgatgggcaacaagttgagcaagttgtgtttatgctgtcggtcggacccatttcaaccaaagtgatgcatgtttgatagatatggaaagcagcccgttttggctatgtcaagtgtcccaaagatttgcttacttaatttcaccaatcatgcattcatgcatgcaccttcgtcatcgatccaagcattgtcctgccctgtcctgcaatctcgaagaccttgcttgttggggcatcaaaatcatctccccgtactcgaaaacacagcaaaatcaacagtcaccttatccaaacatttgtcctaacagtgatatagtacaaaaaagaaatacagaacaaactacaggtagacattttacctacctgcagtgcaggctgcatttgggttgggtgtcatatggtttgaaggaaggctgagctgacacaacccaggagcccatatatacaaatgtagttcttctggttcagcacccagaaaccacctactatgtgatacagtacgtacttttacaaccgaagcacatgcctttgccttccaaaagaaagttttgcaacttcaatcagtagcaaaaagatctgatgtaatcccttctgcagcacaccaacatgaacagctaagtttccgtttgccaatgcaaagggtacatactctttcttacccatataacttggcaaaatagtagcaagatctaatcatcctagttttcgttgcgctgaagctgctgagctccagcataagtaactccactgttactgccagctgcttgttgggacggcagggaaagaagcagaccttgctgtggtagctgagctccattattcaagtgaactaaattaactggtgggggtcggcccagcaatcctcgactaagctgaggagccactggcaactgaagcgataaactgtagccaaaaccagaagggataataacaaaaggtggcgttggcttgtgcgcacactgagtactagccttagcctgggtgggatgtcgatgtacaacctgaggagcttcagcagttgtagaattagcatgctggtctgatcctactaggtgcacagcatgctttccctttccgagcccatatctgctatctgggctcgtttgtggcttgcgttttctcttgccacgcttcaaacgaggtttactgactagctcatctggtttaaggcatccaaacagaagggtctttagctttgatgtatctagtttacccctcatgaaatctaacaagttcaaagcacaatctcgaagacatctgcaaatcttctgcatctcctttttcccaactgacctagcaaaattttgtgaccggtccaagaaatcttcaacctacatgaacaggagtaaaggaaaattcttgttgagggcataatacttaattcaaaacaaatcttacatttaaattgccaattcctttcttccaggtcttagagatccatgatgcttcaaagttgctagcgcatagcccatgctcccataagctctccgctgataatagctggagaacaaaaggccaactttgtgacttattagcgaccataataaactatcacacaatggtaattaaggtggtacaattttaaaacaagttcaagctaatacaagtgaccaaataattgtacacacaaaaatgttaattgcaatattggggaaaaaacgttgaaattaatagtgtgcaatgtatttttccgtgtaatgaaaatagctaaaagccccaaaagcacaaacaaacaaatacatcctgctagaacgggtacattatgagaatttctggacgagtattatcttgtttgggcttgcctaacccaaagttcttaaagaaaatgatacaaggagaatctgagttcaaaaggaacctaggcacagtaatgaacatttaaatgagtcaacaaatcacattattaataaggaaagtaacttaaacataaaagctatataaaagttatatcccaaaggaactcactttactgatcaacgatacaaacagttcagctacagtttctttatttgttctcccaaaccccttaaatgccaacgtattcctctcaacactttcaaaatctgaaccatctgcaaggaatctcatcatcagctcagagtgactcagttgctgccagcacatgaaaaaaaacaaagataaaaaattatttcaaaaaccttttaataaggcagataacgggggtaatattggaggatcccgggtctgcgctgcacattgcaccaatggtaagaagattcaacttatacttattcatataaaaaaggaaaagaagtattaaatgccaaatgtttgttttcttaagcatagatctagtgagttactagtaaaacacccagtttcataaagttcgatgcaacaaactccaaaacgaatgtgtaaaaagacttcatctgttcaattgaaattcaacataaacccctggcatcattccttgatattataaggatatgaaaaactttttagtgaaaatcctctttgtttgctagacatattgattcaaatccaatagttgaaacaaaatatgggaaaacaactaatcatcatataatagtcaaacagtgcattgtgaaatcctctgtacctgcaaatggaaagcaactaatgaaactattgacatggagctcagcgttcgctctctcgggctattcacatcatgtatcttagcccagaacttcaccttcaaacacaaaagaaaaaagaacattgttatcaccttgcatttgtatagtatatctttttttctcgggggaggggattacattaccaggtaacttagtatctgaaaccttggatcaagtgaagaaatgaacttaaagatcattgatcttgtcatgccatctttattttcaaccgtaatatcacactcaatcccagttccccgatcaataacattcacaataggcaccctagcagttacaacaggcagaaccccacagaaaattccattccctgaaaatgtgagtatattactgcagttggagatagatgggcttagaaagatgcataattatagcgggctatttttatgctttctctatttgaaaaaagaaaaaaaaaagtggccaggatggtccattagtgaagtatatcagtcggcacacccagtgactttgtaaagctccaattttcagataagctgatttgaactaattatcctatgattacttttgcagtgcgcttttttcacttttatgagatttagtagcaactgaggcttagtacatataaaccatctgcaatgttgtcagttttgatatcctttttttatccctgtatgagctatcgttgcaattggaagtaagatcagaaaaccaagtggcatgtcacaggaaacggggtcgaaggaagcattccttgacaccggggaatgccgtccccatcctggaaacgtgggtgcattttcattcccaccttataaaaacctctcacaagtagcataccacgttcctcgatcccatcgacctgggaactttgtgactcatgcaaaggagcctaatgataaaaattggtggacacacaaagtactagtgaatatttagagatactgtgctctaggcagtaattactttgatgagaatatagaactttggtgaacttcctaatagcagaaatttttttcttgcgagcatactgatcgtcagtattagcagtaaaattgacagagaggtccaggtcacttctaggggtaaataaatccattgtaaatgatccaaatgcctccacgactggaaacccattattgttacctgaaatgatttgttaaagaggatggccaatcagcatgctagagacaatgtttagcaactaatcaaactatcactttataaagagttgttttacagtcattgggaggtattgacagatatggaggcatattctagatttctagtggtaaacagtggccaagtagtgaagtagagtattgtgaagaacattagtataggatagtagatgaacattggtattagaaacgattacaggggtatgcaataagcagatgagtaaggaaatgaaagaaaaatgatgcctcttagcataccgaagatttggtttgctatgttgttgaagacatgaaccaaggtagtccgttgctcgtaatcaagtggttttgggcgcagcatagtatacacctgaagaagcaaattatcgagaataggaagaagagtgcgattgactgacagggctgccaactcctccgactcgagacattcggcatgcgcgcgtaacactgaagagaaacaggaaatcgaaattaaaaggagagctagcgcaaaatgcatggaagatgaatgggagcagcagctagtagcctagtaccgtaccttggggatcccatgcgcttacctcactgtcactggacctaggtggagcaccaacaatcaaatcaaagaggaaaacatatgagatccagtggagtatgatattcccagccccagcgagcgggaaggaataatacaggattggattggagtagaggacgccaactaactgtgtgctttcggaggaagatgatggcatggagaagaccgccggcggagatggtggcggggatcgagtagtgtcctctcctgtcatgtgggtcctacaagtcagtctcgctcactgctggaatactgactactcgcgcaactactcctgtcaactccttcgacgccccgccgcgctccccaacttgtcgcccccgcccccgcagaggaccggcggatgagcagggatcccgtaccacccgactaggccgctgggtgacgagcgacgagggatgacgggtggttgaggaatgggcgttgctaccaccgccgcccccgccggtgcgctgtccttggccgccgccgccgccgccgtccgtgcgtggccgccggtggactgggtggggtgggaaatgaaatgaggataacatgggctttttagactcgcgatatactagtagttattattagtctaatatacatcctccggggatccacgggtcaaccgcccccgatcctactcatgaccgggaaatcaacacgcacccggcaccccccggcctctttcctactgattaaatttaactgttagtagtacagtatttgataatcacgctgattagcgttaatccttagggttcttcctactacaaaacatgacagacagacagacagacaaccgtcgtcaatctagcaatctcatataccaattagagcaaggataataataatatagcacacttcctacttcctactattagcctatcttaaagctaacatatataataaattagctataagattgtctacaatttttttctcctctctctaggtatttatcttggagattgtgttaagttagctcttgcatgagagccaacctttacatctctcatccacactagctaattaaatcgtgcattcgcgcgaccatgacatgtccttttatgtattaaaattagaactaaatattgggatgtggatttttatttctcgagggaatatcctccactcattgcttgaaacatatcacttccaacaaattcgatttatacatatggccataaaatatgttgtatttacgaagggctaatttgagttgtttcagctttaatatacgtgcgtagatgccacatcaaactggttaattagctggtgaaaacagcggttttctttatcgttagttggaagaaaaaaaatcagcagtaatgcaggaggctgctacttttttccttggagatggccagcaggattgttgccacgtgtctgtgtttattgctctgtgttgggaaccagagaaacgatcacactcttctagatcattctcttgcctcttagcttttgatcaatccaagccatccctccttaatccaatgactaatataatattgtatacgtggctcaatggcagagggaataaacattctacgttcatatgatgatgatgatgataagcttataataggcttatagttcactgttatactttctcttaacgtgatcactccagtttcattcaacaagcgaggtctatgcgtattgtctgcatcaaaattacatgacaatgtgcaggtaggcgcatgcggccagcattttatgttgtactagacaggaacattagttccctcttactgtatcccatcaatcagtttgttcaaatgatcagttgtgaaatgaattagtagctgcctccggtaatcccagttcccaaacaaaacactttctgccaccccaaaaccatatattacaccaaggcagacaagcagggccccaatctaacaaaacaatggaactcatcagagacaagagacacacaagacaacacaggcatagggcatagctaaaattgaatataatcatacatccactaacacctacaagctctaagtaggaaaaagaaaagaaaaaaacatttcttcttctttatcttcctttctctctgtatctacatgatgaagtatgctcggatcacctcaattatgggtgcacggcacagcgggcatttccctccgcttcgaaccaactcattcgcgcattttgaacatgtgcacatgtgcccacatctgatagaaagtcaacaccccaacccccaacaaagaggcaaaacaaaccatcattagtactgttatactgtattagagaagaacaaactacatggacctattattcattatttcagaagaaaagcatgagttcaaacctgtacaaaagagagtcaatcggagtatcacagcatatacagcacgtcccttttctcacatggatccattttgatccatcgtctatagtttctttactttcacctgagataccaaatacaaagcttaggtacaagtctgagccaatgcgacaagcatctaagcatcaggcgttacaaaactgcatatgatgaaagtttattgtataccaaatttatcgttccatgatagatccaaactacctagctagataacaacttaggtcaaaattaacatagcttgaccgcacatctcccaggacttgacatgttattgactggaaggagtataatagcattcgttcttgaggaaccttattatcttagctaagtgacaatttgaattgtaaggcgcgcctcgcaaccttgacagtgtaagcactatgacgaagaaacaacatccacgtatcatataaatatactatgcatcaaagtgatacaccaagggataatcaaagattaatttcaatgctaaattttgttttgttagtgttgttaatagatgagtactttccagatgagttactaaccttgctccccgatgaagcgattcaaggctgcagaaacttcctgccttacagatcgctgtaactcgagctgcatgtccatacaagcttccaacattctttgcatatgactcatgccctgctgaagcctagccatatcagcccttaagtcattaatagcctcccattcctgcaaatacaaaccaaaagaaaatgagcctttaacaacaaatatagaagcaacagtgcactatgcatggaggatagagaggctgaatgtggcaacctaattttaaaaaaaagtgcaagtctcaattaaaaatggcatgttggcttggccattcagaaaaaaagaaattgtgcacttggaacgaactgaggaagatgaaaagctcacacatgtgacaagaataacataggtaataacttacaatatcagagcgatgtatgttttgtctgatccagttattacgatgcaactccgaatgccaaagtggctggcgaggaggtataggcggaggtggaatcactaagggaggcctaacaacattatcatgaagctcctgttcctcttcatctctatgctgctcctggctttgctcgggtgagtcaggcgcaggaggtgctccttccaaatcccaagagagaggagcacgaccttgcctttcaacatatgaccggataagtcggtccaaattttcacgaaaagcactatgaagaagattagaaacactccttctgcagaatgaacactaattcagtatttacgctgagaactaaagaaatatgttgcagagactttcttcatgaaagaaataaaaaaacctgcttaggagttcccttagttctgtactgtacacattatcatcatcagctgggacaaacgtattagctcttctaataagagcagaatcatgatcaattggttgatcagagttgtcatcatgccaattatctgcagtatcattggactcatcatcatcatgccactcttcatttactccttggaaatgatcatcgctgtgccactcgttgtgtacttctgtaggaataaatggattactgccctcattccactctccacgagattgttgaagatcactgtcatgcagctcttcattctcctcgggaagatggctattgtcctgctgttctccatgagattgaggaggaagattgtcactagctaactcatcatgtgattctggaatatgtgcatcttgaccaccttcaacttcggtaccctcatgagatgaaccattgtacgtattttcatgccaatttatttcagattcctctccagtaatagcatgggaaaattgttcccaatctcttctctcttgttccaaatcatcctgccaactctctgcttgactatgaggttcatacaggccttcagcaatactaggagtattgcttccagattcagatactgtcgctgtaccttcaatttgctgaagaccaatattcagccttgtccgttgatgtctctcgagattatattcagaagaagaagggcttgattcagtatggccatttatagagagctcaacattttgagctgaagaatcatcggattggctaactgcatgacccctgacgacgttctccaatctgaagcggaactcttctctagttattaaaaataataagtattgttattatattttatatcccacaaaacttaatgtatacaagtaaattatatccataagttggtttcaagatgatgtgctcaacaaaaaccatatgctctaatatccatatccagttgacaaggtcataattactcattagttgttcagatatagtctagaagctctaattgtacattaacataggtaatctgagaaaagatgcaacgtaaataagcaacatatagcaatggcggcatgaatagaaagaatgaagaggtctcataagaggtaacacatgcaaccaccgagcagctaaggatatactgacaatgaccttgtaggccaataatcacatgcattccagaagagaagtggaagacaagcagcagcagtagtgcagtagcaaaaagaaacacgcgaaggcagtgatagtatagcacaatggagtatgtatgtagtgggtagagagagacctcaaaccagagacagaatgacgctgtcgtagctggccgagctcggtggcggcggtggatggtggccttctgtcgtcgtcaccattgcgcagaaacctcccccggagtagtgcctggtaggggaatccgtagattagattagataggggcaaggcaaatggggtcaacaaacaatagaactaatggtatgggggattgggagcagggtacgtggattcggttgcggtgggggaagtcggagacggcgcggtggtgggagaggcggtggagctcggcgtgtcggtcggcggccatgcgcatgacgagctcgaggcgagcctggcggccgcggatccggaggcgggcgtggtcggggggcgggtcgtcgtcgcggtcgcggtcgcgggaggccatgtacatgtggagcgagatctgggcggggccggggtcgtcgggccagcggcgggcggcgcggcggacggcggaggcggaggcggggtcgggggagccctcgcggctggatccgtcccagtcccagtcgctgtcgctttggcggcgggtcatgaggcgtggcggcggcgggaggtcggccatcgtcggccgaggaggcgaggaggcatgggttcaggattcacaactcctccatttctgagtcttcctgacactgctggagacgacgaccaccacaatggattggatttggatacaccaacaacaacaacaagaagccgatgccctccggctccgacgaggagagtccactccaacccctagctaagcctaagcaaaggagtcccctctcccctcccctcccacccaaagcctctcgcctccgctccctccgattgctgtttttccgccctttcacttctttctgttttttttccctttgtaaataataataataaataaataagcaagacaaatattctggagggaaacaacattccaaatgcatcacattcatcatcattattgttattaacaattatatttgataataatccagaaacacttgtattatacaaagtgaacttattcttaaatattattattgatttatttgtgaaaagtccatgagatgcacatcatgcgcagcgtgcacgatcataaagtctaagagagtgcgatgattttgttcatggaataaatcctttgtacaaatctagagcttgtcaaacaacgacgactactagatagtatttcacaccgcatgataaattttactttggatcatcttttattgtcggtctagttatgtggcatttttgatcaacctcaactcttatctatttacatctaactttgtcatatgtcaagaaaaaaaatctacatacagttaggggagtttgttgacgtgttggaccactctcaattcttttatccatttaaatcgcaaacttatcatatgtcaaaaaaaactacatacacagaagcaagcgtacccaaggccattcgtatgcttgagaggagatacgagatggtccaaactaaaacaaaacacacaagatgattaaagaatagtttaaagcgatacatcggtgataaaaaaaggtggctcaaagtaaaaataactcttaatctaattaactactcaaaataacataatgactctttgcttttaacactatttggaatattgtgggatttgggatacacccccaaacatctttatagactatactcccttcgtcctcaaataaaatttgaatgagatgttatctaatacaatgaatctagatatatctcgatctagattcgttgtactagataatatctcatataatttttggttattttattttagaacgaagggagtacgtttactactaaaatattctccaaaatgttttttttaaaagaacagtgctcatactctatcgaataatcataagttatttttaaagaataatactcatcacaatgcgcattaacattgcttctctgcaatgcgcagagagggagagacggtaaataatcatgcttttctggaaaaaaaatgtaaagaaatgttatcattataactaacacggtttcagtgtagagcatcacaaaatacttctcctacctactatcactaaaaaacccatttttgttgctggatggcaacatagcaccatctgatcttggtagacgcaatattattcttactccctacttttatttcacatgcagagatttgagcttttcttaagagtagcgtgcaaattaaacatattccttctgttttttttatgaactaaggctgcgttctttcaggggagatagaggagattgtccctcgttttccgcacgcacgcttttcaaactactaaacggtgcgttttttacaaaaaatttctatataaaagttactgggtaccgagctcgcattcgcactaggtaagtgaatnccaccgt

SEQ ID NO: 29709 - DNA, 5082 bp, Oryza sativa
  unsure (1)..(5082): unsure at all n locations
gcggttgattctgtcattcgctcatatgggcgaattccagctcggtacccgttttgcgtatcttcccaatcttctctatctcctcctcaaacacagcctaactaacgtaatacattnagggatgtaggagatattgtttcaaccagaagtttaaaccatttatctgtatttatttatgtagacaagtagtatatctcctcctcaaacacagcctaactaacgtaatacattttgggatgtaggagatattgcttcaaccagaagtttaaaccatttatctgtatttttttatgtagacaagtagtagtagctccatactgaaactgttactcaatcagctcgtcagaaaccaaccaaaaaactataattcagtagtttttgctagcaacagtaacaagaagcttaggatgattcagcaccagcatagattggcatgcgataccaacccgcgggatatgcaaaataacaggagcagcatcccaaattaacaaaaaaaaaagcttaatctcccaaaatgctctcataatacacgagtttggcagtagctctagctccttcctcgagcaagcaaggtagctggttcactagtggatcaatatttcaaaacaaaagaagatgttaagcaagttgggcaggagcttgttcagcgacaagcttactgcaaagactgacacttcttggtgcagatgctttcaggcagcgtaaggtaattcactggctccaagtttcagttcacagactaatccattgcaactcttcagtttgctcttcattgttttcagtgtcccaaccgtcaaacgcagctatatttctcttgctaaaatgaaggttttcaatcagctatatctctctgtctaaacgagagcttttcttctcgtaccacaataagacatcagcaaaatcagctatactttttgtgcgtataagagcatctacagctcattcaagaactttctctccagttgagaagacattccacaccactgtccctactatgtacaataccacagccacctgaaacacactatcccaagaacctggcagtccaaaaaagaaagttaagacgtaagagaaagttagcataaacacacattgatacatattccacaagaatgaacatgaaattcattattaaaatatggtctgtcctgtttgacatttctagagataccatgtttttcaacatccctacctttctgaagaatgtagccagtggcagcagtaccaaaaactcctgccagcacgccagcagtgtttgacagtccaagaagtacaccctacatttttttgtaacattgtatcgttagctgatggatcaaagttaaaaagaagcaacttaacatcaatacagctagcagtaacactataatttctattgtgaactagggaattttggagcagtaacaatctatgtgagagcattactgcataacgtgggcctatgtcctggtgattcgaatatagcccagactgtgaaaaggcatcactcccctgccaaagaaattggatatcaagatcaacaagcattaaaagacaatagtcaatagatggttcagaagctaaatccatatgaatagcctttcagaagaatatcaaacctgactgcatgccatacacaatacagccatggctggagttcggactttgctcagcagtgtcaagaagagggctggtccaaggaaaccaatcgattgcatgatctacaaaatacatttcaaaagtatgtcaaaaccaaaagctcagcagtcagcacagctattcccagaagttcatacaggaaacagctattactgaagaatttaccttacgaacattcgttatggaaacccccctcccaacaagagtgtcagcaatccagccaccaatattcgcaaatatagccattgtcagccacggcaagacacacaaaagcccagattcagtaagattgaacttaagaacctggataagagcacctggtgagtacaaccaccaagaacaggatatgctaccattgtctgatatgggcagtgggtattaaattgtaagaacctggttgtagtatgtaggcatccatgttagaagaatgaaggttccccaattatggcaaaaatgtgatactattagagcccatactggaggctttgatagaattagcttccaaggtatggaggtgacgggctccttcaaggtgcttccacctagaatgtacctcttttcggctttgcttagttcgggatcttcactcggggagctgtgtgcctaattaagggtagacatgcactaccagttagcccttttttcaggggtaacggcaattagtcatgtaagaattaacaagaatgagcatctaagaaccaaatagtacggtcatttccagagttacttatgtggttaacataataaatgaaatgacttcaaaagcaaatttttaggttggaagctagtacatgaattgatttatcttacttttctttgccaaagtgcaaaccagacgcttccaagggacccgaatgcgtaaaaaacagatggccaaccgaatctgctgatcaagagaggtgaaaaggctaggccagtcactgaaccaaggtacattccactgtacactaatgcaagagatctgcttctctctgaaactggaacccatttggagagtatgttgttcatggctggcatggcaacaccctgttaaaccataatataacaaaattaatcacataaaggaaaggaaaagcatcagtgtaaaaactttgtttttttttatactcaatgaaagcaaactgagtggtactggcatttttcaccgagatacttgatgaccagttacttcaaaagcttaactttgcttaatttggaggagtatgacaggtgtttttgtgacagacaattgctccaagttagacagaatttccaccctcacatttgcttgcatttcattaaacctaatctagaggaaccattgtccggactattacgagaagtgtgtttatacaaacattccacttgatggtagtggcagtttgaattatagtagagagaggcacagatatctacctctcctatccccatgaaagcccgcatgacaagtaggaaaggaagtccaatctttgcagcaaggggtgtaagaactgtcgcaattgaccaccagacaaccccaaatcctagcaccaccttaccaccaaacctgtcggcccatatacctccaaggatctgcagtttagtatgaaatattagtcctcacaaaggacagattcaaatgtgagagaaactgacgcataaaaatccctggcttacaacagtaatgcacctgagtaagaaggtaaccccaaaagaaggaggactggattaggcctacagttgctggactccagccgaattctgatgacattggaaggatcgcgatactcatattaacctggcagaaggcagtaaagaaaacaggaggagagttataattaatgaccttacataaaaagaaaagaaaagaaaaaagaggtaattcaactgttgttatgaggtatatttggagaaaggaaagggcaactcacacggtccatgttgcacagaaggaaggaaaagaagcacaagagaacgactgtccatcgcttagggaactgctgccaccagggagaaatctcatttgtatctccaatgagaactgcctcggcgggaacatcagaagggctcaacggtgatcccgttatctcatactgctcggctttacagtcggcgcgtgttctgaccggaattttgtagtctggctggacacaagcagtgtccaaactagtgaagttgtcccatcttcttggttttagccaaccagtgtttattggatccgaagtgagaaagcattcaatccgccgcctcttgaggtttgcattgtaaaaccacctggtgaggtagtttgtagaagagtcaaccacaggctggtggaatcgggcagaaagttgaaatctttccattgaagtgctcctggaatagttagagacttggaaaatggtggtcctagtagtgagtcgactgaatttatctcgggtgggaggtgaggaacaggtgcacttgttgttttgtggtggatgctgctttcctgtaaaacccaaagggaagaatcaggttgacatttcgtgtaaatggccatggccggccctgcccttgattatagtcaacctgattacactgactagctagttagttatgatgttgggtatatataggcagttgatgaataaattggtcagtaatgttacaagcaattgaaggcagtaagcgtgtcatgttatacatagttatagggaatgagagagaaatgaatggagtcccgtaatagctagcagtgaatagtactactagtgtagaaaagaagttagtaatagtattacggacctgaggaggagagtggagaggcgaaggttctgctggagagcacggcccccatagccatggcctccgcctggtcagagcacaagaggatctctctctctcactcactcactcagctctgggggagctgctcccctctcgtgttgcataggaaggatcttgcttggcccctggagcctggaggaggagattgggggggaagacgatgagacgagaggaggacgtgtggtgtggataagcaagcaaaagtagagtagcctctcccttcttctcctcctctctctcctgttatttcgatttcttttttttctcccttttattgcaggatatagagatggctgtttctgttgggattctttccgactgaacaaaaacaaaaagcagagcgcgaaaatgaccttaactgaatgaaaagtaacacactagacacgtctcctgttgtgatgtccacatccccatctgctcttggacggaaggcgtgcttttctccacgtacgcacccaccccgccactccatagccgtccgatcgtctccactgccatgtggccccctggttatttggtcccaacccaaagtagaagtttcttggatttgcctctccatctaaattcaacagcgggaacccgaacaaaaaccagcaagggattgggccctaccgaggaagaggaagaatccctattccctattcctcacctcctagatcaggttggttggagggcccn

SEQ ID NO: 29710 - DNA, 2685 bp, Oryza sativa
  unsure (1)..(2685): unsure at all n locations
cggcgattgtcgttcagccttctaannnnnnnnnnnnnnnnnnnnnnnnnnnnnnnnnnnnnnnnnnnnnnnnnnnnnnnnnntacgcacgcacaccagatggtagctgccatagtttagttaccacaatttactttacaggcactctctcaaacttcaacattacatagtatctctcattcagttcatgaatcaggtcaggtcaggtcaggtgatgagctcgatgctgtactcccacagcctcttggccagctccatgtcattgcctttctcactcgcctcgttcacattgctgtcactgaagtacttcccggacacacccttcacctgtgggtgcaatgcaacataacaagtggtggccgccccctgttcatttacaccacaaactcaccatcaccaacatattacattcaccatgaatttgatgcaccacccagctcccccctctagcccgccctatctagatcgtcaactaaattgcagataatgataagcacaatctggccatcatgcaatgctctctactcttaacctcaggattaatctgccatttcctatatctcacaaaatccaaacaaaaactggtgtactactaccataccagctagagaacattttgaaatgctcagttatcttgcattttgctttttctttagcacgggttgatgtctgtaatagctgattcattgttccacccattgtcatgtaaagagtttttgtgtaatagcttttctgtagggccaaaactagcatcttcaacaaatagtgtatccattaaaacaaccagttgcatacaactgatttctatgaaagattagctaaccataggcataaccacatataaagcgtagaatgagagaaagcccagaatattaaaaaagagagcacaaccatacctgctgagcatttttaagcaccaatttaccaagtgtccgatggagaactgcatataacaaatataatattcatgagatcagttattacaacagaaaacaagctcttttaaccatgaaaaatctagttttaacccaccactgcagtcaagtaaaagcactagtatttcgtttcacagtatgtggttattttcttccttttggttgctatccttggtccttgctgctattttctttatggtgtggtaagtccataggtggcatgaattttcaagagattttgttttgttacatgtttcagttcaattattttgagttcatgagtgaaagatccctttagcttacaaaagcaggaatactaaatatctcctagagttcaattcaagtatattttaccatctaggatactgtggtgacgaagaaggttcgtgatgatagatccaggatgaagagaatttgcagttatgttgacaccctcatcctgttaaaccaatgatgatagtcaatacaaaacaaaactatgggacatgtacaaatttaaaatttatttcagaaaagtacaactattttatcaaaatatcggtttactgcaactttagttagacatttcaggaaactgcaacaacagtcaacagttgatggctttggcgtaaaactgcacctttatttgcctgacgagtatgggcccacctgtcaggtgaacattaaaaaatcatacagctacaggtcgggcccacatgtcagtcatatagtgggttaaagttacagtttatggttgaaatcatttgctatagtttgtagctttgtcaaatgcctaactaaaattgcagcgatgtgatagttttaacgaaatagttgtagttttatgaaatttactcaattcaaaatggacaacacctgaaataaagacaacgttcagttggccaatacctgacacgatgtgtttatctatcatgggtgtagatttcttactaaacagtgcaacagacagctagctggtgcaatttttagagtttagcagcaaattactagagatagaattcattgctggtgcttgtggaacaacgctcctgttggattacacgctaataaacatatctcaattgaaataactccaaatacagcgttgcaccaaaaaaaatatatctataactggcgacatgatctaagagaagagcaatgcgcaccttaaatctcctagcaagttcattcgcatgcaaaatgtttgcaagctttgactgcccatatgctccaatggagttgtacctgtacaacacaagattgaaccatatattagtacagtacaattcctttgaaggaagttaacaaggaaaagaaaaacaaagtgcataaaagttgcatactccgactcgtcatttatcttggcaaagcggatgccttcccgatatgcaaacctgtgcccctctgatgaaacattaacgattcttccttccacatttgattcacgagaggtctttttcattgtctccaagagaagatgagtcaaaagaaaatgacctgaaaattatgacaggagatacacattttaacgcaatgatacacagctctctccagcatgtttgagagaaaaagggacacattttaactcattggtatccgtaactatcataatgaattagaacattgaggaacaggtgaagtagaaaattgctatggactgttaaaataaatttgactaattagaaggatnnnnnnnnnnnnnnnnnnnnnnnnnnnnnnnnnnnnnnnnnnnnnnnnnnnagagtgtcactaacaagctgtgataaccgcc

SEQ ID NO: 29711 - DNA, 1733 bp, Oryza sativa
  unsure (1)..(1733): unsure at all n locations
gtggttgttgtcgcctnnnnnnnnnnnnnnnnnnnnnnnnnnnnnnnnnnnnnnnnnnnnnnnnnnnnnnnnnnnnnnnnnnntggtgtggataagcaagcaaaagtagagtatcctctcccttcttctcctcctctctctcctgttatttcgatttcttttttttctcccttttattgcaggatatagagatggctgtttctgttgggattctttccgactgaacaaaaacaaaaagcagagcgcgaaaatgaccttaactgaatgaaaagtaacacactagacacgtctcctgttgtgatgtccacatccccatctgctcttggacggaaggcgtgcttttctccacgtacgcacccaccccgccactccatagccgtccgatcgtctccactgccatgtggcccctggttaattggtcccaacccaaagtaggagtatcttgcatttgcatctccactcagattcagcagcgggaaccggaacaaaaacaagcaaggcaatgggtactacggaggaggaggaagattcgcatatgcttattactcactactagtatcatgttggtttgatgtacgtacgcacgcacaccagatggtagctgccatagttaagttaccacaatttactttacaggcactctctcaaacttcaacattacatagtatctctcattcagttcatgaatcaggtcaggtcaggtcaggtgatgagctcgatgctgtactcccacagcctcttggccagctccatgtcattgcctttctcactcgcctcgttcacattgctgtcactgaagtacttcccggacacacccttcacctgtgggtgcaatgcaacataacaagtggtggcccgcccctgttcatttacaccacaaactcaccatcaccaacatattacattcaccatgaatttgatgcaccacccagctcccccctctagcccggcctatctagatcgtcaactaaattgcagataatgataagcacaatctggccatcatgcaatgctctctactcttaaacttaagattaatctgccatttcctatatctcacaaaatccaaacaaaaactggtgtactactaccataccagctagagaacattttgaaatgctcagtatcttgcattttgctttttctttagcacggctagatgtctgtaatagctgattcattgttccacccattgtcatgtaaagagtttttgtgtaatagcttttctgtaagggccaaaactagcatctccaacaaatagtgtatccattaaaacaaccagttgcatacaactgatttctatgaaagatttgctaaccattggcataaccacatataaagcgtagaatggagagaaggcccagaatattaaaaaaggtgcacaaccatacctgctgagcatttttaagcaccaatttaccaagtgtccgatggagaactgcatataacaaatataatattcatgagatcagttattacaacagaaaacaagctcttttaaccattgaaaatctagttttaacccaccactgcagtcaagtaaagcactagtatttcgttcacagnatgtgntattttctttcctttggaaggtatcctaggccttgctgctatttctttatgggggggaaagcccatatgtgcatgatttttcagaagatttgttttgtacatggttcaggtaaatattttgaagtcatgagtggaagatccctttactttcaaaacaggaa

SEQ ID NO: 29712 - DNA, 5347 bp, Oryza sativa
  unsure (1)..(5347): unsure at all n locations
aggactgatctacgattnggcaaagncgagctcggnnccccgttaataaacatatctcaatagaaataactccaaatacagcgttgcaccaaaaaaaatatatctataactggcgacatgatctaagagaagagcaatgcgcaccttaaatctcctagcaagttcattcgcatgcaaaatgtttgcaagctttgactgcccatatgctccaatggagttgtacctgtacaacacaagattgaaccatatattagtacagtacaattcctttgaaggaagttaacaaggaaaagaaaaacaaagtgcataaaagttgcatactccgactcgtcatttatcttggcaaagcggatgccttcccgatatgcaaacctgtgcccctctgatgaaacattaacgattcttccttccacatttgattcacgagaggtctttttcattgtctccaagagaagatgagtcaaaagaaaatgacctgaaaattatgacaggagatacacattttaacgcaatgatacacagctctctccagcatgtttgagagaaaaagggacacattttaactcattggtatccgtaactatcataatgaattagaacattgaggaacaggtgaagtagaaaattgctatggactgttgaaataaatttgactaattagaaggatgcaaagtcttccttacttcttaaagaatatggctggaaaaacatttgcaacactacgtagtagttaatgagaagcttttaaatcagtgtaaccggtgcatgaagttcataccaacatggttagtggcaaattgcaactcgataccatcctttgagagagagaaaggagttgccatcacccctgcattgttgctgcaaacaaaaccaccaaccaatcaggaagtgtgatgagctataaaagaagcattctaataactacgcaaccaaacaagcatgaaacacagacacttgtcggtagtactaaatgtgatttttagggtattcataggaaggagctgtactatcatagtagtataattaacggcagcaagatataaatgaagatatccagtggctgcagaaaaattttgagcaccaaatgtaataaaacacaaacacatgcacaagtcatgccattgttcctggagttataccatttcatggttaaaacaagaaaccatacatttaacatgccctccctgatttttgcgctagaaaagagtaaagaaaagcataggaagagcttgttgtgaccttcagctagtaagattgtttacaataaaaacatggaaatcgtagctaacatgatagaagaaagtgttgtttacagtaaaaataggtccatgcggccgtagtagaagtaatatagcagtaggctagtcatatgtatccagcatgcaactagtactactcctacttgagaaagcaaaaaggaagttgtagtccctctgagagctgaatcataattccatgaaaatggcttccacccactcctggaattggagtatgtcttagcgtggggtagagatgcaggattgaatgtgtagagtatgatgttgcattgtccaaaaaaacaaggtgcaactgaggtagtatagtactagtagctgaatttagtgaaagcagcagtgagtagtgaatgcagtgcaggtaggtaggatactgctggtcctaactgaaaaatgagggaatttgtacttggcattgaaagaggagtactagtacatgaggatattgagggggaggcccttggcggcgaagtcggaggcgaaggcgcggacggagtccatggaggcgaggtcgagctccatgaggtcgagggaagcggcaggggcgtcggcgaggatggcgtcgcgcacgggctgcgcggcggcgaggttgcggacggccatgacgacgtgtgccccgcggatggcgaggacgcgagccgtctcggcgccgatgccgctggaggcgccggtgacgatggcggtgaggccggcggcggagagcccggcggtgacttggtcggcggtggaggcccacgagaagcccgagggcccactccgccggaacaaccaagaagacatcatcaatctctctctccgccgcgcaaccgcaagatgtgtgggtgggacaacgcagtcgctgttgcctcgtcctagtactgtctaccctagtcagtggactactcgtcacaagtcagcatcatcaccatcagcagccagactattgattttattatagaggacgtgcggattggatgagaaaatagttatggcacgcgagattttattacagaggacatacggattggatgagaaaatagtccagacacaaattttagggtaaaaaagtcaagatatgcgaatttgatgctaaaaaagtggcatacgaacaaattttatggtaaaaaaagtcaagatatgagaatttgatgctaaaaaagtggcatacgaagaatttgatggtaaattctctaaattctccacaaggagagcatccatccatcatcaattgacgaaccagaaccaaaaatgaaaaaaaaaacattgctcttgaattgctattcttcagtcatcgtcgatcaaacgaaacaaaatacgccttacaataaaaacataagaaacggagggagcagtaaataccccatttactcctgatatgatatgatggagtatattacaattacatacatgcaacccaaaaccaaaaccaaaaccagcacaacattcactaatcttgtccatgtttgcaacgaatccaatgttaacgcacgcaccggctgtcatatcatataactataactgtatatataaacaaataaattcaatgttcatgaaccccggctgtcatctactccaaaccaaattaaaatgcagcttaattccctgctcgtctaacaaaaagccatcacttcatttcctacggagtagtgcccacacgccaggaacccccctctgccaacttcactagttctagtaactccgattggttgatgatgcagactcaacccttgctacttcgccggctcaacaggatcccacgttacttgcttcagccttcagggcacaggacaagcttcacatgatctgcgtttattgcttccttccatcctacaaaaacagtacatgaccatgattccagctaaacaaggagatgtacttataagtttgatcaaccttttatacggtatgcgagtggataaacagtagtaatggaaaaaaagaaagggtgaccatcagcaccaattggaaaaagaagtggaacagccactagcaattaacaaatataaaaatgcgcaacaaccaccagcaattgaaagagtgcaagaaccagaaagataattactttgagaaaggaaggcagctgcttctttactggaaaagatggcgcctcgtaagcctccaccctctgccaaccctgcattgcagcagcttgaacaattgtttccatctgtcataacgccggatgaagaatgatcctgtgctgttggagtaatactaacttcaacatcattatgagcattgtatccgtttccctcttctccatggttaaatggctgcatcaccttcgttacaggatggttgccaatattcaattgagaagcaggagtcgggtattccttggaatattggttatcctccaagcattcgctgccgtcttcaatggcaacacttatggatcctattaatacacgagacttcttgttcagaacaatctcttgcccatcatctatattcaactcatcttttgggctgtgctcttcaatctcagttcgcactttccatgtccatgttttgtttctatttgacactgcaccggcatttgcacccctgtaatgtgaatgccttactgaagctggatgctttgaaccaattgcagaaccaccagaggcaaagctattttgggcaaagttttctgttcttcctacacgatgtcttgaaaagacttgttgattcaaagtaacacttggattcacttcatggcctggatcatgaatgtcatgttctacaggtaggtcagcaaaactactattatcttccgaagccactggcgttggcaactgtgtatcttcttgctcataaaggccaggatccgaagtggcttccttcagacttagtattccagaagaatctgttgtcccatccacagatccaggaaaacggtctgtgacatcctcatccttcaagtctttcaatctctgttctttctgcctcagtttcttcatccgttttctttctatcagttcagcttgccttcaagatacagatgatgatgttgaattaaatgattttgcattgatacaaacaataagctggtaaatagtgctttccagcttttagaaattgcaatcatccatggtattaagcactaaccttttctgagcagcttcctcttcctccacgagcaacttctggcatcttaatgcttcagcagccttatcagcagaccatgcttcgacctgatgttttatgtacagccactataaaaactgaatgtaaatgcatatcatattttgcaaattgtagtgaaatcttaccagtgtttgttcaagcatataactagtgcatgcaacagcatttttcaactcaggtgcaactttgtcagcctccccgttaaatataaacttttgtatacaggcggttgggttagtagagagaaacgtattctcacttgcttcgtcaagcatgctaaatagttcattcgatgatacaggtaaccttgaagctgttgtttcaattaggtcctatagcgggtaaaatgaagcttagatatgagactaataataggtttatatggtagagcaggataatttaggtcaaaaaccttaccagaagttgattgccagctctggcatatggcagcggtaatgaagcataccccggcttacacatccatgtggacagtgctgctaaaatggaaggaccagtgacaccctgaaaatgtattcacattccaactttagatcactgtttatgatcaacacactgatccagagacattattgcacatattttctggagttacctctatatccacatctgccaaggacaaaattgttttggcctgatccaacgtaagctgaagagcgtgacaaataaattcaatgctatgagaaacagttaaagtccagcgcatgattaattattatgtcatctatataaggagttgttactcaacatgcatgcatatggactagtatagatgcacatgcacttcatggtgtcaagatagcaaaaacagaaactagacagtgaaaaatgcatgctggcggtagagtattcttcacgtgaaaagnnnnnnnnnnnnnnnnnnnnnnnnnnnnnnnnnnnnnnnnnnnnnnnnnnnnnnnnnnnnnnnnnnnngatctacctccatc

SEQ ID NO: 29713 - DNA, 31684 bp, Oryza sativa
  unsure (1)..(31684): unsure at all n locations
gcctgggatgattgcccnnnnnnnnnnnnnnnnnnnnnnnnnnnnnnnnnnnnnnnnnnnnnnnnnnnnnnnnnnnnnnnnnnnatgaatgaatataccttggattggattggaaccgaatatgagaggcggcggcggcggcgcacgaggaagggaagggaagggaagggaagggaggatcgatcggaaattcggtttgcagatgggatgggtacagaacagtaccctagaaccaaccaaccccaaatgaaccgcaagggcttcttggtcaattctcccttctctcaattgaattgaaattataataatttctcagtaggaaccacattttcttttaaaaatattgtatatatctttgtttttttaaaaagctaggtttgtttcagtttaaaattattataatttagttttttgagctagattactataagctactcccttcgtccaaaaaaaaaaggcaaaccctagctattttttggacggagggagtagattataataagatgtgagctgtttttatttctatagattattggatgcatggaggctaatgtctataatactctcatctattttggatatcttgtgtaactgtatataacaagtatataatatgaagtagctaaaaaatatattaataaataaaacattcatgaatatttttatttgtataataggctgaacacgaaatattatctcttagcaaataaagcatcaataatactatcccgaaggagctggatttgcgcgcagctagggagggaggacacgaatgtgtgcatgatcggagaagaaagggaatgcacactcggctagggaaagagccatctccataatcgggaaaggaagggaatgcgcgctggactagggaaggaagggaatgtgcgctcggacagggaaagaggtatctcgatctgtttggttctcgcagtggtgggtaatttacgtaaagtttttaggggtaatgggtcttttgtcacccaataatctataaaaaaaacacctttagaggagattatcatattataccaatatagcttatattttataataatctatctggtttgttttagattactccaaataatttaaatcattataatcctaagctaaatcaaacatggcctaaatttaaactttcaagtttcggtcaaagctaattagttgtacgagtgcgttaaaattatattgacatttttaaatgttttcacttagggcctcatcttttcgtttatgcttatgtttatcagttaaaatttgaatttttaaccttaaatttggagctgattttgaggttttttcatcaaatattatttttcagcctttacttttagatcgctaagaacacatatataaaagttttattcacaaattacttttcatttgcaaatatgtcgttcctcttattctgtgaataagcgaaacgatggctccgtcaatgttactactagctattaaaaaaatatttattaaaagagtaatatgtaatagttttaaatcaaaatatgtgttctaaaaccttataaatatttaagttatgatattttgttgcatgctaagtatggtagtacaatttccatccttcaaagcataatgatcttttttttaaataaaataaatcaaagttggaaaataaaagcactggtcaacagtgacaggtaaataggagcatattgatgcatacattgatacatatggcaatcttgaagatgaaaaattggagcaaccattataatgctaaaataattacattgacagtagtacaaaacaggttatttgacactttgactgttgactaccgtagaccccctatccttatgtacatgcacaggcaacatgcatactgaaaagtagctagctactcctagtttttcttaaaagaaaaaagaaaaagaaaaagaaaaaaatacgcctatactgtaggagtagtaattactatcgacggctaggttgcatgaatagaaatagaagtccatttccgagatttagatggtgaatttgccatgcggagcataatgtcaagcgacctccactcagcgtcgcacgtgattgccggtcgccgcttcctctccaggctgcagcagcgcagcgccaggcggagcagcttctcggcctgcacctccggccagctcccggcggaggcgtccagcacggagtggacggcgtccatcttgagggcctcgcgcacctggtcggcgatgttgaggtcgagcagtccggtgagcacctggaggacgacgacgccgaaggcgtagacgtcggactcggcggtgagctcgccggtgacgaagaagacggggtccatgtagccggtggtgcccatggggttggtgcggcggcaaatggtgtccgcctggtcctgcagcggcttgacgtgcaccgcgcgcgccgtgccgaagtcgccgaggcggctggagttggcggcgtctaggaggatgttggtgagcttgaggtcggcgtggatgatggcgtgggggcggcaggaatggaggtaggccagcgcggaacgctgctcgccgaggatcctcacgcgatccttccatgacagactcttggagttggagaggatgtccaagagggtgccattgggcaggtgctcgtacaccagcccgcatgactccgggcacacgcccatgagcctcactatgtgtggatgctccattctactcagcaccacaacctgcaatcatcccatgcattctatataatacaactgcttccttcttcagtaaactaactacttaatgttaatgacataggaggaggagtatatatatatttacctcctgcttgtactctggaaatccttgcctgccatggggtctcagcagcttgatggccactgccacgccacccagttttcccttgtacactggcccatagcctccttcacctatcaggtttcctgagcagaagttgcccgttgctttactgatcatcgacatggagaaccgtgagatatgttgtggaagttgcagctctgggtatcttcctgttgatagcctcttctccttcttcagtgaagcagcagcagccttttgcctaggtgacaagatgctcctatcatcctcttcttgcagctctttcagtttcctttggagtttgtctatttcttcctgccaacaacaatgtgaagcattcatcacatatacaaacttctccaagaaatcaataaataaattcaaatgattctgtgtttttatgtccatgcttagataggccctgctgtttctgatttcataactggaatataagctagagaaatgaagcatatatgcaacttttaccatcagttcttcagctctttcagttgtacttctaaaactctgtatctcatcagttctatgagcagtctctccggaagagtgctccccctcctcctcataagaatttagttcccctgtttctatgctttcctcatcctttgtttcggtttcctgcacatcacactacagaaagcaaatcagctcttctctttatttatgaacactgcagctttcacaaatcacaagttgtaacaccacaacatttttaccaaatatagttactgtgaaaaccaaccttattacacgcagtgtgaacctaaattatcaatctttcctgttgtgtgggcaaacttgaaaaaacatgcataagttttcaccactagcgctcatgctctaataattatcttatgggtttcatctatccattatctaaaaaaatgttgtaataattgtcttgaaagtaaaattaaggaaaatagccataccgttgccaattcatcagcaccatccatttgaataaccccatcatcatacatgatttcatctgcctaaagtgaaacatattcgagaatacatcagaaattagtattcgaaatctgaaccaagatcatagactgcatgcatttgtttagtgctttgctaggaagccgcttacaaaatcacttggtggtgttgtgtagccatttgaatcatcgctcagctcatgtacagatgccaaagattcagcgctccctccatatccaatgctcccggtatgttccagatgatcattgctgcattttagaatgatctcatccatgaacttgttgctagatttgatccaatattgctgcaggtgttgattatagattttggagaatatctcaaactatacctagtacacatgtgttttccattgataaccacccaaacctgacagcatttgcgcagcatcgcttcctttgacatgctcctgcataataccctggtttagcatgcgcatggagtaatatatgccaatagagaaatggatctcttttgaaagaaggaatggaaattcaaaatgtagaatttgggatcttaccttgaaccaatgataattctcttaattttgagcttctttatcagattcacaacaccagcaagaacatcatcgtgtgaaaggtaatgtgccctaacctgtacggacagcctgcttagataacatgatttctttttcttttcttttttttggccaaatagtaactatcccaccacacttatattttattggttcaactgtcaatatcgttgaagtcaattattcaccatatggtaggaagctcattcattgcatatttggggttcaaatagtagacctaaggcaaaattctagtatttacaactagaactcatttccacgcttttttaggaaggactgcagaaaacattcttatgtactccatagtagtttatgaatttgctatatgcttacaaataagaaaccctgaaaatctcatagaattaatatctgatttatacttgtcagatgagtgggatgcttaaataagcactgcttaatcggactcacatgattcaaactaagaaccgaaggataattagtatcacctttcttgatccacaaaggtttttgtattgtgacaacatcttgaccatcgcatccgtttctttggctcgatgcatctccttctccttttcatctgcaaacttatatagaactttgccacccactgcagttgttggaaaggagcaaagtattgttcatacagcacatgacaatcaggacacgctatgctgttagtttttacgttcatcaagaaaaactattttatggcaatttattatacttccatttcgcagaataacaagagtgtatgaaagccagcgttttacacatgggaaatcacaagtaataggaattaggcatcttccttttactctactgataggaagactaggatgcacataaactaagatggtcatgaatattaaatcaacaaatcatcttttatcgggtacaagatcacctatcgtactgtcaacaaatttccccccttttttaggattgaatggtgtagcgctttctttttaacacagttgaaagataaattgcattggcttatggaaataaatttgtctgaagaagtatgaagatcttactgaagggcatccacttggaaggccagtgaacatgaacaagaactatagtggcccttgggaaccttgcagcagcccataagatgttagccttctcctttctgaagttcttcccaaccgcaatatgaatctcttcctcatccatcttttcttgccctcttctacatcaggaactaaaatcaaattgtggttctgatcttgtcaatatatctggttcagcagcagaagcaagcaaggcttgaaaggaagaaggtaagagtatatctgaacttgatccagaagaaagggaagctaaagtaccttattgtggtgcaccacttttcatcaacttcacttcatggtggtatctgtatcaataccatcaacttcatggtattcttaaaactagaaagtatcagttgaaagaagggccaaaggtggggagagacagccgggggttttaaagcttgtttaccatggtctgaggtttcaacagcttgatggtatccagcagcagtatcaggctgtgggtcccaaaatgcaatccaatcaggaaattataccacttccaacttggcagtattgttttgccctctcagtattcagtagccactaactcctgctgcatacttggtttgcgaaacggcaggttcatttagatcatcaactgcaaatgattttacaagttgcataggagagactgtaatctcatcaatgtttctattcaatttgaatttttaagctaaaatcatcatttttacaaatcttttgtaattaatggcttgtctgtttgttcatcagatagaaacaagaacgaatggtattgttccagctgagggttccgagttttccaagaaatttctgtccaagacgctgtcgtacatgtttgtccttgatcgacgactgactttggaagattagcagtgaagtcttgtatatatctccccggccggtcggcaatataatgcagctaaacacgttattttcaagttgcagaagaattgattagtcgtcattggattggatgcaagctttgaattctggtgtgcatttgctgaatacctgaatggttattcgacatttggccctcatccttctctttccctggacgttgctttcacagaattcttgctccccaggctgtcaatatagtaatgcaaatgaagacatgtcattaaagcgatatgaacagcatataccagaatcattctttctttctaccactgaacaaatcaagtgcatgcgttaagattgaggtttgcattgtaatctccacatcaaggaggcgcagtttcttccagatttctgacttcagaagatcccagttgattcatcacacattattcttactgtaactctttaagcagcaatttggtccgacattgcacctttttataatttttcggcgaattgcatatgcaaggaactttgacaaatttaagcactggacgcatatttcaaaaagaaggttttgtcctactcgatgactttgtgtcatcagcatacctaaccagctagcttttgcacaattcaaactttcaggttagacatcgtggcacaggaaacagtatataatcagaatggttacaacacgtaagcatgataacattataaatggtgaaattctgatctgatagttctattcatacatgtatttccacttccatacactctagctgagcatttttttggctattgctcagatatcacaactctctactacactgacaaagtgacaagtgactacctgtacaatgtctaccatgctactgatggagcagagatagctccgaatttattatattttttacatacaggttttgctaaaaaaaagaaaagaaaagaacaaccgtgtgtatacctttaattagtcattccttcagaacaaaaaaagacacaagacgtttggtttcctgtggtttctgcttattaaccctggtctgagatgtatcttcagaagatatatgacataattttcattgttactttccatgatgagaatccaaacatattaatctgcatttgactgaagccattcttgaattgcagaacggagggcatggttcggcaaaagatcacggtgtggtagatcgaggtttgtcatgggtgatgtatagtgaccactatcaaaccactctcttatagcctctgcttcgtaggtgaaaccatctgcagcaattaaagggtccctcatgacatcctgcaatgcataaaatgcacaggtgaaccaagggagaagaaaactgattatctttccttaggtaacacacaaaaaatttggtgtgtcattgcatcagggttgagaaacacacatacaaacagtagtttacaatggtcatttcattagtaacaagaactgagagctcccataacttgaagttcacagagatgtttgcagaactgatatctcaactgctgtccaggcaaacaattgactgactttctctaaaattactaagaatcatactaaatggaaacagaagctcaggagtaatttggagttaatcaaataacatcaggaatcataaatggaagcagaagcgcaagaggaatttaaatccaatcaaatgtcaccctttgatttctcttattgtatacaaaaaatatttcatctagttatcctttagagactagtatattaaaaaaaatagaaatggatatcattacatagacggaccaattaccaaacatgagagtctgaaggaaatcatggtgaggaaatacttttgagagaagggggagtaataatcactaagtaaagtatatatgactaacctgttgtattggacagatgaagtaggatggcacattaccaaagtcttcagatactgatttaaatgataatgaacatagcatagaggaagcagacctcaacattggttcaagtactgtccaaacctctgtttgcaggtcaggacggttttttcttctgatttcacagcatcttaggcctacccgagacaactgctcagcatgcataagaggccagtctccagctgatgaatccaatattgcttgcaagcaaccctttgctactgcccgttgcacatctttcaaaagaccaaatcctgatcttccagtcaagagtcgcaggagtatgataccaaaagaatatacatcagataggggtgtcagatcaccagaaatagcgtattcaggatcaatgtacacaaaagttccttttgggtgggtatggcggtatagagtggttgtggccttgaattcatcagttaacattcggcacacaccaaaaccactaagcttagccacattatttccatcaagaagaatgttagatgctttcaagtcactgtgaacaatgctgtggggtttattggaatggagaaaaatcagtgcagaacaaatattggaagcgatgcgggtacgcaactgccaactaagaggctttgaattgtccttgcaagccaagcggtcatctaagcttccattgggcatgtattcatagacaagagctcgggcatccttgcatgcccctataagagttacaagattcggatgtcgcaccctgctaaggatttccacctgtaaattatcagcaagaacaacttaactgtctgaaatacaacagtttatttggaccaacaaaatgtcaatcaagtttatagaaggtaagtatataactagaacaaaaacttttacctcatgactgaactgtgacagtgactctgtgctttcaggattcaacttctttacagccacatttgtttgccgaagaagtcccttatatacacttccataaacactttccccaaccttcgatgagtgatcaaagttgctggttgcctccttaatctctgatatcgatagctctgtaatgggaattgttctatccgcaattgcagtagactctccattttttacacgtattgcttctgcctctcttactgctttgtcacgctgcaacataagatccttgataatacggtcagaatgggcgcttcgcttctctaggaccaatatcttctcacattgctcttgaaattttgcagcaagttcatcagctgttcttgcaagcctgtcaacttcctccattgttgttgccaattttacctctatttcattcttttgcttcagttctccaaagtacaaattctctgatacctgcacctgttggtgatattaaatgtgagaccaaggattttgtttaaatctgtaggtatcacttatccaaaacatcatttccagatttatactccacgatatagagtataacaatcatgaaagttttttacatggacagtacgaagaatttctctgctctcattggcatgcagccatattatcattagaataaccattaagtatagcacacattatatgagagataaatataattaatctattcttactttctggagagcctcaaataactcctgctctgctttctcacgcctacatttctcctcataagcttcttgtcttactctctctaactgcatgggtatatgctggagctcattgtcagactcaccacgctctttagtatcttcctgcataagattgggtagcttattcatgcatcaaaatttgtgagagcactgccattaagatattagagagctcccaaaattcaaaggaaaactagataagatgatcaaaagtacaaactggtgagctattagacaaaatggcataccatgtaatgatcctctaacttatgtatgtatcaagcaaatgctccatcatggatccatttcaagtgaggatgcaatgtggacagatcaattagtgatcttaatcagatccaacatcgacgtaattgtgcttaccttttccttatcagagtatctgtctgaactagttgtctcgatatgtggttcgaggtttagtttgtgtagccatgtgtttgaaacacaccaaatctctgacaagctactcgatctctccactgaacattgtgcagaagtagcactttgcctacagtcctgcatcacatcatggccaaagggagcagccttcctagtgtagagaatacaaaggaagagaacatagtaaatgcaaatggatgcaggctggaaagtccgtaatgtaggaacaaagtgaagtgtatgatcagcttacaaccatacctacagtataccagtgtgcctttgcaaatgaaccatattttgcagaaatgatctgcatgctgttctacaactcgtgctttcctggatttcagaaccttcattttcctgaactcttgaaacaaggagttaggttttagagaattaatagggcaaagattactatttagattttagaacgtactgaagcagtacaaacactaagtttgcttcccagaaaaccaaggtgcaagcaattagtgttaacatttaattatcttgaagaatttatttagctaagtagacaaaaaccaacacttctcccaagcatggttccttactagcatccactgtgatcacagtgtttcatcatagttactactactacggataaaaatgcataaaagtattccaagctttggcacatgcgtactttgtatagtgcttatcatctgcggcccccattacaagcatggaaacattatgctcagagatgacgtccaccaatccgtatgcaacatcatctgattcaaccaccaatttctcagcttgtacctagagatgaatagcacagtgaagtatcaatcgagattacggatgacattttgcaacaaacaaaaccaatgaattgatacatccgtgttggcctttacatgtgaatacaactgaattttagttcaataaagtgggaaacaggcagaccttctgctgcgcgcatatgagttggtattgatccaagttgtcactgattctttgcaggttcatcttcttgtgtgcaatcagctcctgctctcgcagctggcgggcgggaatcttggctccgactgcacacgacaatggatggaggttgcataagcatttgcagccatacacatacatggactgaaaactctaagaggaagccagagatgtaaacaaaatggaagccaaactcaatctgaatgaattgagttggcctcgattgtaaaaacgtagggggtaaaatggtgcattaaaaaaagagagagaaatgatttagtgtgtggggaaaaaggttgtaaatttggagtcattgagggaactggacaaagaaactagacgatctgtgccaatacaatcgtggtagatcggatcatcaatctagactctagtactagtgtaggtaggaggaagagggatgcgtacggatggggaggaagttgggaggggagtagacatggagcagcacgaaggcggtgccttgggggaacttgtgcagcgcccacagcagcgtgcccctgctggactcctcccccaccgccacgtacaccttctcgccggagaaggacggctccggcgaatcaccggggtacggagagggggagcccgccgtggccatggctttgttggcctcgcctcgccggcgccgctttggaatccttctttgtgttggactctcttcttgttgcctccctccctgcctgctctcactttaatactccactgctaatctcaaaatatataagcatttagatattgtcataagtcaaattatgaggacaataaacatcattagatgcattgtgaaatatatattttagtaattttatcttttttttatgtgatagtagatgctaatgttcttatttataaacttgataaacttagcatagtttaaccaagaacagactcgtaaatacttatattctactagaacggagagagtagcattctacaaatgttttggttatgttctggtgatttgaatagtaaatatcaagattcttatttcaaaccaaactatggacactaccaacatctaattctttttgccgggtgggccaaaggctggccgacaaattttcattaataatgaaagaaaatgacagtttagacatataaagtgtcatttccaatggagttcaagagtatttttaaatggtagtttctgcaaggtcccttttttcgctatattttgaatgacttcaatgcttgtgaaaatacaatatacatataagagagttgaattgaggttgaaaacagaaggcataggatttgtattgcagttgcggcagacttataggttgcaaatgcatttaccttctgaaattgaattagttatgacgatgtcatttctgcatttactaatttgtcaacaggacctatgttagcacaattgactacaggcacacgtctgctcggtgcattgccgttgacgcttaactgttaattggtgattggctcaattaagagtgcattgtctgagtatgttccataaaaatcaatttctaactataaatctagacatagcatatgttcaggtttacagtcatgaattagttttaaattttattggaacggatcttcccttctcttgtaccatgtcctttctttttatttttcaggcccattctgtaaatacatttatttctcttaataaaaaatacgtgtctcgcgtattcctaaaattttgttggaacggagggagggagtatgtgttaaatacgtatacaaccatctatctgtataaaatcgcactgtctaacgtactgttaatctagctactagctatcaggcttcacggtttgaatttcacctagtgatttaagattatcctgcaggaagcatataactacatttttcacacctgaccttgcacaattatcctgtaggagtaacttcctttatatagaacatagtacaatacaactaaccaagattattatgaaatgtgcaactactacaattgcgtacgtaaattacctcgtcaattacaacatatcacaagtctccgtaaacaatcaatgtatgaaaggaaagaagctttttaaaaaggttgaaattaaaggttgaaaatttccttgtccttaacactactaactgctactagtgtctatgtcgaccgcacttgctcactcacaaaaagcttaccgtcatctagtacaccagtatcaccttcatcgacgaccgactgaatgaactccaggtcgtaaagtgtgctccctccgtcccagaaaagttaaccaacaaatatatccagattcgttgtattacagtacagcccccgctaaccactgtcttctttctgaaatatgaaaccttatattggacgtctcgatctaattgatagtactagcttatatattttgtgatagaagaaatactgtaatagaagcatgcatgtgcatatcttcacttaatttatgaaagcaaatgaaatatctttgcttgaaattatctaagctatatatatataagagcatcctagtcatctactccctccgtagaaaaagccaacctataaggggatccctctagtactataaatttggacaaagagctgtccagattcattgtacttttaagattggattttttttttacggagggactatagtgataaggcttaacttgtcagttactcttgtgcaaaaagctaaaacgcgtggaaaaactaaacagaatgtcggtcactgatgagtcctttgctttgctggattccgattgaaacaatagctccgttcatggttgatttgaatctctagctagccacctcaatttctctgtattttcctttcttctacttttttttgataaagtgaggatggagcgatattaaatgatgctatgcagcatatttctattaaaaaaatccattttactctctcgaataattaaaatccctaaactttttttggctaattttgttcccgtaaactattaaaattgttcactttactacttgatactctatctatctcaaaacaaaattatttctgttccttcttgtttgtctaaaataaatttatttttgagcaattatttcactgaagtttgtgaaagtggaaccaaattcgttgggagtacataaagtgggtaacatcttaatatgattaatatcttaagctgattttttaagccatagataacactattatgaaaggtccaaaatatttcaagattatatcatgaacgcttgtttacacttcaaaatctcgaagtttatatcaataagtgtttccaacctactccatatgttcgacaaaaaaccaacataatactagatgaggcatttcctagtatatcgaatctagacatagcctgtccagattcgttgtgctagaaaatgtctcatccaatcttttttttttacggagggagtatgtaaaacaatgatatttttttaaaaaataatatcaggaggtaagtgcaattttaggagtgagaggggaaaaataagaggaagagaaaattacccaacacactctattagatgaggtggtagagagtaggatggtagttaaaggtaaaatagagaaaaaaaataaatgagatgtgattaatgtgataagtagtatgataggattgcacttattttgagataggattaaaatctaggccatgtttacttcccaaaaacttttcacaaaaacataacatcgaatctttggacacatgtatggagcattaaatatagataaaaagaaaaactaattacacaatttacatgaaacgagacaaatcttttgagcctaattagtccatgattagctataagtgttacagtaacccacatgtgctaatgacggcttaattaggctcaaaagatccgtctcgcggtttgcaggcgagttatgaaattagttttttcattcgtgtacgaaaacccctttcgacatccggtcaaacgtccgatgtgacaccaaaaattttcatttcaccaactaaacatgcccctaaaattgcacacttgtagatctagggatgaaaaattttgacatgtcaaattggatatacgaacacacatttgaagtattaaacgtagactaataacaaaataaattacatattccacctgtaaattgcgagacgaatttattaagcctaattaatctatcattagcaaatgtttactgtagcaccgaattatcaaatcatggcgcatttaggcttaaaagatttgtctcgcaatttacacgcaatctgtgtaattagttattttcttatatttaatactctatatatgtgtccaaacatttaatgtgaaatggcgaaaaaatttgctagaggatctaaaacaggcccttatgtagagagagagaaaagagatactttagacatgctagacaacgtgtttttctggcagatctacgcgtaaaatgagaaacatggttaacatgtggtgattgagtattaacttaaaaacttaaaaaatagatttatttgattttctttaaacgcaaattctatatcacaaccacgtaagtttagtagattgaaaaatgtgataacgaaaaaacaagaagtagctatggtcaaatagcactttagaacagaccccgaatatagttccggtattgaaatatagaatgaattgcgcatcttttctatcagcttaggcgcttttggactgtaaagaatgtataaacagttagtactactccaaatcgtgttccacatttctattttgcacatttgcaggcaggcgccgggttgatgagtccatcttgatttgccgctgcggcggcggcggttgcgagttgggacgaacaggccaggcggactgcagggcataggcatggccgcccgccccccggacccggagctcatcgaggtaagtttcggattgggagttcgtgcttgcttgctttattggcttaatttcgagcactatgctatgcaatgctatgcttggtcaactaccgatcgatgatcaattgcagcggctgctcaatttttttttttttgcctcttccggtcctcccccttctctattgtttgggtgccttgagctgttgcacgccacctgtttgtatgaatgccatgccctcgtgcttgaagattctgcaaccaaatgttgcattcgtgctaatattgcttcacatgtactgctcatcctacccatggatcgcaaggagagccttcatttttcaccaatatataattccactaaaaccatgactcagtcatgtagttgtggcgcttatttcgcctcattgaaaaagctgctcatgaggcttatcaactaaagctacggcgaattaatcatctttttgttgttaaactatctagggcctgcattccatgaaaattacctagggcagtaaactcatgcttcacatgtctctttcaaggttagaggtgctagagggatggagggttgttaaggaatacacaatcacatatcgagttaaattattgcacagactaagccaatatcaaatggatatacgcaatttggaggaaagtcatgaacaaataaaagtctgtaccttccccctttctggttgaataagcttaagtttttctttttctcaaacagtatgactccaagccaacagtgacctctccctttccttttttcctgtttgaaactagaacttcaatgctccagtgtttgtgaattatcatcagttttattttttgaaagtccggcagggggatcctatatctccgatgatcttcatccttgccatggattctctgaactcccttttcgtcaaagcggaagagttggggctcctccaaccattggggatcccccaccgggtctccctctacgccgacgatgtggtcgccttcgtcaagccgacagtcggtgagctgcagtaagggttgcaattgtgtcaaatccccgcctgctagccctcccaactttaaggcaggaattgcagagccagagatagaaagaatagggtcttcaattctcagcaaaggccttggtcagagatagcccgagctttggcggcggaagcgactctctggtggttggcacacgcggcgctgccggtgctaaccatttaggtcttgttctaggtcatcccctttctgttgccacgagaataggcttaagctagctgttgatcccttgtatcccgtcccccttctatttttcatttttggctcggtttgtacatacacttaatacaaagatgcgctccttgcgtattcccccaaaagaaaaaacataaggatgaggaaatcccatacaatatccctttcctaaaagcagcttatttgacagttcagggcagtcgagcaacaaccttttcatattagtgcagcatgttattcccttatcttcttcttgaagggcaggagaaatagaaagtgtaacaaaactatcatgccataccagtagttttaactgaaaaatcgcacatacattgttaatttctgaactgcccacactactataaactatccatgctcatggatttttactgcttaccatctgcactttttttttacgataataaccatctgaccttttgaatgatcgtgttgtagttttgcttccatgctgtaacgaacttctaactttgcaaaaggcagagataaaataggcatccattgacaggtggatctagtatccttttctgggtactacatcttcttggttaggttacgttgcaagtaagttcatcctaaacgtgtgagcctcctcaaatatgtacatcacttctatccatggactccaaaattttgagaaagtattagctgcttcagttaaaatgtaattccctacactatacaatttaaactattttcttaaactttagatacacgataaaatacaaaccaaataaaaggtcatagttgctgtttcatttgccactcttgaatggcaaaacgaagggcattattgggaatcagctcgtagtgtgtgaaactgaggtaggtcatgggggacgtcttatgccccctttgaagccagtcttttatagcctcaccttcatatgtgaatccatcagcagcaatatgtggatccttcatgatttcctgaaatattcaaaagatgctagattatttcaaattaaaagtaaaaacataaattcaggagaaggtgatgatgatactgataatagatttggcgaacgcgaagagttgttggtttggcataagccatcacacgatttgagtgcttaatttctttgatttgttatccatgttgaccatcaatagagtaatttctcatgtgctctatttgtgctggtgcttaatattgtttatgcaatagatatacagtggtagagatgctttgaaatttctattaatctactgtctcatgatgtaactgacctgtgtcattgggcagatgaaaaatgatggtatcttgcatttgttgtctggatagttcaccatggcttgtaaaacaccccaggcctccttggcaagatcagggcgctcctttctgtcataccggcaacatctcagtgctaggattgccaactttttactatactcaggtggccattcccctgcagaagcatcaactacctgttgcagcatttcattgttcagggctgcctctacctcactaggaaggcctagtggactcttgccagttagcaatcttagcagcactactccaaatgaatagacatcatactgtgctgtgagctcccctgaagcaatgtatcctggatccatgtatcccaatgtgcctttaatttggtttgtttggtggtaaggtgtgatggtggtgtttgtcagattcaacgaacgagatatcccaaagtcccctagcttgcctacaaagttgtctccaaggagaatattatcaggcttcagatcaccatgggcaatgccttttggtttgttggaatgaaggaagataagtgctgtgcagatgtcagcagcaattttgatcctcattctccatggaagtggatctgtttggtgtttacattgcaaacggtcctctaggctcccgtttggcaagaactcatagaccaaagctttggcctccctgcacactccaatcagggtcacaaggtttggatgtctcatccttcccagaatctctacctgtaatgtattggcaaaatcacatatttatataaagttttttactctctttctcatgtaaatatatagccataagttagaaggattggtgaaaaatacctcatcatcgaactctttctctcctgttatgccttcacggttgaatttctttatagccacagtggtatgacggagaaaacctttgtagacacttccacatccaccatgtccgatcattttggattcatcaaagtcgttagtcgcttctttaatctctgtgtaggtgaactctgtcaaggcaacagcactagtagaacaagatacattgttgcagtttatttggctcatcttttcagcttctttcacagcattgtctttctgacgttgcaactctccttgcacagtctggagctcttccattagagaattggcatgcataagctttctctccagttccattatttgctcatttgccttctgcagctcattgtagatctggaggtgctccttttcaagactgaccttttctctggttagtctttcctctaccgcaattttttctttacagagtgaattctcccgtgctctaaactgcgaaaaaaaaggtttgcaatttcgatataaagttgagagactcatctatcatgtagtaaaaactgtatgtacgtatttcactaacacatttgtgcatctttcaaaatacgacgtattttgaggcccaaaggtactaaaatcagtagattaagcataaattcttcatgatgagagggatatggggataacaaacaccataccatcttagacgcttcaaacagctctttctcggctttctgtcggccctcagatgcttcctttcttgaccgttctagctcattgcgaacttgctgccattgttcaaacatttcattctgcatgttagcttccacctgtaaattattaaggtttgatctgaattcagtagttgtcctttccttacttaaaaaaaaggtgcatccatgaaggtatccctagagatttgtttcagtacaatatagcttaccatgaaatgctgatgctcttcggagcttgagcttgaaacaggtactgataatccatccacagtgtccaaatctgtcagagttggtgaggaacctttgctttgatggctggaattcggggagcaaccttttggtgctacgtcgactgagtttggccttataggtgatatattttccacgccgttctctaattgtcttgaaaagggaaagggatgactaatggaattggaccgccgaggtagcgattgctgatctggagagcctaagaaacctgaataccatgacggcaacgacactgatcttggagggaattcagacttatctgacagagaactcccggagctgcttctgggggaatctcctttgtcagcaaactgactggcttccctaaaatggtaaacaatcacaataacgttgttttacaatcacaataagtttgtcaaaatggtaaattcaatgtggaattggatttatgttggagactaggtaggactgcatgaacattcatacctagtgcaagcaagagcttctttgcaaatatataagatctggcaatatggtttggcctgttgatgtacaattgctgcaacttttgattttggtacttgcctcttcctgttcatgaaagattcatgcccatggtcaacattgaaattttcagattatacactaattagaggatctggtctctagtttagacaagaagatgatagccattaaaacctagcttgttaacagtagtttaacgtcatattatgcttgccatttgctaagtaagaaatatacaagaaaggtaaattgctgagttgtattaggaaggggaaaatgcattgttcaagaagtgtttgcttgttggtcctgacgcctttgtcatcaatacttgttagaatgagcgacacaaacatgacaaataataaaatcacatctacggactacaatatgctcagtctagagatatctcagtggttgtgattcatgatgaggcctcagtacaatggaataagggcatcttggcatacactgagaaggaagatgttcccataacaagctttgtaatgtgatgttgatcaataagctcaacaatgccatttgcaacactgttcttctcaatcaccaatttttcagcttgcacctgcaaatttggtgattttgctgagatgacatagaatgggaagcaacttctgattagcataaaggatataaaatattgcatagatttctgtaatttgatgttcttattcaatccacttcatcagaacaattagtcataaagcttaatttgtctaggcctggtacaaaatgtggttaaaatattgattgttatctttccataaattgatcctcaagctgaccatagttcactttgttgaaaaataaaattcccatttcatatgacttgagtgagagtgcttatctgacctttggaaatgctctgcagtaactcaggtactgttctaaaagtttattcatatcgtccttctcaatctttctgtatgctctgagctccttttcttctagctgttttgcaggaaccttacacaagcctgcaaggatggcatcatcgcaggaaaccatgagcaccggcgtggacttcttttttttttttggcagagcaacatgtaacactaaaacaagtattatttcctttttctgtgggaaatatagaagattttctgatttttaagaaaatagatgtctggtagcaacttgggttaatgcataacatctaattgacagaacaccactttggttattttcaggttcattgtttgtatgatagctgcggtacagtctcttgagaagcagggcatatggaaaagaaaaaatgtgtgtgctgctgctttcccaattgaacagaccaaaggtgtctttcccagaagttgcagagaaaaacaacaatttgtggaaatggaaatacaaccgttgttgcctgctacgtggtactagttatcatactagtaatattgttagtgttgttgaatgctactacttactaataataacagaagaaaagggcaagtagaaggaaagaaattatataccgctcatgattctgtctgcaggctggtggacatgcagcagcacaagaagcttgttgacatcaccctgctgaggctggagtttcctagctgcccactggatgttggccttgccgtccttgaggtccttgccgaccgacacgtaagtctttcctccgtcatcgtcgtcgtcatcttcctcctcgtcaatctctctgaggctgcgggttcctccgcctgcgcgcaccaacatccgctcaacgcctgcaggtactaccggctgaggagacaagggcggcaatggtgacgacgacgacgacggcaacgaagaacgagcacttgccacggccatgcagcgcaaacaacttaaattaactgccctgccaccacacaaccgacagaataagaagcaaacaactgggagtagctagctaggcaggagaaagaacaagtacctactatatctttgcttgctttattatagtttctgctgctgctgctgctggaggcgacggcaacaacaaagcaaacaaaaggatcgaatctctcacaaaggggacttttggcttcgcttgtatgtcgtctggcaacttttataaactcatctgcttcagttattcgacaaaagaaagaaaaatctctgttaaatctatcttacatactccgtactagatagataggatattattgattgtgagatgaagacatttgggagccggggaagtttcctgcaggtatcatccttcatttttcattcatattccttcttccttaattctttttttgtcttcggtcaacaataggagggcgtggatttgtcctgcacagctgttaacttggaatatactgcctgcctagcttgcttttggtcttgggctagctgtacctgtactcccttttaaaagatcctgcatacaaccatgaccatgaaggaaactctcactcttaccaagtcttgcttctactgtttgccttccatcattggttaaaggttagtaatatgaaaatggaagacttattgtgcttaatcctatgttgggtgaggtcaaccttattagctgcgtaatggagtattattgtagtatactatatacaggtctgtgaatgtatatgattctcggatgtataatttatttgtgcttgttcggtgtcatcattctctcttactccatatatgtatatataagtagaagtaacacaagtagtagcagggtacattgacattgaaacggaacacttccttttgttgttgtatcacgttaatccaacatgaattacttaatcttttctagtcgttggatctgcattactagttcaactgacaaattaaggcggcacatacaaggttgcttgctagggaccctgctggtatatccaagatgtatcaggtatattccgccaagtcgtcagtcatcagacgaagaaatgagagaaaaattcttttgtttgaataaattaattggatggttggtttaagctatgcgattggtcagtcagtcatacgcatttcctatatagaatatagctcaagtatactcactctgtcctattttaaatgtaactattattttccgtgcacaactttaaccattcgtctcatttattttttttaaaaaaaacatgtactattcatattttatcatctcataacaataaaaatactaattataaacaactttaaataagatggataattaaagttgggcacagaaaattatgattgtatttaaaaaatgggacgggggagtactaggtgcatgtgtccttgttattgttaacaagttgtaattaatgtaacacgtaagtagtgcaacgaattcaattactaatacggccctgtttagttcacatcaaacttccctcaaactcctaacttttcatcacattacatcacatctaaaactttcctactcacataaattctcaacttattttccaaactaccaacttttcctaagcttcttcctaatttcaaaaattaaacacagcctacatttcagaggcagtctagctggctatcgagaagtgcaggccttgggcggcggtgtcgcctcttcctgcgcggatatatggagatggcgtctcacatattccaacagttctgtcagcacccacaaaatcaattggttgttgaatcaccccattcctcaagtcaatgggtaggatccatgccttgtgagcaaggtggtcgatgtgcaagctgagcacgggatgacccacatggagcttctccaagataggaaagtagttgggcagcttaggcatcaaatttgagacgtccgaagcatggagctggcagtcgttgcgccagcaaccagattatgtgttccaactctatttagcgagttatgaaattagttttttcattcatatccgaaaattcctttcgatatttggtcaaacgttcgatatgacacccaaaaaattttatttcaccaactaaacatgttctaagtggtggaggcagctggatgtagcttggggcaggttcctcttgaaggagattgacaagcacgatgcccagccaaaggtcaacgaaacccatcagtccaggagcttgggcggcgatactctctctccccaatctcacttccagggaagccaaaccaaaaaaaagaaaagaaaagaaagcgcccctcttctactcctcggttatgggcttatgggctaggtgcctaggtacttgggatgggcctttgcgacaagtgtgatccagtggaaaaagtacaccaaagatccctcaacttatcgtaagatacaaaatcgtcctcgaaccgcaaaaccagatatacggggtccctcaattatacaaaaccggtcacccaatgtctttggtggttttgaccctggttttggtccggtcactaagccaatgatgcaggaaatgcacgctaggagaagtttggcatgcttagttagtgggagcacttgaggaagactaaagcttgaaaggggcttcacttctaggacttcttggctaagaggatgcttgctataagaagtataagtaggcgggtaacgtttcatttcttccatagaatctcaatatggcgagaatgaagcagggcaattaaagtttgaattcaattcaatagtcaaggtagagtagaaagggggggcgtgctacttaacgcaactgcacttggctaagaaaataggatagagcagagagagcctaatctcccgcttggtcattgagcagtgagccgaggtgcgatgagcggttgagtcacgcactacaagatggctgaaggttggcggcttagtcctcgtgggacccacatagtccccacatgtcaggtgtccacgtcaccctctctttttcccctcctctctctcacttctctgcaagctaaccggggcgagacgggagggcagcgccgtgacggccgccggcggaggcagcgtgcgagcgcgacggcttctccgctttctccgcctcctcgtcccgctcggccgacgtgggcgcgctcgccggcgaacgcgtcggccctgtcagcggcgccggcgacgcgtacgcgcggtgggacgcggcggtggggtgccgggcgctcgcggagaactaccggccgtggtcgcccgacccagcggcgctgcagcacgacagcacgtacgtggttggttggttggcttcttttcggtttgttcgttccttgtggttgagagtgagtgaggtggaggagagagaggaggaagaggaggggattcattcacgtggtttccggagagagcaggagccaacgtgcggcttgactctggagatctctctctctctctctcaagcccaaatcagaagtgagtgagtgagtgattgattgattcctcctccgtgttcctgtccggcatttatgattttctctcctacgttcttgtcgccgtgatgtgcgtgtgccaccgatgaaggcgtcgaggtcgtgagagggagaggaatcgacggagagagagaggcggcggcaggaaaaggtggagaagtcaagaaacaagaacccaatcaccattgagattgggttcgttttccaccctcctctgcgccgatgcgtgtttcttggtgttcttctctgtattgttcgtttcttttttgtgtggatggaatcatggaaatggaataaagatttgcatctttaccatctgcatgcgtggggctccaggttgcagggtatcaggatatatagcatctggctagcgtcgattttctttttcttttgtgtgtctcgaaatgataggaatcgtagtactgatcatttctcccttcgtcggcaagaataattcctctctttatcttggcgcaagaatctaatttgcagtagaagaacatgcatggtttgagtagtaatatcctgtattatgaatctggctgcagaacgcctcatcactgcagcaatgccatcatcagccatggccgtcgacaccactgctcctgagcattggctcgactggaggttcatgctctgcgcggtctggccgtctgagtctactcctgcatggtcctggcatgcttcttgatctggaagtacgaggggccgagctcgcaggacggcaatggcgatggcggcggggacagtgaggatgcacggccgccccgggccgcatccggggtcgatcgcccggcaccccaccgccgcgtcccaccgcgcgtacgcgtcgccggcgccgctgatagggccgacgtgttcgccggcgagcgcgcccacgtcggccgagcgggacgaggaggcggagaaagccgcctccaccggccgccgtcgcggcgccgccctcccgcatcgtcccggccagcttgcagagtagagagagagatgaggaagggagagaagagggaaaagagagagggtgacgtggacacctgacattgtggggccacgtgggtcctatgctgacttaaccccacgtagactaaaaccgaggtcaaaaccaccaaagaatctcgggtgaccgattttgtatagctaaggactagcatatttggtttttggttttggggttggaggacgattttatacccaacgactggttgagggaccatcggtgtactttttccgtgatccagtcaattgaaaaaaggtccacctgacgtccttcaactctagcttaagtttataactagtaaacgtgcacgttcgcacatcatgtcacactaattaattattatgtacaatcaccccaagataataatcttgcaaacaaccaaagttcaagaattatatatattctagtgtaaattggtaactcgtttttagacactttctattaaaaaataaatacaaagcagagaacggtatgaaatgtatacaatggtgccatagctttgatatacacgcactaattaaactcagctctacctagctacatctaatcggaaaaaaaagcctcccttatctacataatagcttcccttcatccacaataagttcaaatgcgctacaaaacaatctgcaataaaaatatcatttaaatgatctccaataaataactcctgtcgtatcaccagtaatgaaaaccacaagccctttagtgttgtactgttgttgtatactccatccgtttcgaaatgtttgatgccgttgactttttagcacatgtttgtccgtttgtcttatttaaaaaatttaagtaattattaattcttttcctatcatttgattcattactaaatatatttttatgtaggcatataattttacatatttcacaaaagttttgaataagacgaacggtcaaacatgtgctaaaaagtcaacggtgtcaaacatttcgaaacggaatgagtacttacaaatgtttacttatcgatactgatattcagacataagctcgctgaatactccagctacgcggtcggtcagtaagtcatgtgcatgtgtccttgttatggttaacaagctgtaattaatgtaacatgcgtacgtagtgcaatgaattcaattataaagtacatttcacttaggcagtctagctagttatctagaacggcaggcactattgcattattactgttccccgtcctccggcggtgtcgcctcttcctgcgcggatatctggagatggtcgtttggacatacgtctcacttattccaaacgttctgtcagcaccagcaaaatctgatggttgttgaatgacccagttcctcaggtcaataggtaggatccatgcctacctattgatcttggccatgaggtgaacaagatgggcgtcgtgcaagctgagcacgggatgacccacatggagcttttgcaagcttggttgaggacgacgggcagtgtcgtagtttggcagggtaggcatcatatgatgtgagatttgagaggaacgtaggcggcagtccatgcgccagcaaccaactccatttagcggccgtccagccatcagcaatgtgtctctctgcgggtgtggaaggcctttgaactcaaactcaacatagttgatgcaaccctctaagtcgatggcaatgtcacgaacatcgcttgcgttgccctcgtcaatgcctatgcctgattcgtggaggcaatgggatgtagcttggcgcaggttggtcatgaagcacattgacaagcacgacgccacgccaaaggtcagcgaaacccatgaggccaggagcttggcgggagaggttgatgaccttgtcggtgtgatggaagaagaaagttaggggaggcgagctttggttggtggtggagtggtaaaggtgaaggcggtattctccccctggcttcctgatgggagtgagcgcggcgacgatatgatgtagtgctgctgtttggcgtacgtgcggaattagcgggtggtggccacggaggatgccgacgtggttgtcaagaaagaggctgtcgaggtcgccgctgggatgggggatgcgcgtgagcgatggcgagctaccatcggagaggaataaattgtgacggttaccatggccgagggtgaggcggaaaaggaggaggtcgtcgtgagcggcgatgatcttgggctcacgggcaaagtcatccgagggatttcatggccctcccttgttttggaggtggcgttgcagatatcggcaaagtaggcggtcttgtcgaggagtgcccagggtggcggccgcccccgccggcttttcttgtgaacgtctcggccgtgcgcaggaggtcgcagggaggagtccttgatgggcttgccaacctccatctctgatctctctctaagacgacttaattagcttgattgatctttcaaggaagaggaagaagagcaccacagaagctggacatacttatatgctggggggccggcctgggcactgggcagcagtgagtagcaatcggagtcggagatagtgtgtttcctctctctctctctccaatctctcttcggccggtgcacaggacaacaaaaaccgccatctttgctcttcgctgtgttctcaagggtgagaagaaaccatccgtgtttttgggagaaattttcaactctaggaatgacttattttgtaatattctcttctctttctctttgcatcacaaatccacaggttaacaatattagtaacagttcaagaatatgaataaataaccttcttatagttcaattgaaaaatattagtatcaaacaaacaataatctcctagttagtaaaacatccgagggcaactacttctcacagctgataatatcattataccataccaattcgttatgtatggatgatggataagatcctatgaacagagagccaatttgaaactttcaatggatttatggaacaatttcgttcgaatagaaataatgtgctccacaagcacgtaggagcatagatgcccaatttatagcggccaagttgatacctccagcaagcagctagctacaatgtttttcacacacactccaaaaacaattgagagtccagaataagctgattatctaccaaaaaaaatctcaaactacacagggcttctttctgttaacttccaacatctaaagctcctgtcaaattcatgccttctaaagctaccttttcctgcgcttggaagacttcactgtcaacgtccttggcgcttcatcagacatcttaaattcaacatactgctcctgcacaaccgaccaaggaagagcaggattcgtgttacatatgttccgtttgaaaataatgcgaggaatgtaaatcacgggattatctgccattttggagaaggacagatacagacctcctcccactttttctggagctgcaaaagctctttacagcatgccacacactcagcatggtaagcagcagccagttctttaatcaaggccttccttttgattattcctatcacttcaaaacaccatggcattatatacaagcacaagaatgctggcaactattttacaaatgaaaaatgttttttagattttgcaagcaatgcatcaacagaactcaatatatctctaatactataatgaggccagtgtaccatgtgaaaatcatggagagataaagctttgacatttcataactcactcatgacaatatactagcaaggtagctagtacatgcataacaattgtacttctattcagtatctggtaggataggatacctgctccaatcatttatatagagtcaaattttttgcaacatactagacttactccatcccgaataaactgagatgttggttcaagaattaccatcctatgcacatctctcagaaagctttataagtgaactgaattatggaccaagggctacgaaaattgaggccatggccatggcatttgataggatctttgtgcattcctagttgtgcagcagatgtttatttcgtgtgactgtgagatttccaatttgattcgtggcgaattgttagttagcaatactagtttacaaaacctgaaccctctaaagcaaatcagtatgagtcgtgatttgttatactctagtaccgaataggagtaaccaaatctagagcacgaacacaaaaggtaacaaaaattaaaggtgcgtgagaaagagagagacccttacttcggctgggatcgaagtgttgctcgtcgggcttcttctccccgttggccgtcggctccccgctgccgctcgcgccgtccatgggatgggaggcggaagatcgccgcggttaggcctttgcttagatccaaccaaacaagccaacacccaggaaaggggaaggcgacagagccgagccggttctctggatgtgtatttgttgggatttctcgcttctaggtcgccggcgaaaaggggctcgctggccggagacgaagacggagacgcagatggagacgagagtgacaatggcggcggcggacgcaacgctccgtcggcctcgagtaggaaagtgaaggaaaccaacacaaaagaggaagtatatgggcctcagcccggcccatgtacagtttttctgnnnnnnnnnnnnnnnnnnnnnnnnnnnnnnnnnnnnnnnctgcacntcaagcgcggt

SEQ ID NO: 29714 - DNA, 6604 bp, Oryza sativa
  unsure (1)..(6604): unsure at all n locations
cggcgttatagacgccctnnnnnnnnnnnnnnnnnnnnnnnnnnnnnnnnnnnnnnnnnnnnnnnnnnnnnnnnnnnnnnnnnnatggggacgtcggtgcaggtgactccgttgagtggcgcgtacggtgagggacccctctgctacctgctcgccgtcgatggcttccgcttcctcctcgactgcggctggaccgacctntgcgacccctcccacctccaacccctcgtcaagtacgcttccaccattttcgccctaactctcctcttggctagtcggggtcagctgctttggtgctagtctttctcctttgccgcatgctgcgatgagttcggatgggatggggatggggttgccatgcgcgccacctgctcgttcaattgcctacacttggagacagtgaagggttctccggctctgctgtgattttgtcatcttagggttatctgtgttgctatgtaacgaatgagatcgtcggtttaggagattgatttgcctcaactgaattgctgagtccgacaggtgttcgggtgtgcttgtgcatagtcaggcttggtgcatgttatgcacttgtgttggtgggtccgtgtgcacgaacgcatatgcacttctacattgtgcccatgatcctgcatacataccatatggactacttactgatgtgttgtttatgtatgaccttaattgttaattagtatgtgccaaagatgtagctcgagtttctaaaccgtgcttaatattgcttctcaagcttgtcttactgggcgttgcccctcaacatttcatgtggtttttacatggaaccttcagtaattgctttcatttgcttaaatggtgaatatctatcttaaggcaattatagagtggcatgatcaaggcaattttttgcctccctgtaatagatagcctgctttcaggttgaactctgactcatatttatatttatttttctatgctgaataaacttattcttgttcgtcttccttgattgttgagtaatcatggcatagatttagtagcaattatctcaccagcttggtactagtagcctcaaaatcatgcaaaagttccattttaagctcccatgatctttgttgttcaattattcaaattacacatctgtaaagattgaagggaacacttgaacatgtttcagtatttttatggattatgaatttgatcagtatttttttttcagggttgcaccaacaatagatgcagttcttttgtctcatgccgataccatgcatctaggagctttgccatatgctatgaaacatctcggactatctgcaccagtatatgccacagaacctgtatttagacttggcattttaaccttgtatgattactttatatcacgacgggtaagctttctagtgtccattttaacctcttgtttgtttcattgcatatagtggatctaaccattctttattttcctttgcagcaagtttcagattttgacttgtttactttggacgatattgatgctgcattccaaaatgttgttagattgaagtactcacagaaccaccttttgaatggtcagtaagcatgctgttgatgtatatcctttgctaaattacatccccttacatactattgattggcagataaaggtgaaggaatagttattgctccacatgttgctgggcatgatttgggtggcacggtatggaagataacaaaagatggggaggatgttgtttatgctgttgacttcaaccatcgtaaagagaggttaaatccttcctttgtcatttacttgtcattttagttttctctttattagcaaataataacagcaatgtgcttttccaggcatttgaatggtactgctcttggatcatttgtacggccagctgttctgataactgatgcatacaatgccttgaacaaccatgtctacaaaaggcagcaggatcaagatttcattggtacaacactggacatgttattatcatagctctctatctctatctctttttcaaatgctttcagctctagcattactactatacccacacagccatggttgcaggtaacagctcatgataattttgttggaagctgttttttacttatgttttctccatcaaagtagcactgatgaatatatcttctattttccaaatttgcaacttggacacaactttttttatttctcaattattttttagtgctacacattgttgagttcaataataaactattaatattttagactccaaatatatgttatcgtgtatatggtttgttttagttactgtatgggaatcctcttgtgatgtctaattgacatcctgtttcatgcagatgcattagtgaaagttctaactggtggtggtagtgtgttactgccgattgatacagctggtagagttcttgaaattcttttgatattggagcaggtgaaatcttgaaggtcttgttctcgtactgttttattttgttatgtcaataatatgttcaccttttgtcttgatttattgcagtactgggctcaacggcatttgatctaccctatctactttctgacaaatgtttctacgagtactgttgattatgtcaagagttttcttgaatggatgaatgattcaatctcaaagtcttttgaacacactagagacaatgccttcctattaaagtacgaatgattcttgttactttcctttttttcagttcatcgttttgttttattctgtgcatattgacaattgctatgcattgcaagcctgaagattcatgatgagcttattattttacatttcaacagcccaatagacatgtttcctctattactttctccttatggagtcatatttatattttatctcattgggctgtcctgttattacaatactgtattatcagagccaattcaactgcctcttttcctgaatcagcgctatactattatttgtttataaacttcatatataactttcttaagaacgatatttgtatgattgttttgtttagtttctacaacttttgttttttctgtgttgcagatgtgttacacagataataaacaaagatgagcttgaaaagctgggagatgcaccaaaggttagagtaacatttatttcctccatactgtcggaaacgtgaatttaacaaacatttagcaggtggttctagcatccatggcaagcttggaggttggcttttctcatgacatatttgttgatatggcaaatgaagcaaagaatctagtactttttactgagaagggacaggtaaatccatgtactcaatatatctggatggtttatttctttctcagcacatacattcaataactagctacatacaaaccattatagcttcaaacctgtaagtgacaagtagtccaacaccttgaaggggccttagcaaattgattgctacaacctacatgaaacttttaaaatttgtgtaaacaacatgaatcttgatgatgaatccaaacttacgtcacgttaaccatatcctctctgccttcatgttccatagatttctgtatttgcaaaaactgatcaaacatttgtgttgttctcactcagcaaaagaattctagcatcatatatctatgttctacagctatctaattacaaagtatcccattccagtttgggacactagctcgcatgctccaagtagatccacctccaaaagctgtaaaggtcactatgagcaagcgaattcctttagttggtgatgagctgaaagcttacgaagaagaacaagaacggataaaaaaggaggaagcgctaaaggccagtctaaacaaagaggaggaaaagaaggcgtctcttggatcaaacgcaaaggcttctgatcccatggttattgatgccagcacatctcgcaaaccatccaacggtatagctaggctgcgtttgtaagacctttacgatctgatgcaatatattatatgtggttaacaacccttcttggctctgtggttccatcagctggttcaaagtttggcgggaatgtggatattctcattgatggatttgtccctccatcatcaagtgttgctccaatgtttcctttctttgaaaatacttctgaatgggatgacttcggtgaggttatcaaccctgaagactatctgatgaagcaagaagaaatggataatactttgatgcccgtaagtttgcttatgtactttttttcttttttttacaatcggaaccctgtggccagatggtttaattttgcctggagcatatcagccaactatgtttagggttttctttcttggaacctgaaaaaacttgaaatgccaacaaaataaacttgaatgtcaatgttttcatgaattgttttcagggtgctggggatggtatggatagtatgcttgatgagggctcagcacgcctactccttgattctacaccctcaaaagttatttccaacgagatgactgtaagttttttttcccatttacttcattttgtctgtctgtttatttatttctagaaaaatctttacttctatttaattatgatcaacatttttaggtgcaagtcaagtgttcattagcatatatggactttgaaggtcggtctgatgggcgctctgtaaaatctgttattgctcatgtggccccattaaaacttgtaagtgctggaaatacccttcttttagcatccatgatttaggatttagaatttatactttttgacacatgattatctccttcttggaacatatatttttctcacgtatatagcttgtcccttttcaacaagaaattagtttgaaattccctaaacctatttactgattattattgatgcccttgagctatggaaaccatttacaaatacaattatttacatttccgtttatttcttgagggtaaacatgccatcacatactgaagctcctgttacattttcaggttttggttcatggatcagcagaagctactgagcatttaaaaatgcattgttcgaagaactcagacttgcatgtttatgctcctcagatagaagaaactattgatgtgacatcagatttatgtgcttacaaggtctgtataacgtttatgttaacagccaaactcttattatgtgtgacgggcaggcgttgcctgatgctggtgtccaattcttatccgatgacttaaacaacatgaggcaaaactgaatagttgccatttaccaatcatttttactgcactatcactgtatcatatatttccatacatacacaaacttattcactatctttgtaatttcaggtacaactttcggagaagttaatgagtaatgttatttctaagaaggtaagagcattggtttcctccttcactattaatgtattttatccttcaactggtgctaataaatctccttgatgtggacgctatcagatgatataaacttgaaccaaattaagctatcaaactgatttttttgcttataaagtgagccagattcccaggaccattcatgtttcagtagtaataagattataaccagaaaaggcagaacttcttctattgttgcaaaaatgttacttcatatgcaatatgtatatgaatgaccgaggtccttccaatgcagttttgagaaatgattgattccatactggttactggatggtccattctgttgccctagtcagtcgaatgtttttcagcataagaagcctttcatgacaaaattgtctgtgaaccagataccacaagcctgtgattatttctttttttttttgcccatacaagaatatgaatgaccgaggtccttccaatacagttttgagaaatgattgattccatactgcttactggatggtccattctgttgccctactcagttgaatgtttttcagcataagtagcctttcatgacaaaattatctgtgaacctgataccacaagcctgtgattatttttttttttgcccatacaagtatacaacctttgggggctaacctgaaactgcactttgttgttatggattagcagtaagaaagcactaacactggcactctgtgcagttgggtgagcatgaaattgcatgggtagatgcagaggttggaaaaacagatgacaagcttactttgttgcccccgtcgtcaactccagcagcccacaagtcagttcttgtgggtgatttgaaattggctgattttaagcaattcctggcaaataaaggtttgcaggtaagttttcattttcaaatatgttagtactgtataatattaagttcttggatatactggcccttcacgtttcagtgttgagagagagagagagagagagagagagagagagagcatgtcctgacagttacaactgttactcctgctcccatacagaaccagttgttagatggctcctcttaggagtacacttaatattgtttgcataacttactagtagctggaataccaaaatcgattaacaaaactgtaataggctaacttggaagcagatgttaaccaggctgtaagcatgagtaattatagctgttgatacattctgaaaccattgaaattcagggctaagnnnnnnnnnnnnnnnnnnnnnnnnnnnnnnnnnnnnnnnnnnnnnnnnnnnnnnnnnnntactattagnagatgcatttcaatggggcgg

SEQ ID NO: 29715 - DNA, 810 bp, Oryza sativa
  unsure (1)..(810): unsure at all n locations
gaggatgagtgaacacctnnnnnnnnnnnnnnnnnnnnnnnnnnnnnnnnnnnnnnnnnnnnnnnnnnnnnnnnnnnnnnnnnnntgaagattattttgcacaaacaaagggcttacaaccaagccccattttactgtacagaaacagataaagcattcagcactgttccaggcatggagattatacttcacatgatagaacttgctgaacataaattgcaccaaactgaagatcctttgtaacagtatttgccatccaatttgccgccctttaagaaattaccatttgatctataagcctttcaattttaccatcaggactgcgaatttcttcattccgtgccacttcctttcggttcgagcgcatcgtctgtctaagtttgtccgtacgtccgtctgcctgctgacacgtgcatctgttcaccccatcgatggtgttgacgatcagcccgttggccccttgcctagggcatcccaacagtagcaccgnacgaggaccgtgaagcagcttttgggggtcgtcgttcctctgcagctttagagctcagcgacagctcctcctgccagtggacaggacccactgccgtcagatggacagttactattgtgaaatgcacttactcagccgttatgctgtgggctccgcacgaccggtttcaatgtggcaagtgggtgttncccggaaatccaaaagttgggaatggcagcgcttggtttctaggggacttaagaagatcggacaattggtgccccattgaaccatgctcacatgccctcaagcattaggtggaatcggttagcccccacggt

SEQ ID NO: 29716 - DNA, 815 bp, Oryza sativa
  unsure (1)..(815): unsure at all n locations
gaggatgaacgcctgnnnnnnnnnnnnnnnnnnnnnnnnnnnnnnnnnnnnnnnnnnnnnnnnnnnnnnnnnnnnnnnnnttgcagcgtgacaaagcagtaagagaggcagaagcaatacgtgtaaaaaatggagagtctactgcaattgcggatagaacaattcccattacagagctatcgatatcagagattaaggaggcaaccagcaactttgatcactcatcgaaggttggggaaagtgtttatggaagtgtatataagggacttcttcggcaaacaaatgtggctgtaaagaagttgaatcctgaaagcacagagtcactgtcacagttcagtcatgaggtaaaagtttttgttctagttatatacttaccttctataaacttgattgacattttgttggtccaaataaactgttgtatttcagacagttaagttgttcttgctgataatttacaggtggaaatccttagcagggtgcgacatccgaatcttgtaactcttataggggcatgcaaggatgcccgagctcttgtctatgaatacatgcccaatggaagcttagatgaccgcttggcttgcaaggacaattcaaagcctcttagttggcagttgcgtacccgcatcgcttccaatatttggtctgcactgatttttctccatttcaataaaccccacaagatttgtcacagtgacttgaaagcatctaacattcttcttgatggaaataatgtggctaaagctaatgggtttggtgtgtggccgatgtttacctgtgaaatccaggccaccaaccactttataccggcatan

SEQ ID NO: 29717 - DNA, 774 bp, Oryza sativa
  unsure (1)..(774): unsure at all n locations
agcgtgtttganattttgatattctagctcggtacccgcaaatattataaccggactcatttaaggtgctataacatgtcataaaaagttgtctagaatctatatagaacataaccttgcctgatgtggtcgcggtccgaagcggtgcgccacgaatcagcaagcggctagcaatagcaatagcaatagcagtaggccagtagcagcgtgaatgcatgattgatgccgcgatggggccgagagccttattctgcggcgtcacgcgggggcaccacaccaccactagcgcctcgtgccatgtcccgttcgtcgtcgctgcctgcactgcacaccacattctcttaaatttttttcctcgccgccatcaaggcattaccacgacagggggcgtgaccgatcgacctgtgtgtgattgctgatttgaaatcgtaaccgtcacattacatttggagagaattgtgattgcaactcttgtgttagtggttgatactgcagcagctttcgtgactttggaagtagacggcgagattattgtgacggggacagcactgttgttctggagtgagagttccacgtgcgactttgtttgcgttgcagcttgtgggatttcgattccaggaggatacgtacttcgatgagcttcatgggcggtgatttttgtcgagttatacttgatggttgtcgcagaaacactcctaaccgcgagttagaagaaagtagaatcgtgctagatagaaaatgcttagttttctattntaagaggctatgctaagn

SEQ ID NO: 29718 - DNA, 876 bp, Oryza sativa
  unsure (1)..(876): unsure at all n locations
gggtctcngncggccgggacggccagtgtctgctccgatcgcaccaagaggtaatcaatcaattctgactccaactaacactccatctctatgttctccatcagtttgattgcaaattaagnagattaattagtactagatcacgaagaacacacagaaattcgttagaagaaccaactttttcaacacaaatattgtactatttagtaaattcgtttttattcagctagcgataatatagtactcccacagcataggaccaatcaaacccgtacatagacagtcaacaaaagcaaaacgtataagcatcaaagccggcacggcaattccaaaggtaaagtaaaacgagtctacatagaaatggtcctactctagatgccgcctgctgatccgcgcaatctgtaaaacgaagatcaacctgcttgactgcttgtacgttccccacatcattccacctgttactgtttggtatatccagtagtacatgctacagattactgttttacacgagtagtacgagttactgtaaatgcgacgacctactccgatggagaaagcaagggaagcgagtgtcgtacaaacggatagatggttaccacgcaaccacatgagtcgggacaaggggacgcgtccttgtctcactgaattcgtggaccagatagcgtgcgcagcgtctggtttaatgccggcaattctgagatcgacttgctaatcgcgacgtgaaacgaaaacctggnnaattgggatgacgatgatgcagggagagagatggcgagaccgtgcggtgctggtcgctgctgtgggatcggcggtggcgcaagtcgagccggggagatcacggcaacgagtccgccatccgggccgcgatcctcaagg

SEQ ID NO: 29719 - DNA, 2835 bp, Oryza sativa
  unsure (1)..(2835): unsure at all n locations
accaacactggggtgtcaattaaaaaatcaaaaacacttctgttttttcaaccctattttatttactggaaaatggaaaagtttgcactagtagccctataaatgttgcgcatttgagcaatcaaacttatcacttttggttgggtgaatctgcttgaacagtgcaacttgtacaagtagaggtataaaacctaagcattaaataaaggcacggacaagtgatgaaacaagtcgaaggaacagaggcatcagattaactatggaaagtaaaatagatgaccttacaaagctaagattgaggcctaaatgactattcgatcatgagctttttgctaagtttcgataaatctgctaaaacaccaaaatagaaaagaacagattcataagttcgcttggctagaagtgtcattaatttcaaaggaaaacatgatagcagaccttaatatttttttaagcagtaatcagcagctaccagaaaaggagagatgatacctgcaatagtttaccaccagcgacgaaggaacgtaatcccatggtatcctgaaaggcaaattgggtcagtagaagtgccagtgccagatatgcgtcacattaaagtaaaatttgaatgggtaactgaagcaagcacaaaaagggaaaggctaaaactatattaccttgtttttgaaagtgactaggaactgagcagcagggtccctgtttgtagcatttgacacgatatcaaggatccaaccaccaccaccagcaagtctctgtcttgcaacatggaaccctgaattatcttttgttctcaaggctacaacaaaaccatctttgagtgtatcaggatatttccttctgagaactgtaggcaacttcgtctcagaagttatttccattggggattcagcaggagatttctgcttgtattttgagtcctcaggagacgcaaatcgtgaactggaactcaatacctggtcccttccactcattgcagtatcatcatctctgcgtgaggaataattactgccactctctacagcagataattcatctgttttctgttgagatctgcggcgagcaggtctctttttccctttctttccagaacggctgcgccttccttctgatcgggggacaatatgttgagatctaacagatgcttgaagctctttatgcctggatatggctcttctcttttcgtacttcatttttaactgactttcatctgtctgctgctcagaataaaaaacttgtgaactgctaaccttttcttctagctgatcatcttcatttgcagcttcgctaatttcctcatcttcatcagatattgcactacttggaacagcaccatcaaagaaaaaggactgcaatatcgngattgctttctctcttatttccatccacacttcttcactgtagtctgcacttcgaggaagaattaaaacatttggcnnnnnnnnnnnnnnnnnnnnnnnnnnnnnnnnncacactatttctcagctggcagtaaaatgtactcttccaagaaaaaaaacatgtcgttttgtagccagctgcataatgtctagctagtttttaacctttttcacacacatatgtttttacatttaaagaaatagttaattgtatttttttggggggcggatccaagacctggtgaccccggacgaccgcccgagctcgtgcacttcaagctagcagtaaaatgtactcttccagctaaaaaaacatgtcgttttgtgaccaactgcataatgcctagctagttttgtttccacatttaattaattaaagaaataattaattgtatatttttgggagcggatccaagacctggctagtggttaccttcgggcaaccgtccgaactcattgacaagtcacatcaatgtaatagcttccatcgctgatgttcaatggcatccatataatcctttggacatatatgtttgttcatgttctaaaagatctctagattcgccaatgtacattcacacacttaattagtcattcgtacatgcagcgtgcttaagtttctaggcgcataaggcagggtcgactagtatcccttaataaagcttatggtgatatgatggtggcattgtgtgaactgtgaaggtgtccaattatcaagtgtacatggtagccggctcgcactgtctatatcatagctcctcttcttcccttctaaaattttggaaggatgccataatatggttttgaagtttcttggccgccaagctgaagccaccaccacactgagctgtcgatccgcgtgtatttccagtcggtggtagtaacacgcacggtgcatcctgagccagtgagccgctttagcgacacatcacgtgcatcggattatcggaagcacacggtcaaggcaagacaggtattttgttagtcgcgattaatctacaacagttagggcatccacaatgtgctacaaaagtagtccatagggaataaactattccatttagccatttagtaacactgggcaactagtccatataaagaaaatagcaaaagatatccatatgcatatacactacctatatgacataaataatattatatatctctacttctctctcttctcctaatgttacattgtatccatatacattgtgagattgctatagttaaagtttatttatatgggtcccatctatataaaccacttttaacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgatgctcatccntcacact

SEQ ID NO: 29720 - DNA, 2195 bp, Oryza sativa
  unsure (1)..(2195): unsure at all n locations
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgattgatcttgcagataagtttggcacttaattatattctagtcgatcaagtacgtgggaagaaattctcgttgtcaaggttttttattcagcgagttaacattgacagctccggatcgaattttgagagagagctatgcagctcagcccgacagcgatttgtcatagtcacacaaaaatgatggctcctttactactatcgccgcatagtccacacataggcacgagaaaagaaagtgttgttttctttcctacgcggtcactgccacagcttggaaacacagagtgaccgcagcgactagtacttggcagttggagcacgaaggcctgaatctgatggtggtgccaactcggccaaagtcccaattattcctcacaagtcgcgacttggcaatcgacgtcgccttcaataatgcaaggctgactggcaatgagactgggcatgtagcacgcgcgtcgctcatgtgtgtgtatcacgctaacatttgtctcggggctctggcagattatgggtggagatttggacggaagctagctagtaatatatatgttggtctgttccagttacgttgcaaactgcgataatggcgaacggatcgatgggcacaaagccacatatgcatggngcatggacttaactagatagtgcggtttggtggcgtctacacgttttagattcgcatctcattctcggtgaataaaaacctagtcaaaaggtgaggctctaccatctgcaagactgcaaccgaacagacgctgaagaatctatcttaggatcgagctcgtcgtgttcactgttcaggcggccgaagctttgcgcctggttgatggggacgggagtatctatagtggaccagtacttcactgtactattactactactactactactgctccagtacaaatactgatgatgtgtgttcgcatcacattattctggcctaagctttcttcctcctctttcttgggacgaggacagcggcggcagcgtacgcagcgggccagattctacacgaattctgcacgctagttgcatgcaaaagccgccttgcgagttgcgagttccgacgtacggttacctctgggcaccaaacgggaaaccggccaagccgttgctgtgtttcgagttccgacgacgacgccgctgcggcagcggtgcactcacactcacgatagctgtggcaattcagctcgattatatcacgggcgggggcatggcgtgtcctgggacggtgccattcggtggagcgtcaactcggaaagcggccgtccggtgacacggccgacctggcctggcctctcccttcggcttcacttccctagcttgagacttcccaaagagcacccacaatagtaaagtaacgtgctatctataaaatatatacatatcagtaatagactagattaatagtaaaccactttaattgtatgtctatatgggtatctatagctctctaatccattgtctcgtttttctctatagactatctccagattagtagatatctttgctctctctctccatttaatctctttcaagtaggaaaatatgctgacatgtatcttttatagaaaatctatagataattattgcgggtgcccttattgtaccacatgttgatggagacattcggggtagttgaccacgtcggggcgatgaatcatgcgcgcatgtatcgtatggtctggagacgacgatataactgcttgcgtgtgctgcgtccatggagcttttaaccggccgagacatctcgctttnnnnnnnnnnnnnnnnnnnnnnnnnnnnnnnnnnnnnnnnnnnnnnnnnnnnnnnnnnnnnnnagaaggcgatcatccggcccc

SEQ ID NO: 29721 - DNA, 730 bp, Oryza sativa
  unsure (1)..(730): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgcgcgaggaggacgacgagggtggggcgctacgagctcggcaagacgatcggggaggggagcttcgccaaggtcaaggtcgcccgcgacacgcgcaccggcgacaccctcgccatcaaggtgctcgaccgcaaccatgtgcttcgccacaagatggtcgagcaggtccgccgccttaatcatcctcaaaattgaatatttatctctttttttagacatcaggtaataacaagttggatcttttctcggaggggatcgaattaagaatcctaaattattctagatagatgctagattattataaaagatggattttcatggggattaataaacattaaacgagaatatgcgcttactacgtctctaccattgtcaagattctgtctgtttggattgtttgtgattgaagaaaggtcatnnnnnnnnnnnnnnnnnnnnnnnnnnnnnnnnnnnnnnnnnnnnatatattttcaaanngggcgcgc

SEQ ID NO: 29722 - DNA, 7223 bp, Oryza sativa
  unsure (1)..(7223): unsure at all n locations
ngtattctatccatgtccaggtggcgtggtggtgatcatggccgatccaaggttaaatgggcttaatagaagcggcatttctgggtcctggaaatagaacttgtccatggtcaatagaagactttcatgattaagagagtattggggcgtggtcggacaaaaaacttacacaatgtggggcatctttttctttatttagacngatataataaaccatgcatcatgcaatgccaagtgcccaagtatatggctttcacccaacgaggggtcacggtttaagttttgtcgcgctcatccaggaggcacatcccacaataatcaaagtaccttccttttgactgaacctgtgaaagtagtaaaaacagagacggtcacgttgccgaccagcgggacagcaaccgccacgtgggcccccacgatgccggtcggtcagcagatcgggcaggcgagatttgcccgcacgttttgccctcaaacccctgatagtacgtgcctttgacagcaaaagaagccgtggcagatcgacccaacaatgtgtcatcctcctgcccccatcgcacacagaaccccccttgcgtgaattgcatcgcgagaacccgaaacgcctcgtcggtttagctgcaacgtagattcaccgatcgatcgatcccttccaccacgctccactccaccgggggaggtaaatccacgggaaaacgggtgtagtgaagcgagcgaggcgcgcaccaaccgcagtcaccaccaccggcacccaacacccagacgcgcggctccccggttgcgccgcactcgggctgtttggatggtatacgaagtttatcatcattcatcatactttttacgtcacatttgtttaagttgtggcttacaagtgtcacactttagggagttaatgacatgtgaggtcataatagatgagaagaaatcttgtcataagtgtggctataaaccaaacaatagactaacttaatcaatcttgtctactggtgtggtaatctttagtaacctttaggaattaggatcaaaccaaacagcccctctggggagaggccgttacgttatcccacgggggaaaaatacgagaaaccgcaaccgaaaagagaggaggaaaagggagccgcgcgccgtcgacgccgtgccacttaaccaaccagccaactcaagccccgcccgtaataaagcgagccccccgccgcacgcacgcacgcagccgagaccaccctgctgcagctgctgtgctgcgcgggttaaaaagagagagatctattaactggccctcctctcccacagcaaacacactcgtgtcgtactgagcatctgagctcggtggttgccgaggaggattcgccggcggcggcggcgggggggagatgtcgcagcatgcggtgtgctgcggggcgatgttctgggtgtacctgatgtcgtgcgtggggctggtgatgttcgccgggctcatgtcggggctcaccctcggcctcatgtcgctcagcctcgtcgacctcgaggtcctcgccaaggccggcaccccgacggacaaggacaacgccggtacgtcctcctctctctctctctctctgccccccctagctctactgctgctgctgatcgctgcgtgtgcgcgcgcgcgcgcagccaggatcctgccggtcgtcaagaaccagcacttgctcctctgcaccctcctcatcggcaactccctcgccatggaggtacaaatctctcctgctgtttttcgatcccctgtatgcacgtatccagattggagctgatggctttgtggcggcggcgtgtgcgcaggcgctgccgatatttctggactcgctcgtcccgtccttcggcgccatcctcatctccgtcacgctcatcctcgccttcggtgaggtgaggcattgatccatctcgcgtgtccatggactatgggttgctcacttggggtttggctggctgattcggtttctcctgtggtcgcagatcatgccgcaggccatctgcacgcgctacgggctcagcgtcggggccaaggcggcgcccgttgtccgggtactcctcatcgtcttcttcccggtcgcctacccaatcagcaaggtgcgcctgctggcttagcctgtttcgttgctcttgtttgcttgcaaagaatttgggggaggaattggaaccttgtagttggtcacttggccggggtgtgctcacaatttggatttggatgggacactacaagtggctgaccgcgactaggacgcagatcggttacttactgattcattaattaattttccaatcaagggacttgtcccattctcatttagtcatctgtctacaaaattctttgtagccggtgactaattaattagtaaatgtaatctgtcccattccccattgaaccagaataagcaatcatagccgtgaagcaagaaccctgttttagtgttcttttttcctttgccagactaggaaaaatgccttcataagcgtgtttgattgctcctgaataattttagatgaagcaattcaattcgcttcttagtttaattatttcctgctaaactaattgttttctgaatcatattttacaaagaaaaaagaacagaatttaattggggctgaaacacagcgaactacttattgtcgcagatgaatgttttgagttgcattcaactaaccatttccttgtttctaatgcaaaattagctataattagaggatgcatagatatgcttgtgttttccactaatgccatgtcttaatttgattcatgtccatctttccagttgttggattgggtactcggaaagggccatgttgcacttatgaggagagctgagctaaagactttagtcgatatgcatggtaatgagggaggttttattcttattctcttatgcatttctggtaagttgtagctctttacactatgtagtttgcatcaatagtggttttttttggttgcaacagctgtgtgcggcgtccaagagttgatctcaagaggccatgttctatatagattctagacaactttttatgacatgttatagcaccttaaatgagtccggttataatatttgctgctatatggacaatatgattgggcatttctacatgccttgaatattttcttctggctctaatatacatatattctctgggctacttgtgtttgcaatagctattggtgctttcctcagacaaatatgaataccattaaacttctgctggttcacttgttcttaggctggcaaaggtggagagctgactcatgatgaaaccactatcattacaggagctttggagatgactcaaaagactgcaaaagatgccatgactcccatatctgaaaccttctcacttgatataaacgctaagctggacctgtaagaatattccaactattgtacgtgttttgaatgacacattctattgatgctactgttctcttcttgataggcacacaatgggtatgataatgaccaaagggcatagtcgtgttccaatatactctgggactccaaacaatattattggccttatattggtaggctaaactttatgtattattaacttttttggtgccaaaaatcctgttccctagaaacttatgactttcatgttatttactcttggatgcatgttgtcaatgatcaatctttgtggcttgagttgccggttctaactgctgtgtcagtcacactttttattgtgaataagatagcacattacagatattcgatactgaatctgctagcccatttcagttttaatagataaatacttgaattagagaagaatgtttttgttgtgatgaaatatattttataaattcattaatgatattctagttctctggttaaaggaagcctttgcagcagtcattcaaccatgacacgtcggtaataaaattgtcataaaataattgttttcagttgattgtgggatcacatactctaacgaaatacagatatgagtgactaatttggcagagtcttgtgtacttccactcaagctgcccttagttattcaaaacctgaggcaacattcacaaatttaagcctttctaaacatgcccttatgattgcttatatttttgccgggtcggccgaaagatttggtcgaccaatttcattaagtgggggaaaagatttaattgcctataagtaattcacttttggaaaaataacaacaataactttcccgatccttccattactgtcacttcctggacatcctatatcccaatgaaatagccaatcttgccactttactttcatgtgtttgttatttactatttgaccaataagcaaagaccatctcattttcaggttaaaaacttaattacttgccaacctgaggatgaagtgcccattcgaaatgttactatcagaaaaatcccaaggtatgatcttttattgctttatcaaattggctgtttgccccctaggcccctactgttcctccctaaaaagctactactatgttttcattggcttgattaaaaaatgtacccactattaactttctctgagtctgagttggaagtcaaaatctcgtgcagatacattaggcatgcttcaagaaagctcaaggctacgcatatctactactacttaaaaaataagaggtgcttccatcgtccgtcaaaaaaaccgggtgaaaaaaaaccggaacgaatccgattcatcaacgcggtaaaagaaaaatcgggaaaaaaaaagaatatgtccgattccacaaaaataggaaacaaactcccatctgttataccaagtcctattcggttagcatcaccaggagaaccgacaccattcacagagagagagagagacgacgccggcacctcttcccgccccgttggaccgcagccgccttcatgccgccgaatctggcggaggcgaggtccggcccggcgcccctcccacccccgccgggctgcagctgcctccacactgccggatctggcggaggcgaggcccgaccggcgttccatgacgtccgccaccaccaccactgccgcacctccccaccatgcacagagagagagagaaagagacgacgccgccgcctctcctgccctcgccggaccacagccgcttccatgccgccagatctggcggaggcgaggtccggcccgccgcccctcccgctcccgccgggccgcagccgcctccacgccgccgttgttcggggagagggcgccgcgccgttggttgtgggggagggcgccgccgccgccgctcgcgggaagaggggcgccgtcgccgccgctcgggggcccggaggggagggcggcgatgtgagatgggagggagggaaatgggctagggtttcggcggctgaggagaaggaggggttttgtttccccgatatcgacgctcggccgtccgatcaaaaccctaaagatcggacgatcggtgtcgtccaggccgaaatcagcccaagagggatcgagagtgaggccacttttctggcccaagcccaggttgtggcctggggaggggaagtgcacttgcgcgtgcacaaaagcccgtggaccgaccggcaagggccggaaataagtctattttaggtccctcaggcccaaaaaaagagaataagttcatttttagtgctcattttttcagaagcattacaacaattataagttattgaatgtgtttatttcgaagcaaacctaaaaggaagtattttctttctttttccaagtaaataattgttaaatgacgtttgtattaataaaattaacaattaagctctgaaaaattcaaatataatttcaaagagcgtaactaatcatggagaatttaaaaaaaattaaatttaaccatgtcattttatttctcacacttgctttacttgtaaatttatttaattatacacatacctacttaaaaataccaaatatttcagcgaatttgtattttaattaattgcatatttttctaatctgtacgcttcacattgtaacacacaggcacttttgctagaccaaacaacacttttggtcaatatacacactccgtaatcacccggtgcaacgcacgggcacttttgctagtataactaaagttgacaagttaagattatttccatggcttaaactgagggcacccaaggttgctacatactgtgatatgctttggaattgattcaaatatgcacttctgaatacttaatgcttctatgctcttcataacaagagaactattctcagatatttggaatctcttatttaaggaagctatactccatgttgccttgtaatttgcgtgtatctatctccatacaaaatgttcgtttgtcatcttctaattttcctttggtgttgctgctttttggtatatcagggtgtctgatgatcttcctctctacgacattctaaacgagtttcagaaaggtcacagtcacatggctgtggtggtcagacgcataaaagaaccaggagcatccattgaaaagacttatagtgacagatcagattacaaaactaacagcgacagatcagattacaaaattaaccacagagatgcccatgctgatggtacatactttccattagccatgatgatcacttgtttttccaggaataaatatttgtttggctgtctgatcatttgaaaataccctcaggtttgtcaccctctcgtgtcagcattgctggaagtcgtcgaagtaacattgaaaagaatggagaggtgcgcttatataagaaatcagaaaaaaagcgggacaatattcttgattttaatagcggtccacttccaagctattcattggatcaagaagcagtggggataatcacaatggaagatgttatggaacaattgctacaggttggagatattcttaaatacagcttgttcttaatttatatttttatttgaaaacaaagtcttgcatttttcacatcctgatgcttttttgaggacaccattattttttctccatttatactcttgtttgttgtataaagattttagtgttctccaacctatgggagcaacacgtttaattcagcatgatgttgcatttttttagagtcatctagtgttttccaatagttagaaaagaaactagaaatttttcatagatgtatcgttctttgtaaaatattttcgcttatacatgcaaactggcataaacttctcttggnnnnnnnnnnnnnnnnnnnnnnnnnnnnnnnnnnnnnnnnnnnnnnnnnnnnnnnnnatgnagagcntcagttccataccgcg

SEQ ID NO: 29723 - DNA, 1148 bp, Oryza sativa
  unsure (1)..(1148): unsure at all n locations
actaatcaattaaccaagaaagcggaagaagccccacattacaccaagccggcttctctccggcgcctttgacgaattcaattaatgcaggcgggcaagaccaggttttccgaatgagaaagcggccagttgaggccaaacccaatttaatgtgaggtaagctcactccattaagccaccacaagcctttaacccttttaagccttccggattcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagggccaagtctggtgggacaagttccacgccaaggaactcacctacactcgcggttacctgctcgagctcctctactctaacaatatcatcatctctaatgtcaccttcgtcgactcgccgtcatggaatctccatcccacctactgcacgtaagaatcatcagtactcgcaaccagaattcagtttctgaacggttagatatagatcatgatgctcaccttctttgtgttccgtgctgcgccagcaatgtgaccatcagcggcatcaccattctagcacctctcaactcgcccaacaccgatggaatcgacccaggtataaacatacaagtcacactgcacttgatcaatgctgccatgaggaaagcattggtttgtgctagatgtgatgagctcttgttgtccatggtgcagattcttcctcccatgtcaagatcgaggacagctacatcgtgtccggcgacgactgcatcgccgtgaagagcggctgggaccagtacggcatcaagttcaacatgccgagccagcacatcctcatcaggaggctcacctgcatctccccgacgagcgccatgatcgcgctcggcagcgagatgtccggcggcatccgcgacgtgcgcgccgtggacaacgtcgccatcgacaccgagtcggccgtcaggatcaagtccggcgtggggcgcggcggctacgtnnnnnnnnnnnnnnnnnnnnnnnnnnnnnnnnnnnnnnnnnnnnnnnnnnnnnnnnnnnnnnnnnnnnnnnnnnngcaatnccatcgc

SEQ ID NO: 29724 - DNA, 887 bp, Oryza sativa
  unsure (1)..(887): unsure at all n locations
tttcatgtcaaggtcacgcgcagttcgcgccaacgcaagaacttcattgaactgcacgatgtcaaggtgtcgcttcgacgtctcgccggtccgtgccgaagctcgggcgcgggcaaaccaatgcgccttcctgaaaaagagctcgtcatcggtccgcctgaattgccaacgtgtagctactgaaatactgatataggatgatagtatggtgtgggtaatggcttgggctatgagatgcttgggaccaaagagatatatatgatgtggtttagtgagtaaagttaagcagtttgaaaatgctgccggataatctctttacacccaattcatttatgagtgctcatctgcgaatgacctgaccaaagcaaagccttttcattttgtcttctgacagtaaatacagcacgtgacaagataacaaaatcatcaaacttctaaacgaaactttgcaaaaacaatgacaattgacaaagtgagaagcaaagctcaacgtgcttaggcagcggtttgcaatcaccgtcttcccctgcccttgctcatgaagtggtggcgcttcaacctcttcttccggatcaccacggaggacttgatgtgctccgcgaacggcatgccaaggagggtgagcagcctgagagcctcgttgtcggtcttcgcggtggtgacgatgcagacgtccattccattcttcttcccaccgacctcgtacgggatctccgggaacacgccctgatcacgaaggcctatggtgaagttgccatggccatcaaagctgttggggttgacaccaaggaagtccatggtcctaggaannnnnnnnnnnnnnnnnnnnnnnnnnnnnnnnnnnnnnnnnnnnnnnnnnnnnnnnnnnnngagctgcagtcatccag

SEQ ID NO: 29725 - DNA, 823 bp, Oryza sativa
  unsure (1)..(823): unsure at all n locations
cgaagcaatcgnaacgncgnacgtacctggtgcaagcggtgatgtccagcctcgggttcacgtccatggccgccgccgccgtctactaccgcttcgcctggcaaatggaggtaggtaacacgccatcgccaaattcccgctcgcatcttaccattacccaattcggcaattccttcgccgcagcactaaaatttctccgcgtgctcgaccagggaagcggcgagatcccggtcacgaaaatgttcggcactttcgcgctatcggtgggcgccccggtaagcgcacacacacgcaccgtccgcacgacgccgcgcgtcgctcgtgtaaccgtgttggttttgccttgccattttgcgcaggtggggatgaagttctgggcgcggtgggcgcaccgggcgctgtggcacgcgtcgctgtggcacatgcacgagtcgcaccaccgcccgcgagacgggccgttcgagctcaacgacgtcttcgccatcaccaacgccgtcccggccatgtccctcctcgcctacggcttcttcacccgcggcctcgtccccggcctctgcttcggcgcggtgagtggtcgatcctcctccatttcaaccaaatccccatcacttctctcaaacacactgtaccaggatttgaccaagcgtgcttaacgtggccgtattaaaatgacaaaagtgcatgatgtagtactatgttcagttgattacattcacattccatggccgcctgnnnnnnnnnnnnnnnnnnnnnnnnnnnnnnnnnnnnnnnnnnnnnnnnnnnnnnnnnnnnnnnnnnnnnccattccatncaaagccgtccg

SEQ ID NO: 29726 - DNA, 1171 bp, Oryza sativa
  unsure (1)..(1171): unsure at all n locations
gggaccgtgattgagatcctattcttgcatgtctgcacgtcgactctagaggatcccccgtcagattcatatttagctgacagacaaaatgtgctttgcaaatattaattatcagaagtacttacattggaaatctttatccaggattcaagtgtgttgatggcctccccggagcgttgtgtttcctgtgctaacgctacaccatcatgcaaagtatttactttaccactgacaagaaagagatgctgcagcattcagcacctatgaagaaaaaaagattgattaatgttttgcatagcaaagcaactcaacgtgtgcaaggtaataattaagtgtcatatatgatttgtgaaaaaaaatctaaacaaaattaaatcctatcatgacaaggatcggtaagctgtttatgacagggcgcactgcaaacccccatctattgaagaacttcctatgaaatattcgtatgttaaagataggctaaccactgcagaattctgagttcattgtaaaaaaatgcattacaagaagtttagaaggtagaaagtagaagtaactagaaagagaggataactgtaatgattaacttacgagagcatcagcaattgaacctctttgaccagcaagaacatcctggagaacttttgcgttgaacgctggatcacctccttttagatcttccagcgtgcagcggggtataccaaaatccactggattgtaacataattttaaaaagtgagactaaaaaaaaagtgtatcatatcgtcataatgtatttcagaagttagcatgcataattagaaataagtataatgtgcataaaacatgcaattgatgagactaaactcgaagactcgctcaaattacacaagtgagtccaataaacagtctctgtttctaaaaattctgagaaaaacatagaaaaaaaaactcgtacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 29727 - DNA, 12582 bp, Oryza sativa
  unsure (1)..(12582): unsure at all n locations
cgcgcgatgaatgcactgacacccaccttananactncacagngtgtaaaagtacatactatagctacagtagtatatagtgatctgaaccgaccatcttgagagtgctcgttttatttttatagcaccatataccaccatatccaaaaatacattggccaatctaaaaggcaatttcggtctatttgagtgtatgattcagatctttctttgggggtaaaatggaacaaaaagaaagaagaaaaaatgggttatgtatatgaccactgcgctttctcgaaaaggaaaagaggtagatcaattactatgatcatatagggggtcaatcagaaggatgcaatgtctctgtgcggtgtgacagtgttgtagttacatgtgaatgaacacatttatttgtgtcacatttattttttacagtccttaaggtaccacttttctcttgtaaaatttgataccttgagaactgtaaaattgctctatatacaaaacatatactaccgacacagagaattgtttgttttatgatttttattataaaaatattatgttgaagtagcaaatgtaattcaaaatatataactttacacacatactactatgtatgtagagcatgcaataaacagcttgatttttaatcaatatacatcatatcacatcagatgcatatgataccaataccagtatgaagaatttttttaagcatctgattatgatcaataaagatcaacgaagaaaagaggggaatgtaaaagaaaaaaaactgaaaaggttgcaaataaacagggcatatatatagccacatctttttccataacagaaatgaagaagtttctgcatcgagatgtatttggccacattcatagctacatcttgttcgactattttcagttcaagctagcaaagaggagaagagaagtgctagaattttttttcgaagaacaagcagctaaggatttttgcctaatagagaggagctagattgaacaaaattaaagaacagatcaagatgatcaaaccagcacagatctcagatcgatgaacacaccaacatgtatagctaataactgatcgatcaaccagtactgaaactcacctcagatcaagcgacagcttcagttatctcgatctatacagattaggcgatcgaattcaagaaactctcttctccaaggagaagcacaaactcgtctgtatgttctcttctctagctgttggcaagaagctggcctgcgtgtgtggaagaataaatagcattggagaggaggagatggagtttgcattggagaagaaaagaggggtcgagaaggtggcgggtataaaaaagggtcggggtcgctctcctttccgtcgcgcgtgggtgaggggaatgaaggcccttgggccccacatatgggcccaccagctgacgtcacgtcgtcctcttcctcctgctgctagctgctactcctctttccctttcctctcccggcactgaacagtacagaagaagctctagcattcgagcatctatgtctaacctttgcatgtagctgatgatatatgtgcctattgatcaatcttgtagcggccagaacttagccatgatccagctagggcctttgcatataccggctcttagagtaattcatacgtagaagcaggtgcaaaggtatctgcacctagctagtaactcatgcatatatcacttaatttaagagagactaaacctagatctctcaatggattcggcggcatgccattccagtgctagatggcatacataagctactagctatatttgatatatattctgatcaagaaactagaacagaagaacatatataagttagttatgcatctcgtcctctctaatttggagaaacgaggcatgattaacttttaaatgcatgctttagtttctggtgcaatcaagtgcatgttaattcttgccaatggtaccacaatgtgctttcagctgtttataggaccatgttgccccagttgacagatgaacaaattgctcagtagaatgagctgctgcttgttgcaggtcccgtacacagttgtccaggtatcatgcatgatcagtccattctatcattgcagtagatttctggggcgaacgggtttccctactttcaaattgtgattgatgcgatatgtttaattgaacaaaatgatgttaactgtacagttttgatctgatatgtaagtagcaatcactagctggctagctagtagcagttaatttgattttgatcactcaacacagaagccagtaaaaatcaccgatctctagctagctagcttatcaaatgcagatcgatatatgcaatacagacatgtcctttcttaatttgactattattattcatgtcctacctagaattttgtgttctcagatcagagagcaatatgcaccaaggctgatgagggactaattgcgtctgttagccttagccattagcattaaatcaattatattccagaagcatgatcagtgggaattatgatgtcgataacacaggggcgtaggcatgcattacacaaaacatgttgtgctaagtatgatgccacctaccactgttaggagccacagggaaacaacaaatccttgcgtgataagattggatcaaatttgggaaccctcgcatcattccggttctcattgctggctagctgctgatcaactcatgatcaaagaaaagctatttacaatgatgcaatgaaagtgaaacaattttagatttatttattaacaaattgtgatctgtatttaattaagccaaaataatttcttcaattcattacctcagaaagttaaaagttttgccaatatgaacaatggcataactttctacatgctgtgcagagctttacaacaccagaatccaactctaactaacggtatcatgagcaaagtcaaggaaatctacggagtagctagtgtgctataattgttgatgattattacaaatgtgttctaattcaactgggtgaccacagagacaaagcaagcattggtcaaattttggattaaggtagtgtatctatattcgatctttctttttcgtcaagcaaagaaagcgaaaaagttgtgcttttttccttcaataataaaacctacatactacaccccattctagtccccattctaatcttctggatgcaccatcttttgaaattttcaattgtaaattaatcaagtggtaaactcactcaatcttcttcgtcacactgagtttgtctgttttcccccataatataaatacttagtattaattagacctagtactccattttcaactgcaacaacgtactttaattagattaattaattgccttccctgaaaagtatatatacatgtttgtagtacttgatgaacaagtgatcagggaacaaaaagctagaaatatatggagtccagctacagcataacatacatgtttgttctcttttttttccaataaatatagcagacactggtgtactggaacaaaacaatgatacacttttggtttttggaccatatgaatgtcgtaacacagaactttcaaaacctaataaggataggtagtgtgagagatggaaaaagattatggacacaggggcccagcagccctgcaaattgcttgggtttgcatcatgttcttgcggccgggtgactataataatgccggccccttcatctatctatagctagctactatagacatgcattagtttctcatgaacttttgtttcctcatcacaaatgttttggtagagagagatggagaggtcaaatgggaggaattaattcaggtaggacatagcaggcgagcagctgctaatgatcatgtaacctcaaaacaatctcacgcggcgctaatcccgatgggagctgctctccacgctggagcacgacattcccctgcacttttgctccccggacgacacgtcgtctgcagatcactctgggattaaaccctaattaattcagtgggtgtgccctgggttacccatgttcttgctgcagggttagagtggcgcagcattagggaacaggggccagtaggatattatgtatagacgggttcacttttcttgtctctgcaagctgtttctgttcttggttgacatgttgataaatttaagatatttcttggtctacacgagcactttaaccttactgtctagttagtagttcattatattaagaatgtacattgccattagcctgcgctgaagagtgattagcagcttaattagcatatacctgaagggaaggcaggtttaatgtgtggaacagagttccaaattgatcatctagatagaggacatgttctggtttctggtcagcttctaattaataaccttgctaatgttctatctcccggcctctagctatggaatatacgtactaattcttcaattcatcatgtgcttgacagttgacaccgtatgcagcagcattgaagctagctagctgatcaccacatatttcttaaagcgatgcgcttttcatctggcattgcacacatatttgcacattactactatacacttcagcagctgcatgcgatcgaaacatacaggaacaacagactgatcaatcgatcggaaagctgtaacggcacgccatgtttctttcttttctttcttggttaaggctggctgatgacttgtcctttcttcccccaccaagcatgtaacagcatctccccaaaagtgcacttaacaataacaggataagcttagcagctgttacgcctcacccgtacataagcataaactacaatcgtgtggccaataactgggcgtccagggtatatactaatcatgctactcccgatgatgcatctagaactagctagctagctcccaatatattcatctacttttaggcccacacattgcagtactgaatccatgtgtctgaaactatgtactcctagcagtagcagtatatagcagtagcactagtaatgtagtataaaacagggtacatatatacgtagcaacatcaagcaaaatacagacgtgttggtaggacaagaaaaggaggtcaagttgcatattgcctggggccggacaccgatggacaatggtgaccctacctgaaacgatgcaactcgtcgagaggtccagacatatggaaaacgtctgaactcgacacgtacctagctgcagctgactgatgctgccttggctaatggtatggtcgatgatccaaaggctttacgtacaagatacactagatgcaaagtacacatacacgtcgtttttgtactcgacgtcgttttaggctacgaggatttccacttgtaagcacgaaggtacgtccatgagagtaacctctgacaggttattttacatgtggcaggcttggagcagttgctagctactccagcttgcacaaatgtgttcagacgtcgagttgcaggcagtgtgaatgtgccatttgtatgatcagcatgttgatgtgtagatgcagccatgcatgcagatattgcgaaagcagaatgaaagttagctatcttgccacaaatcgagtgaatacagtgttttgtttgcctttcgtctattcctcagaacgctaaaaagcgctgagattttttcccatggaaaggttgttcttttcacagtacagtacaccggcaggcacatattgttgcctctagaaactcgccattgtggcccaggccagccggcgatgcagaaaagtcaaaagttgttcagaactgtactttatctgtgatgtgacgggcacaatacatggatgctgtgttcaagatcatatctgctgttagcctgttactataagatcatatcagaccgagcaggaatgcaggatattaaggagtatgcataaaaagttatttttcatacttaactttcattggttggtcggcaccatgcgtatctttgaaatgctgtaactaactcttcttaccttggttaattaatcgttttacttaaccggatggcgactgaccaaaatatcctgcagccccagagtaacgggctaaacgtcgctatcaaagttaacccctctgcttcactttgcatcattagttacctaagcatatgataacatttacaaagtcccatttaaactcggatagtgtgtcggcgtccacggccgccccggcaggtaacattatattggtttctggatgggaaaaaagacagacggtccccatatacaattcaaactcgatcgaaagtcatacatataatgttacatgcgtgcatgcaccaatgcagatcactggccggacgtactgtaagtttggactgtaacagcatgcagctggtatccaaccacgcggggcaataaccaatggaacggtggtaagtggggcggtgcatgcatagtgcggatggggacggcacggctcgtcgcccatgcaccgcgtgcgctcctcgctcggtcgatcggtcggtccgaaagattagcccgggcggcgcccatccgcccgcccaatcatgagcacctcgcgggtcgcggcatcatttgctcgagatatatatcgctacgtacgtacacggccggatcggtgcgcgcgagcccgacgccgggtagccccggcccccaccccgcgcgcgtacgtacgtaggccccgcctcgcaccaccaccgctcgtacgcgcgttgcgccgtccgcgcctcggcggctctcgtatatccacaccaccccgcgcgtttcgcgtgccggccaacgccgacgcgcacgtacaccaccaccagcgtgcgcgcgtatctcgcttgttttccgcacgacgcaaccgcgcccgcgcagggggtgggctatagctgcaggttacgcgcgaggccggcgccggcgtgacctctcccttttgcggttttgccgagaattgagcaggcaggcatgccgcgcattgtactacaggttctatctgtgcgacgggatggagaccttttggatcgtttggtgaggaaagatacggcaagttggctagcgagaatacatgtgtgagatccttggcgtaagcggcaaaaaggctatagcatgcttgtttgctcccttagtgcatgcataaaaagcctagctgctgtgacagtaacacacacacacacacatacaaattgttctcttctgtgttgtactgctagctagttagctacatatgctcgcgctttcatcctctctagctgcttcaagaaaaagcctatttacctttgatgtaagagtgatgacgtgctaaaaatgctactgatccggtgacccgactgactaagaaagctaagcttgattttttttttctggactctcactttcactggcggcacaagtgtgattgatttggcggcacgcttataattttgaagcggtgtgacatggatgtatatacatgagccgacttatatgcatgcctgatgtagtatatctcagatcgatcggctagctagtgcgaggagaggtgaacggcaagggatcatcagaaggatcgatatcgtaggttgttacgagttactattgaattgctcctacgtggacagaggctgcagccatatatggaggttggtaaagggaaagtgactgcacaacacgttggctactgagaaaagggcagctgatgtaggatagatagatatatagatagagggatagatacttgttgcacactactcttaccgcttttgatacatgtgatgtgagcatcaagcttgtttctttcttttcttttcttcttcccttcatcctttctcttccctgtacattgctgtccttgatgcatggcttgtcgatgcttccttgctatcattgctcgccggccctcattcccgttccattccagggtatggagtgccatggttgtgatctcaaaagctagttggcgtgagcatggcattgtccggacaagcatgcatgagagtagttaagtaaattgaatcaacttcgattgttaacttgatagcttccctgctgtgtggccaaaaaatctaccatgttgttcgcttctggaacggaatcattcaggaaactggcagcccctcggtgtgcgtgaggcatcgatggatttcgtggactaataaccagcggaatgatcgcgcgctacctctatcaaatcgatcgtctctcatgacgacgagcaaagaaacgacatgatacggcacagaaaagctcgcaaaccgtagcagcagctcgcaaagctcataagtacaagatcctctctgatctggcctaatggcagacagacaagtggaccattcatcacatagacgatcgagagcaacaattagctagtgacagttcagtggtaagatatgtagttactaaaacttacaaggtgcgactgcatgcaattgcatgcctctgcaagtctgcagcactgaatgcagtgggtggccggccgggcggtgcctttgatctcactgagtcactgccaaattcagctggctagctggacaccgcgcgcacacgggcggttgccgattgatgctcctcctccgcgtcggagacgtacattacatcatttcggcgcagtggaggaggtggggagcacaccgcgcacggaggccgggccgggcggccgatctacatgattcacaccttgcgagctagttctcaactcatgcgagcaatcttttcctgcaaagttaccatccattctttttatctttctagtttcgcatatctatgatctccattcacacaacaatatatggctgtggtgaaaaggctctgttaaaaagcggcatccattgcagcccactcgatcctgggtgctcttgcgatcgatccatagcagcctcctctggtagctagctagctttcgtctctctgactcttctatcctgtaattgtgcccattgtgcattattctgcattgacgtatgcttgcctttcgctatagacttttcctgctcttctcttcaagatagctagctagtcttcagtgattgtactgttcctttcttgaaaaagaaacgcatatacagtctgaggataagatattgagatgcatgcacacaaatgcaataaagaagagatgtagaaactctgaagaaagaaaaaaaatagagagagagatgttacgggtagcagcttccgttctcccttgaaagttcaaacggaggacaaagaggccaaattgctgagttggctgtttaaattgggcttaagttccccctcggcccaaagtagggcttcagttgttttcttattgggctagtgtagactgtaggcttgacctgtttctgatttctgaagcccatgtattctttcttgtttacattttttttccggagtcgttagaaatatggcgccatatgctacagtcgattttttttcagccacttacatagtagttatatctcatttacaccccacttacatatataattagtatgtattttttgaatttacatatgtaattttagtacttacatatgtaattttgagacttacattgtaaatacactatgaacttacaatgtaaatacatgccgattattttttgatgaaaaatatggcaccataaatatagctacacccttttttttatagctcgaacaaacaaatctggagacactgccaaagtgctagaaaaatatcaatcgaacatatgttggcgctatgtatcttaggaattgtttagttaggtaaaatttttaggtttgattgtcacatcggatattcggacaatatagactaataacaaataaattatagactccccatgaaattgcgagacgaatttattaagtctaattaatccgtcattagcaaatatttactgtagcaccacagtatcaaatcatggcataattaagcttaaaagatttgtctcgcaatttacacgtaaactgtgtaattggtttttatttttatcaacatctaatactctatgtatgtgtctaaatattcgatgtgatggatgaaaaatttttattttagcaactaaacaaagcctttgtgctacatggctgaatattaagtctttcgaagtggtcatacaaaaattctcgtttgagctgtgctgcaagaaactctgcatctatcgccctgacacgcgcttcattacgatgaggttggcaagcctgcaggacatcctcgtctagtcgtttgcacatgatgtagcctgtagcctgtagccatacaagagagcacgaccaaattactggagtatggtacgttgctgcaccgcgtactgttgggaatggaaggcgactaatcaacctcagaggccacatcccatgtggtcctcttcttgaagacgtcttttaccctctactggaacggcagcagtaaatcgcattgcctcccagtagtcaatggccatcgatcacgagcaagcaaggcattgatacgcgcgtacgtacagtcagtcctacacacatccgtagtggtatatactccctccgtaccaaaaaaaaagacaaactctatttttcgtgcctaatatttgaccgtccgtcttatttaaaaaaattatgaaaaaaattaaaaagacaaatcacgcataaaatattaatcatgttttatcatctaacaataataaatatatgaattataaaaaaaattatataagacggacaattaaaattggacacggaaatctagggtttgtcttttttttgagacggagagagtatggtacagtggttcatgccatgtcaatgccggcctcacgaggacggctagctcgccgtgtcgaccgcgccaccgcgaacggggcgtcacggcctgaaactgcaagtgtgttccttattctcggttagaattcagaaattactgtatttcctctgaaacctctgcaggtgtacgtacgtcgtcgcgcttggtcggtgacatgaataactagtccagtacgtagtccgtacgtacatgtacgcggatgatccccgtgctgcgtggtccgggtgcagcacgtcatctccggcccagccagcctacgctcgtgacaagtgttgctcgatcgttcgttgcaattgaccttggagctagccggtcgggccatggcttcgcttaagaacgaccgtcaatgtctctgcaaattaagcccaaatccagtgcaggatcagtgcggagacaaaaccgatggcgatataaccgaatcggccgatcgatccattccatgtgtcgcgctcgaccatcgctacgccttcacgacagcccggcgcggcaggcacgtcgtcttgcggatcgaacaaaagtgggcgatgtgttcggcaccaccggccgccgcccgcgcgtcccgtggagaatccgaatagaataatccactactactagcagtgttacatttcgcctcacagaggctcacagggggatccacgggagacggcgtcacgggaagctacgcccggacgccccccatcgtcgtggcgagcgcgagtcgcttgctcgatactcatcgctcggtgtggcagggcagcaacggcagcgcgcgcacggggggggtccacacggtttcctccgcaaaaaacccgctttctctcggtcgtcgtcgcttttccaaccgtgaaatctcccttcttccacaccggcctttggaggcttggagctactagcttttttgttcgtgcagccatgtggcggcagtgcgcttgcctgcctgcctgcgctgcggctgcgcaatgctctgcacttgaccagatcgtgatgtagtagtagtatgatgtaagggcattaccaatgtatatgttaaaagtggtttatatagatgggacccatataaataaactttaactatagcaatctcacaatgtatatggatacaatgtaacattaggagaagagagagaagtagagatatataatattatttatgtcatataggtagtgtatatgcatatggatatcttttgctattttctttatatggactagttgcccagtgttactaaatggctaaatggaatagtttattccctatggactacttttgtagcacattgtggatgccctaactgttgtagattaatcgcgactaacaaaatacctgtcttgccttgaccgtgtgcttccgataatccgatgcacgtgatgtgtcgctaaagcggctcactggctcaggatgcaccgtgcgtgttactaccaccgactgcaaatacacgcggatcgacagctcagtgtggtggtggcttcagcttggcggccaagaaacttcaaaaccatattatggcatccttccaaaattttagaagggaagaagaggagctatgatatagacagtgcgagccggctaccatgtacacttgataattggacaccttcacagttcacacaatgccaccatcatatcaccataagctttattaagggatactagtcgaccctgccttatgcgcctagaaacttaagcacgctgcatgtacgaatgactaattaagtgtgtgaatgtacattggcgaatctagagatcttttagaacatgaacaaacatatatgtccaaaggattatatggatgccattgaacatcagcgatggaagctattacattgatgtgacttgtcaatgagttcggacggttgcccgaaggtaaccactagccaggtcttggatccgggtcccaaaaatatnnnnnnnnnnnnnnnnnnnnnnnnnnnnnnnnnnnnnnnnnnnnnnnaaggcatnccatcccggngc

SEQ ID NO: 29728 - DNA, 731 bp, Oryza sativa
  unsure (1)..(731): unsure at all n locations
tgatggattgatgactgacttacnnnnnnnnnnnnnnnnnnnnnnnnnnnnnnnnnnnnacgacgagcggcgggagcgagcgggacggcgccacgccgaggagcacggcgagcggctctgctgggccggaggtgtcgcacctcgggtggggccattggttcactctccgggagctcgaggaggcaaccgacgggctcgcggaggagaatgtgatcggggaaggcggctacgggattgtttacaagggcacgctgcagaattccgccatggtcgccgtcaagaatctactcaataataggtactaatcctgtgccttctcttggagcttttcgatttgatttggacatctccagcctttccatccttgtatagcctagaattcgtccttgggtgagtagaaaggatggagaatatagttaggaatacccgtttttattttttattttttaaagaaatcaattttccctttctgtttaaactggggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 29729 - DNA, 1065 bp, Oryza sativa
  unsure (1)..(1065): unsure at all n locations
nacccatggatgccgaaaacatatagggtcacgtaaggttttttgttaagaacacaaaggtcacacaagtagcttacttttgttggtgtattcaaagcaccctctattgatatgggatgcataaaattttttgtcggcaaattcacatatcactatagcaaagccagccaactaaaggggtaataaatcaacacatcatgagataaattaaaatttattccaacctcaaagatatgtagatatcaagtaatttcatcaatgcttgaccatgcattcaactgatccaaggaataagaaatacatgctcaaaagcatgaaatctgatgcaaccaacgtagcatatagactggtaaaaaatgaatagaaagagatgcagaggaaatttacttcttgtagctgaggtatgatcttcccatcagcaaacaaatcaacaacaatacctgtacacattaactagatgttgttaggccagaaaactttgagatgcacttgatggtgaagttgcaaggagtgtgtggtttcaaccccgacgttttttgttcaatctccaacacgctcacaatttcttcttaaaaattgtttggagagatgtctcttcctccaaactcttattttttaggccagaaaactttcaaagcctttgaaaactcaaaaagaaaaacattaatctaacagtacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 29730 - DNA, 1219 bp, Oryza sativa
  unsure (1)..(1219): unsure at all n locations
atggcttgatgttcaacntcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacgccgatgaagagcttaaacaagatcaagcaaactctgaacctagcaacagttgctggcagatcagcaggagatctgccacgcttgatcaacattgaaaaatggacggaatatcacgacgaggatcctcgtcacatgcttatgcctaactaatcatgcagtaaccgtaacatgcagttctttataaccaggggacaatcactaggatctgatttgaaagggtccagatcacaacattgcgcttgccctaccttgttctaccaaggaccagcaatgccacgaccgtgatcctgtgaggatcgacttgacaccaagagtagaaacacaacggacaatatcttcctttgtagtttgcaacctaatcctgataaactacattaacctccttgacctcaagaagtaattgtcagtctgtgaccttgtcacttgtcagggccttaatgaacagccattcagcagtatggaggaaccgcctagtgtgcataagcttcattaattcttcttcacggtcaaaaagtaatcagccatgcatcactttcatatttacatccggcacatctcgtgaacaagagatacagaatgtcggcaaataaagaatataaaagaaagtacacattttatcagtgaacacctcactgtcagcagcacgactcaaccagactaataaattcagaatggtactgattaatatatatcattaccagcagtactagcaaaagcatcagccattcagccccagcacatcatttctaatacctgtgtgctccaccgtccaaatgagcttccaaatatctatctaaattattcttctattaacaggacagaaaagcatattacaaggctacaattgccactgaagcaaaaactaataagagatgacagcaaataaaaagaaaaaaatgtgtgataagtagctctcattggatcgcatctaaggtctctttcctcttaatcctcctcttgatctccttctccagctcctcaatnnnnnnnnnnnnnnnnnnnnnnnnnnnnnnnnnnnnnnnnnnnnnnnnnnnnnnnnnnnnnnnnnnnnnnnnnnnnnccatntcaagggcg

SEQ ID NO: 29731 - DNA, 741 bp, Oryza sativa
  unsure (1)..(741): unsure at all n locations
ctgtggagggagaatcacnnnnnnnnnnnnnnnnnnnnnnnnnnnnnnnnnnnnnnnnnacttaactttcattggttggtcggcaccatgcgtatctttgaaatgctgtaactaactcttcttaccttggttaattaatcggggggacttaaccggatggcgactgaccaaaatatcctgcagccccagagtaacgggctaaacgtcgctatcaaagttaacccctctgcttcactttgcatcattagttacctaagcatatgataacatttacaaagtcccatttaaactcggatagtgtgtcggcgtccacggccgccccggcaggtaacattatattggtttctggatgggaaaaaagacagacggtccccatatacaattcaaactcgatcgaaagtcatacatataatgttacatgcgtgcatgcaccaatgcagatcactggccggacgtactgtaagtttggactgtaacagcatgcagctggtatccaaccacgcggggcaataaccaatggaacggtggtaagtggggcggtgcatgcatagtgcggatggggacggcacggttcgtcgcccatgcaccgcgtgcgcttctcgctcggtcgatcggtcggtccgaaagattagcccgggcggagcccattcggccgcccaatatgagcacctcgcgggtcgcgggataatttgctcgagatatatatcgctacgtacgtacacgggccgaatcgggcgcgcg

SEQ ID NO: 29732 - DNA, 5789 bp, Oryza sativa
  unsure (1)..(5789): unsure at all n locations
atcatctaatggtaataatttttttataaaaaaaataccaagatagattaatgtgatatatcactttacgacacatggaatgtcaaatttaacttctacatgtcgcaaaagaaaaaatggctatgaatatatgttaactagctatagtttaattttcttttgcaacatgtagaaattggattttaacttgtatgtttgtggagtgatatatcatatattatctattttctcaaaattttcatatttatttagatgatatgcaaacaacgaggtgatgtcctctcaacagttcaaaatccactccctcacatttaggcttatcagctcattttctttggtgagacataaaacatagaaagagtatttcctagtatgagatgttgtatattatagtatgataaatctagacaaaaatttgttcattcataatactagaatgtgacacatcccatactaaattaacttaatatgtgacgaaggaagtactatataactagcaacaaccatgcatcacaatactaaaaaccaaaggggaaacacaaaatgattgtgatctacccctggaccttctgtgtccaccctacagaagagctaccatccatgcatgccctacgagctgtactgtactcctccactgcacaggacactccccgtccagtagtacgatcggcatgcactatagcgttgcaacttcgcaagcagtatctcagcaaatgtgagcgcatctactagtagctaggatcagtaggcagctcgcccacaatgcacaatgcaaggccagagctaagctagggtccctgctgtgccatggaattcctcgacaaacagacagaacggtcagaggccgtgcaagaaaaccgatagtcgtgtgcccctgctggctgctgctgtgttagctttccattctctctgtgcatgccatggctatagctttcacggagcagtgagtgatcgagtgagtgttagtggcgcttttttagcctcttcttctcctttaatttgcaggcctgatcgctgaaagggccctccgatccccggcattggctagctagcttcctctcctcacgtttttattctctccatcttttgctcccagccccacctttaatttgtcaaatttttttacatgccccacggcatgcaggcgcgtgctcatccgcccggcaaatgctagcgatgcagctttctcgttttggttgttgtgttttaagcttagccccagcatccacgcaccatgtataaatgccatatgttttataccctttttatttaggcttataagccaacttataagtcaaaaaatataagcctaaacaaacaatcagctttttcgtttggcttttttgaagccataagccactctaacactattaagccaaaatctaggttggagaagtttttttggcttatgtgagatagatgcatgactccaccattaaacttagaacattaaatccaccggcttataaatcatataagccaataagctgacttaaaagtctaagccaataagcccaagcccaaacaaagagggcattaggccccgtttgattcaaaggaaattcataggaattttagaggattttattcctataggaatttttcctacaaagacctttgaatcaaaggaatgaacactatggaatcctatgaaattcctatggaatgcctcttcccatacaagttttggaggaattttaacaagaggtagaacctcatggaagaaatccttcgagtctttatctctcctcaaattcctgtgtttttcctgtggtccaatcaaacggtcattcctatgtttttcctgtggtttgcaatcctctgttttacacttacattcctgtcagaatcatatgtttttcctattcctccgttttttcattcctttgattcaaaggggcccttagtttgcgaactagataaaaagctgctaatattaagatatattcaattctagaattaattgcagatatattgcattgcatatatacttgatgctctaagctatatacagtacgtacgtatatctaagctatgtacagtatatgtacaaaataaaggcctggcaagctctgcgtacagtgctttgcattgagccatgcatgaatccattttcatgagagctgtatgatcagaatgagtagaaaatcatgcatattgaggttcttaagtactagctatactagcgtgtatctagcgcacacatgcacttcaaaaacatatatgcagcactctctagtataaaagtcacactaattgttgctacaaattaaggcccctaattttattactctaaacaaattactgaactctgaacaaactaatcagagaaggtacaataaatctaatcagcaggctccaaaatattccaactcagattattctcacgtggaagagagataactggagagagggaacaaagcgggcgctagatgtagcgccgagcgatacacagatacgcatgcatttgtgggtcccgcaaccaccccgccgatcccgtgtatcgttttgtttctgttgtgcctcttccgatccgcccgatgcattttgctccgcttcacgccgcctccgctcacccctgtctcgccggaattttctcccgcgacgtgaaactccgccgtgaaagctccagtgcgcccaaaaagttagtaatcccagttctcagcgacaaagaaagcgagaggaggattgagaggcgcttggtgcgggcatgcaactggcacccaaagcaataagcaacttcttgatttgaattggcttggtctaattcttttcttttcttctcccactgtctgttgaatgcttgtcgtctatgtttgttctaccgattcttcgtctcatctgttgcatctagtccgttctaatctcttcctatagctccttttattttcccttttgttcttctccttttttcatgtatagattatgcagttgggcagcagtgggttgtgatatactatgtgaattatcaagtgtgttgttattcgttaatttttcaagtagagtagtagataacccatatttattacataatacaaatggccatataagccacagagttgagggcgtttctgatcatgcacatgtaaagtttattgtttgaataatgagatcatgttgatataatagccaacctattgtactagttagttttggtattggctataaaatgacatggatgttattggagctagtagctggctacactattgaccttgctcttatatagcagaccatttttctgctgctgcaacagctataattcgttgctgactatagcccacatgcctctgagatatcaccagtcgacagtatcattcgcaggcctgtagctttcctacatttgtccctgctggcctcttgcccaggctctgccgtactttgcctttttatcctagaaagtccatagtgcaaacccaacatggctggattaaattttaccaaagcactgaaacccatacacactactgtagtagtatactccttgtcagtcagtctgtagctagtcattcagtatccagaccaaaccaatgctactagcccttctgtgcagatagcttttgcatttgtgtgtcctataaaaaatcgcaagatagccagcctgcttgcaccgaatgattcgagcacttgcatgtgttctttactactagtgccactcgcgagctatatcatttgatgcatgcatgcattgggtgtggatggatatttagaagacggtgttgctgaatctgatgcacggtgcatgcaattgcagtgcaggcacaggttggtgatcatatggacgccatggaatcatgcgtccctcctgggttcaggttccaccccaccgacgaggagctcgtcggctactacctccgcaagaaggtcgcctcccagaagatcgacctcgacgtcatccgcgacatcgatctctaccgcatcgaaccctgggatctccaaggtacaactagagatcgtatgattaatttgagtttcagagatgatcattgtggcattatttatcctaattgtgttgcctggtttgttgattgatgaagaacattgtgggatcgggtacgatgagcaaagcgagtggtacttcttcagctacaaggacaggaagtacccgacggggacgaggacgaacagggcgacaatggcggggttctggaaggcgacggggagggacaaggcggtgcacgacaagagcaggctcatcggcatgaggaagacactcgtcttctataagggcagggcgcctaatggccagaagaccgactggatcatgcacgagtaccgcctcgagaccgacgagaacgcgccgccacaggtatatacatataccgatttcactagctaattggtttcttaattttctctgcatgctagctagctctacataaactagcaaactggttccatgcttgataggctaagttcctaattttaaaaagttgtatatatccggttggatgtataggctgggtttatcaaaaaaaaaagaaaatattttttaaggttgttagtgaccacattgcatacttatatatctgagaaaatatatctgaattatatacttatatatgtgtgttgcaacttgcaactgaagataaaatgcagtataccagcttaggccttattagaggttaaggtctaatggtgcccagagatttctaaagtagcacgcacagagatctgccgccgatatacatgcgtgcaagcatgtctaattcatgtaccactagtaatggaccatatagataggaatatatcagtagcactaagcagcaccacaactctttttgttcttgaaagataagtcttgcattggcctccctttttgtgagccttccaaagtcttctattctctcccaaataaaggtagcctgcatccagtgttgatgccatcctgaccttaccactaacaccaaaaccttttttccctagacaattgcatgcgcatgcatggcctagttagggtttcccctggtgtgaacgtcctaacatgcgccatatattgtttacaagctgtatgcaacttgtgctagtactcatcaaaaccattgcatgctgcttggcaaacatgtcaccacaaaactaaaaaagttatcagctcgtattgttccactatcacacagtgggaagctagctaactttacgaatgattggcaaatactttggtgtcaatgtcaaccttgcaaaatgcagctcacatcccccccgttcgtttcctcttaaaacaatggattaaattttgaatttttgtgctacgcttttcaaactgctaaacggtgtgtttcttgtgaaaactttctatatgaaagttgttctaaaatatcggattaatctatttttcaagtttataataattaaaacttaattaattatacgttattaccacaacgttttacatgaaatatttaatcttaatcttcgggagactcaaacaccacctaagtatctaactttatttgcatgtgtgtactacaggaagaaggatgggtggtgtgccgagcattcaagaagaggacggcgtatccggcgaggagcatggtggagacgtgggactactccttgcacgagcgcaacatcatgagcgccgcggcggcggcggcgttcgccgatccgagcgcggcgtacgcgcagatgaggcggcagcacaggagcgggcggttcaagcaagaggcggagcttgacggngcccgcacaagccttcttcactacttcaggcaccttgncgagctgtcgcaggtcgagagcccctncgnggttgnngngcgntccagnccaacccgagcagctgcccacgn

SEQ ID NO: 29733 - DNA, 17984 bp, Oryza sativa
  unsure (1)..(17984): unsure at all n locations
catgtgcanttagaatcacactctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggagactcaaacaccacctaagtatctaactttatttgcatgtgtgtactacaggaagaaggatgggtggtgtgccgagcattcaagaagaggacggcgtatccggcgaggagcatggtggagacgtgggactactccttgcacgagcgcaacatcatgagcgccgcggcggcggcggcgttcgccgatccgagcgcggcgtacgcgcagatgaggcggcagcacaggagcgggcggttcaagcaggaggcggagctggacggcgccgncacagccctccttcactactccagccacctcgccgagctgccgcagctcgagagcccctccggggttggggcgccgctccagcccaacccgagccagctggccaccgccggcgaggacgacgactgcaagggcgataatggcggtaggagggccaagaaagcccgcgccgccggcgacaaggtggcgacgaccacggactggagagcgctcgacaagttcgtcgcgtcgcagcttagccccggggagtgtggcagcatggaggcaacggcggaagccgcggcggcggcagtcgccggtgtgagctcgccgctggaccacggcgatgacgacatggcagcattgctgtttctcaacagcgacgagagagacgaggtcgacaggtggacggggttgctcggctccggcgccggcgcgagcggcgtcgacggcgacctcggaatctgtgtgtttgacaaatgagggacaaagcattcacagcacgatgtgttcatcacatcaaccggatgggatatatggttatagctgaaatttttataaattgttctctttttttttcttctgcttctttttatgttcccaaatgtgattgtaacctttaatcgatctgtcccctgtgcagagtcataagatgcatggcattgcaatgtgctttttttttcccagttgatgtgatcctacattggcactttgtaaatgtctttgactcccagctgggtggcatatatagtacactgtactctctacagtaattaatgacataatatttgaagtcagcataacttgctagaaacgactaaagcaagaggtgcgcgtgcagaacaaaatgctactctgactcagcacactagctagtaactcgttgaacttgtacaaatattatcaagaaaaaactctaggaaatttagattgtgatcactagtcaagagggctgtgcgattgatcaggctatatacataatcatagattccaaaacaaagttgtattatatatatagattcttatagcactgctggagaaaggggcatcactcccggttggtaaccctctaaagtcctggttttgcaactggaccacgaattcaagactaaagatgttaaaataaccaagagtaaagattgatctttattcccggttaccaactggaacaaaagagggtagcgccaggctctctaatccctattctcctctttttttttttctttttcattgttctttgcatattgattttacaccaaaatcacatagatcaacatcacaaaatcgaacattgacatcacaaattcacacatacatcacaaatccaccacaaatccagacatacatcacaaatccaccacaaatccacacatacatcataaatccacgtatcaattcgatatacaaatttactaacacaatacactacaatttactaaaatatttttatatatatttttttaaaaaagacgagtgatcaaagttttgaagataaatagtcctattgacagttactaaaaggggaggtgaatggagtacgtgttatggctttatgcaaatttggcgtgtttgatagaagagaatatttgtgactacctgagaatacagatgtgatttgcatagaatagtgacaggctctaggtagtagatctgaagcaaaatattcgctaaatcaatatactcctatgttgttattagtgcggtctcactcaatcaccacaaatccctagaccttaattcagtcttgttcccagttgttgccaaacgacgaagccgtaagtagggatgccagtagttagtcccgttacccgtataaaaacccgtttactagttcatttcttacacgatagtataaaatttagaagaaaaaataaactagaagagagatatataagcgggcttaaaaaaaacccgcttgcatccctaccgtaagattattatatacgacaacagatgatcttccaaataggaggcctattctctcgtgataggtagaagggatcaacaactaattaattataccgtagtgcgtgcttactacccattaatcaattattataccgggataatgaactcagtctaaaatctctgttcatgttggtctaatatatattatcactaactagtctgatcaaaataatgcagaaattcctattctaaaaaaaaactgcagaaatcaaggattcaagggtgtacctgctgaattgctccggttgatcggatcagcttctgaaaatccacccacggatcgtaactcgccgctcgccacacgcccaaaccagtacaactagggcggcggtgcgcgccaacgccaatcgatcggccggtggtggcggtgacgcccggtgccggcgccggccctcatggaaacgagaggattggtgcgaccgccggagtgcgctccgatggccgattggccgcggcggcggcggcggcaccgcgagtcggcgagacgacgcctgatcaggccgccgcttctcttccccaatccctctacctcccggtcttgtactgtacatcatttaggcccagcaaagcccacgtagtccgttttttatgtgggcctcatcagtccttcctcgcaactaaggcccatttagcgaaacccaggctcgttggcccagttctcccctccgtcttcagttttctccaccatgagaggactgctacagagttgtggagtggatctccgcctccggtgagctccagctccgatggcacgcggaggcggctacgggtgggcgctcgcggcgggcctcaacgccgcgctcgccgccatctccgccaagttcttcgcgcctccggtactctactagctctctctctacctccctccgatctgaacattctgttttctgttcataccttgcttggaaggctgccgctgtaaccttaataggccgcttcagcctttgttcgggtttaatttgttcatgctggttcgattaaatgattttaccaagttcatgggcatgaaacagtcacttacttggatccgaagttgcggattcatcagataattcgaggttagatgtgtgatcccttcagctaatgacttagtgctagaagtataactgggataatgtggaaattgctgatcaaaagttaactatcatgtgtggttcaattagtttaggatcagattgtgaaaatacctcaaatcaaatgataccggtttaacctgtactccggattagttcctcctaccagtgtacttgtagtctagtgctgcctgctattttgttacttgagacttgactttattattgccttctacagcttctgaaatacagcatggtgatacttttcaatgtgacaatgtggggctgctatgtgaacagcctcaaagcactgtcatccctccaagcaaccgtcaccaattttgctgccaacttcatttcatcaggtcttgcagggtactttctgttcgaggagccactgccttctaaggtaatatgagaattctcccttctgtgtagtgcgtgcacatcaagctagttattcatgcagatcaaatagctaaaaattttcaaatttatttgtgttagcttatgtcctctgttagattgggctttttcttccctttcaaacatgggaagagtatcctaggttgatctgtcacattgcttcttagtagtatgagtaggtttatttattataaataggattaaatctagttattaagctaggccactttatctggattcatattactcgcttgaaaagtcacatagcatacaaagattatcttataatttactgttgtatgaaaaaattcttgagagatgcatgcagttggttgataggaaagaaaacacactggatctttaggttgttatgctaaaatagatgccgtttttcagatagagaaatagatggtcttgtgctttatatcatgagcaatgacttgcccccttgtataccagttaaatacaagccaaaccctgtcataaatacaacaataataacatatcacttgcctactatatctgtacagctgaatttatgtacagtctgtaaaatataataataataaaaaaagacatttggagggagagatgtccctccaaacagtttcaagaagaaatgtgagcgtgttggggattgaacacgggacctcagggttgaaaccacacaccctttgccactgcattatcaggtgtatctcagactgtagaatactgatacatcactttccccacttttgagtttacatgtatacaaaattgtaactgaactgcactcagcttttgaatttgatgtatgttcatacagtggtttgtaggtgctagtcttatcattgttggtgtttttatcctaagcaaatcaagcatcgagaagaaactgaactctgactagagtaagttttaaggccaaaattttattagctacgacacacattgtcagtttgtacttctataagcttgtggtatgtttgaccataacttgactcttttgtaaaaacttgtgtcaattatgttttgcaactttagttcatatttttgtaattagtaaataacttgagctcatctattgagacatcaatacaagattgttttaaaagtgaatgcatgatctaagaattgctttttatattgactttaagatgacaacaatcaggaagtggaagcgccatatctgaaaggagtatctcttttctcattagcagtatagtcacagcagaaattcttccctctaatattttcataatttcattgcccgagctctgactttgattttttttacggcaagaggagattttcagctgttcctgaagcactgtagatcatgatcctctgaaatgcagtgtgagtgaaaaaagataaggttctttccactgttcatgaagcacagcagataatgttcctctgaaatgacaatcctatgtcggatgctccatcaacattagcttcccatctgctgacccctccaagggacagcataatttgcttttgatacccgcggtatagtttcatcagtgtttaactgtcccttcgtttctaagagaaccttcttagtacgccagtctggactgttaactgatactactaccttgtttggtgatactgatacctgaacggctgaacctgtgttatcacttgtcaggaccttacagtttgctctgtcctgctagcgagcaacgcaatcagtaattcagtatatcgaaggagatcgtgcgtggtcgtgctatcagccgatcaagtgatgaaaacttgaatctatagggattgaattgtcatcctcatcagtaaaaaatatttgcattccaaacatgtctgaggcttttcttgaaataaaaaaaagaatcattgcagttgcctgttgcagcatccggaaagaaagaaagaaagaggagcacatgcacatgccatgcgtcccatttgagcatcttttattggggtagggtgggttcctcctgaatggatgcaatctgcatggcaagtaaaccatttctgttgactagtacaaactcctgctgaaaaatattcttcagacaaacggagtaggaccatccgagacgatcgatcgatgaatcgatggactttatgggtgtagtacgctgggcagagacaagagtttggctatcttgattctgaggatgagtcgaccaagggaccctttgcagggtcaggtttgttttttgtcccactctctggaagactggagtagtacactacttgaagcatcccatagctgggggatagtgacaattacagagtcgttctacattgtgtattcgcttatctaatttgctgatcctgaagaaacgggcagtctatcctagatggaaatggaagaacaacgatctgaaatgggaatagtaaacccgaaattatggaaattaggagtaacacaggattgattggaaacgtttcattcagaaatttttatacgttccaaacgagacactgcgtgttgcttcgactacacgttgtgcgtccggcacgatacgacaaactttccagctgaagctggatgtatgcgagcagtgcaacggccggccgggaaacgaacacctcttgaatccctctcacagaagcgaacaagccagcttcgtggccagtaagtaccaagccacagctcaccgcggaatcgaccggggtgagctgagctggatgcagattgcgcccggagtaaccgagctggggacggggttaaagtgaggacatgattagtctgttgaaaaaaaactttaggaataccaaattttggtttattgatacatggtaaaaaaaaagtgtaccagagatcttatttgctctgaattttggaaatctcaagagtaaatactcagaatctactaaactcctatttggtaaggttcatatatgtttagaagatagtatatttgatttattacgcaaccgaaatatggtatattgtttttcctaacgagaaaccaatgaagcccttgattttcggggtagaaaatgttgaaattcttactacaagatgtctgatttattaccttacaaaatgcgacagcagtaaattttggtgatctttaatttttttttgtggcaagaaacccatcaaagcccctttgatcctggcgtggaaagcgataagcggtggtgtcgcgtcgcgtctgcagtagaaatggaagcctgggggctgtggctgtggcgtgggccaaagcagcagccatcaccagataaccccgcccgcatgcccccgcctcaggcccccctccccaacgtagtatattcacctcgccgcacggcagcggcagcagcagcgtgccacgagacgaccaccagctagctcgcaatggcgcagcacgagaggaagccagtcggcgaggcggtggacgtggaggcgggaggaggaggagtacggcagcgagctgcggcggcggcgggggagagaatgaggttgacgtggtcgtgcctcaccgtggcggcgggcgtgacgactacgggggtggcgggcgcgcccgtgctggtgtggtggccggtggcgttccacccggcgcatgagcagctgtgaatggtgcccgtcggcctcgtcctcctcggcaccccgctcgtcgcctggctctccctcttcgcctccggtgcgtgccgccgcctcggcagcctccgcgccgtccaggaccaggtcccgccgcccttcgctgccgagaaatgactgggttgtcttcgatctgtcgtccgtccgtcgagtgtacattttcttagtcttattattcttcttcggtgttctttcttatcgtcgtttttcctaagatgatcggaatgtgatcagaatgggatccaaattctaaagaaaagttcttgctagtacaaacctgcagatttcagatgcttcgattgatcttgcagataagtttggcacttaattatattctagtcgatcaagtacgtgggaagaaattctcgttgtcaaggttttttattcagcgagttaacattgacagctccggatcgaattttgagagagagctatgcagctcagcccgacagcgatttgtcatagtcacacaaaaatgatggctcctttactactatcgccgcatagtccacacataggcacgagaaaagaaagtgttgttttctttcctacgcggtcactgccacagcttggaaacacagagtgaccgcagcgactagtacttggcagttggagcacgaaggcctgaatctgatggtggtgccaactcggccaaagtcccaattattcctcacaagtcgcgacttggcaatcgacgtcgccttcaataatgcaaggctgactggcaatgagactgggcatgtagcacgcgcgtcgctcatgtgtgtgtatcacgctaacatttgtctcggggctctggcagattatgggtggagatttggacggaagctagctagtaatatatatgttggtctgttccagttacgttgcaaactgcgataatggcgaacggatcgatgggcacaaagccacatatgcatggggcatggacttaactagatagtgcggtttggtggcgtctacacgttttagaattcgcatctcattctcggtgaataaaaacctagtcaaaagttgaggctctcccatctgcaagactgcaaccgaacagacgctgaagaatctatcttaggatcgagctcgtcgtgttcactgttcaggcggccgaagctttgcgcctggttgatggggacgggagtatctatagtggaccagtacttcactgtactattactactactactactactgctccagtacaaatactgatgatgtgtgttcgcatcacattattctggctaagctttcttcctcctctttcttgggacgaggacagcggcggcagcgtacgcagcgggccagattctacacgaattctgcacgctagttgcatgcaaaagccgccttgcgagttgcgagttccgacgtacggttacctctgggcaccaaacgggaaaccggccaagccgttgctgtgtttcgagttccgacgacgacgccgctgcggcagcggtgcactcacactcacgatagctgtggcaattcagctcgattatatcacgggcgggggcatggcgtgtcctgggacggtgccattcggtggagcgtcaactcggaaagcggccgtccggtgacacggccgacctggcctggcctctcccttcggcttcacttccctagcttgagacttcccaaagagcacccacaatagtaaagtaacgtgctatctataaaatatatacatatcagtaatagactagattaatagtaaaccactttaattgtatgtctatatgggtatctatagctctctaatccattgtctcgtttttctctatagactatctccagattagtagatatctttgctctctctctccatttaatctctttcaagtaggaaaatatgctgacatgtatcttttatagaaaatctatagataattattgcgggtgcccttattgtaccacatgttgatggagacattcggggtagttgaccacgtcggggcgatgaatcatgcgcgcatgtatcgtatggtctggagacgacgatccttttcttctcatgggctgggcttctttcactcgtcgacagagagcatcatgggccagcccaccgttgtttttgtaaggcgagagcgagagagagagagagagagagagagagagagagagagtccggtttcagggcctgtttgtcaactgggcctgaaagaattgggccaggtttctcgccagattatgggctcccaaacagagggttttgggtttatgacatttcttctgctgctaacctgccacgttgggagctgaatatctacgaactacgtcaaaatgtataaaatcgcggttttaatttttcttttcagaaatctcttagcatagccttcttaaaatagaaaactaagcattttctatctagcacgattctactttcttctaactcgcggttaggagtgtttctgcgacaaccatcaagtataactcgacaaaaatcaccggccatggagctcatcgaagtacgtatcctcctggaatcgaaatcccacaagctgacaacgcaaacaaagtcgcacgtggaactctcactccagaacaacagtgctgtccccgtcacaataatctcgccgtctacttccaaagtcacgaaagctgctgcagtatcaaccactaacacaagagttgcaatcacaattctctccaaatgtaatgtgacggttacgatttcaaatcagcaatcacacacaggtcgatcggtcacgccccctgtcgtggtaatgccttgatggcggcgaggaaaaagatttgagagaatgtggtgtgcagtgcaggcagcgacgacgaacgggacatggcacgaggcgctagtggtggtgtggtgcccccgcgtgacgccgcaggataaggctctcggccccatcgcggcatcaatcatgcattcacgctgctactggcctactgctattgctattgctattgctagccgcttgctgattcgtggcgcaccgcttccgaccgcgaccacatcaggcaaggttaattgcgtgcatgattgctggaaaaacaacacagcaaacggcatacagtagcaagatcacacacgttcgtttttgtcgtcgtcgcggtcgcggtgaattgttcagaggagagccagagtttgttcaggggaggacgtgtggagcacggatggatcagcgcgtcgttttcaacggaggaatgattgagagtacggcaccgtacgggtgctccttcgaggaaggtgcaaagcacgcatgttcagggttactactagctcgttgcctgtcgctgtggccacggtggtggacgacggcgagattttccctactccagcgtaaagaaaaccgaaaggagcgatctccaagtggcaacacgtaaaatctcgccccacatttggatttatccatccgaggaggagccacggttaaatgccgcgttcgcgcgtgctcgttacgtacgcgtgttgctttcgagtttgattaatcgttttttttgccggggtggtggtgggattgggatagagttcgggccactgcctgtgaaaactgtgaatcgcgtcgcgttgcacacggccaaaacgatagcgcgcgcacgcacgcacgcattcgtgccgcacgccgcgcgccgcctacgtttcgtcccacgcggttcccgaccggaccccacaccacacctgccaccaacgcattttcggcttatttgaggcgcgcgcacggggcgcccaagccatccagcctgcgtgcgacctaccaacgcgcgcactcctcgatcccatcatcggaaggcggcgaggcgcgcggtggaggattgatctgcgggagggattgatggcggaagcggaagcggaggctgcggaggcgggggcggtggcggggccggcgaggaggacgacgagggtggggcgctacgagctcggcaagacgatcgggaaggggagcttcgccaaggtcaaggtcgcccgcgacacgcgcaccggcgacaccctcgccatcaaggtgctcgaccgcaaccatgtgcttcgccacaagatggtcgagcaggtccgccgccttaatcatcctcaaaattgaatatttatctctttttttagacatcaggtaataacaagttggatcttttctcggaggggatcgaattaagaatcctaaattattctagatagatgctagattattataaaagatggattttcatggggattaataaacattaaacgagaatatgcgcttactacgtctctaccattgtcaagattctgtctgtttggattgtttgtgattgaagaaaggtcatgtgtccgcctgtccagcgggctaaatctgctctgatctaaaggaaattagatggaattgtatcaagtttgaatcggaaatgtaacaacagattatcaagctgggccatgtaactataacaatatctccgatgcggtgatgccaaccctgtcttaatcaaatgctttctgcctagcaaaaagctgtgctagctttggtgttcgtaggagtggcaagagttgttctagattcatttttttttctcggggagttataaattcagtctgactggggggaaactcgggtattgtacattccgtgctagatcactcattggttgatgcattgtttggtggaaaaactagtattttttttggttaaatatgtgattttccatatgatgtgttggcacaattaaatgtccctgctcgagctgttctgttttccagcttgagctttcgattgtgaatgataacctcatattccacttctatcagatcaaacgggagatttccacaatgaagctaataaaacatccaaatgtggtccagttgcatgaggtactttgctatctttgcaggaacaatagcgtcattaccactcatacccttctttttttttttatctcatctcattcaatgagaattttacattcaatgtgtgtttgacaggtcatggctagcaaatcaaagatatacatggttcttgaatatgttgatggaggcgagctttttgataagattgtaaggcccatgaactttctgtgccagatatcacgattcttatttttgtttatgtacaaattgcttttacatgctgtaagagtagcttgttgaaccggcacatttgactgttttgatactgactgactaatccgcagttcttggaccatacaagttgacccatttatcatcatgttattatcaactaggtcaattctgggagactaggagaagatgaagcaagaagatacttccatcaacttataaatgcagtagattattgccacagcagaggagtgtaccatagagatctgaaggtttgttgaattatcctgcttacctcctttctgggtaatctccactgggatggatgtattctcattcatattttttatgtgccatttgcagccagagaatctgcttcttgattcacatggagctcttaaagtttcagattttggccttagtgcgtttgctccacaaacaaaagtatgatatctagctagtacccagaagtatgtttttgtagttgttaaaaaattaaccagtttctttatcctaatgtgatgtgtttgggttttctagcatttttctggtttaattgacttgttccttaacttgcactattacctcaaatgaacttcggacgcataattatttgttttggtgacaagaaagttgaaagaagtaactttggtaaactattttgattgttttatttaggaggatggacttctgcatactgcttgcggaacaccaaattatgttgcacctgaggtgattcatgttgcctttgattaaactcgtgtattttctccaaaaagatgtaagaatcatatattcatactgttccctcaggtgcttgctgataaaggttatgatggtatggctgctgatgtatggtcctgcggcataatcttatttgtcctcatggctggatatttacctttcgatgaccccaacctaatgaccctttacaaactggtaagtatgtgtaacatgcacgcattctaatgtttcttgtgaatttcattggtaaacttgatagacttttgatgttctcttcacagatctgcaaggcaaaagtttcttgtccacattggttttcttcaggtgcgaagaagttcattaagcgcatacttgatcctaatccctgcacagtaagtgacaattaaggacatatatcttcagctaaccagtttgaccagctgactgctgctagtccaatgagtttcattgtatatcctctttgaagccttttatgatggcaatttgagagaagtcagaaaacaatgagctatattctttgcagagaataacaattgcacaaattttggaagatgattggttcaaaaaggattacaaaccaccactttttgagcaaggtgaagatgtgagccttgatgatgttgatgctgcattcgattgttcagaggtaatgctagctgaacatttatctgtaacctgcatcctttcccaaaaatacgatttgtaacctgagttaaaaccacttctttgtttgttacgtttgtttgtttaacctttcaggagaatctcgtggcagagaagagagaaaagcctgaatccatgaatgcatttgctctaatttcaaggtcacagggattcaaccttggaaatttatttgagaaggaaatgatggtaggttttgatagagtccaatattataattccatgttgagaatatgttatgtgctagatagattggagtgcttctttctggaagcttgtatcggttaatataattttgctaatgttttcctcttttctttatgtgctaagtccgacagaacaattatgttttgatcaatttatcatcctattagttgtactccttagtcgtttactaaatagtctgagtctacctaatatatatagggaatggtgaagcgggaaacttgcttcacatctcaatgtacaccacaggagatcatgtctaaaatagaggaagcttgtggacctcttggtttcaatgtgcggaaacaaaattataaggtttgtagcattttagacggctatgtattgactagtttgctttatgtgggtttctgttagtttccttgagaatttgcatcagtatgttcgccattcagaagtaacttggatttgttcttttttgttgggctccagatgaagttaaaaggtgataagactggaagaaaaggctatttatctgtagcaacggaggtattggaaattaaattgacatgtatcctgttaagtctgtgcaatgcttcagtaaattttgctttaataaaagaacttattcacatgctatctcacaggttttcgaggttgctccatcactccacatggttgagcttcgtaaaactggaggggacacgctggagtttcacaatgtatgttatcaaactttgtatattctatcatttcatagtgggtcattgaaaaaaaaaatcatttcatagtacccagcatctagttgtttcttgatgatttcagaacgattaacgtcatttctatcaaattgcatgcagttctacaacaatttctcgtcagagttaaaagacatagtgtggaaatctgaatctgacgcaaaagcagcaaagaagaggtgatctttagtattccaactatccaatgctcctggatgtagttccccctttgtagcgtttgcaccatttctccaggtgataccaaaggatatcgtcctcctggtcttgtgcacattgatgaattttctgtggggtcacatcttgttgtgccaatccttgcaaaagggagcgcttttttttttctttttacccttagcgcaactgtagacatgctcacatgcatgtataaggccctcccggagatgcaccttgtatttgcagttgggatgtcaaataggtgtcctacatgctttggtgaccagtagggttgtgtgccttttcttttagtgctgaaaagtatataataagatcaaaatgtgaaattgggaggctatgtaacactaagctgtgctctgttcttgagaaacctagcagcagaatggcagtgtaactttgttagttctttcttttgtgaaactgtaatggcttcacacctgagctatgggtgtatgtattcaatcatgatgcaatctgattggccggataaaagaaagaatagtaatcacctttgcatgctatttattatgaaccatcacatcctcttgggccggatcggtaccaatgcgattctagtcgggtttggtctcaccagcccatgagttaatacggcccggatggaggagagagtttgatttgatctgctcgcggctctccctgccacgccgccggtcgccggagctccgtcagccgtccaccggcgttgctgcacggaagctacaggcgatcgccctggagttagctgcactacctgtgtttccttggtcttcaactcattagcagatgggaactgaagcatcaaaatttaatttctatttgcaatcttttcagttcatttgtttaatacagtagttcatcgtgtgataagttgtcttttatcagctgctaattgtatttcagttgtattacgaggctgatccatttgatacggcttttgcttgagtgcgatgatagcaaccgcaaagctcaaatacaggcgccgatggttacaagatttaaaccagaaaacagtggctgcttttgtttgctgttgcgatcattcatccgacttcttttttccttttgcagggagtacaaaaatgcagagtcatatgacatagactcgtgctggagaaaacaaagatgggtgtgtttagttcacgcctagttcacgccgaaattagaagtttggttgaaattgagacgatgtgacggaaaagttagaagtttatgtgtgtaggaaaatttcgatgtaatggaaaagttggaagtttgaaaaaatattttggaactaaacacggcgataaatttacttatctgtcaatgtctgctcctatacggacgatggtttctaggatatcatgaggtaactgtccatgtagttttgtccaagaaaattctgtcgccgagtggagcgatttcattttcaccctctgcgacaacgaaagaggcgggtcaggtgaggctggatgataaaaaccgcagcaggcagccaggtaaattttcaatggcattatttctgattttcttccatcgccatcttcaccgaccacagcacacacgtagcttcatttccgtattttctgctctaatatatttgcgagttgatgatcggaagctgaacatgacctcacaaaatcactatttttaatcatcacatgatcacatctgcatcaatctataattaacaacaattgtttcgtgatatatctggagtacgaaggctctgtttcatcgaaaacgaaaaagatgcgtcgcctttggctgaacggttgagctcctttctctagtccttcagcgttggaagaggtagctgccaatgctgtcgtcaggggtgacgagaaagtcaggatcatccgactcacccaaaccgcaaaaattgacaagcgattcactccccgtttgtttgattattataggatgcaaaatggatctgcaaatgcaaatgggaattgggacatcacaaccacagctgctgccaatattcttctgctagttttttcgtcatgttggaaatgaaaatctacccaccttttgaagccccggtgattctgccgtctttctttgcctcctcagtcctcagtgctagtataatctatggtcatggtgtgcggtatttttaatgagaaaatgcatacgcagatcaaacttttggttgagacttaaaccttttcctaactatggattgttgtgatcctaaaaccagtgcgcaataaagaactcgccgactaatcttcagtttatttatagttgaaaaagtttgtggagatacatacactagaaaattgaaaggacactaaaattttcaggcttacgagtggctgtttcttcctaaacgaaaagcttaggactgttttgctgatgggtcctaggctcctagctgagctttagttgcagcacattactataccttctttcatttcctcgttcttattttcttgtcgaagtaaatgaaagcagatggctgaaattagtgtctctagatggctaatttctccattaataccacgggcaacagtcaacaggcatctgaattagtatggttcttccatgcaatggtttgactcgataccgcccttctcgtcagaaattcaaagttgccggcaaattcttctaccctccaattcaaacacgagatacactactatgcagtatacacatcggttctcaaaaaaaaaaaaaaaaaaaaaaaacagtatacacatcatgttcgagaaaatgtacgtagggctacttgctagttgctacagatcagatgcaatgcaagaataccattcgatcagcaaatggcacacgggttggggttctcctccatgctcatgtccctcgcgtagtagtactgtggcggcgcgtacgggtaggccggcggcggcggcgacgncggccggtactggttcatgtacccggcgttgaacatgtacggcggtggcagttggtgcatcggcatcggcatcggtnnnnnnnnnnnnnnnnnnnnnnnnnnnnnnnnnnnnagagtgttcttcactnggacac

SEQ ID NO: 29734 - DNA, 3287 bp, Oryza sativa
  unsure (1)..(3287): unsure at all n locations
cgtggcattgattgatgatacaannnnnnnnnnnnnnnnnnnnnnnnnnnnnnnnnnnnnnnnnncttcttgccatcgccgccatccttcttggcatcgccgcggccctccttcttcttctccggctccttggccgggccgagggactcgatgtaggccggccagaacgccttgcgcagcttgctcaccacgttcaccgggtcaaccgtgccgatcaccgtcatcttgcgcgacgccatgtccatggaaatggcgtcgatgcctgacatgagtgacatgcataaacgaacagcagtcatttctcttgatcgtttctgaacacgggcagaacggttgatggatcgaacacgatgcgtaccggcaagcgtggagacgaccttcatggccttctgcttgtccttgttgtcatggagatccagcttcaccacaatcttctgcagcagaggaacatgtgaaacatcagtgttagtttacgcaccaccatggtatacgaacgctcgcaatgtgtaacggacaaaaacaacatgtatattttactggattcagaagcagagatcattttatcccacagaagctactacagtaatcaggatgagaatccaagagcaaaagacagagcctcaccttcgacatgtccacgaccagccagcgtcagccgtcagcagcacaccacgccggagaagaagaagaagaagaagaatgcaagaacgggagatgatcagaagcagcggcaaggtgatatgacagaagaagagcaaatatcagcagaattagccaaagttaggcgagcgtatcacgcaacgcaacagcagcaaaagcagaggggcgagcgggcaatgcaatgcgacgaaagcgtcctaaatactatcacttgggccaccggcgtagtggtggtcgatggcctgctgcggctgcgactgcgacttgggctacagtagtagtagtagttgttgttgtttcggtggacacgatcggcacgcggacgtgctggtgacggtatacgatcgggtggacacgacccgtcacctgccggtgtacgaaacccacatcgccaaaaatcccaactccccaaggcatcgctaagcagagcatgttcatgtgcaaacatccaacaggggagaacatgagccgggctactattgttgcgacatcaaacaaaacgtctcgattggtatgaaacttcttgttttttgggggataacagattggtatgaaactgaaagagatgagaccaattgcttgacgtctctgctggttagttagctaagactgatttgccttgctcagagactcccagcccaactggagcgactctgctgcccccttgttggaacgttgggtcgtgtcgttttccaacggcaggagcctgaccgaatgtgagctagcagacgagcggatttgcaagacgagaacctgaccgagtgatgaccgtgtgatcggaaaagaaagatggtgacgctggcgctggcgttggaaagacattactaagtcccaaaactcctgttttctcttctgaacagagggtgtgtttagttcacgctaaaattagaagtttagttgaaattagaacgatgtgatgaaaaagttggaagtttatatgtgtagaaaagttttgatgtgatagaaaagttgaaaatttgaagaaaaaatttgaaactaagtaaggccagaacatccattttcacatcaagattcaaggctatagttatacaggtaggatgttgcactccatgaatactggcgggctgctaaaacatatttagctggtccgtatttattttcttttctggaagattgttctttttagaaagcacctccttccttttttaataaatgacgcagtttacttttgtatacaggtttaaccattcgttttatttaaactttttttctaaatacataagatataagcgatgtttagagtacttttagcaataaaataactcacaataaaataaataataataacatatttttttaaataagacaaacgataaaacatacgtactgtgtagtaggtcatatgacccggtttttacagaaagctatcacggcatcattcactgggaaaaccagcttttccaagacacagttcaagacagcacaattctgaaaacagagaaaaaacaccttggtcacaaccaagttttcccaaaccgccggtaagcacgtggttatcgtagttatcgcgcttaccacggggtgcgttaaaagaaaaaccgcggtaaacctccttaaatttaaataaattttaaaaataatttaaattttgataaattttatacggtttgccacaattaccacggttaccgtatggtattccggctccggccacaattgtgactagggtttggaaaaccgtagtcacaacccgaccaccgagcgagaacgaacacctccaaacacaagagttcgctcccaggatgacaaccagcatgacgactacaatcccagtaccacggagaaaaactatttctggaggattgttaagcaggaatgtttatttattggaataagttcactttcggtccctcaatttgtcacccagtttgattttcatcctcagtctagaaaaccggatacaacgcatcccttaacttacaaaaccgtgcagaaaatgtccctcggcagtattatgtccggttttggatgacgtggcgcctacgtggctccctttgactagatcctcgtcccatgtggcattgacgtgtcacttatgtggcaattggatcctggaaaaataattaaaaaccatgggacccacatgtcagctataaaaaaataataagaaaaggtggggcccatgtggtcccacatgtcagcccccttttttttctatccccctctctctcttccctacagaacggcgagcggcggcgcaaaagggggcggtgggcggagcgattgcgggcggcggggccaaacggagtggccgcgtgtggtgggcggaccnccncccctnctccttcccctctcgctcctccttttgcatggtgcttcctcctcccctttttcgccattccctctctttcttcgcttttctggtcccactctcttctatagtccggccccttcctatcaccatttatacctctcctcacaactcatctcaacgtactctcgaatcacttggatggcattttttctctcctcccctaatgcagcctgtacattgttgacgtcctccccatacctgcgtgccgtgcgtcatccttgcagcccttgctctttctatccctccctaacccgttcaccgcgatccacgtcttcctcacctacgcattccg

SEQ ID NO: 29735 - DNA, 9290 bp, Oryza sativa
  unsure (1)..(9290): unsure at all n locations
cgggtgagtaagtaatgnatttgtgagtgtggtggacaaattattttctcctccgtggcggataaatatgctctttnnntaaaataatattttcancnnntnntactnnnccnccnnnncagtggttgaatgcatttgcagacgccgcagncgaccctagagatccccatcgctgaacaacatagcaataacaaaacaacacgatcaacgacgaccctcacatgatcctgaaacagatgcaccatctcgttctcgtactggtcgaattgcgtgacgagctcgtctcggagaggagagacgatgcggaggaggccgtcgtcgacacgtgctccgacccgccatcgtctaactcgagactgagcaccgtcaccgccggccgcttgtgcagctgcgcgaggctcactaccttgtgccccttgcccctgcgcctgcggctgcaacgacacttctgcatgcggcgccaccatgcccgccgcctctgcctgtctcagccgcttcctctagttgcccccatctgcaagcaagggggaagaaaaagaaggggaacgaattgatcaaggggcgcgccaagtgtgtgagcctgtgagagggaagaggagttggacggccggaggtaggagaaagttgcgggcagcgcgagcgaactggtcatctctctcactgtttctttttctctcacctcaccagcagcaaagcagcgcgcggcggagacgggagacgggcggcgcgcggcggccggcgaggtgggcggggagggaggaggcagggaagccagaaatggtgccgccgtccctcggccgagctcctccgcatcggcaccgctgcccgtccgcaccgccgaggccgcgacccgtgccggggccggcgccgccacacggccacgctcgcgccgagccgtcgctcggccgagctcctccgcataggcaccgttgtccggccgcactgccgccgcgtgccgctgcctctccgtcgcctgaagagaggagaggagaggagagagagatgaatatagggagatggggagagaggaggaataaaagaagaggtgagttggactgactgtgggtcccaccacttttttttattattttctgtgtgagacttacacgtgggtcttacgggttttattatttttccggatcgaattgccacgtaatcgccacgttaatgccacgtcaaatgaagaccgagttaaattagccacgtaggcgccacgtcagctaaaaccgctttcaaaaccaccgaatgaactaatctgcaccggttttgatagttgagggacccgttgtgtctggttttccggatgagggacggaaatcggattcattgacaagttaagggacctcagatgaacttattccttatttattccacttagggcctttgtaagtggatataatgggcttgttagtatttcaggcccaattttcacaaggcagatgttgggctgctttctgttttttgcgggtatttgggctgtttctaccaatttatgctagatgggctgagaaatgatatgtagtactgggccaagaatcagttgggctgagttaagatcagtgtttggctagacttctctggatatgaccctagtttggcccattgccttcgccggcgctgataccatcatttgagtccggtcgtaatgctccatgcctgatacccaggtagacatgagccgtcagccatgaagccaatcaagacatcattgagattccacaccatttgtccatcacaacgatcgaagacaactattcttgtttccaatcaatcaccccaggatgcatctgatacaggagttgccaccttttatcaggagacaacatgtttgatcgagtaccaagtgcctgtgctagagtcaaaactcaaaaaggcaggacatgccaatttaaaaagaatgcgatttatttatttatttattttttgcagaataggccagcagtctaatgaagcatttttttcgttttgatgtatgccacattaccatcatctaatgatcagtatctctaaagaagacacacttgtctgttacacctgctgtttggtgttcctactgcatcaattacctcctgacagtctgattcacttcactagttcaatctcggttagctgcagggacagcaagcatgtaagtttggtggccttctgttgaggacatgatcatgatcatgagcagcagagcacggggagcactttgcctagcgtggccggaatgtattaccagcagaagatgcatgtgacaagcaagcaaacaaacgtccaggcccagcacagtgtttcttccaaggcatctctcctcctctgcactgtactgtactctgtagtgtaatcttgctgtttgcagtagggtctctgaccttgaaaggaaatctgttaattaggcccatccaaatctcccgtcacttcgctttgacatcccttggattttcctctgtctcgtgtcatctgctcttttgttctattcgctgggatttagttgcgcaaatcgcgcgcaagcttgggaaatggtatgttagtttttcatttgtctgatgtgttctttgccctgtttctgacgtagcagtacaaccttgcgtgcgttttgtaataacttcccttgcaaatagagttatgcaaaatctgaaagcatcagtacatctgtacacgaacagaatggtaagcgtataagtctgaaacaaataggagtagtaaccgattaactgaacggtcagaaatagtattgagctatactttgtaagtcaatgttgttttcaccctggattgacccaagattaccgctggtaaatcgaccagaatctgacactgacctcctaacaacggatagcgtgatactaattttttggttaatgacttggaattataaatgtgtctgtagttgagtaattgctgctactgcatcagcatgtctgaaattcacctagctggctcttgttaagcccaggctttaagaagtctgtccccctagctccccactatagctggtgtagctagtccacaacaaacagcgcacaagctcacttgctctcaacccaaggacatgaaagcgacgacacgtcgcggcatggccgatcagggcctaccatcgaagaagaagaagaagaagggttcgagcgcagcggccgcgcgcggcttcatgtgcggctgcggcggcgccaagtcggtgtccgtcgtgtcccggctctccgccgccggcaatatctcgcccgccacgaccacgccaccgacgatgacgtcaagtgctaccgcgacgtcggcgaagacgacgagggtgaccgtgcccacgcccgcgccgaacaccgtgcacgacgcggatggcacgccgagcgtgggcacgctcctgctgcagctgcgcgagctggagcgcggcgtgcgcgcgctgggcgtccgggaagaccgcgggatcaggccggcgacgccgccgccgccgcggcacaggaggagcgcgagcgatgcatcgtcaggcggcaggcggcggcgcgggcggcttgaagaggagagcgtgccggtggtgacggagtcggacgacccgctgggcgacttccggcggtcgatggcgcagatgatcgtggagaacgagatcacggccacccccgagctgcgggagctgctgcatcgcttcctctcgctcaactcgtcgcgccaccaccacctcatcctccgcgccttcgccgacgtctgtgaggagctcttcgccggcgccggcgaacacaaccaccaccgccctcgccgccggccaacgaaacctctcccgtacagcgccactaccaactagctaatgtacgtcttgtccacgcatgctgcatgcagtacagttgcaccttgcacgcttgcacgcacgcatgcacgcactgcgctgacacgttaactacagttgcagtataaatccacgtcctcgggattcgctgcatgtgtacgtgtcattaaatacgtttaagagtacattattgtcactgcaatttgatggagattaggccgtgaagtgcgggaggctgctcgttgatagcgagccaaagcacaaagaaaacgagctagaaagcttagcctaccaagtaccaaccgaacctttttcttttggctaatttggtggatggagagagtggttgatagaaactgcgtcggtgcgcgagacggcgccggcggatcggtgaaacatcgaattcccagtgtatttgccggcgatctcaaggaacgtgggctcatctgacgtgcgccgttgcgtgcgtcagtgtcggccgcgatgtctttgcagctttgctggttttacggatgtcatggcggcgtcgtggcccctgtcgcggcgtgtctcccggcggccggcgacaggtcaattggcgtccgatgcatgtgtccaaaggctccaattgaccaaactgattggaagttggggagaggctaggttgttagctgcagattcattttatcatgcacaatcacctggagtaggtggtacctgcgagaaagttaagtactatggtcatattcttcctgtcccaaaaaaaattgctcatattctgaaacagccgttcgaagtttcgaatcaatacaacacatcaagattgtttgtcttgtacaggtttgaaatgctattattctgggagtttactgcttgcttgcttcgcagtttgatttcagatgaaaccaaccacactagaatactcaggcccaattatggcccataacattgtaagactatatctgctgggcctctgaaattttctcttatcgggcctcatccgaaaaggcctcttaagaaataatcatggtttaagagaagaaccgattacgctaatacgctttgcagttatcaaaagggaattcctaacccgccatctccatcaacggcttgaaatcgtgggaacccaatccctcgccgtgcattagcattctatctcatcagcaatggccaccatgccgctaaccttctccccgcctcgcctcctccaccgccaccgccgccgcgaagccaagccccaacgccgctccgccacccgagtctccctcctccctcgacggggagcggcctcggcgcggcggccgctgtactgcgcccccggtggcggcggcgaagtctccgcccctccagccaccgagcagcaggagcaagcggcgaaggaggaggaggaggagtacacgctcctcgccatcaccggtagcgacttcaacgaggtcatcatgatcatcgactcgcccgccacccgctacctcctcctcgacaccaaccgtacgtattgcgctgcacactgcgatttcttcctccgcctcgaaattggattcgtttggtgagttcgtgctcccgattggttgtatcgtgcagggaatgttcacagcgttctccccaagaccggagtctggaccaactcatattgggtatagaactgtaatcctttgcttctaatctttatagcgtagtttagattgcatgtgaggtgtttgctgttttgtttcgcctgcttttgctgaatccgttgagccggcgagcgcgtcgtgccgtcgtgcgccgtgacccggggcgtatgggatagcattcaccactaaccggtcacggagcgcaccatgggatcgtggccctaaccttgttgtaattgtcgttcaaaacggagggaagaaaaccgaaaagctgcagattaactagcaaagcacgaaaacctttgtctaccaaggttcatgcctacaagctgttcgtccagtgttcccaaattgatccagttgaaagtttgagttgagtgtgagatttgagagcgatttcaatcgggagtgctgacagggtatgcatttatcgtatgagtaatctgaactgatcgagttgaatttagattactaatgtgccattttgacatacaagcataatattgttgagcgccttgtatgcattaggaatttgacgctctatcccgtcaactatccatgataaacaagtttttgagaaggacagtaataggctcctggtagttggatagcagtttagtaccaaaaaaaaaaaaagactataatatgctcatataggtacttgttatctatgtgatgggttggtttctttgcaaaacgcatcctatttctacgccaactattctgtttgaaatgatgtttttcatcctttaaaaatggctgctcaatgtaaatgcttaatacggtgtgcttttcctattgtacaggatgagttcgtgagcctaccagctgttgttccacgtggtcctgttgctcttctaggattggtaaatcacttggtgcatgattcacctattatcttgttcatcatacttcattgttctgcataactactatgcataaaaagcaaaattcctgccatgcttagagggtttgggaaggcctgaatggatgtcttaccgaccaattgcaattagattatcagcacacatcacaattccagcatacatccacaagcattacggaggcttttcatttgaacaactcacttctatttttttcacgggcaacttacctcttcacacgcttgtggatattcaatgcacattatgattcctgtcttttcccctgtttctttttcagggtgctgggactgcagcacatctgatgctaaaattttatccttggttgcaacttgttggatgggagattgatcctaaggtgaacactcttttcattgttctctctctttttaattgtttggtgaccacaggctcacagatggtagtgaaatattttcacattgttacttattgtgttgcaaaaagaaattcagtaatatattcctagttaaggctgttaagctagctcaagcacctctttgcattatttttctttagacttatcccttgtgctccacgcatccattttcatatgcccatttcttactctcagtttgcattactgaatgacagataattgaactgtcaagggattattttggtttatctgatttagaaaaggcaacagaatcaggtggttcactttctgtgcgcattggtgatgcactttctccgtcagctacaattgaaggagggtttgctggtgagtgcttactacctgatgcaaatggaatacatgctttactctcttgttactatttaattatacaacgctgacaattgaaggagggtttgctggtgagtgcttactacctgatgcaaatggaatacatgctttactctcttgttactatttaattatacaacgctcttggatgatgcatttttggagtatgctagttggattatctgtagtatattggaaagcatgtactgttagattaatgtttttctttttgagttttcaaaggctttgaaagttttctggcctaaaaaataagagtttggaggaagagacatctctccaaacaatttttaagaagaaattgtgagcgtgttggagattgaacaaaaaacgtcggggttgaaaccacacactccttgcaacttcaccatcaagtgcatctcaaagttttctggcctaacaacatctagttaatgtgtacaggtattgttgttgatttgtttgctgatgggaagatcatacctcagctacaagaagtaaatttcctctgcatctctttctattcattttttaccagtctatatgctacgttggttgcatcagatttcatgcttttgagcatgtatttcttattccttggatcagttgaatgcatggtcaagcatggatgaaattacttgatatctacatatcttgaagtttgtaataaattttaatttatctcatgatgtgttgatttattacccttagtttggctggcttgctatagtgatatgtgaatttgtcgacaaaaaatcttatgcatcccaatatcaatagagggtgctttggatacaccaacaaaagtaagctacttgtgtgaccttagtgttcttaacaaaaaaccttacgtgaccttagtgtcttcggcatccatggattactctcctttgcgacccttcctttcaagcctaattgaccaaatggctgatatgattctctgcaattgaaataatttgaacaatttttcaaaacatgtaaaagtgcagctgagagaaaattcctggacgctacttttgtatatctatattcttttaactttttggaacacttccacagttttttattttctactggatttaatttcaacattgttacaggttgaaacctggttggaaatcgcgaaaaagctaatgccagatggacggatcattgttaactgtggtggagctgatgctgctgtatctcttgctaatgatacgggcctttcgtcctgggttcagaattccacaattaaggcactctgtgctgcatttccggggcaggtaagattatacatgaaccacagaaatatccatattttgactgctgtagttgtatagtttctagtactagatgatggaaaagtttaaaacaataaaatatggaatggtaattgtttaactgttttgggttgctacgtatacgagcaatgccatgtcactgttgttagaatgcccacctgacgtaaacctgaattacagctcaactggaagagactatcagagaaagagagtgtaaattacgttgcattgacgggtcctcttccaaacttggatgagtggtctacctcagttcctagtgagatgagcacaaaagtgaaacagtgggtaccttgcgaacttgcttgaggttgagaatgaacaatttcttctagatgtaccctatttgcttcaacaacttgtgtgccccctctgttgatggctctctttctggtgagtagtagctggtagctgcagacagtattatgtaccgttaacgtaacaacactcgattattagctctaggggtactatgtgcctgtctgattgattaaaaaactttaataccatgctgacttggttatttgttcaaagtgtgttttaggcatatgcctctgatgcaacactgaaatgttcaaggaatagaagtgcaaggtaattgagccacactcaaattttgtttctgaagttaagtagcatagcgaagtgaagcataagttgaactcagtgaatgtgcgaatgttggaaggttgtcaagacaaacaagcagcacgaagttcagaacatactacacgacagttttgtcatctcttactgttaatattcatgcatttttgtttgaaggaaaaatccatgtcagcttcgtaaagtgacaaattggtttgtctgaacagctgtccagtagctttcactgacaaatactgttcgttagtagctttcactgatagatgcatggatggtacttcccccttcatgagggctctgaaggggatcctctagagtcggcctgcaggcatgcannnnnnnnaatctatccgc

SEQ ID NO: 29736 - DNA, 4252 bp, Oryza sativa
  unsure (1)..(4252): unsure at all n locations
tccaccggaggaggtaacatgcctccaatcccggttgcgctctgcaaaacttttttctgttcaagattggattgtgacgatatatcacatgcctggtaaatgttcagggtattaagcgcatgcactataatgaatgatgatgctcgatggcatgatcttgttgtgctaacttgttgggttacttgatggaaatcatggaactctatgtctctatcttttaactcttcacttgagttcagtccggcatttttgttacaatgtacacaggcggcgggcagctgtctatccttggcagctaaatgatgtgaggcaatctttctctcggggtgtgtttaatacacgttaaaattgaaagtttgattgaaattaaaatgatgtgacggaaaagttaaaagtttgtgtgtataagaacgttttgatgtgatgaaaaagttggaagtttaaagaaaaaattgggaactaaaccaggctttgcttggagggaagaaaagcagagagtgctttacttggtacccaaaactccatgattaagtacgaagaaacaaacttctcttattttgatggatatgccaactgatcttttctggactttagctactagatcttcataaatattgccatgctaaataatgttttcgaatcatcacaatgaattaaagaaataattcaagatttgtttgcatctgctcagtcactggcagtggcgcgagagacacaagcacaagctgcaaacaattaacaatgcgaatctgacggtttgcaacgcaccgttccctcgtgagctggtgagtggtggcccccgtgcggcccaccactctgacaagcgtagtagcagaagagcatttcttccctcttattcctcttgcctttgcacgggacaaaaagcccccctcggcccggagacgggaggcccgcaccaaaacccgggccacgcgacgctcccgatccgagcgccgagagggaggcgcagggatggcccgctcggcggcctacggcggcggcggcgggggccagccgctggtggtgttactgaactgcctcgacgacccgtcgatggagcaagaggggctggccggcgtggcgggggtggagcacgttcccctcttcggcgtcgccttccggcgcgtggaggcggccgcggccgtgctcctggcctcgctcggctttctcccgcgggccgcgcaacggcgccttcccccgtggcagcttctgctctgcctcgggtcgcccgaccgcgccgcggacgccggcctcgtcggggagctgggcctccgcctggtccacgttgacgccaaccgagccgaggaggtggccgacacccgcatggcgctcttcctcgggctgctccgccggacccacctgctctcgcgccacgccttgtcgggcccggccgctgtcgccgctgggtggctaggctccgtccagccgatgtgtcgcggcatgaggcgctgccgcggcctcgtgctcggcatcattggtcgatccgccgccgcccgctgcctcgccactcgcagcctcgccttccggatggacgtcctctacttcgatccgcgccattcggtactggatctacgacttgctacgctcctgtagtttcctcttcttactactgttctacgtatacttgcacagctctaaaactctggatcttaatccgcgcattgttgttgtggtaatttcatttggtcatacacctagcaaccgactggaacagtttcacccccaattctagaatgagttgttttctgattagtaatgttctgctatgaacaaacttctttgaacatattaagttggaataggtgattgaacagttagacagtccaaagatttggaatgttatgacttaaatgatctcactgcttctgcctatgatgagacgtccctttgtaatgttgtgagctgaatgatctcattccctgtattttagcaaaattcttcagctttctgaatgagacaactatatattctctgtaagctgtggtacgaatgctagctgttggataaagaagtaagaacaatactccctccattccaaaatataagcatttctagggttttagcaaagattaagtgaatagaaaagaaactatgatgccccctcatagatgaggtatggttggggccttgggggtaatatgggaagcttttttttttttggtgtgtgtgtgttcggggggggggggggggtgatgggacaagtagtacaccagaagggctatattttggtacaaatttaaaatgctagaagtgcttatatttcggaacgcagggagtagtaacttatgctaaaatgcaaaggaggggatgacattgtgacaagaacatcttgatgggtatatcttatctggttctaacctattacccccccccccccccaaagttttcatgggctattaactttctgttacattaagaaatctccccaaattcatgttcagttcacattatttatgtccaaagttcatgatatatatcttgtcgcacttgtatgcaattacctactgattttaagaaatgctaggcggtaaagtattattttgactattctaactgaattagcatgtctactgaaggctaatggaaaagcaaagcggccttccattgtatttccttctgccgccaggagaatggatactctcaatgatttgttggcagcaagtgaccttgtttcactgcactgcacattaacaaatgacacgatgcatatacttaatgctgactgtctgcagcatgtaaaacctggtaaggtttatcttcaacccctttctttcttctgctttatgcattatatattccgaaataatgcttatcatgcctttagttcagccgtaaaacacagtataattttcttgtttatctcacaggagcattcatagtaaatactggaagttgccaacttatagatgattgtgcactcaaacagctattgattgatggtacaatagctggttgtgcattggatggtgctgaaggtccacaatggatggaagcgtgggtacgtccatcagcttttgatgtgtttttttgttgataagtggccatttgcgatggatgaaattcatctaagatcaaaacatcaccatttagaatgctctgctcttccggatgttgaaaaggaatctctaggaaaaacatatggaaaatgagtaaatatttaatttagtttagcatcaagtatttcaagttccctgcactccacctgttgagctcttactattttagggataactttgaactctcttgattctgcatattgtacagaagagcaacaaccaatatgctagtagtagaggacaaacaactgtgcccttttctgcattgctatggtggtgccacttgttcatcatccatcttataaaaaaagaacttgttgttcagcaaaatgatggatactatttatttgacataggtaagggagatgccaaatgttttaattcttcctcgaagtgcagactacagtgaagaagtgtggatggaaataagagagaaagcaatcacgatattgcagtcctttttctttgatggtgctgttccaagtagtgcaatatctgatgaagatgaggaaattagcgaagctggaaatgaagatgatcagctagaagaaaaggttagcagttcacaagttttttattctgagcagcagacagatgaaagtcagttaaaaatggagtacgaaaagaggagagccatatcccagcataaagagcctcaagcatctgctagatctcaacatattgtcccccgatcagaaggaaggcgcagccgttctggaaagaaagggaaaaagagacctgctcgccgcagatctcaacagaaaacagatgaattatctgctgtagagagtggcagtaattattcctcacgcagagatgatgatactgcaatgagtggaagggaccaggtattgagttccagttcacgatttgcgtctcctgaggactcaaaatacaagcagaaatctcctgctgaatccccaatggaaataacttctgagacgaagttgcctacagttctcagaaggaaatatcctgatacactcaaagatggttttgttgtagccttgagaacaaaagataattcagggttccatgttgcaagacagagacttgctggtggtggtggttggatccttgatatcgtgtcaaatgctacaaacagggnnnnnnnnnnnnnnnnnnnnnnnnnnnnnnnnnnnnnnnnnnnnnnnnnnnnnnnnnnnnnnnnnnnnnnnnncgttgcatgcaaggcg

SEQ ID NO: 29737 - DNA, 13965 bp, Oryza sativa
  unsure (1)..(13965): unsure at all n locations
agcgtgattgagatcttcatnnnnnnnnnnnnnnnnnnnnnnnnnnnnnnnnnnntgacgcatatctggcactggcacttctactgacccaatttgcctttcaggataccatgggattacgttccttcgtcgctggtggtaaactattgcaggtatcatctctccttttctggtagctgctgattactgcttaaaaaaatattaaggtctgctatcatgttttcctttgaaattaatgacacttctagccaagcgaacttatgaatctgttcttttctattttggggttttagcagatttatcgaaacttagcaaaaagctcatgatcgaatagtcatttaggcctcaatcttagctttgtaaggtcatctattttactttccatagttaatctgatgcctctgttccttcgacttgtttcatcacttgtccgtgcctctatttaatgcttaggttttatacctctacttgtacaagttgcactgtacaagcagatacacccaaccaaaagtaataagtttgattgctcaaatgcgcaacatttatagggctactagtgcaacttttccatttccagtagtaaaatgggttgagaaacagaagtgttttgatttcttatcgacacccagggttgctaatgttctaacatttaacttttttaaatgtgctgaagattaataggaggatggagtttgtgtttgcaagtcatacatttgatgtttgggagagctggatgctggaggggtccttgttggagggttgcaaacttatcaattgcagaaattcatcggtatgaacttttccatttgcttctaaaaagaggatttctattatttcatgcatctcctccccccttgccccctcttcaataacgttgtttaagtaggttactgctctttttctgtataaaacagtagcacactatgcgtccaaccacgaaatgaaacagtcacattgtgtcctatcccatgtgcaagcacttaagctaatgtactcagcttcctactgtttgcatgttctgtaggctgtattggacgtctgtatcgagatccttgcagctgcgagtgaagaagatggagttactcggtggctagattaggccgctggggacagaaaaatggactgactcgttcttgttgcttggtttggtttgttgccaactctctttttctgcctaaagtattcaattttcgcttttgtagtacaggaaccttgtgggcacagagtgtatgattgtacgtgttgtcttgctaaacctgaccttcaacactgtagtaagttttgatttttatccttgcacgtttgatgctcgtattccccatggggaagccttcgactcttcgacggcagtgtgaactgctgttagccattgtcctttgcagatttcctcgtgtcgaagctccctagaatccagggagtattatgcaatgtttttctttcttgggaatccggatgcgcacacgtgatcggtatgtgtaatagcggaagcacacgtcaccaagacattttggtctggtcctttttaaattttattttataaataaacccctagaaaaaaatatttcataaatagtcttggcaacaggacaactggcaccaagatccaatgttttgacactgacacccttgctctctagcagccgagatgtagaggagtcggcgcttgaggacctaggctgcgtttagtttcaccttaaaattgaaagtttgaagaaattgaaatgattcgatagaaaagttaaaagtttaaatgtataggaaagttcgatgtgacggaaaaagttgaaagtttaaaaaaaaaagttaaaatctaaaccgagccctagtttattttataaatacggagtaggtccttggtgctaatattcttggtaccgatcccatttgcatcattgactatttgactttgcttttacagagggctatggtagggtgccagttattattggcgtcgaggcattgaactttcgtgttaatgaactgatgttgaggaaaaagatctattcttaaaataggatttttttaaatctatttatataaaaaaaatcaacatccagttctgatatccctccctgatgttattggtaatccacaggcgccgggcaaacaccggcaacctgaaatctaccaaccactggaggaaaattctgccgtgaccccatgtccccatcgcaggcaacaacactacgaacgcacagcaaacaacctatcttgcccggaaccggagctgaacggaagagaggtaggagtacacctagtagtcaagttccattcatctacatccaagcgcggtgccgtgcagccgtactactcgtcctccccggctccccgcgcttgtcaccaagggagaaaagaaatgttgtactatctgcagaagtcgtagcctatttttaatccaacattacgcaattgcgagcattatctgactttgtagtttgtaccgaaccgcttgcacgtactggtggctggcaaaaaataattctatctcgctgtcctctctgaccggattaatggaggctgtgtttatgtctagttcaacgtaaagtttagattttggttaaaattaaagatgatgtgactaagaaattgtgtatatgacatattgatgtgatgaaaaaggagtatctaaattttaaatctaaacacgggtgctgtcatgtcatgcctgtctcgtcaaaacgaaatctctcgaattgaaaacaagccatgtgatacgcacgcgagatagggaaccggtcgagcaactgtccttttctagttaaagattactagattttatgtccattttcgttagcacatactctctcctccttgtagctgtcgaattacgtctaacgttcgattgtttgttttattttaaattttttttaattagtatttacattgatattagatgataaaacatgtataatattttacacgtgatttatttttctaatatttttataaattttttaaataagatgaatgatcaaatattggatacagaggtccacagcacacttaaaatgagatgtatggagtaactactaaatgatgtgattggtgcgaaatttttctacggaatttgctttaaaatatcaaatatctatttgtcaaatttataatgattaaatcataattagtcgtatgttgatgatttttttttcattttacatgcgttaacttaatcttccagtctcatcagtttcatcaattcaaacataacatagtatatcgtggtcgcgacaaaagatatgagcaagttggatttgtggtgtttgtgcaacgaatcagcaaaatcttacagccagatcgttggaaaaggtcgccacggaagaagcagggagagtaccatcagcaggacgagctcacgagaacgagtttttcgtcctgtctctccaacaaccaaagcgtagaaacatcgcgatttccacgtgcgcaataattcatcctataataatcttcttcttttttggaataatccgatgatagtgtaggatgtatggcacatatgctgcatagtcctataagagcaggtacaatagcaggctacaagccagctataaacatattttaaagagataaaagaagagagagaagagcagcgggctacatatagtcagctgcagcacggatttcaagacgtaatatgtgtatgactagtgagactaggtattaatagtatagtaagcaactattgtatgaattggctattgcgttggttatagatgatttggagctagtagtggactatactattaaacttgctctaaagcactcatcgactgcaacctactcccaaacatcaaattacacggtttttcttataagataaaagtatcaaagtgattgtaccaaatgcattttggagaggcattaaattacaccatgttgtaattctatactaagggcccacgaaggattggtaaaaaaaataatcataggaataattttcttaggatttttcttcctatataccctatgatttttttaaaaaaaaatggatatatccggcctctatatataaatcagatatacacagtaacacagctattgatggaacatgccagttttgcgagcgcttaggatccaacctggatgggctacgtgcacgacggtaatgctatccaaccaatcaacatttagttcccatatcctttgatttataggaaaaggacgttaaactttgtatagtattacattcctataatcaattctaaagagaattaagtgagaggttagatatcttagaaccttgtctgtgttttctactccatattataggattaaagaaacacgctacttcaatttatatgtttttcctatcctttatttctttattcctataatacgttttaaagggggttaaccatttaaggaaatagttgcctaataaaaagagttagtacggcagtagatcagatattcagatactgtagtttcaaactttcaataactgtagtacagattattattattcctgcatactccctccgtccaaaaaaaaggcaaaccgcgggtttgcgtgccaacgtttgactgttcgtcttatatgaaatttttttataattagtattttcattgttgttagatgataaaacatgatgaatactttatgcgtgacttatctttttaattttttttcataattttttcaaataagacggacggtcaaacattggacacggaaacgagggtttgtctttttttgggacggagggagtactcatcctatgcaacaaggctgcgtttagttccgtccaaagtttggattttgattgaaattggagatgatgtgactgaaaagttgtgtgtgtatgacatgttgatgtgatggaattttgcaaactttagatccaaacacacccaaaagtggaaaagaaaagtgaggttggtggcgagcagatctgtttcagtttcgcagccatccctacaaaatccgctcgctcgcaggtctccgccttacaccaacacacggaacactgggctggcttctctcttcctctgaagtctgaaccccacccccaacccgcacgaatccactcgcccctcgcgtcgcctcgccgcaccaatggcggcggcgtcgatcaagctcttcttcttcgccaagcccctcgcccccgcgccggtctcccacctcctccccctccgcgcgcaccacgcgcggccgctccccgcgcgcctcccgccgccgccccgcgttgccgtgcaacacaccgccgcgcgggcctccgatgcctccccccgcaccggcttctttgacaaggtgcgccccgcaatgtctcgtcgcttctccccctcttcgtcctcatctggtccggggctcgtctcagccgtttgtttgtttgtttgtttgtttgtttgttgtggtggtggtgacgtcaggtgctggagacgctgatcggcggtgaccacttctcggagaaggaggcggaggcgacgctgcggctgttgctggaggagaagaacgaggcgcgcatcgccgccttcctcgtgctcctcagggccaagggcgagacctacgaagaggtgggtgcgccgcctcagccgcggcgctaattttgatttcgttctggtccagagatgggagtgagagatttctccgccttgttctcagatcgtggggttggcgaaggcgatgataggctgctgcgtccgggtcgacgggctcgatgacgccgtcgacattgtcggcaccggcggggacggcgcggacaccgtcaacatctccaccggctccaccatcctcgccgccgcggcgggtgccaaagtcgccaaggtactggctcctcgcccctttcatttgtttatgggagattatacatgcgcatgccattttcccttcagtttgtgctccaattggatttaggtagtagtactactagtggtgatgcaataatgtgttctcgcttgcgttttgtgcagcaagggagcagagctagctcgtcggcctgcggcagcgccgatgtgctggaggcgtttggtgtcaacatcgagttgggacccgaggtagttgcctttgcctgattgaccactgattgctttctgcctggtcctgtgagctagtattgcctttaggatcttatattcatgcatttatattgtactcctgtactctgtagcactagtaggagcactattcatgcttcatggcaactggcaagtgatattacctcgtgaatacctctaaaatatgatgtgggttgcaggcctagatcacccgtgtggttttaacctttagtttggtgaagtaatttctgtgtttgactttttttttctctgtcaagtacataatcgtacatatgaaatggaagctgaaacagcatggtccctttgcaagccacccaaagaaaagaaggctatgaagagtagtcgaagaccatagctccctttcgtctaaagacacgtgtgatgtttacagcatgtgtatttttttttctgggaataaaaggttaggctacaaaagcaggccacctgcatctcagtggatcacaaagttccagtacaagtggtttggtctgttcatgagatacataaacagagggagagattctacattagaactacaacaccagtatccatacccataatacataacccaattcaaacctttgctccaacactgagggtgctgactgcagagctgcacatccaccaagctgctggtagcggaactagaaaattttgtagagcaggccatgcagtaggaattatataagcatgttccaaatgatagatctatactcattctagtgctaaattgtgtaccgcgtaaaatagtacgatacttggggataggggtagccacggcccctgccagtcctctgtctctctgccactgcaagcagatatagcttactgaaaatttgtgctgaccactgaggttggtacctccaaccttcatctgactgaggtgcgaagcacgccccatttgtctagttgacatctcagatctactacatagatgtgtagatcagcctctttatggttctatcatttgtttaggtttgcttatcggtgtaaaaaggcacaattgaattgttggattccagtaattggattatgaacatcaacatttgaagttactgtgtgcagatacacatagcttgttcttgtagtcacaaactgaggctgaatggtgttacatatttagactcgtctctagatatttgtggacaaagggagtagttaggaattctagatgtagtcgctccatttatttataatgtggctgtttcttctaagcacagaaaggctggttgcccctggcttttcaaattttacattattcactattatatgcatcttatggcatcagaaacctggtggggtttatatatattattgtattttcttttttcagggtattaaacgatgtgtcaatgaggtgggtgttggattcatgatgtctgcaaactatcatccagcaatgaaaatcgtgaaacctgtgaggaagaagctgaaaataaagacagttttcaatatccttggtcctctcttaaatccagcaagggtgccttatgctgttattggtgtttaccacgagaacatagtaagttccttattcatttcttcttttcttctagtaaatcatcaaagcataaatagtatgatatgcaagaaaagattttttaaagtgacaatttaatatttcgttgacccacatgatcgtcatcatcaccactattgtcttggttttatacttaaagtaggtgtagggcagtttttaagttgacaaatgatgcgagtttatattaaagaccttaaaggcaagcatcagacatctactgttgagctgttgaaccgatgttgctcaattcagagttcagatataagattctccttttccaatttttagtgaacttcatctttagcaaatattgtgttacttgacttgcagatacatggttataaagctttttttcttgagatgtcagccccgctaaaagctatattgcagttgctggttttccatctagtgttcattgttcatccctaatgaacatattttgttttactcaggttaccaagatggctaaggcagctcagaaatttggaatgaagagagcattggttgtccattcgaagggtttggatgaaataagcccacttggtacggacacatactaatgtatccatttcaccactgtgctacactgctgctaaaattccatgattcctcaaaaaaataccttggaatattaaaactaagtgttctgcatttaactgagaatttcttttatcaatgctgtagggcctggatatatccttgatgtcacaccaagaaagattgaaaaaatgctcttcgatccatgtacgagtttttttttctatgtttttctcagaatttttagaaacagagactgtttattggactcacttgtgtaatttgagcgagtcttcgagtttagtctcatcaattgcatgttttatgcacattatacttatttctaattatgcatgctaacttctgaaatacattatgacgatatgatacactttttttttagtctcactttttaaaattatgttacaatccagtggattttggtataccccgctgcacgctggaagatctaaaaggaggtgatccagcgttcaacgcaaaagttctccaggatgttcttgctggtcaaagaggttcaattgctgatgctctcgtaagttaatcattacagttatcctctctttctagttacttctactttctaccttctaaacttcttgtaatgcatttttttacaatgaactcagaattctgcagtggttagcctatctttaacatacgaatatttcataggaagttcttcaatagatgggggtttgcagtgcgccctgtcataaacagcttaccgatccttgtcatgataggatttaattttgtttagattttttttcacaaatcatatatgacacttaattattaccttgcacacgttgagttgctttgctatgcaaaacattaatcaatctttttttcttcataggtgctgaatgctgcagcatctcttcttgtcagtggtaaagtaaatactttgcatgatggtgtagcgttagcacaggaaacacaacgctccggggaggccatcaacacacttgaatcctggataaagatttccaatgtaagtacttctgataattaatatttgcaaagcacattttgtctgtcagctaaatatgaatctgacgccctccggaaaattgttgatacagagttgctgagactgatgttggttggccaacagaattcctcgataagatcctcaccaaagaaaaaaaagggattcttcaataagacctgaggaatgatggcaaataaggattattttaggttatctttgtccatagtgacatatttatgtatgttcgttccaagtgccatctggggtgagattataaggttatggttgggattgtagcttcttttctagtctatttagagatagatgactcttgtttagagatcttggtagtgcccgttacattatgtgctagtgcaaggcgtggaaggaaaacggagctatacagtatatctgttcaatgttgcatctcaattttgtaaaatgcttcagaaacaatacatatgattcatctcgactgcctcccattataaactgaacttgagttcacaacgataccctggatgtgcacgcaattatggaatcatttccaatatgcctatcttcagtttttcacacacaatcagttcacaagcacaaaatggacactcataagtatgtacaaaaccatacattagtattgatacacccagtggtggcaggcagataagtctgcgctagctatctaagaccaaaacgatggacgctagcagcagcattcagattttctttggggaagaagcgttgtgtttcgccgccttgaggatcgcggcccggatggcggactcgttgccgtgatctccccggctcgacttgcgccaccgccgatcccacagcagcgaccagcaccgcacggtctcgccatctctctccctgcatcatcgtcatcatcagttcgtttcacgtcgcgattagcaagtcgatctcagaattgccggcattaaaccagacgctgcgcacgctatctggtccacgaattcagtgagacaaggacgcgtccccttgtcccgactcatgtggttgcgtggtaaccatctatccgtttgtacgacactcgcttcccttgctttctccatcggagtaggtcgtcgcatttacagtaactcgtactactcgtgtaaaacagtaatctgtagcatgtactactggatataccaaacagtaacaggtggaatgatgtggggaacgtacaagcagtcaagcaggttgatcttcgttttacagattgcgcggatcagcaggcggcatctagagtaggaccatttctatgtagactcgttttactttacctttggaattgccgtgccggctttgatgcttatacgttttgcttttgttgactgtctatgtacgggtttgattggtcctatgctgtgggagtactatattatcgctagctgaataaaaacgaatttactaaatagtacaatatttgtgttgaaaaagttggttcttctaacgaatttctgtgtgttcttcgtgatctagtactaattaatctccttaatttgcaatcaaactgatggagaacatagagatggagtgttagttggagtcagaattgattgattacctcttgttgcgatcggagcagacactggcggtccggccgccggagaccgacggcggccggccggggccagtggtgcgcggcgcggtgaagctgcgggtgaaggagcgtggcatgtagaagttgagcaggacgccgtcgctgctgctgcggaagctgctgccgcccgcgctgtcccaccgcctcgccgaccccctcctttccggcctccccgccgccgccgccgcctgctgctgctgctccgactgcctgccggacgccgtccgcgccgggcccggctctgccttcccctccgacggcgaaggcgaaggcggcgccacgccgacaccgccggccttctcgacgaggtccgtgagcgagagctcgtactcggactcggggaggtcatgcagcatcccgagcatctcctcccgcctccgcgcgatctcctgcgccctcgccgacagcccggcgtccaccgcctgcgggctcatcccgggcacccacatcccggccgccgccgccgccgccgccggctgctgctgcaactccgagctcgcctggagcatggctactccgagcgaaacgagcggcaaagagtgagaagtagtagcgcgtactggtcccgatataacgatcgagaagaggagagaaaacgggtcgacgacgacgactcgatcgatcgatcgatcggggcgagtggtgagggagacgacgacgcgcgcgcgcgcgcgcgaaggcgtgggagtgggcgtgggcgcgtacgcgacacgacgcgcgcgcggatttgacgaagcgatcgcggttggatacgtagcgttggaatctagaagctcttcttctcttttttgtccttttgtttttccggatggatgatcctgacctcatccatgccttcggttgcacgcattgaatattttgtactttcttcgtttttttaatagatgacgccattaattttttctcatatgtttgaccattcgtcttatttaaaaaaatttatgcaaatgtataagatataaatcacaattaaagtactatgagtgataaaacaactcataacaaaataatttataattatgtaaattttttgaataagacgaatggtcaaacatgtgagaaaaaatcaacggcgtcatctattaaaaaaacggaagtagtatttatttacatgttcgtcctctgttcatatacaacagggtaaaaccgtaaaagtatagaaggagcgaactgcgatcaccgagggtcgtcggatcgagaaccacgtctcggatctgtcacttatatacacactctccgtcctaagaaaaaaaaaagcaacctaggagagatcaccgttatactaggagaggtcacgtctccttctatattgttttttttttacggaaggagcatgtgtctggtacatttttttttaaggttgaagtggatttctctgccctacatttccctttatcttttcaggtaaaactgtccttgatggtccggctgatccactagcttctctcttgatggcccactcgataattatgaggtttgccctttgcaatcttatgatctgatctcattatgtaactttgactttagtcacaacactctgctcaatatcaccaaactagcatcacaaacataagcttgcgccttatcactaatctgaatttctgatacaatatgagaggacttgtacagtgcttaaatggtgtggatagccatcagtgaatgcaccaacatctgcttgctgatcattaaaatgatgggggcatgcatacaagaacagcacaaatgcatactagtgcattccttttacatttttatcttcaagctttcctctgcaatggtaattgcaagctgacaaaaatacatctacagtaggtagtgagacttccatctatagcgatgtccagatgctaagccatacgtatatacaagcatgtaatcaacaaataagcatcaacagtacaagagatatgctgatctgtataattcagtcctaagctcaaaatgtcttaatctgtttatgttgacattttaccatttctcaggaaacgttgtccttagagctctttagctctcaacgccgttttacgaattccttgagacctatgaaggaaacagaagaacaatgagcatggtatgatgtaggccaccaacaactgtttcacattcaaggggaaaatacaacctaaatctttacaggtagatgaaaataagttccttgcaatttaggcgaaataaaatgaaaataaaataatatgtgatgtgatgtgtcacaaatagcctatataacccgcatagacacaaagtgactactcacctgagttgaattaggtgaactacgcgaaggtgcttgagaagcaggcgatctttcaggagaaattattgtcggcaaagtcccaggagactgaggattgtttgaagcaggggaacgtaagatggagccaccatgatggtatgatgacaatggagaagtcataggggtcctcctgagtccttgggaatggggcccattacttggagatatagttggtgataatgatttgcccagaggtagcatgtttattttaatcctgcaaaacaaagaaatgttagttctctcatcatttggaggttctgttaagagtaaaaagtaacagggttcaagccacttacttgttatgtacatcaacatattcatctgtttcatccaagatatcttcctgccaagagaagtttatgccagtttgcatgtataagcgaaaatattttacaaagaacgatacatctatgaaaaatttctagtttcttttctaactattggaaaacactagatgactctaaaaaaatgcaacatcatgctgaattaaacgtgttgctcccataggttggagaacactaaaatctttatacaacaaacaagagtataaatggagaaaaaataatggtgtcctcaaaaaagcatcaggatgtgaaaaatgcaagactttgttttcaaataaaaatataaattaagaacaagctgtatttaagaatatctccaacctgtagcaattgttccataacatcttccattgtgattatccccactgcttcttgatccaatgaatagcttggaagtggaccgctattaaaatcaagaatattgtcccgcttttttctgattcttatataagcgcacctctccattcttttaatgttacttcgacgactttcaacaatgctgacacgagagggtgacacaccttgagggtatttcaatgatccgaccggcaacaaatatttatttctggagaacaagtgatcatcatgcttatggcaagtttgtacatcagcatgggc

SEQ ID NO: 29738 - DNA, 780 bp, Oryza sativa
  unsure (1)..(780): unsure at all n locations
tcttcaaaacccgtgagccgtcaacaaagggtttccatctcctcctcccttctttcccggtccggaaagcaagcctcacggttcagacgncggaaaagcccgcgtcgaccccgcgcagcgcaggcgccatggccgccccggaggcaccctcctgctacgttgggatcgcgcggcagtccgccgccttccgcctcatgaagcaaatggtgcgtgatactacctaattcaaagttttcctcatgcgttggggcatgcagtatgctattgctagacgtaggtttatgttggttaacatcggttgatcctgtcggatatggagtctgaaggagttgctgttgttgttcctgttgaattgtaactagcaacgtttgttaatgctacggagtggaatttgggaactgccgcaaacgagtgaacttggcttggattttggaaaggagttgaaattcacattcttcacgagttatggctgcacatagattgaatttagtgtagttaatatttctaatcgaaccaaatgagtaacgtgaatggaatggtggtttgcactccataaacaagtttatttcgtcagattatactgatttttctgtaatttagatttgttctctttttactgattttaaagtgtagttagcattttttttttcattatgctttaggggtgggaagaaggtgaaggccttggtaaagataagcaannnnnnnnnnnnnnnnnnnnnnnnnnnnnnnnnnnnnnnnnnnnnnnnnnaagtcnggtttgtcagtggattccatccg

SEQ ID NO: 29739 - DNA, 10144 bp, Oryza sativa
  unsure (1)..(10144): unsure at all n locations
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgggtattcgttacaagtcactactcttcttcatccaaaaaatataattaaaaaaatcatctaaacacctgtaagcaaaataaaattatttttaagagcttgttcactttgttgtcaaatcaattttatcaaaatttattatgttttaatgctaccattttttggtaccgttggatatgttcaatttgatgtcttctaaaattttataatgttttttcgagataaaatttttgaaacttctcaattttgttaggatagtattggcaagatcattttaaatttgttaccatactataaatttagtacattcaaagtgaacaatgtctaactccatagacatgtgggccatattctctctccccaagagtcagcttctatgcttaatgcccaatacttttattaggactgctaaaaagatgtctataatgtatagaaaattcacactgtggatgctcttataataaatactcactagtaaggatgcatttatcatgtgtttggtcatagggatatgatgggttgggttggagaaaactagttctttaaagtgtttggatcagggataggtgagatgagatgatcatgattcctgaaaagtaatatttccttcaaataaaaggctccatcccttaaataaaaggacggatcaatctaactcactttctctcttattggcatccgggacacaccctccaaacccttaaaaatagtaccattccaacccttgtggcaaacatatactcccaatcaaacacaagccatcaggcccgccagtccgcaacggcatcatggatggacataagatcgaggaagaagcaaccacgaggaaaagaaaacgaaggattcgccacccacgctagcaattttcttctgtcaattcctttcaccattttcaggctgaattttgtcaggcttccagcccaattaattaattaggagtaggatatggtcagatttttcttctggcaattcatgcctgctcgtggatcagaccgtacaatttacgagtacttcactgtttcctttctagagatgttgtgtttggtcagatttttcttctggcaatcatgccttatccaaacagagaatggcaagatatcatctcacacaaagaaagcaaccagccattagtccacagtggcacagtacgtgttgccttgcactcttcaccttcatcacgccctgcggctcaagattcgcatgctcgtgttgtattcaccttgcaaggcaaaacacatcacgagttgcacagcaaaccttcgcttggacagaacgagtccacagccttaaccgccatgcaatgcaccacctcaaatggcaatgggcattggcagaaagcgagatgtctcggccggttaaaagctccatggacgcagcacacgcaagcagttattgccacgtctattggctcggcaagtttggcatagcaggcagaaagcaatcaataaatagcacgcatttactggggggttaacataggcagggattgatacaggacacacccgtaatatcctccaccggtctaggcactttctgtatctatatatacgtaagcacgtcctgattcttgttgcatttctcgtcctgatttgcgtcctgcagctctctctcatcacagtttcgcaatggccaaaaaaacaatactgcaggtaagtaacgctctccgtctccgtccaatccgatcaattttcgtggcgtcttaggattattattttcttatagaatcaagaaagggaattttggttggttggttggttgcaggtggtttgcgcggtggcgctggtggcgctgtgcgcgtgcggcgtcgcggcgtcaccgtcgtcgccggcgggagcggggtgccggaagcacgtcgcgaggatcacggagtacggcggcgtcggggacgggaggaggtccaacacggcggcgttcgccaaggcggtggcggacctgtcgctgcgcgccggcgacggcggcgcggcgctggtggtgccgaaggggaagtggctgacggggccctttaacctcaccagccacttcaccctcttcctcgaccacggcgccgagatcctcgcgtctcaggtgatctgagccaccaacaacatcggttgcatgcatcaaccccctctcttattaccatttaccatgattaactgcgccattatctctatctctatctcggctggtgtttcgccgcgaaagtagcgcatgttaaatgtccggttcctactactagctctaattcacctatagctaatctaataaccaatttatatgatagtcatgtcatacacacattgtatcttggagtcgagtccgtgctgcagctgactacatatctgtagctcactgcttttctctctcatcttttatctcattaaaatatattgtagctagctaatagtctgctatttttctctctcatcttttatctcattaaaatatattgtagctagctaatagtctgctattgtcccttctcttaccgtcacacttgtgaccaaacagtcacacgcgaccgccctaaagttggcgggtactagctacttccgttttattggcgtagatgatgctttttgccagggaaaaacgccttttttggtctggggtcccatatctgtcctcccaggctcccatctgttcttgatggaatctcaaactggcaaactgttaatacgaacattaacatgctaaatgccacggttacatgctgtattttttttttgtcgtaatcaaccttatctgattgtcgctctcaagaaatgggaggacaacgtattaaggcggcgcttaaatatgtgccaagagctgtatgttgggagcttgaacccggtgatgtgtcattgcaattgcggtggttgcctattgtaaggatgagctggtggctattgaatacatgtaaatgaaccggttttgatcagatagctgattaattagtttggaccattgaaggtcaatcgatgttaatgtgatccgtttcagttgctaaccgtgccgtactgagagaaagagaatggattgggagtgttaggacaaaagctctgccatgtcatttcagaaatttctactgttatatggttgctccacttttatgctttgaattttgtcagcacataacttgtggacctgctactcttatctgtttttgttcacccgttttcagttactagtgtaactggttcatctctcattatctgaagtgttgacagtctaagctgttcatttcgttcttcagaacttggaagattggcctctgatagctcctctgccatcctacggaagaggaagggacgaaccaggcccaagatacagcaatttcattgctggatccaatctcacagatgtcatcatcactggtacacgaatgaatgcgtgatgaagattgctattttctcaaccttttcgtgtaactgctgtgattgtggtatatgtttagctgtggatatctgaaattgagcaacatttcaggtaggaatggaacgatcaacggccagggccaagtctggtgggacaagttccacgccaaggaactcacctacactcgcggttacctgctcgagctcctctactctaacaatatcatcatctctaatgtcaccttcgtcgactcgccgtcatggaatctccatcccacctactgcacgtaagaatcatcagtactcgcaaccagaattcagtttctgaacggttagatatagatcatgatgctcaccttctttgtgttccgtgctgcgccagcaatgtgaccatcagcggcatcaccattctagcacctctcaactcgcccaacaccgatggaatcgacccaggtataaacatacaagtcacactgcacttgatcaatgctgccatgaggaaagcattggtttgtgctagatgtgatgagctcttgttgtccatggtgcagattcttcctcccatgtcaagatcgaggacagctacatcgtgtccggcgacgactgcatcgccgtgaagagcggctgggaccagtacggcatcaagttcaacatgccgagccagcacatcctcatcaggaggctcacctgcatctccccgacgagcgccatgatcgcgctcggcagcgagatgtccggcggcatccgcgacgtgcgcgccgtggacaacgtcgccatcgacaccgagtcggccgtcaggatcaagtccggcgtggggcgcggcggctacgtcaaggacgtgttcgtccgcggcctcagcctccacaccatgaagtgggtgttctggatgaccggcaactacggccagcacccggacaactcctccgaccccaacgctctgccggaggtcaccggcatcaactacagcgacgtgttcgcggagaacgtcaccatggccggcaggatggaggggattcccaacgacccctacactggcatctgcatgtccaacgtcaccgcgcagctcgcgccggacgccaagaagctgcaatggaactgcaccgatgtcaagggtgtcgcctccgacgtctcgccggtgccgtgcccggagctcggggcggcgggcaagccatgcgccttccctgaagaagagctcgtcatcggtccgcctgaattgccaacgtgtagctactgaaatactgatataggatgatagtatggtgtgggtaatggcctgggctatgagatgcttgggaccaaagagatatatatgatgtggtttagtgagtaaagttaagcagtttgaaaatgctgccggataatctctttacacccaattcatttatgagtgctcatctgcgaatgacctgaccaaagcaaagccttttcattttgtcttctgacagtaaatacagcacgtgacaagataacaaaatcatcaaacttctaaacgaaactttgcaaaaacaatgacaattgacaaagtgagaagcaaagctcaacgtgcctaggcagcggtttgcaatcaccgtcttcccctgcccttgctcatgaagtggtggcgcttcaacctcttcttccggatcaccacggaggacttgatgtgctccgcgaacggcatgccaaggagggtgagcagcctgagagcctcgttgtcggtcttcgcggtggtgacgatgcagacgtccattccattcttcttcccaccgacctcgtacgggatctccgggaacacgccctgatcacgaaggcctatggtgaagttgccatggccatcaaagctgttggggttgacaccaaggaagtccatggtcctaggaagcccaaggttgatgagcctatccaggaagttgaacattacctgcagcaagccaaaataagctcatcgatcaaacatattccctaggttcccaaatacttgtcactggatactattcatatttgaactttgatcacttatattttttagaaaataaaatgcatatacctaaaaatatgccatattattaaagttgttactccacatagataggtattaaactttcgttcgtccaaccatttaaaatttgtggtcaatgtaaaatactgacggccaacggtgacaataatttggaactggatggagtaattgcaattctcacacatactttaggctattatactgtcatgcaaatcccaaattgatacaacattgcagtccccaatttgtcaatgtctgcatcgcaagtagccagaggtacagaggactcaccctgccgcggagcgtaacggcaataccaatggtgttcccctcgcggatcttgaaactggcgacggacttcttggccttcgtcttgacgggccactggccggtgatcatggcgaggtccttcatggcggattcgagccccttggagttaccggcttcagcccccaacccgcaattcactacaatcttctcaaccttgggcacctgaataaaatcgagaatccaaaacacactcctctaagctcaattattgaacaacaatcgaatttcccgagttccgcaaagaaatggccatgtctatcctataattgcgagaagggagacagaggtcgaacacctggtggacattggtgtagccgaactcctcggtgatgagggggaccaccttctggtcgtatacagccttgaggcggtgcaccttctgtgcctcggtggggtcgacgaggacgatgcccgaaggcgaggtcggcggcggcgccggcttgggtggcgcgtcggccgcggcggaggcggcgacgcggagggctcggcgaggaggcggggagcggaggaagaagcggacgttacgggaggaggaggcggtggtggtgacgggaaagggggccggcgaggacggcagggtcacagccgtggccgccattggagcgtgcgcggagacggaggtgggagctgaggagggagctttatgccatggatggattacgggataaggcgagttggctgtggctggctgccgttgctgtccagtgtcgcaggtgggctttctcgtcatggttcggcccatcgaactgttcgacatggtttcaggccttaggcccatcaaaaccgttgatttgggccttaggcccatcaaaaccgttgagttgggggtgaactaaacacggcctaagagaagggtaaagttacatgagtcaacaactgcaagtctgcagtgtgtgaatttcgatatatgccttgttttggtcaaccggtaacagtgtttgagtatgtggcccattctgtattttctaatgcactacaggacatcactagtatagtagtagtatgccattaaacgatgacttcaaacataaaaaacgccgatgaagagcttaaacaagatcaagcaaactctgaacctagcaacagttgctggcagatcagcaggagatctgccacgcttgatcaacattgaaaaatggacggaatatcacgacgaggatcctcgtcacatgcttatgcctaactaatcatgcagtaaccgtaacatgcagttctttataaccaggggacaatcactaggatctgatttgaaaggtcccagatcacaacattgcgcttgccctaccttgttctaccaaggaccagcaatgccacgaccgtgatcctgtgaggatcgacttgacaccaagagtagaaacacaacggacaatatcttccttgtcagtttgcaacctaatcctgataaactacattaacctccttgacctcaagaagtaactgtcagtctgtgaccttgtcacttgtcagggccttaatgaacagccattcagcagtatggaggaaccgcctagtgtgcataagcttcattaattcttcttcacggtcaaaaagtaatcagccatgcatcactttcatatttacatccggcacatctcgtgaacaagagatacagaatgtcggcaaataaagaatataaaagaaagtacacattttatcagtgaacacctcactgtcagcagcacgactcaaccagactaataaattcagaatggtactgattaatatatatcattaccagcagtactagcaaaagcatcagccattcagccccagcacatcatttctaatacctgtgtgctccaccgtccaaatgagcttccaaatatctatctaaattattcttctattaacaggacagaaaagcatattacaaggctacaattgccactgaagcaaaaactaataagagatgacagcaaataaaaagaaaaaaatgtgtgataagtagctctcattggatcgcatctaaggtctctttcctcttaatcctcctcttgatctccttctccagctcctcaatcccacccacctcctccagctcctgtcaaccacataaaacagagacattttagaacatttcagacaatttttccgacgatcacaaatatttgtaatacatcttagaacatttcaaaatttccagtccttttatatcaacacagttcaaattctacattagcttcccaatcacaaattcatgcttgcaataaaggagtactgcaagtatgcaaactactcgacaaatggacaccgttggagcaggagtaagccaacaagcatccatggtagcatggggcacgaggaagcaaagcatgaatagcatgagacacatctcctcaccttgggaccaaggaacagcccatatggcacaccttcgaacttgtccatgtgatgtatctgcaagaatgaatggcaggcaaggatggatcagctcacataaattcagaaccacggcaagagaagctcagagacagggatgcgtggtcggctgcagttaggtggagagcgaccgggccggacctggtgggcggcggcgacccgccggaagtagggcacgttggcgatgggccccaccgggaagcggcggtggaccaggccgtcgtggacgaacatgtacgccatcccgaacagcgtgatcccgagtccctgcggcgaacggacacgtcagcacttggatcatctctgcccagagccccagatcacaaaaattcaaccttggcaatcaaattgaacaaaaagaaacgctgctagcgcttgtattttacttgttccggtgagaccgttgatgggtacctcgcatgggtgaccatggcgccgtcgcaatgcgacaacaatacctattgctttagtacaatctacgttatagggggaactatttaatcattcgagggatgttctctcatttgcttacagaatatccaaaggttatgaaattttttgacaacactcagataacatatctgtgcaactacataaaatcttatattcaaactcaactcacacgttgagatataaaaaattaaattcaatgtatgattagtagcgtaatgttcacatctgaattatcttttcttttattcgtgttgtgtatatggaagttgaacataatttttggtggactgatagatctcactatactctacattattactttttaaaaaaaaaaattcataactatttgtatcgaatttgaaagagaaaaatatacgagataacatccctcaaagatattagaatccattataggtttctctgggaactcatggaggccaggccactccgtttttctaaattttctcgatctcgaatgttcaattttttattgtttatccgatgcagcaaggacatcaagatcttttggagttcgctctacgctttggcttctcttgacagataaattcatttttttttggcaggcggccatggaatgtgaatgtaatcaactgaacatagtactacatcatgcacttttgtcattttaatacggccacgttaagcacgcttggtcaaatcctggtacagtgtgtttgagagaagtgatggggatttggttgaaatggaggaggatcgaccactcaccgcgccgaagcaaaggccggggacgaggccgcgggtgaagaagccgtaggcgaggagggacatggccgggacggcgttggtgatggcgaagacgtcgttgagctcgaacggcccgtctcgcgggcggtggtgcgactcgtgcatgtgccacagcgacgcgtgccacagcgcccggtgcgcccaccgcgcccagaacttcatccccacctgcgcaaaatggcaaggcaaaaccaacacggttacacgagcgacgcgcggcgtcttgcggacggtgcgtgtgtgtgcgcttaccggggcgcccaccgatagcgcgaaggtgccgaacattttcgtgaacgggatcttcgcggttgccttgtcgagcacgcggagaaattttagtgctggcgcgaaagaattgccgaattgggtaatggtaaaatgcgagcgggagtttgccgatggcgtgttacctacctccaattgccaggcgaagcggtagtagacggcggcggcggccatggacgtgatc

SEQ ID NO: 29740 - DNA, 37382 bp, Oryza sativa
  unsure (1)..(37382): unsure at all n locations
cccaggcaaagccggtagtaaccgccggcgccggccaatgnacgtgatcccgaggttgaacatcaccgctgccaccaggtacgtccgccgctccgattgtttccgcgcggcgcgctccgccaccgccctccgcgcatcctcctccggctccggctcacccaccgccacgcgcaaggggacggccagcccccgcgccgggagcggcgcgaacgccagccgcagcagcgccgggggcgatcggtgtgccgccgccaccgcggcggggaagagaagaggggcccgcgcggccaccagcctcgcgacggccatggatgccgcagccgcagcctacgcgaacgcggacgcggggatggatggacggttttgattgggcgggtgaagcggtccgcgtccgcctcggggagcgagaggcgtcgtccaagacaagtgggtcggatggagtcgccgtcgtcacgagtcaacttgtgattgtgagcatggaaattcgtgaggaacgccggctcggacccggtggcttttatataggagtatcaggggccatgtggaaacagcgacttattcacgttgacactaatttagagtattaaatatagattaattataaaaccaattatataaccttatactaattcacgagacaaatcttttgagcctaattatgtcatgatttgacaatgtgatgctacagtaaattttttataattatagattaattagacttaaaaaattcgtctcacgaattagctctaatttatgaaattagttttttattagcatatttttaacactccaaattagtgtccaaacatccgatgtgacacggactaaaaagtttttagtcccatctaaacagcccctcattactccctctgtttaagatggtataaattataatacaatgtatctggatatacctctgtctatatatgttgtattagaatatgtcacattctattttaggttgttttttttttctggagggagtaggcacgaatgcacgatgcggatgcgagctgagtcatgcatattttggaatggaattattctcagatcatcagcaattggtgtattggagattaaggtctttcctgaagctggggttatctcgttgccgctgggtgattggccaggttgaggccgcttgcctgagctaccgcggcgtcaggggcagtggaaaatgacattgcaggttcagggcacctgattcgccacgtggccgtctcaacgcatccgcgcacgcagcttctggtcagctatacaccgcgccggcgagccgtcctccgctgcgtcgccatcacaacgagttactcctgacccctgatctcaagcgtcggagttcacctttcgattgagcgctcgattctggtctgacttataaaggtgcgacatttttcatcattttcttatcgggaattggctgtttattatatatctaaattcttgaaaactattcaaaatctctttcagcatatactttcatcaagtatccaaacctcaaaaattctgagatttactatcggttttcgtgaaaaaacgtaaaccctaactgagatctgtatgtagttcatgttctagctcatcatcgttctgctccatgcatgccatggccaatgcttgctgggcacaataatttttaccaccacacttcttcttttaggcatagctcctttcctttgtcgttaaaaaattggagaggatagaacatctttctaaagtacgaactccacctgatcatgttcgcttatccagaataggaatgtggctgcctgccctacgaacgccgtaggccatggaaggggtgtgtacgtgtcagggcagcgtcccgacgcgagcgtttgcccggcgaatgctgctgctcgccgccccactacgtggccactggcatgtacccaccgcacttgccgacgcccacgctttcctcccgctgcagtcacgcttcagcagctcagcacctcccactcgtgaattgggcaccccatgaaaaagatggaaaaagaaccaaaccgcttcaacctcaacgatctactattaggggtttacaaaaccacacgattaacacacggttattacgattaccatgcacgataacctttgtagtttttaaaaccacggtatgtcttacggttaccgcgcggtaaccatcttaccgcgggagttcggtaaccgtattaaaaacggtaaggggaaccctactacttttactcagaaccttagatgctactcagatcactataaccactgggctatatgactatttacgaagccctactactatcccccttgattatactcgcaagaagagacatctagatcttttaccttcgccctggtgtagtcaagtctcatcgtttcgctacctgcttacctggtgatcggtggttcggtacaaacacgacggaatatacgagtgctctcgtggtgccgatggcgacgcgcgacgagaggccacctgacggcgacgggagcctcgccgtagtgggggcggccgcgccgcggttgctcgcgctcggcgacacgtacccgacgggggatttaggataactggttttcggaggtggacgtggtggtcaaacgcgcggtgagttttttaattgggggaaacttttggatgatttggatctccaagctgccgtaacagtgccacctattccattttcgcggtagcctgatagcgtgaagtgtgaaccctgaaatggacggataatggaatatggcaatatcgcatacggagtatgcaaatgaccgaatgtgtgtgtgcgggtcgtcgtccacgtttctcacagtctcacctgtctacgacagcaatcgactactactcctccgtctttgattttaatattttgtttgtactatttaatcatttattttattaaaaaaattatacaaatataaaaaataaaaaattgtgtttaaagtactttagataataaagtaagtcacaaataaaataaataataattctaaatttttttaaatgagacgaatgatcaaaacagtacaagcaagttaaaatacgttatattagaggacggaaggagtactacggattgattgatggatcgggatggctttgaggacaaatatctttgctatctgcttagctgcagtcgatcgagcagttaactaattggtttctactccatggagtaaaaggaaaaggaatgaagcatctattgttctctgaaaattgacaacagctcataccactaaacacgctaagcatgtgcaagaaaaataaaagaagagcggcaaaacatatactctctccgtcttaaaatataacaacaatcaatcttgtatgttcagatttattgtattagaatatatcctatccagtacaaagttgctatattttgaaagagatagagtagcagtactaaaagcgctaaagcatgtttttagtaaaagaagaagaaaaaagcgactcaagttctcaaactcatgcttaacacgctaaacatgtatagtaccaacagtacatgttttagcggcacctttgaaaaactaggggcacctttgaaacgtatataatattaaaaaaaatagatgaataaaaaacacataattttaacagaataaaagtacgaaacaaagtccattaacataattaattgagtattaattattacaaagcttgaaagataacttcatttgacttttaaagaaatttctatataaaaaagttatttttagaaaaatcatttagtcgtttagaaaacatgcttatagaagacaaagagttgtaattgctaaacgaaaaaataaacgaggccgaagtgaagctaaacaagctatgaaattaaataaaagaaccaaacatgtactaagtaaagctaaacaatcttttttgtttggcatgaaagctaaacaatctaaaacatgtactgccaagtaaaacaatatagcaaagcaaaaaaaaaaagtaaagctaaacacgctaaaaacatgaactaccaagtcaaaaagctaaacatgcactaagtaaaacaggtacgaagtagaagcacatttcttttacccattcataaaataaatgtactaaaaaaacctgaaccacatgtgttcgctatttaaggttcccaaccagaaccctccgtacggaaaacggagcgatccattagcgcgtgattaattaagtattagctatttttttttttaaaaaaaagattaatttgatttttttaaagaaacttttgtataaaaactttttcaaaaaacgcaccgtttaacagtttaaaaagcgtacgcgcggaaaacgagagagaggggttggaaaaggggtgtccgaacacaccctaagtagaagcaactaaacatgtactagctgagaaaaaaaagtagaaataaactaaacatgtataagtaaaataataagcatgaaattaatacacgtgctaataagtataaaaaagaacaaggtaactaaacatgtactaattaagttaaaaaagtacaaagcagctagacgttgtactactaaataaaataactaacaaacatgtaatcaatacatgtcccaagtaaaaaaaatgcaaagcaactacccctctgtcaaaaaaaaaaaaaggtccaattctaaggacaaatctggattctgaatacatgcaatccagatttatctctagaattaattttttttgacagagcgattaaacttgtagtagaaaaataaaataaaacatgggccaactaataccacctaagtactccatccgtctcaaaataaatatagttttgcactattcatgttcaatgtctgttcatcttacttgaattttttattagtatttttattattattaaatgataaaatatgaatagtactttatacgtgagtcttttttttcataattttttcaaataatacagacagacaaacgttggatacgaatatccatggctacacttatcttggaacgaatgcagtatatactaactccgccccgaacaaatataagtctaggttgtttagcatgtattaagatttgtgaagaaagattattatgcctcgcattaataataggaaataattttaatgataagtaaatgatgggacaattaagaatattttattatgacaaatgttgtaagaaaaattaaatcatagaaatataattattatgagatggaggtagtaatactaggacaataccaaacatgtagcaaaaaaaggtaaaagttgaatggttgttaagggtaaaatagaaaaaaaattaaatgataagtaattgatgagacaattaataatactatattatgacaaatgttgtgggacaaatttaaattaaaaaatactaggacaaaaccatacttaaaaagtagtgggacaaatttaaatataaaaatactaggacaaaaccagacttgtttaaaatataaaaaatactaggacaaaaccatacttaaaaagtagtgggacaaatttaaatataaaaaatactaggacaaaaccatacttaaaaagtagtgggacaaatttaaatataaaaaatactaggacaaaaccagacttgtttaaaaaaatttataagtgtggctgctgggattcgagcccaggtctccacggccacaacgtggaattctcaccactaaactacagccactttattaaacaaggttaattagtcatcatatattgaataaaatatggttaaagcacaagaacaaacttccagagcattttttgcacgcaggggcagccggtagctaaccgtatctgtttgttattgatcgcagggcaaaatttgcagcttggcatgctgaaaccgcgatatacatttgtcgggcagatctcagtgttactctaagtctgaatgataatagacattcgcttcttcagtaattttcctccaccctcccattgtcattgtcgtgttcttcaagttcaatctgaattccaattctcaagcactgatcgttccatgaccccatcggtaggcaaaggagcaacaatttctacagattttcctttccagaaagcgatctatagatttcaccttcaatcaggaaggatactggaaggtagcaataagtgaaccgaacggcccaagacaatccatcacaaggatggcccatgtgaaagaaaacccacccaactgcaaattactaaggcccagcctgggcaaccaatcaccgacctttccagagcccaccgtatagcaactccgggcctatacggcacggcccgttatcgaggctcaccaacccgagcgggaatctccaggcaaaatcatcggctgcctcaaaacccctgagccgtgcatcctagggtttccctctcctcctcccctctctccccgtccggcaacgcagcctcaccgttcaggcggcggcgaaggccgcgtcgaccccgcgcagcgcaggcgccatggccgccccggaggcaccctcctgctacgttgggatcgcgcggcagtccgccgccttccgcctcatgaagcaaatggtgcgtgatactacctaattcaaagttttcctcatgcgttggggcatgcagtatgctattgctagacgtaggtttatgttggttaacatcggttgatcctgtcggatatggagtctgaaggagttgctgttgttgttcctgttgaattgtaactagcaacgtttgttaatgctacggagtggaatttgggaactgccgcaaacgagtgaacttggcttggattttggaaaggagttgaaattcacattcttcacgagttatggctgcacatagattgaatttagtgtagttaatatttctaatcgaaccaaatgagtaacgtgaatggaatggtggtttgcactccataaacaagtttatttcgtcagattatactgatttttctgtaatttagatttgttctctttttactgattttaaagtgtagttagcattttttttttcattatgctttaggggtgggaagaaggtgaaggccttggtaaagataagcaaggcattaaggggcatgttagagtgaaaaacaagcaggacactcttggtatgtttctatatagatcttctactttagaagtctatttgtaaggatatatatccttgttaaccacccgtgggctctcttaaacctaatctgatcgtttctgcaggtgttggtgtagacagtcctcataacaaatgggtatatgacaccacccaatttgacaatatactaaagaaactgaaagtggtatggcgtgtaacaattactttgtttgctctatgtataaattggtcattatttcagttcctaattgtttcctattatctttttcttgtcatttgatcgttgctcccatcttctttggcagcaatccgctactcctgctataaaaggtacctgacggtgtttgtgcgtatagttcttattttcatcttgttaggtgttgtttgataacatttttggtgtagcagaatttgaagatgatgtaagcaattcaccagatagtacaccaaaggaagctaaaccaacaaacaatgaagttaccaaagttacccgaccccaaggaaggttggtttgctcccatagcttcagtatttgtatttctgtatctattttttcttctctttacagtttacgcaatacttatttcagatataagaaaagagagagggggaaaagtgtgagcggttattcagcaaaagatcttgaaggcatacttgtgagttgttattcttatgtgtgcctatttctttcttagctaatctagttactatccatgagcaatttttttcttgtgcacctgtgtaaactgtgtaacttactttattacatgcatgaaatattgtgtttgcacaggttcgcaaaagtgatgacaattgcaaagtggaccaggaagttgaaccaacatgctgtgatgaacctgatcccatcatctgtcaagatacaggtctgtaatttgcatgtttagtttccccatcattgcttcttggtctgagccaggactgaggtgccaaacttttagaactagaatgtgtacacactgcatacaagtcactgaacagctaaatggtaaagctctgctgattatactcatatactgttaattttggttctctactagacgagatctaccatgtcagcatctaagttgctaattgcttaccagagtaaagcacattttatttgctctctaatctttctctcttcactaatggtttgaattgtgactacctgattggttgtactgcacatggtctgatgcttggtttggattgaaatgattctgataaatttgttactctaaatatgtaatcttcttttgagaccatagactaatatcattgagattttactaatagttcatgacaactctctgttcagtatcgcaagctgatgatgtgaactggtgggggcataaatttggattcaagtcaggcggctttctaggagcaaaatcgcgcaagaacaaatcttctgctacaaaaggtacttcaaatgtccgccagacatttggggaagaagaccaagaaaacctatacaatcttgttcaggttggtattaacagtctatcagatctcccataatgtcctataacaagactgtccatttcttaatgtgcttttagagactttttaaccacatataagcaacttgcctttgaattctatatttttcttacagtttggcctgaaattgcaaagtcaatttagacctctgttgattgattatcgaacaaatctgatgtatttaaaaacatatagatatagctgagttctcaataatatccattccatctaaatggtctttgtaactgctgcaggacaaagccacatctggaaagcagggtcttggcattaagggtctgccaattaaagttgccggacaccgttggaaagggaacaaaacttcttttggtgatagcgatgaggaaaattcaacccaatccaatgaattatcagagttggaagaagatggtgatgaggaagaatctgctaacgataatgaactaatagacgccaatgtgaatactgtgaaagaaatgtgcgtggatgttaaacaaaaacataaaaccaaggtcaagaaactttgcaaaacaattcttcgtcaggtatggttgtttaattatcatactctctgtatgtggcttcatgtgttgtgccgtaatcacaacgtttatttacttgtattattcccaggccccagcacaatctatgaaattgaaggaacttaaggtagctgttgaagcacattcagagtctatgttctccaacttctcttgtaggcgtgaagctctattgttcttaaagaggaaggtacgggttttctttttcatttggcagaggctttgcgatctttctctctttcgttatggagtaattagggagcacctactatagaaggtatggtatgtagttgcataaagaaaaacagatagcagatttggttgcaatgtaacttgttgggatcttcaccatagccattgtatcatcagcgtgacctcattgaattagaacagaagctctattgagctacatgttgctactgggcagcggtgtaatagccttatttaacctttttctgtctattttgcagctccaaggaagcagaaaattcaatattgatggcaaacgggttcagcttgtatcgtaaattacgaagccgttcgggtgtgacatgaagccattgtggtcatattaggctattcgtgcttctgatgagtgtacgaaagtacggagcacagtatgctctgcggtatagatgtaagaagtaatacccctcacgcatggggggtcaaattttgcaaaacttacgaacggctgagatgctaattgtgtgtacactgttgagcacatttgattttcatcgttcatttccctacagcaaatgtttggcagccggttctgaataccaatgcacgtcaatattgtaccttagctggtgtattagctggtgtatcttcaattattatacttctgtttggagcgtgtggtatatgattggagctagtttgtgccaacgttcagaggcgctctacttttagaacatgttttttgcacattgattttgttattatctgaaaccggtgccaccccctgatgattttgcctgattaattcgtcatgctagttaaaaatatattttatttgttaaaaaaaatattgttgtattgatatttaaatttactttcataaggttataatatatgagaagttagaaggaaaaagattagttttgaagaccgtatcaactttgatcgagctttgtattatattatggaatagagggagtagtactgttttaatttcaccagataagatatacacaaaccctggtgattgtacatttctactgacctgccacgtggcactttacattcgcatagtcagcttcgttcacagcggtaggcggcggcccggcgtcttgaggcgatgcgcattggtcgggggaattcgggataagcagcgaagtcattcatggtcgcgccagcgacgccgaggccgtcgcggatcctgccgcgagcgtcgcactcccactcccagccggccgccgtcggcctcgcgtccgaccgtgccgccgccgccaccgtctcctcccgccgccgccgcaacttcgtcttcgtcgtcaacccctccggtactccccccccctccaccccgctacccttaccccctatcctatgcgcgctctcaacgcccttcacgtcgtcgcaggcgccaatggccgcacgggcaaccagtggaagcagctgctcccgcacctccgcacccgcttcgctgaccaatgcgatgtaagactttcgatttctcttagatccctggatcgtagcatcctgaaccggaagctgcaattgctgtatgagaccatatttgggatcagatccccatgctaatttgggggctctacggaatgttctgatttgttggtattgcgtgatcagatttgtgagtgcatcacctcggccccgttcgacgccatagatatcacgagggaggtgtgtatgggcttcctatagctgccagtatccaattgttaatttccccttttggttttcttgttacaatgtgtgtatgatgatgatgatgtaggctgtaaaggatggggctgatgccgtgattgctgttggtggtgatggaacacttcatgaggtattatttgtgttgacttttgcaatatggatacaacctttgtactaaatttgtccagaaacttgatattcaaatacggtaatatttgtggatggaatgtgcaggtcgtcaatggcttcttctgtaagggaagtcctgtccatgctcttgatcaaggacctgatcattccacagcgcttggtgtgagtgtacttagtttctagctattctatccaatcagatcacccttctagcctcttaaattaagcattagactattctgaactgaaatgtttgtttatgcactggaatttgttcggtagtgaagcggattgtttttctctgacagctcattccacttggaactggttcagactttgcaaggacatttggctggtatatttctccagcataatctacatatggtgtttagataacctctactttcactgatgtttctttcttttgtgcaaccaggacaaatgatcctcatgaggcgattgatcgaattgtgagaggttccttctttgattcttcttttatagtgtgtgctgtcagtccatactcgtggtctcatagtggtcattcatctcctggtatatgtatatgaatgcacagtaacattattaaagtaccagttgtcatatgactagccaggtgattgggtttgtcttaaaagatttgaaataaagtttttggaagcataacaatgaaattgctattataaactggccatcttcatgaaaatatacaaaaactagatttatgtctactacgaattcgcaatcataacatatgaggctcacaggtgcatatttttgcaggagtcaaatcaaaactagatataggtatgatggaaggcccagatggaaacccacattattttgttaatgttgctgatatccatttgtaagtcaagcatggctcatttgacctgtgaaattcaatggatggtttgaaaaggaaaaaattgctctgcacctgcaggagtgctaaggcgggttatttttcttctatgtacaagagatttggcaacttatgctatgtttttggagcgctcagagccttttggggacatagtaatcgagatcttagaataaaggtttgcatcgcactggttttagaaggaagcttagttgcaatcttactgatttttttcgtcattatcagtcccacacctcttgaatttactagtgcatataataggtaaatggtggagaatggaaaaccattcgtaaagtcactgcactatgcataggaaatgccaaatacttcggcggtggtatgaagatcactccaacagctgatcctttcgggggtgaccttgaggtgcctaaaaagtcatttttctttatagttttgagtaagcattaagaaaagttagcctttgttaatttatgtgtcatttcataggtcgttattcttcaagatttcaaatggcatgatttcctgctcaagcttcatagattgtatggaggaactcatctatcagtgactggtgtgtcatcgataaggtaaggggactccgctaatgaatcttagtgttgctctacttactttaaacaatgctgagttaagggttgtacttctggttggtttcatccaataacccttcagttgttatttggcatataggtcagatctccggacagattaatcttgttagcatcatcactggtagttttgcaatgacatgatggcaatcaaaattgttgaggaatatttattcgagctctatgcctctattgctttcctcctgatatgtgtctcattagttctaaaacaggattcaatgtttgttaagccttctcaaaatagctaacatcactattaggctgtttaactgggtattctatttggggtcactaagtgacaatatttttgtcgcagagttcagtcgattgaagtagcagaaaaggaagttagtgctgacatctttgtgcaatctgatggggagcattttggttttcttccaaccaaattttcagttcttcccggtgcagttgatttcttctgctagattagtatgcttcttcctgtgggatacaaaggtttcttaatccttgtcaagtcactacgtgtactttgaactagctgtgttattttgaagtgatatcgtaattgaatagttacattcattttctggcaatacatgggataaaatctgttgtcacccgccatgtaatgactataattatatgcaacatttgctaatcaaactaccataaaaatttggtggtgacggtgcactatgaactgtttgaattatactggaccaaactggcatcaatgtaaatgacacaatgacttttaggcttgtaccctgtgtaatttatacttttgccttttgctcaacaacagaaggacatagttagctgcagtttcaatacaaaatttatttaccttcagcttccaacttcgaagttactattcttactcatagtaccttatgaatcagtcacacgatgtactcctatatgagactgatgctgctagaattcaccacccaacgttttctcaagagtaaattgcactttacactggtaaaacgcacctatttttgctttgtactaattttagcacatactttcagtttttatcagttgtactccctccgtctcaataaaaagtgcacttagtattgggtgtgacattttatagaacacttatatgaaatgtcacatccgatcttaggtgcacttatattaggacggagagaatattgaaataagtttcactttatgttaggatacatcatcaaacctatagaaaattcactaacttatataaaatttgaataaaactttgtgaaacatgttctaaatttgaatgggtccataaattccacttgtgttttataagattttctttcaattatgtgctgcaatctagaataatatacctgcatggaagtcaaaatatgtactaaagctggtgcaaagccaaacaaagatatgctctacccaatgctatgtaattcctccgtcccaaaatgtaaagagttttggttgaatgagacatgtcataatactacgaatcttaacagtagtcttacggattaggatgtgtctcatccaactaaaacttcttgtattttgggattgaaggagtacaatatactcttctcttaatttgtttggttcatctattattttttaatgggtatagtattttgttagggggagtactaatcaattacacggccgtacctgtgattatgaagtcgatttaaaatttctttcttgtgaagtgattctcaagcagagtatttgctgtttgttccttccatacgtaaggaataatttctgttgcttgaaaatttaaatggccattgagatactcctagaaagtaccctgtcccctgatgctgcggcaccagactttaaccctgtctatgacttgactttattctcataatctgccatgttctcctgtagccctgtcgcttgaccatgacgacgtcatacttatacgttctgaccttgtaaaacttgtactccctccgtcaaaaaaaaaaaaaagacaaaccctgggtttccgtgtccaactttgactgtccgtcttacatgaaattttttataattcgtattttcattgttgttagatgataaaacatgattaatattttatgtgtgacttgtctttttaatttttttcataatttctttcaaataaaacggacggtcaaacgttgaacacggaaaccagggtttttctttttttgggacggaggtagtacttcctccgtcccaaaataagtacagccatggttttccgcgcccaactttgaccgttcgtcttatctgaaaattttttgaaaaaatttgaaaacataagccacgagtaaagtactattcttgttttatcatctcataacaacaaaaatgctaattataaaaaaaattaaataagacgaacgatcaaagttggtcgcgagacgaaggtagtactacttacagcagctttggtcatgaacagcgtgaaaagaaagtgtgttccttctccgctgccgcctgggcaaagaagacgaaaataatggtagaaactggaaaaaggaaggaaggcttgtccaaagcataatccaataatcctacgtcgtgacaggtacggtatccgttttttccccgtacgtccttcccatgtgatgcgtcaacagttaaaaaattgccctcttttgctcggctcatccgcgcgccgcgcgcgtctcggccaacattggcaaacacgcgacgcagccaccgttccgtccccgcatcctcctgcgtctcctcgtgctcgtgcggctctcgcgctcgctgcgcgcctgcgccgaatcgagcgaacgccgcagccgcaggttgcagcgcgcgcgcgcacgtcgtgtgcccgtggctgcgtgccgcgagtcgcgacgccatgctaaaaagaaaaaaaatatcaccggacgcatcgcgtcgtatcgggcggagcacacgagtcatggacctgtacgacgttgtgggggcgtgagttttactcgtcctcatgtcatgtcgtccgcgagaagcaaaaggaatttacgcacgcgctcgtgggtcgggtcgtggaacgtgaacggcttgtacgtcggggtatatggggacaaaatggccttctgttgcgttgctacaccccgtggttggcgttgcacgtaaggcatccgatcgagcagccggagcgagccggggtccgggggtctgattgtgtgaacgaatcagtgatcgcctgaatggtgatcggagcatatatgctttggctggcccggcgtgatgattactgcgtagcacagtagcaggacgcactggaacagtactagtaagaaggccatgattattatcgtgattagagtacacagcctcgtaattgcacatacgcaacggaggcgctgccaggtgtcgtgtaccattcttttggtattagacttgccatgactatcgtgtgaatgcctgaatggcaattccgagccgtagcttgcgtacatcttaaagaaacccactcatcgcgatgacgctatcagccacatgaacatcaccagccagactgtatcctcagggagcccggccgccaattgagaaaatctgcaaatgggtacgactgctaattactactatgatttaataacacaatagtagaacagtgtgaaggtgatactaccaaatattcgaagccttctctctctatctctccacgagtccatgtcaaatggagaaggaaaagggtggagctcttttttgcttggccctgcatgcgtctgcgtcagagcgcgcacgaccagcacacacacccccacattccgttggtgcagtgcagtgcggtgcgcgcggctcaactttgaaagcggacggccgactgactgacggctcgacgtcgccgtgccgccgagctgtcacgcagctagctgacagccaatgctaatcttggaagcgcacgtcacctaactcctctccagaatccaaatcacaaggggccccggcacacacaagtttgcaacgaggtggtggtcctcactcctgaccgtctgtcctagtaatgcaaggggaaattatcctctgattgttgatttgtctccacatattaggccccgtttagttcccaaaattttttcccaaaaacatcgcatcgaatctttggacatatacataagcattaaatatatataaaaagaaaacctaattgcacagttatggaggaaatcgcgagacgaatcttttaagcctaattagtccgtgattagccataagtgctacagtaaccacatgtgctaatgacggcttaattagtctcaagagattcgtctcgcggtttccaggcgagttctgaaattagttttttcattcgtatccgaaaaccccttccgacatccggtcaaatgttccatgtaacacccaaaaattctcttttccctaactacacatacccttgggagtgttcgttaggtggagataggagagattgtctatcgttttccgcgcgcacgcttttcaaactactaaacggtgcgttttttgcaaaaaatttcaataggaaagttgctttaaaaaatcatattaatccatttttgaaatttaaaatagttaatactcaattaatcatgagctaatggcttacctcgttttgcgtatcttcccaatctcctcaatccccttctcttcaaacactccctagtcactttcggatactaaggaagagctacggcttgaacaaaacgcataatttccagtcttatcctctattcaactcctcattgtattaattgctgctcccttcgtttgaagttaaaataattatagctatatattattcagataaaaataactatattttagaatattttagaacagagaaagtagaaaggagctctcacgtttggccataccatctagtaactatgtcaaccaatagatcatacttcctccgtattagccattaaactgatgagtatcggtaaagaagttataaaatctcattacaatgcgtgggatgcgcgatatagtcattactatattttaactcagtgttgtggaagattaagggcggttgcgcaattgtcatgtatctcgtgtactgtcaatcataagtttcaattcatctatacccctttaaaagtctttaatattggttgcaaagaatttgccctcttaccattgcttttgtagtttttagaaattgcatcattatgtttttcatgacaattgctctatccatatttgaatatatgagattattcggttatatctttgaaaatttaaccgtcaatagctctaaaaacagttagtttgaaacacataacaatcatatgggaacatttttatttatatgtagttttacaatataataattttgttacttcctcaatcccaaaatatagctatctattactccaggagtacaactatagatcaggacaacttggtagctatgagccccattggttgtcctaataaatcaaaaccaaagccagaacttgaatttttaagttgaatttaagatattttcaatgtagttttttatattgggttttaagtcgctaataacacatatataaaagtgttacctataaattaactttcattctctaataagttgtttttggcttattatgatatatgtgcaatcgatgaggtcttatattttgggacggagtatttaaatagaaaacaataggtcaaataagtctcagtaacacctgagatcctgggttcgattccccacgggaatgaatttttcaggatttaacggtattgtgctttcagtggtaggcgacgtacctgtcgacagcgagacgcctgtggtgacttcgtcaatcctaatggatttgccggcccagtcttcggagatgctcataggggtagggtttgcgtgtgtttatagaggtgagtgcatgtgcgttgtgagtgtctgtgttgtactgtataatttttttttaaaaaagaaaagatagatatggtttacatgcactcttgctcagagattgaatttcagtggtgctgtagacctgtggtgcacaccatatccaaattaccatcgtccctactacagcactactcctttcttagctcactgtcggtgggtccacatgacaaactgggcccacctgtcatacgagcgtctcaaatcggtaacaacaaactcgctagcctcaccacctcaaaactcaaaagttacccagaacgctccccacgccgctctctcgtcgtcaagtcgcatgcctatgtaaagcagagcgaccaaagaatccaaggaggccaaagcgctctctctctctctctctctctctctctctctgcttcatcagctccccgtggcggcgatggcggctcagaggaggctgctcgccgaggcacctccgcaccagccgcacccctcgcggcaccagcagggcgcgccgtcgtcggtgtggagcgccgggtacctcaacgggtggctgtcgcagcgcacggcggtgttcgggctccgcctctgggtgctcatcggcatcgccgtcggcgccgccatcgtgctcgtcctggtcctcgtcttcgtctgcctctcccgccggcgccggcgccgcgatgacctcgcatccaatctgtacccggccgacaccaagattctcaagcagcatctccagcagcccacgccgccgaaggacatacaggagatcgttcgccggcagcagcggcagcagcagacgccgacgccgacgccgccgcagccgcctccaccggcggcgcaacatggggtgcagctcgccaaagcagagactccgccgccgccgcagcggacgcagccgccggtgctaccggcgggatccacgcggtcgacggcggccagcggcatgtcggccacgacgagcggcgggagcgagcgggacggcgccacgccgaggagcacggcgagcggctcggctgggccggaggtgtcgcacctcgggtggggccattggttcactctccgggagctcgaggaggcaaccgacgggctcgcggaggagaatgtgatcggggaaggcggctacgggattgtttacaagggcacgctgcagaattccgccatggtcgccgtcaagaatctactcaataataggtactaatcctgtgccttctcttggagcttttcgatttgatttggacatctccagcctttccatccttgtatagcctagaattcgtccttgggtgagtagaaaggatggagaatatagttaggaatacccgtttttattttttattttttaaagaaatcaattttccctttctgtttaaactggggtgtgtgatttcgtttgttcgtaaaaatgccactgatttcgtctgtttaaccgtgtttgtgttcttgttcatcggtttctttggctgtttgctccggttgtattcttgttcatcgaattgatacgcagatctctaatcttatcttcttctgcgataatgggttgttggacttggatatgatcagtctgatggaccaggaagtgagctgtcaaaaactgtgaatttccatttgaagaagggaaagatccttttttttttctagtgtatttgatcggattttttgtgcatagaggtgcaacttgtttcagtttattcatgaagcagtggtctgctggtgaacggttgggtcgtggggctcaagaagtttcaaattgctgtcatcatttacctcttctgtgcgcccatctccattccccattcgcctcgatatctgtgacgcaatttaatcctacacggctttctagggactggattaccgtttcattttctcacacattttcttgttctgttttatgacaacaaaaaatcaaattgttttcctgctttgccaggggccaggctgagaaggagttcaaggtggaggttgaagcgatcgggcgtgttcggcataagaatctcgttagattgctcggctactgtgtagagggcgcttataggtacaatgaaatctcttcatcaattttgtgcattattattccctctctgattaatggatgttttactcacattgccgttttggttgaacaggatgctcgtgtatgaatatgtagacaacggcaatcttgatcaatggcttcatggtgatgtaggggaagtgagcccactaacttgggaagtcaggatgaacataattcttggaactgctaaagggtaatgcttctctcactgttgcacgccaattttgccaaagtgggtaccttgaacagtgttatattggtatgccttgcctgattctgtttaatacttcgacattaaagattatgaatattatgggcaaatataggtcatgatcattcagattttagaagacaggtgctagctggcatgggaggcttgttttgttgtgagacatgcatcatagttaggatagtagagtctaattctggtgaaattgattgtcgtaggaattcaggtgctttactcaagtttgttaggttgtgttccttagcatgcacatattcccaaagacagctgattctaacccatgtttagcagatacgaaaaaaaaaacatgtttttttctttgttagcattaggcatcatttggttgttcagaaaacaattagaatttcatgtgcatttaaatagtacaaacgccaaagtaaaggtgtcgaatttcttggacattgcatgtgctcatcttgcattcgtcctttaattgctttcctgttgccagcttgctttattttaatcaaagcacccagtctgagattgttttgattcgctctatagagatttaagatactgcatgtaaataactaaatacttaccttgcacatgcgttcggactagaacattgtgaccctgtttgacagttaaaatctagattaaagcatcatgtgcattgataagcactctaccgataatattctttgcctgaaagcaatattgtcagtggcttgcttaaacaacatcaacagttcttttaaaagatgggtttgatagggaaacacatgaatactgacacccaacttctgctctctaggctggcctatcttcatgaggggctggaaccgaaggttgtccatcgtgacatcaaatctagcaatatccttcttgaccagcaatggaatgctaaagtgtcagattttggtcttgcgaagctattgtgctcagagagaagttatgttactacccgtgttatgggaacctttgggttagtattgacaatccacacacaacctttactgtacataaaagttagtacatcttatcatgactgaaattggctatgttgcagttacgtggcacctgaatacgccagcacggggatgttaaatgagaggagcgatgtttatagctttggagtacttataatggagattataacgggtagatcaccagtagattacaccagggcacctggagaggtcagtatcctacctattctttcatgaatctcttccaggatcgttggcatctgatggagctaaattgtcttcttttcaggtgaacttggttgaatggctgaagaccatggttgctgagaggaaagcagaggaggtagtagaccccaagctgcccgagaagccttctcccaaagcactgaaacgggcacttctggtcgcccttcgctgcgtcgatcctgatggccacaagaggcctaaaatgggacatgtaattcacatgctcgaaatggatgatctactatgccgcgatgtatgttctactcacttatgaactttttgatttcttccatttactaaacagtatagttaactcattttctgattgcaattgttcatcatacaggataagaaacccggaagagatgcgcctcagacatcggacagacacagctcaagggatggcgggaacttcagcaagcgtgagaaccaacggtacagatgacaacagcccagcactacagttgaacatgagtttgtatggattgccattagggattgccaatattaaccatgttgtcattacataattttttcccctctcgttggatctcataaccagctctccttgctcttttgactgtattatactcgagcatcattctatgacacttgacacttataaactacacaagtgtagggtggtgttgtgactgagactgactatgccccagctaatgcttacagtgttaatgtgattctacctaatgcaagtacagttgtctgctctaatgcatcttttaccagtccactcctgataccagctgcctgctttactgcactgggagaagtaatgctttcttcttgtagcctaatggttggtgcctgcttgcacatgatgtcacatgaccattttctgcatctcatctcatctcacacttccatcctgcatctaaccctttgtttatgatcgccattagtagttggctgcagagcttgggacttgtatattctgctggcaaatgcttttgtccactatactgcatctggtgatcagctgcacagcatttgcgccagttcttgtcgcttcgccttgtcttgatctaaatactaatcttcgtttccatgttcagttgctgtgactttttcgtactagtatattcattagttcttttttacagccaaccagctctggatcttgtgctaataaacttgaccgctgacagtactgattaattagcaggtgatgatcctaccatcacgtgaatacgtgatcgaacaactactgtgcaatcaccatgtatgcaatgaatggtcaagtactaacatgataccatgccacaaattagtttgatcatgctgattcatttatttgacactgtacagtctgtactactgaagtggaatagcatgagagaagtttctttcatttttcaacggttagcttggagctactgtgccctggaaatgttcagagatggattcttccattgggaaaaaggttgagttatgacttgtgagttgagagagtagtgcaggacacagcacactagtggccaaaaaaacggcttggaggattcatgaaccgatggcagaaaaaaacaagaggaaaaaaaagcacagcgaaaggttatccggcacaggctgccgcaaatactaaatcttgttggacagagacatttttgggtgatatctgacgcgttcttcaccctttccccactttattcgatagaataattgaataaacattcacctatcttgataatgcttaatgccttagtctaattattgcacaaagtctctcaacaacctgaaagacgcagctaagcctgccactgccgttgtgatgacttgtgaacagctgctgctgcttcatcaagctgataatgcacaatcatatgccatggtacaggtacacgcattgtcgaggtctacgtccacatagcttcaggcgatctccgtcctgtagcgtagcgacctcgtgaacacctgagctgttccgaaatggacgcgagcaatatccacaaggcaccaggttgtcgggttgccgccgttggggttttcccggtgggccagtcgacggcggcaacgccacatggaatagaaccagcccgacgtactagaagaaggcacgggcgccagtctgttgcggctagctcgccccccatggcctctggtccagcctttaactcgtcgtgttcacctcgcggttcgattcgattcttcttctgccagcagcccagccttcaccgtgagtgctactatactgatacgttgtgtagccatcgatatgcaccgtccgattagtgaccagacggccggaattacatcgatttcgatcatgtttgatgaagcttaacattctaaaaagacaatcggttggtagtcagtttatagaaatatgaatctactagtttttttttaattatgcaattgcaacttcttaaatttcaaataaaaagctgaattgtttcgaaaggttttgttttaggagaagtttcagctaccagaaactctctcaaatatgcccatagcccatccgcagttggccgctgccgttgttacggctcccgtcacgcgcggtgtctctcacgtcctctgcggcggccgctgctgcttagctggatagcaaacgccgagccgtgcacgctccgctgccatggacagcgactcgcgtcgcgcagcacggcgccacgagcgcacaacgcgccgggccagcctcacgcgcgcgcggacgacggcgttccactggaactcggtctttctcacgagacgccgacgccgtcgtctactcgtcttcgttcacagatggatagggaaaaaaagggaaacaaaaagggcgacgcgcgtgagcttgcatgattgatatgtaccatactaatataatctgacaaaagaaggtaatgctaagagataagagaggcaatgatcactttcagcctttggaaagctgacgctgaggcaattatgtagggaaaaatggtttcatcaagttgtgctagtgtcggcataaaagactgcaatagtgctagttccgtatcaaaggtgccgcactgacactgaggatgagggtgtatgtacatgcatggggagctcttttgatcaatcacacaagagagatgatgacactactagtaagcatatgcctgaacaagcacacacacatacatacaggtagtatgacatgcatgctgtcagttcagcagcacaagagatgccggagagaacaacagctgcgttttagcttctaccacttgcagttgcctggctaccaccaccatcagagagagggcctcttggttgtttgccgttgttctgtggggtcaggttgtctggtgcagctctctttggcctcaactacagtcaagataaagcgttgataaatagatgttccatactgatttatgtaacctttgtgagagtcttaggctcttagcagcgcaccttttcctcggatttttgataaaaatgcctcaacaggatgttcttggggtctgttgttatcactgcgattccagacacaaacggtcagggaaatagtgaaaatagcaacaaaaaaaaaagaggtgatttctgtacagtaaaaaagaaaacttggaatagttggggtagttctggtaggaatggacgagagcccagaaagaaccaaaacgaggtaaagagagcgagcaactatcgagtctgatcgactacgaaaatatctaagagcaggtacaatagcaggctattagccagctgtaaacatattttaatgagagaaaggatgagagagaagagcagcgggctatagatctgtagccagctgcatcgcggactctaagacgcaatgtatgtatgacaggtgtgaccatatattaatagtatagtaagcaactattgtatgaattggctattagattggctatagatgaattggagttagcagtgggctatactattaaacttgctctaatgaactaaagcactcaagaattcaccactatcagaagcaatatcccatgcacaggaaattcaagagggaataggcagcaaaaatacggaggggctgttcagattgttgccaaaataaaccttacctaaaattttagcaagttgacaatattaccaaaattttggcaggatttcttatgtatttaccaaaatttggcaacaaaccaaatgtaggcacatttttggcaactttgccaaaaaatgatatggttgaaaatggcatcaatctgaacagcccctgaataaactggaaactaaggaactagctccatgcctgcaacggaccaatgaagtacaatgtttacatagaatatctaaaaacaatgttctttttttttagataatggaaatggtttacatctttggcctctgccaacaggcacacgggcaatgagtcgagaagaaaaactgtgttctataaatgtaaccatccaaatcatattggcaatatggcataaacagaacacttcaataaaactatgttggcagcactagaggaagatgactaatatgagaggttgctttggttggccagttcatttgctccttactaataaattgcccagcttgcctatagttttctttcatttttcttttgtggagatggtaagcagcatgcaatcaattttttactgaatacctgtacctgaaatctggagatagttcagtggacaggcctgaaagcaaccaggatgtttggtggttcggcctggcctgccaaaagattaggctaggaggaaaaaaaggacttaacagaatgctcatacaaaattgtaataggtacacatagtgggtcagagcaaagtctctgaggcgaaaatactaaattatgttgattcatcattaggaaactccaacctctagtccaaatagatgttgctctagcatgtgttattccaaaatttgattgctaaaattataaaagcatttaacttatcaaatcaattcaaggggactcaactatgaaggtgtaagatcaggtttagttggtctttccagtttgccggctaggccctggctctctgactctcaaccttttctgctctccctcataaagtcatactccaagagaaaagtttgctttgaagctataaaaaatgtaccagaacaaaggtcgtaagggaactacttgaaagtaagctgggcaaattagccataatgtatgtgagttacatatcaagaagccaaaactacagtcctagggaatgcaaaaaatattgactttgaagacatatctaacagtccaacagaatctattcatggatctatcactcagaagatactaaagaggctgcattactgaaaacagtatagatgattggagttaaatatgccagccatgaaaggcaagatagtcactttttggctcagaccaaacaactcagaggatctgctatgccatgtagagtactactgtaaaaggaatttgatgcaatgtgaatgagcagtcacattcaactatacacatttgaacgtttaggaaccacacactcagaagtgaggagcagcacagggaaatcagcattggtaaaagaaacaagggagcaagataccttgaccgggaggtggatccgtcctgtgtgttgcaatgtaagtggctggtacgacattctgaaacacaaaaaaaatagggataagtattggcagtttcgcaccaatgcaacatgtccggactccagagaataagttaccagcttgatactctgacgagaaacacaaatatgacaaactgaatatatgctttgcaaattacaatgcaagtggctgcctggaatgacattcggagcaaaaaccgactagtaattcatcaccacaactgaaaccttaaagggcgttggccatgagagaaaccaaatcctaaatgtataatccatgattcacaaatacctcccaaatgagatattatgatccaactatttggcattgggacttagaaacaaatagtactaaccaccttttgttaatcatgcgcactggaatttcagacacacgctctgacacacaataggactgactagaggtaaagctccggcgtgagggatcaggcacacaattcatggcatcatcaacacaatcaacctaattctgaattgtacttggcggtcggaggcatgagatcacgacagctaagcacagagatcgatcgcgagtgaggggggacagagtcacagaggggctgaccgaccaagggctgcgcggaggggtcggcggggacgacctggctgaagttttgcgggttgtaggacggccagccgcccagggagctctccatcgccgccgcggagctcgccgtgacgtctccgactccgactccggcgacgccccctcttggtttctccacccttttccagcgaccatggattcgtggaggactataatggagcacacagagtcaacattaacttttgggtttcggcccattattgctatcttttgggccttagatttcactggccaaatgggctttaaggcccattttctacctatacatttgtgcttagcgttgtcttgtgtaattgtgttattatcagataataccacgattatacgaatgaattaattcttttagataatggaatgtaacattccagtctttactcaaagagttacagccaattattacagaactcacacagaacaaaactcacatagaaagttcacgatagcacaaacaaagctaagcaaacataaactaatacacaccaacagaagaaaaatatgccataactattgaattgtattagagaaccgccacccgaagttggcaaatatatgcataattgtcgtcaaacgaatgaattaatgaattaagacagacaatagtacaagattcataagttctttttttcgaaaaaaacaaaacacaatacaaccacgcacgttcaattacatacgagcccacttaccaaatgcatacatatatacataccctatccgtataaccacctttaaaagtatgtcttaataatgacaaagtcaccacaagcttctcgcactcatcgaatgtgcaggtaaaaacgcattcgaggattggaccggtatattttaaaattgataaaatcatcaccgacgttttcctatcaacgtatagattgtctatcactaaaatagtatatgtactaagtttgcaacttgaattcagatggtgggttcaaaggaccttgccacaaccacaacccacaagggacaacaaggttacccgaaaatgtgagttctttaaaagcaatgagttttgtttctgtaaataggggtgatagatccatgatctattgttgcaagtaaaccgcaagataagattcgtgcaggagccgtatccttagacagatactaaatcaagtcagggctagctcagagtctcgatcattaagaagggacaattgccgctaatccgacagcgatcagtagcctgtcctttctgttaccagtcgtgggagagttcggattctccacaatttgtccaaatggagtggtatatcaaggtaagctgaagagagaggccggcgtttcatcatccattgttttttttcctgctgtatcgaatcgtacaaagaaacaaggagacggtctctttctagtatcgattaggctgtgacctcccataagtgatacaagaaccggcatgctgacatttcaagaggatgcagatgcagactgaaaactgaattattgacatatatgacgacatctatgtacgaaaaccttgagcaaattggctaagtgaaacagcgaaatctaagatctttttcggcggattgatggcgtttcgagggtggccaagggcccgtctttgctgttggttacggtcaaggtataactgcttgcgagacatcatggactattctgtggccatcgatgtgggggtgtttgtgtgagtgatgtgaagatgctggcgaaagccttgccgggtcttgggccggttcgacgacgacggcgcccatgggcgccgtttcccttcttggaggcgttgtcatggcattctttcatatccccacaaatttctaggtgaaaacctccttccgactttcgaacgagcggcggtggcgttacacgttgtgtcctccttgggggcgtcacttcggagaagttctaacgcatcgacgactgtcgatagtctttttcggttcaaaagctttcataccttttgttcggtgaggccttcgccttcttgggtccgcttctttcttgtggtgggcaacacgctcttcggttgtttctgctaatgaagtcgaagctgcttgctgatgggggtgcggcgacgctcggcaatgatgacatgttgcagtctcttccaaggagctctggtgctggccgtgtgaaggaagttgctcttcggtggcttggctgacgtccattgttggatgtcggagctacttttcgctttggtgactttcgtggcttcagtgttgctgcagttgtggagtcggcgctgctaggtcgcttgggcggctagcttagcaatggtaacacctcttctgcaatgtgggagctgttgtgtcgcttttgtgtttagtttggcagtgacgtcctacgattaggctccgccgtcgttgttagttgtgtagagcggaaggttttagctggttttcctgtaattaaccgtgcagctgtatggtttttgggcccggttttccttataaactgggtcaattttttttttctaagtataacagtggaacaaagttcggcattaggttaaaaaaagatcttttttggggcttgcgaggtttggacaaattttaacttataagaatgtatttacatattaatctgtaataattttcaggaggcttttccctcctaatgtagatagagttaccctcattattatttgatggcacatactgcactagtatatatgataataaatgcagacatgcaaataaacagttaaatgtgaagtgtatagcacatgtaagtaaagtaaaaaaaaaactcaaacctgcactagtaaatgtagtagaacaagtatgtaggagcaaagtatgaaagttaaaatgatatgtatacatgagaacagggggagtagtagtggctcaataaaacctccatgtttagtccttaattagaagcagatgttgtttgagagagataccaatcacaataactttaataacattttaatcctgaataacttatacagtttcatgctgtatatcttgcacgactggagcgatgaggactatgtgaagatcttgacagtgtgcaaaaatgctatttgttaaaaaaaagcaccatgaaaaattaatatgtatgaagctatgccgaaacaataaacctaaataaatgcatgcctatccatataaattttaacccgctgacaacccgacaatgagttactgcatctatcctaaaatataaaaaaattaggattaaatacatgtattacgaaagtaggcagaataccaataataagttatcatctcatccaaaaatataagaactttaggattgagcacatgtattatgaaagtatgtagaattaagtaagagaaagttgtgattcattgagaaaacgaagtaggtagagaaattaaattaggaaatgttattattggttaaaaagagtagaactactattaggagcgctagagcgtggaatattgttcatagcgccaaacatgcgttagcccaggcccaccccaccccacgtcccgtcatcccactcctaccgatccgagtaaattgtttactccgatcgggtgcctctaccacccacctttatttgagtaaacaatttacttcgataataaaaacaacttccatgctttcgatctcaccccatgtcccgcatcgtgcacccaccattatcggagtaaatgatttactacgataaaaacaacttctctgcttccggtatatattctatttttcccgtacccaaccaaccactctcgcccccactccgttttttccttttttttggatctgaatcgatccaccatcccagcccacagatcggcgacacaccatgaaggacgacgacgacaccgtggtggttgatggcggtggccggcgagcagtggccggcggcggttgaggtgaaggcactacttcaggcctcgctgctggacgctaggcagcaccataaccagcaaggaggtgttcacctgagccaatagcaacaaccagcggctactccacgtcggcgacattgatagaacaagcaagtaaggaaatgacactctaatttgcatctgcatactctctttcaacttcacgcatgaagccctaattttttttgcaaatcaaattaacatgtaatctccaatattacctgatctcaattgataggctgcacaggtcctacatttgcacatcgtgctccatgtagctggccgcagaggttaaggtggagtccaccggtgatggagattgtttgctatttttcttttgctcgtcatctgtattgacatgaacgagaatatttttacatttttttgtgcttgttagatgatggatggctgctactgtgcaacgtcaagctcaactctataccacaccgctacattcttccatgattccatgatggatttttggctgaatcattttttttcttttctagtttgattcacctgtgagtaattttatcgcttgtgtgtgattgagcctgtaatttttttcattcatacaactattttgtgatacagatcaacaatactcttagtaccagtttttattcttatactgtatattgaacacatcagtaaacatattactacatggtggctatgagatcatggctatatcgagaggaatgtggaaattgttttactcgcagaccacaaaatctaaataatattggtaaaagaattactagcgttgtaagcttgtagtaattcttttacgaccatttaggtatggcgtcatacgatgtggagacattcatgagaataaatttgttactttagaatgagcagatgtgggaggctgggagtaaatgaaaaattccacggagtaaattcgttacttttcaaacgtgcggagatactagaaaaacggaaaactcggaaagaaaaactagacggtaaatattttactaaaacgcgaaaacagaaaaactatagagaaggaatgaataacagaaaaatctggatggttaatattttacctggaccattgatgaagcacatataagatggaaaagagaaaaaaagaaacacggaaggtggggtgttaaaaaacgaaaaaaaacgacccgagaaaaggtgggatgcggaggaaaggtggggtggtaaaaaacgaaaaaaccggaagtagaaggcggtgtgcagcgctcgaattattattccgcgctgtagcgcgtggaatagcgctaccgtaaaagagagtataagtgaagatgttgcaatattttaaggtaaattttaaatgctagaagttgttatattttagatagagagagtagctaaagttatttcctttatgtaactatacattgagagcgttcatattagccacaatatatcttttattaagagaggtcaaagatgattcatcacaatctctttaaagacctatagatgtcagaacaaaaataagaaaaaattaccctgtaagatcatggtgagttcatattataacggtatagattcatctctataggtgtacaagtataattgtatctaaataaagacatgctaatagctgcatatcaaacttaattcttttttatatattttatctatataacatgagttaagagttgtttatctccgattcaattttaaaggtatattcctgtgtaaaattgtgtgaaaaaaagctagtttgccaaaatggagcacatggggctaagctgacgagagaggccagcattttcatcctctactattttccaggtcttttgaatcgtgcgaagaaaaaaggggatcgtctttttccatggatctgtaagtcttccatatacgcaccgtcatgctgacattttcagtgatcggatgaatggcggcatatatctgggaccaaataaaacctggtgcaaattggctccacgaaagccaagatcttattcagagagtaatcgccatggaacatggtgagattggcatatactatgtaagttggacagttggtcgatcaagtcatcaaacaacttacagagaagataaggtgcgaatcgatgaagctgaaccatgagtgcaaaaacgttcgtaaagtgtattgacgtacattcattgaattttcaggggaaatttgtctctaaaattgatgaatcaaacatttgaaaatttcagagaaattttccagggaataattttctctaaacttaactgccaacgtttggacagttggtcgatcaaacaacttccagagaagataagatgcgaatcgattaatctgaaccatgcgtgctaaggtttgtaaaatgtattgtcaaggattaattgctaacctataacgtacattcattgaattttcagggaataattttctctgcttgcagacagtcagtaaacccatttatgaatacttgatgtacatgtcctgattcgttctcttctctgtcaatgtggatgatgtattgatgtatatgtaagtataacagggtcagtctaaaattaaacacaagacgactttcccgacacgcttacgcgcgtcgcgttgaaaggattcaccgacttattgactcatagtgcaaatctaagtggcatctgccttttattttcaaattagtttggcagctgaagataaagcttccggctaactgctaggttatggggctaataacacacgagaagataatataactgaacagacaccactaactacagaaaaggttgcacatatgcaaatggaaaatgacatgccccattaccagcactgtgcgtgataaccttaatatacccacttatccctctatttctttcctgcttcaacgtggaattgggccatgcacgttgttttcatggcctaatatgtttcctgatttgttaatcgtgactcaatcgctgaccaagctcaactctgatattgaccaagttaggtaaagtagggtagtatatcttagatacactcgataatacagtaatacaccgataagtggaatgtgatttcaaccctaaaatttcgtatttaattctcaacacgcttataatttcttcgtgaaacccttccaaatctcattttaggtaaagtagtgtatcaagtaaaaaacaagccaaaaggaaaacacttgttttttttagtttgttcgttcgatgatgaagtacccacgttccactccaacagaagaggccaaactaaagatcaggcatgctgtcctaagagaaaatcgaaggtcagactgagtcctacacaccaagggtagcttctgaaacggctgggatgatgaacaaaagggtgtcttttgtgcgcagcatctaccggccaatattcctttgcaggcgtgcgcctggtgattcaccaccagcagccaccggattctccgccttgcaacccatgcaatctcgagaatatgctgcatcatgaaactattcttaatgccgagaacaacgagagaatcattcagagttcagacatcttttcgacagtcatatgctagctcctgctattagagcaaatttaatagtatagtccactgcaagcttaaaatcatctatagtcaatctaatagtcaattcatacaatggttatctagaaatgtatactacactattaatatttggtcctatccgtcatacacacattgcgtattggagtccgtgctgcagctggctacaaatctgtaagagcaagtttaatagtatagctcaatacaagctcaaaatcatctatagccaatgtaatagccaattcatacaatagttgcttaatatactattaatacctgattctacttgtcatacatacattacgtcttggagtccgtgctgcaactggctacaaatttatagccagctgttcttctctcttcctttatctctttaaaatatatttatagctggcttatagcctgctattgtacctgctctaagagtaagtataatagtaggctataaggtggctaaatgctgaggtggaggagagagaagagagaggagaagtgggctgtaaacttacagccggcttggatacaagaaccaagaaactctgtgagagagacaagcgggctctgtattaattgtaaagagctaactattatataggcaggctaagagaaggctacaaataaccttatagccaacatgtcggctgtattattagagcaagtacaatagcaggctataagcaatctatacccacatatcaagaagaaaagagaagagagagaagaaagcggactacagatttatagccagttgcaacacggactcaaagacattacgtgtgtatgagatatgagaccgggtattaatggtatgatatatttttatagttaactattgtatgaatgagctattagattagtaatagatgatttggagtcagtagttagctacactattgaagttgctcttagccttgctctaacccgctttcttttctctcttatcttttcttctcgatacgtggttatagctggtttatagtctgctattgtacctgctgttagaagtattctatccatgttcacgtgtgctggtggtgatcatgtccgatcccagctcagatgggcctaaatgagcgtgcaattcttggtcctcggaataggagctgtgcattgtccataggagtacttcatgattagagagtattgggcgtgatcgaccaaaaaactacacaatctggggcatccttttcttttattagaccgatataattaaccatgcatcatgcaatgccaagtgcccaagtatattgctttcaccacaacgagggttcacgctttagcttttgtcgcgctcattcaagtagcaccatccacaataatcaaagtaactttccttttgactgaacctgtcgagagtagtaaaaaacagagaccgtcacgctgacgaccagcgggacagcaaccgccacgtgggcccccacgatgccggtcggtcagcagatcgggcaggcgagatttgcccgcacgttttgccctcaaacccctgatagtacgtgcctttgacagcaaaagaagccgtggcagatcgacccaacaatgtgtcatcctcctgcccccatcgcacacagaaccccccttgcgtgaattgcatcgcgagaacccgaaacgcctcgtcggtttagctgcaacgtagattcaccgatcgatcgatcccttccaccacgctccactccaccgggggaggtaaatccacgggaaaacgggtgtagtgaagcgagcgaggcgcgcaccaaccgcagtcaccaccaccggcacccaacacccagacgcgcggctccccggttgcgccgcactcgggctgtttggatggtatacgaagtttatcatcattcatcatactttttacgtcacatttgtttaagttgtggcttacaagtgtcacactttagggagttaatnnnnnnnnnnnnnnnnnnnnnnnnnnnnnnnnnnnnnnnnnnnnnnnnnnnnnnnnnnnnnngagtggcaatcaaaccacc

SEQ ID NO: 29741 - DNA, 784 bp, Oryza sativa
  unsure (1)..(784): unsure at all n locations
ntaaatgtaatctgtcccattccccattgacccagaataagcaatcatagccgtgaagcaagaaccctgttttagtgttcttttttcctttgccagactaggaaaaatcccttcataagcgtgtttgattgctcctgaataattttagatgaagcaattcaattcgcttcttagtttaattatttcctgctaaactaattgttttctgaatcatattttacaaagaaaaaagaacagaatttaattggggctgaaacacagcgaactacttattgtcgcagatgaatgttttgagttgcattcaactaaccatttccttgtttctaatgcaaaattagctataattagaggatgcatagatatgcttgtgttttccactaatgccatgtcttaatttgattcatgtccatctttccagttgttggattgggtactcggaaagggccatgttgcacttatgaggagagctgagctaaagactttagtcgatatgcatggtaatgaggtaggttttattcttattctcttatgcatttctggtaagttgtagctctttacactatgtagtttgcatcaatagtggttttttttggttgcaacagctgtgtgcggcgtccaagagttgatctcaagaggccatgttctatatagattctagacaactttttatgacatgttatagcaccttaaatgagnnnnnnnnnnnnnnnnnnnnnnnnnnnnnnnnnnnnnnnnnnnnnnnnnnnnnnnnnnnnnnnnnnngcagtggcatncatgtcagggn

SEQ ID NO: 29742 - DNA, 784 bp, Oryza sativa
  unsure (1)..(784): unsure at all n locations
ttcttatatttaaaataagtattgcgtaaactgtaaagagaagaaaaaatagatccagaaatccaaatnctgaagctatgggagcaaaccacccttcctggggtcgggtaactttggtaacttcattgtttgttggtttagcttcctttggtgtactatctggtgaattgcttacatcatcttcaaattctgctacaccaaaaatgttatcaaacaacacctaacaagatgaaaataagaactatacgcacaaacaccgtcaggtaccttttatagcaggagtagcggattgctgccaaagaagatgggagcaacgatcaaatgacaagaaaaagataataggaaccaattaggaactgaaataatgaccaatttatacatagagcaaacaaagtaattgttacacgccataccactttcagtttctttagtatattgtcaaattgggtggtgtcatatacccatttgttatgaggactgtctacaccaacacctgcagaaacgatcagattaggtttaagagagcccacgggtggttaacaaggatatatatccttacaaatagacttctaaagtagaagatctatatagaaacataccaagagtgtcctgcttgtttttcactctaacatgccccttaatgccttgcttatctttaccaaggccttcaccttcttcccacccctaaagcataatnnnnnnnnnnnnnnnnnnnnnnnnnnnnnnnnnnnnnnnnnnnnnnnnnnnnnnnnntgtcaagctggagttgcaattcatccagccn

SEQ ID NO: 29743 - DNA, 792 bp, Oryza sativa
  unsure (1)..(792): unsure at all n locations
cagctaagcgtttatatcaagtgagaaggtttcagatatgggagtcatggcatcttttgcagtcttttgagtcatctccaaagctcctgtaatgatagtggtttcatcatgagtcagctctccacctttgccagcctaagaacaagtgaaccagcagaagtttaatggtattcatatttgtctgaggaaagcaccaatagctattgcaaacacaagtagcccagagaatatatgtatattagagccagaagaaaatattcaaggcatgtagaaatgcccaatcatattgtccatatagcagcaaatattataaccggactcatttaaggtgctataacatgtcataaaaagttgtctagaatctatatagaacatggcctcttgagatcaactcttggacgccgcacacagctgttgcaaccaaaaaaaaccactattgatgcaaactacatagtgtaaagagctacaacttaccagaaatgcataagagaataagaataaaacctacctcattaccatgcatatcgactaaagtctttagctcagctctcctcataagtgcaacatggccctttccgagtacccaatccaacaactggaaagatggacatgaatcaaattaagacatggcattagtggaaaacacaagcatatctatgcatcctctaattatagctaattttgcattagaaacaaggaaatnnnnnnnnnnnnnnnnnnnnnnnnnnnnnnnnnnnnnnnnnnnnnnnnnnnnnnnnnnnnnnnnnnnnnnnnnnnnnnntcaatccatcg

SEQ ID NO: 29744 - DNA, 767 bp, Oryza sativa
  unsure (1)..(767): unsure at all n locations
ccgggcattganatgcanatcgncaatccnnnnnnnnnnnnnnnnnnnnnnnnnnnnnnnntattgtgggtgctctttgggaagtctcaagctagggaagtgaagccgaagggagaggccaggccaggtcggccgtgtcaccggacgggcggtttccgagttgacgctccaccgaatggcaccgtcccaagacacgccatgcccccgcccgtgatataatcgagctgaattgccacagctatcgtgagtgtgagtgcaccgctgccgcagcggcgtcgtcgtcggaactcgaaacacagcaacggcttggccggtttcccgtttggtgcccagaggtaaccgtacgtcggaactcgcaactcgcaaggcggcttttgcatgcaactagcgtgcagaattcgtgtagaatctggcccgctgcgtacgctgccgccgctgtcctcgtcccaagaaagaggaggaagaaagcttagccagaataatgtgatgcgaacacacatcatcagtatttgtactggagcagtagtagtagtagtagtaatagtacagtgaagtactggtccactatagatactcccgtccccatcaaccaggcgcaaagcttcggccgcctgaacagtgaacacgacgagctcgatcctaagatagattcttcaacgtctgttcggttgcagtcttgcaaatgggagagcctcaacttttgactatgtttttatttaccgagaatgagatgcgaattttaaaacgtgtagacgccaccaaaccct

SEQ ID NO: 29745 - DNA, 747 bp, Oryza sativa
  unsure (1)..(747): unsure at all n locations
gtgtgtggtgatcaactcattcngcacgcctgcaggtcgactctagaggatccccatgtggtcctcttttctttatgtgctaagtccgacagaacaattatgttttgatcaatttatcatcctattagttgcactccgggaggcgtttactaaatagactgagtctacctaatatatatagggaatggtgaagcgggaaacttccttcacatctcaatgtacaccacaggagatcatgtctaaaatagaggaagcttgtggacctcttggtttcaatgtgcggaaacaaaattataaggtttgtagcattttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 29746 - DNA, 716 bp, Oryza sativa
  unsure (1)..(716): unsure at all n locations
atggcttgaattgcanattaagttcacgtctcctatacggcgaattcgagctcggtacccattaaaaagacaaatcacgcataaaatattaatcatgttttatcatctaacaataataaatatatgaattataaaaaaaattatataagacggacaattaaaattggacacggaaatctagggtttgtcttttttttgagacggagagagtatggtacagtggttcatgccatgtcaatgccggcctcacgaggacggctagctcgccgtgtcgaccgcgccaccgcgaacggggcgtcacggcctgaaactgcaagtgtgttccttattctcggttagaattcagaaattactgtatttcctctgaaacctctgcaggtgtacgtacgtcgtcgcgcttggtcggtgacatgaataactagtccagtacgtagtccgtacgtacatgtacgcggatgatccccgtgctgcgtggtccgggtgcagcacgtcatctccggcccagccagcctacgctcgtgacaagtgttgctcgatcgttcgttgcaattgaccttggagctagccggtcgggccatggcttcgcttaagaacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 29747 - DNA, 4500 bp, Oryza sativa
  unsure (1)..(4500): unsure at all n locations
tttgtaaaggctaggttttntgtagttattagagactgtacatcatcagtatatgtggtatctgcattgagaaatctcagaatggactcgtgcctgctgatgttttgatttgatactaacatgcattactccactaacgaatcgagtattatcttttgggtgttattttgacctttcttgagtacgctgtaggaaaacggattgcttcatgtcccgaaagaggaagcacagaaagctcaggctgccatgttttcagatccaaacatggccatggacatgatgaaaaacaacctctctatgatagttcctcaggttcagtagcttacatttcaattttcttccatcttagctaccatggctctgtttactaaacatgttgcttcaatatttttcagacacttacatttgcatgggtgaacttcttctttttgggttttgttgcaggtatgcactttatagtgtatgctactgtggtacctgttcttctgatatgccgattccatgtttatatatttatttaatgctgcttcaaaatcatcagtgttaagtattaactagtataaaaatacatcaccattcaagccttggcaaactgatatgatgtgtactacgttgttctcatgtgagatctgtctttttttatttgaggcacaagtgcattgaaatggttgtcatgtaatgcactggtggatcccctgcctggtggccccaggcagccgcccgggttcgtcatgattgcgcagtgaaattttagtgttaacttagagatttaaaataatattttcatagcagacacttagttgagatgtacttgcccaggctctagaattgctattgggcattgaagcttcagtcatgctacttatgttaagaaaagtatatccaggactgcctggaaaaaagtagatatcatatttccacgtcgatgtttaacctgtttactcatcaaggattaattctccatggaaattatgaagtatattttttttcagttaatcagattgccttgcatgaaataaccttatgacagtatgatcattttagcctggatatatactgaagttatcccatctcctatagctgcatttggaaaattttagtttaaaatattgaggtacatcatccttataaccatgatcttccctgagacgagaagtttgacaacaactaaaattctacaagagtgaaatgtgttatccatgattttgaattttcagatatgattgaatggttgatgggtttggtatactggttactgataatatagccatacgtgtcatccacttattttggttttgtaatcatatgtacaattcaatggcatgtacttgtgtccctggactcacatatttcctgctctcttttcagctaagattcccttttcattgactccgcgattcaggggaatgctgcaaaacgggatagacctgagtactgttgatgtgagctatgttagcagccgttcatggtgcgtatattttatttttaatttttttggcaaaatgccaggtaaggaatgatctaggttatatatgaatcacaacttctgaagtgctctaatggtttcttgttattatcaggtactttctcaatttgtttggtttgaggggtctcttcagtctgatcctcggtgaagaaaatggttagataacaaagtcactcctatgtggaactttgtcatatttatggattctcttgattgtgctttgttgtcttggagttttatgatttttttttcatgacctgcagctaatgatgatgcacaaaagatgatgcagatgggtgggggatttggcggtaatcccacaatggtatggtgctccccatcttttaatggattcctgatgcttatcttgaactgatgcatataaacatgcattacatagcacaggttcctgaatacaaaagaaaaaaaaactccagttagcatttttattttcatagaccctgcatgttggaccttcacataaattagattaaattactttaagcataggatgtatagcttgaatgagtctgtatgaaaaaaatactttgggcattttgaattattgtaatgatgtatccacttgattggagcgttggccatttttagtgcttaaatgctacttgagggtttcagttgttccattattttgttgcgcaatgcaaattgtaccttcttgctccaaaaccagacataataaatactgcaggggagtggtgcagctcatatcttgtcatattatccctttgatagatatattcagcaatatgcatagctattttaattcctcattgaatagttaggtattttgttgtccaaaaattcatctgaaatctgcttgatgttttacagtcctttggttgtccttttccactattgatttcactaactttctgtatgcatgcatgttataatggttctttgaacgaactagattaacacagaatcatgtcacatttttgaactggctgtttccagggtttggccgcagagaaagacaacctggatataatccagcatgactgggctttaccaaagatggagcatcatgctgaggaagtgctgaggaagcttctgaagaaatgataggaaactaggctgctccaatgcattactacatcttgcaaaatttttgttttaacctgtttattgaccagacagttaaaactttgtatctgtataacttatggccaagaatttccttcagaaagtttatgtatcatttttctgttatacggaccacagccaggctcaatgcagaatgaacaaaaatcttttttcttggcaaagaggtactgactcagtaaatttgattgcaggcttagcattagtaattcctatgagctctcgttagttgcacaatacaatattatgttgtggcgatgtagttttacactggagaatgcccatgcttcccgagcttataaatggtgcaaattttataacaactcttcatatgaatttttcaagtactgttttaaatccacttttcaactttatttaattcattcatttgtagtctcgaataattatcagaaatctaaatcattacgctattcatcataaaataaaagctattcagcacaaatgaacgtggtataatgcccataggatagaaatgcacaatctgaacaaacaagtttatcatttaatggcaaaattagtcagataacaccgaaagttttcgttttggttttatagcaccaaaatgttcttgttcactttaatgaaccggaagtaactttcaatgttattaaagtgaatcggaacctttcggtgctataagaccaaaacgaaaactttcaatgctctgtaacccatttaacctaatttaattcgtcaatatatcagagatgttctgaacaaacaagttcataatttgtcagtatatcagagatgttcgtgctttctttataactttatacagtgacacaatggttttccgtttatacatacatacatacataattacatcactaagtagactataaacaatcccaattcaagccacacacacaacacaaattcttcattcttcacacgcaccgtgtgatcgggccacgaagctcacatgacggggtagctcggcagcagcgcgatgccgcacagcccggacgccaagccggcgacgtcgcgctgcatgaggatgtagccggggttgccccactccgccccccacgagttcttcacgatccagtacttctcgccgcctttcgccgcgccgccgccgtccgtcttcggctcggactcgccgtagcccaccacggtgacgccgtggttgacgtcggcggtgcacggccccgtgtagaccccgctgccgtagagctggaacatgaagctgccgccgtcgacggcgacggacaccggctgcgccgcggcggccctcgccaggtcgggctcgctgctgggcgtcacgttccggtagcccgcgatggcgaccgcgctctggttcagcttcgccgcttggcacgcgccgttcgcggcgtggtacgggtagctcgcctccgtggtcaggccgtggttgccgacgacgaactcgaacgcccagctcatgtacccgccgccgcaccccaccgccttgtcgtcgcagtccacgagctcctgctccgacagcgacaccagctcgccgttcttgatctggttgatcccctctatcgccgccaccgcggagaacgcccagcaagaacctgcatccacgcagattttccatcggttaatctccaacattttttacagggttgaatctttctttaccattgctattgctcacacaccacaatctccttggttcttcacttccaccactgcccctttcttcctccaatctacgctcttcggcagaatatcatcactgctctctccaggcattgctatgtcagcctgttaaaacacaaatttgttgttcataattcactcttattatgaaaaacaaagtataatttgagtgagtgaatatcannnnnnnnnnnnnnnnnnnnnnnnnnnnnnnnnnnaagtgcgtctatcaaacacgc

SEQ ID NO: 29748 - DNA, 1352 bp, Oryza sativa
  unsure (1)..(1352): unsure at all n locations
tttcaatttcaaccattgcnccttcttcctccaaatttacgctcttcggcaagaatataatcaatgcctctctcaagcaatttgntatgtcagccggttaaaacacaaaatttgttgtcaataattcactcttattatgaaancaaagntatattttgagtgagtgaatatcatacgagcaaggtatttgaaatctgagaaatcgtgacatgaggtctaaaccccagcatcttggctctgaactcctcgttcgtcaggtcgccgaacttgttgtcagccagcttgtagccattgctcatgaagttgaacgtctcaacgagctcgacgttcctcctgtacacctcgaacctcctctgcttctcaccggcgtcggtgtaggcgcggccatgcctgatcatccactgctcgaacctgtccagcatgagatcggcgcgggcgagagccgcgccgatggagaagatgagcagaggaagaaggaggagcaaggatggtttagccattgttggagcttggattggagagggagggtcagcaatggtgaacactgagtggtatgaggcgcagcaatgattgcaagaacatatggtttatataatttgtaggagggagtatcagtgataaatcctatggcctgttcatcatgcagagagtgtgcttggagatgatctgttgtgcaagcatataacattgcatatgcatgtgaattgtgctggaaagagcaatggttgcacaagttttccaaagtctcagcaaattggttaacctccagcacaccgatttatcattttactagaggactgaattctgtatagaaactagcacacattgtattcaagtaaaagttttgtaccaataccccacatctgacttgatataggtaagagttcatataataagttccatcataagccgaaaatggagaagtcgggtaattctgaatgtttagaatttacaagagaatatatttttcgatcagacaacagtttggtgtttctgaagttgctaagacactaaaagatatacaaatcatccattggaatggaagtaccatccttcggtccagttttgcatttcagaaagtatagctgctacatctaaaaggcaatgtgcagtgcacaacaagagcagcaactgctcgtcagtggccaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 29749 - DNA, 691 bp, Oryza sativa
  unsure (1)..(691): unsure at all n locations
cgcgcgcccaggtagagacacatcctnnnnnnnnnnnnnnnnnnnnnnnnnnnnnnnnnnnnnttctcccaccgaccactgttccgcgactcggcggctccacctaggccccacttgtcattgttgccattccccgggtcccggacgcctgtggctgccacaggcgatctggaagcctgcagccgcacctccatgtttttgtgcatgaacccatcgttacccccgagcacctctgctgctctacgtgtcacagccaattattataactaggggattccctgcgatttactgcggaaattactaagtaattttttaatgctattttttttataattcagctaggagtaaaaagaaaaaaataatcaaatcttagggcttatcaatatttatcaaattcacactttaatgtaaaacatattgatatgtacatattaaatattaaaaaaatgatagagagatttgtaaaactattgtggaaataatgtgagaagtgatgattgaatatgcttgcatgttaatctaatttggggcatttgcaaatttgccaatcggttttttcaatattgcaaggatgccactcgaatgacagttctagtggcatttttgcaattttctagtggcaattttacaatagtgtttaaaagagtggtaaaatttgcaattgggccccttaaaacatctttttcaaaca

SEQ ID NO: 29750 - DNA, 9445 bp, Oryza sativa
  unsure (1)..(9445): unsure at all n locations
aggatgaattgganattcccaactangatacccccctcgagcgagcttttgcacctgcggccccatcgnggacttggaccggccagcgcgggaggcggtgagggacaccgtcgcctatgtgctccgcccgctggtggacaacttcaaccgtctattgtcgctcaagaccgcctttgatattaaggattacaatatcggcatgcccaccggtaagtacctagagtacgtactataagggggtgaaaacaatcagaagcatttcttgggaaacgtcgacgctcgatcgacgggtaattgactatatttatcgttaaaattactcagtgtcagacattaatctgtgactacatactatacttattgatgaacacatgtacaatttgcgtggttaatttgattactgaaagtctgaaattaggtgcactcatcgcgtgtgttggatgctatcaactcctgaaaatgaatcccttcgtgttcgtcgatgctgtgctggggtacgcgttctacaagctcagcgtcttgtcgtcgcaggtccggaagcaggaattccccaacgagtacatcacccggatcaaaccagtcagttcgtcatctcatatatatatagagaatttaccttgcgtatatacatgcatggacctgaataataataattgaagtgatccacgagagtaatgatttttttttgcagttattgccttaatttttatcgccaaggatttccataagaacttcgtgcccttggattacatcaagtaagaaccctttgcttgctaattccttgaatgatattatgctcacttcatccaaatttacgagtagctagcgctcatatatatattccaagctaggctcaaactttgcacgttttaaaactaaactgttcagattcagataacctacaggcatatgaggattctaccaatatacagttgtataatatagtttgagtctgtttaaatgtacaggcgtacagctataaaaagcgattttctttttaaaaactagagataatttactagtataagatagatttacattcaaaaggacaaggattttctacacctaggtgccacggcacctatcatttacatgcgactcaaatagttatagaaaaaattgaaaaaaattagtaacatcatttgtgatgatacaagtctatatacaaacatgcatgactaaatttaatctacaactagagaaacaaaaataataaaatcagacagtcaatagtacccgtatagtgtagataaaatttgttatttttatttcttcatatatcgatcgaatttagacttgcatgtttgcatagtgtcttatattatcatggactatcttattaaattttattctgacattcaaaattcaattaaacgaccatgtaaaactaaaatatgccttacaaaatgtagggagtgagtatatgttactaacaagttacttctgccgtggtaattgtgttacacagggtgccagtttttttcttctacctcctaacattactcgtcgaagtgcatggcctaaagaaagacgcaagatatcttttgtctagattgtttgagctgcttcaaatcaaggagggcagacgcgagctactagtcgacatcctcttaaccagatgaataattcttgttgcatgattcaatcaagaaacggttaatcgatttgtctggcttaaagcagatctcgtagtcatatatataattattcttgattaacttgttagaggtatgtgtttgagtgccatccgaagggtttctttatgcataataagttcaccaagcttaattttattgaaagctaattagtagcgttttttagtcaattatgtttaaagtactataacagttttcttctcgaatactcgtatatactcattgatgtagcgaaaattgttaaagtataaaaagctgtaatacttaaaaattaacatacaaaaaaaatctacaaatatgatttctatgcaatgaatctagaattttaaaatgatactaatgttgaaagtttttaaaggttcattcttttctaaaactatatatttgtagagaaaataatttctatgctactcacactactacagcaaatatttttctggacgccggaccgttaatttacaggcgggcccgaagtgaaaccgcacagaaaaataggtggaccggaactggaccgtcgccctcacaggaaaatcaattttcgtgtgcgggtcacttaacaggcccgcacgcaaaaataagccgattttcgcgtgcgggcctcctaatctacccacacaggaaaatacttgttccctctcatcctattccaaacattttaaatttccttctctctcccccggcccccttatctcctctctctctctctccccattatcttctcctcactttcgtctcctcttctcactttcctctctctcaccttctccttctgtggcgccgcgcgcctccttcacctcctcctccggtgccgcctccttctccttctcctcccgtggcgggcttggcggcggcgggctctcggcggcgggctcggcgaccgggagcggcgtgcgcgcggcggtgggcgaccgccccccgcccggatacggcggcgggcggacagtagggcggctacggatccggctacggtgtcggcgacgacgacgacggcgaccgcgatggtgacggcggggaggacagtggcggcagctttaggattagggttttgtttttttggattttctttttttttggttttccatttttgcatgcgggcgacataatcatcccgcatggaaaaatagcgatttttgcagacgcttttttacagatggttgaaagatccacacgtgaaaatcgttgcacgcaaaaatccattatgtagtagtgtcaaattatctagttcccttatatatataccactggaaattggcaatttctctatgggattatctattaaacatttgatagaaaaccccttaatcttagtccaatggctaggactacatcaagattcgtgctagtaaccttagccttcctcttcccattcttcctccctgcctcttggcctcgccagcgttggaaggtgccaacagcgctagcgaggtcccgttggccgttctcccctttccctacatctccttctccccaagcatggcaacggcgagatgcccccacctcatgacatattcggatctagcagcctaccattggccttgcccttctccaaccctgcaacttcaactataccagcaataccttacgttcacctgtatccgctacccaccatctggcctctctttccgttccccaacccatcctcctaccccttatcccaactccaaaggcaaatatgtaggtttattccgggagttaggcgaggagttcatcgaagctagaggagaaagagcccccaaaaattcacgtacacacaaatcttgatgtaatccatgtaatccaatggttcgagattcacaagaagtttcccctctttttttctgagtgaagattatcaattgtgttccgttatatatatgccattggaccataatttttcttcactcgaggacatccccgtcaatctatcattagtatgttgttaaactaaccgtagagagaaagacagaaatgcacatgccccttgcttccccacttttctcattgtcctctgactattcgagcggcgagagctgctttctcccaccgaccactgttccgcgactcggcggctccacctaggccccacttgtcattgttgccattccccgggtccctcacgcctgtggctgccacagccgatctggaggcctgcagccgcacctccatgtctttgtgcatgaacccatcgttacccccgagcacctctgctgctctacgtgtcacagccaattattataactaggggattccctgcgatttactgcggaaattactaagtaattttttaatgctattttttttataattcagctaggagtaaaaagaaaaaaataatcaaatcttagggcttatcaatatttatcaaattcacactttaatgtaaaacatattgatatgtacatattaaatattaaaaaaatgatagagagatttgtaaaactattgtggaaataatgtgagaagtgatgattgaatatgcttgcatgttaatctaatttggggcatttgcaaatttgccatcggttttttcaatattgcaaggatgccactcgaatgacagttctagtggcatttttgcaattttctagtggcaattttacaatagtgattcaaagtagtggtaaatttgcaattgtccctaatttaattgtagaattaaatagattgtagatgctcttgcatgcttgcatgagattgaatatgtaattattgttagtgggtgatgatgtggcatggttgcatgttaaactttagagttagtgggttataactttatagaaagtatagattccgagtcgagattttggtaattttggaaaccccccccccacacatgttcgcgcttggaatttttagatttttctcttttttaatgaatttggttaaagtttatttaaattcagtcaaaatttatttaaatattcaaataatttcagtctagaaatgctgaaaatcctgaaatttcgtaaattttgatcgaaatcgaaagtgcaaactctggtcgtagcatgctgggaggacgaagctcatctaagtgacatcatgccgtgagacaacgaggagaagccgccgcatcgcattcagaggccgtggactcccgtcgacaattttatcgtcgccatcgcattgggaaatcggaacaaggtttttggtgccctaattgtcgcatgacaagttgcctgggtgagaatcttaacagagaaacagccgagtttagcaagtctgtcaaatatgctacagcctctgcacgataacaaatacaggcacacaccaagttcaatttttagaaaattagaataaatccagcctctacattcaaccggatatacataggcaaacatacaagttgtatgatttctgaattctatgggagctggaagagaggtagtaatccaaaggcaatgttcagcacatcaatcatcagaagagcgagaaatgccaagacatattcgagctgtaacaccaaaagaaaacaagaaatgccaagagcccaagagatgaagagattgttcagtaataaaggccagtttaattagaaggccaggcttcgctgcaaacctaaaattctctcaacagcagtacaatatatcatctaactcaggaaccatgaagtggaataaggccaagatactacatattgagctctgtcaaacaccctcttccacgtgtaaacatgatctaggaccaaatattgcttacacactaaattcagcagtgtagatcattagcgtcgtaatgtagtaagtaccactaatagcaaccacaaaaaaacagaacaatttgtgaatgcacattatatcgcaatttcagtacaacgtaaataagctagaactgaagtgcaaatttatctcgacacatgcatacataaactaagtgaacagtaagtcaccagcagaatttcttcaacgattaaggaatcttgcttccgcttacaccagcaataattttaacatgacagcaccaatgaactcagcaagaagaaacaaacaaacataatatgtgttgatcaacgcatggagagagtactagcatgatcgtgaccactggcaacagcagttaaaagaaaaagagatttggagggagagatgtctctccaatcatttttaaagaagaaattgtgaacgttttgaggattgaacacgtacgggacctcaagtttgaaatcacacatcctttgtcactgcactatatatttcaacatgcatttaagtgtaccggttaaaattgcagatggctactttcgtgggcttgggccaaacgttgatggttcagtccctcatgcgtgtatcaatttcttttcctcctttacagcatgtatgaatctcaaagtgcatctaacggtcaaaaatgcaaggtacaatttttctccattttctatcgaccgtaataccataaagagaaaatttttgagaaaaccatcgtaacgatatgtgagttgcaaaaaatactattgtacgtaaggacagggtttgaaatttcggttcgaaatttccgaaatttcgccccccccccacccaccggcatgctcaaatctcgcccgaaatttttggttttttgcatttttttttgtgaatttggtaaaattttattcaaattcagtcaaattttcaaataatttcggcttgaaatttcggaaaccctgggtataaaatctaatttcgaaattgaaaaccctgcgtaaggatcgatgacatgtgaaatctggacttacatgaaaatgacacatatgcactggtatttttcaacttcagagatctttgtgatggtaccaagaaaatcagcccgcaccgcacttcagcgaaaccgtgtcatgtataagcacgccacctaagcaaaactgccaatcggttaattgatctatcgtttgctcatgacaaaagggacaaacagagacacgagatataaaaagctcactaggaatatgcccatgcataaacacatatagtactcctaataagcaacaacttgaacggacaacaactttggtaaaaatgacagcaagacgcgctgttggattccatgtcatatgcatgcaacgaactcaagaacggatttcctagtaccatctaggaagcaacttatatcgtccactgacgtacgtgttgctgatccacaagaaactagctttttcgtccacgcatgcatatgcactagctatagagccaaattaactaccaatgtggcagtctactgtaccatcactacacttatatcacacatgaacaagcatgctgcaggtaccgtaggtaccggtatctcgaggtattttttgttggaccggagcaaatctcgctgcagatagatcgatcatcgatcgagccaagattgctttgcttgcttcttcgtcagacaagcgtgcaatccatggcggctgcggcgccgttcttgtccaccgatgatttcccattgccgcagccgcagccgcagtcgccgccgcgatgtgatttgacgttgacgacgtcgaggttgtagaggatggggatcatgacgagggaggagaggaaggcgaggagcgggccgaagatccagaggaggagcgggacgccggcgaagaagatgcggttgccgacgaagttgagcgtgaaccccttctccagcgcctcctccatgtagtccctcgtcgacggaaggccgaggaggcggcggccgccgtcgtcaccggcgccatcgccgccggcgaggagggtgggggaggtgttgatgaggaagctggcctcgttgaggaagcagatggcgagggagtgggagaggaaggcgacgaggaagaggagcagcagcgccacgtacttgagcgccatcatgtactcgccgtgggcgccgaagacggcgtcgctgagcggcttcttgatggtgtacgtgctgctcagcaccgccgcgatccccgtgcagaagaggatcgccgtcgtcgccaccagcgtcgaccccatgatcacgttccgcagcgactgcaccaccagcaccgccttcttctcgttgtcctgcgcatattcgtccatccatccatgcaccaagaattaatcaagatgtgtacagccatctctctgtacttactccggtgatcgatcaccggcggcgaaacgtacgtaccttggtcatgctgatggcccagaggcggcgggtggcggagttaatgccggcggcggtgcggagcggggtgaggcggacggcgcgccacagccagacgtggtacgccatggggacgaggaggctgagagggatcaagatcaggtccaagaagctgtccctccactccatggcggatcggatcggacacacgattgacgatactatcgatcaaatcgaagatcgatcactcttttcttagatcacgtactaattactattgctagctactatatgtgcagaacaaatatatgcttcgatagtatatagtacgtgataatattgtcaagtttgtgatgatatattgtgcctgcttaggattgagaattgttagctttccgatcttggagatgtctgtgtgcggcgtggagttgatatataggggagaaggggatactatacatgcaaaaaggggaaactgttttaaacactcgggtggacgtccacccgtttctttcatgtcatctaaatggttataaaaaaattaaaaaaattgacatgataggttaatatgtaatatattacttcacaaacatacaagtccaaattcgacttctataaattgtaacaaaaacaattaatttaactgtgaatatacgtataccagttagagtttgatttgttattttcgttacaacttgtagaagtcgaatttgaacttgcatgtttgtgaagtgatatattacatattaacctatcttgtgatttttttaaaaaaaatttcataatcatttaggtggcatgcaataaacgggtgtacgtccacccaagatattagaattcatcctcgtgtaaaaaggtgcaagagatcacaccatagtggcatcttacacaaaacccacaatcttcaatcaatcaaaagaggtatgtaaacctctaaagtcgggaaattaaattgctagagtaatctcgacaaggaaaagcaaggcagattgcaatagaatagaatgtgatatccagcagcatcgacaacgtgtagtattaattcgccgcatcccattcagctacacgcccttatattcccctgaatatcttagcttttccacttaactgcatccaccgatttcttattatgcatatgcgaataaatgaagaccggccggtaagtactgctaaatgcttcctcagtttcagggttagacatacgtataaatgtgagcaaaactagaaagtcttataatatgaagcggaggtattactagtgtactactccatccttctcaaaatataagagattttaattggatgtgacacaaactagtactccctccatcctaaattagatgttatttttaactttttttacaacgtttgtccattcatcttatttataaaattagtgtaaatataaaaaaaatcatactcaaagtacttttgataataaaataagtcacaaacaaaaatgaataataatttcataatctttcaaatatgataaatggtcaaatgttaaaaaaaactaaaaacgataagtattttgggtatcaagacagagagtttgtccagattcatacacagaaatatgtgtccaaattcgtagtactgttacattcatccaaaaatcccggacggagagggagtagtagtagctgatgtagatagttggctagctgcggttagagtaannnnnnnnnnnnnnnnnnnnnnnnnnnnnnnnnnnnnnnnntgttgctacaacaatacaggcg

SEQ ID NO: 29751 - DNA, 3674 bp, Oryza sativa
  unsure (1)..(3674): unsure at all n locations
cgcgcgggtagatacaacannnnnnnnnnnnnnnnnnnnnnnnnnnnnnnnnnnnnnnnccacaacccccacatgtgatcaattaacattatctaccatttattatcatcctaattacctcaacactatctaagtcctaactacagtaattaattaggttctccaactttattggcactcaacagttgtcggccccgatcgatcaacttcatgcatgtctccaaaaggccataattaatcattatattggcatgtacattcatgtgtgtgctattttctcaagcattctgctgagagagagtagtgagattgatgatcgcttgcggaggcatcgatcgagcgatcgttgtcgattcgatcgataggattagttgtgcatgtctgcgttggtttgcaactgtgggctctagctgcttaactatcatgcaattctggggcgcgaaagctacgtatcatgctacgtatgacagcactacgtgtgctagagcgtggcaggttttgtggcctcaaaattaaggctctgttttgtttctaaaacaaaaaatttcacgctgtcacattaaatatttgaacacatatataaagtattatatataggaaaaaaaatcaattgcacagattgcgtgtaaattgcgagacgaatcttttaagcctaattgcgacatgatttgacaatatggtgctatagtaaacatttactaatgacggattaattagggttaataaattcgtctcgcagttttctggcagaatctataatttgttttgttattagactacgtttaatacttcaaatgcgtgcgtatatccgatctgacaatcaaactcaaaaattatctccaactaaacaaggcctaaatgccaatacacttggttgtaaattcaccaaattattattttttaaatgaattgacaagctgtcaattttattgaataaagcaggaaattttcaccaaattattactagtactgataaataataatttgtagtattcatgaaaaggttgggtagctatagctagtaaatttaaagttgactctagtcattagtggagtccaatacatgttgattagttaaagagaggatctgacacattacaggaatcccagcctttttcttccatgatagtgatcgaagccatatgctgagtatataccgatcgtatgggtacatatatattagttctgcattagcttatgatgcaatgcatgtacgtagttctttttttatgaaaaaatatcgctatgttcatttgtctcctagcaaaaggaaattactgatgaaaagcaagcagctagacaagtatctttacagcctgcattgctttgtcctccaattgcattcgaaggtcacaaagtaagcactggtattctaccatattaaaactcctcatgtggagtcaaaatccaggagaaaagtggcaatgatcgatggaaaaaaatagaagtgcgtggggtatatagagctagattgagagtgaacctggccgagacggcgtcctgatacaatccggccagaggccacatatatatgcctgggacacgcattgcgcctctcaccaacaacctaatggtgtagtgtagagtccagtaggcaggcaatgaggcaactgctttgattcggtgtgagaagcagctagtaggagatgccaacgcccaagtgcttctgcttttttaggggagagttgagaagaaaacaattggagataaggctcctttttagtgagtcagcactcagcagttgcaaacgccactaggtactgtgcagatttccaaatatatttcttgaccaagagtagtcgtcggtaattgttatttcttgctctctctcttttttgccactcgtcagttttgtttattttgttttctattttgaaaggaactcgttgcttaattctctcttgacgtaatgctttcagaatttctcatttcatctcctcttctatttccttcttcctctatgctatagctgtgtgcgcaatatgttgggaggaaaatttatggtgaaactaccattggatcgaaaatgaacgtacgagattcgtccactttgagcatgatgacgtggataaatctcatatatttatttttcgatccaacggtagtttttaggatatataatttccactacatattttctcgggttgggaggaggggaccagagaggacatgggtgtgtttcaattttaaagttttgcatttaattcgttatatttgaaattgagtactttttttcaacggtagacaaatgttgacatgttttttttttcttcatagttcttaaagatacgtcaggagcatgatccgaatatctccaagatgcatgtaagggtatggtgtctgtgcgtgtgttgtgcatatgtaggtaagcgtgtactgtgtttattataaaaaacaagtcgagtaaacttgattagagaaatatcttaggatgtattcccaactccttctcttcgactcgcaaaacaaagtaagttttaattagcgcatgattttattttcaaggcacgttagcgtacggttagttaagtattaaaaaattaaaatagactaatataattttatatataattttttttagaaaatacaccgtttaatattttagaaaatgtacgcgtgaaagataatgaaaatgaaatcggaaaattagactaaataacacagctttagtggcagacacagattatctggctatcagcacggcgagaacacgcaccggcaaaagtgtcaaacgagtgaccgcgtagccggcagtaaaacgtggcgaaacttcgtgccacagaacctcgaaatccggccggtgcatccatgactaattattgaccatgcaccacggagcgatcagccctgtgtcgtgtaaaatcacaaggaaacctgttccaccctggtttcggcccgattcggcctccaaactctcgggccgagtgggagtgggaggatacatgggccggaaggaacggtgctgccacgaacacgatagatgggctggaactggatgggctgcgcggtggatgatgggctagaaacgaggtattgggacggagaagacgtggattggctgggattacactgaagactattacgggcaccgccatgtgggccacacgtatcgttgccacgtacacggtacacgtccacggtccaagcgccacgtaggattcgagaagcgatgcatcgaactgaagcgagaagcgcggaaatattctagagcccacgagagcgcgaaacgaaccttctccaactttccctttccctcctcctaaattttcgccgcctcctcttccctcccctcccctctcgccattgccgcatcagccatcatcgcgaaccacacgagctctcgacgaaatcatcaaccaccacatcgctactggatcagttggggtctgtctcttggagacggggagtttgagcagcaggagttgagatggcgatggacgcggcgccggcgctgaagaggaaagacgcggacccgccggagctgtggatgggcggctctctttgctattaacggttataatggtaatttcatcatgcaatttaagaaaaattcctagtaaatgagtttctaattataaaagccaaatctattactttccttggagaaatttcatgtaagaaatttaaccacttaggcttttttggtcgtaacggtaaccgctctacctttcttc

SEQ ID NO: 29752 - DNA, 3530 bp, Oryza sativa
  unsure (1)..(3530): unsure at all n locations
gctggccntttgagtnagataggtcgcatgcctgcaggccgactctagaggatcccctttggttttgggtgcgcgcaggacgcggaggtgccgcccgttgtgcccggcgtgtgcgtgccgccggcgccgccgacgcagcagcaaccgggggcgggattgggggcgggcgacgtgcgggtgttcggcgatcaggtgccagtgggcatggcgcccgcggcggcgccgccgccggcggcgaagaggaaagcctagaacgcgccgaagctgtggctgaacaacgccggcgcagcctccgaattcccggtctcctcccgcgccaccaaaatccgccgtctcgtgcgtactctaactcaaatctccccccaaatcacactagcggcgtatgccatcaactaactcgcgtcgtggtgcgtgcaggacgcggatgtgccgccgcccgttgtgcccgagctgtgcgcgccgccgccgccgccgcagccggtggcggaggtgcagatgcgcggcgaggaggttccggtgatcgccgtgccggcgccgaacgaggagagggcgatcgtgctgtacaagccagacgacgccgcccgcaacctcctcctcggcccactccgcccggaattccctctccgcgtcagccccgattggatccacggcctcaagagtacgtaatccaccaaatccacgcctaatttgagtcgaatttgtttcaacctgaagctgctgagatcaaattaactgtggtttgatcctgcaggcaccgcgctgcgagaggcgagcgaacaccgtgctctgttcgaggagctagccatggacgagacctccaacctggccatggtaccatgggttcccgtgccctcaaactcccaggaagcctccacgtcggccgccgcgacggcgacgacgacgacggagatgatggacgccgaggacacgtccatggaggtcgagcaggacgggggatcgggaggatcccacctcgccgccgccggcgaggcgccctactaccagtggccgcagcactgcatggcgccgccgccgcagccgccgctcccggcggtgagctaccagccgagcccggtgacgtggtcatggtgaagcgcgtgacgcacgcaacgcacgctgtttgtagattgtagtaccatagacacactggtgggctttcatggcggtctttggctttcatttgcttcctgctcgtgtagtttttcctcgttttggcagcgcagtggagactgagcaggagttggagtgagaatcgagatgagatcgtacgtggtgttcttctctttctgtaggagtagtattgtccttgatcagttcatcgatcagtggagaggggaatggtgtattggtggtgaactggtgattacgcggagttttgttctgcttgtacatggtcagtgtggtactggtacggttgacgcctcgacggtcgtttttttaaaaaaaaaatcgtacgtgctgatatttttgctgccagagcttgtaacgtgaaagttgaaactgatatacgggtacatagactgtatgggtggtaagattatgaatgttgacttcacaatgctcttgctaagaatttctccgctattcacactgtgcgcccatctactggttttggatgtgtttggctcggtctgactgaattaatggatgagtaatgtgggtagaaacaaatggatttttttaatcttgaaacaaatggaattttaaccacacttgaggcatactatttgattctctactctaccaattctatcaaaatctaaaacataagcaatttttagtactatcttctacttcttcttttggacctaccaattctatcaaaatctaaaatctaagcaatttttagtactatcttctacttctttttttgggaaagttagctagcccatatttggtttgataccaatgcgaagtatggtaaattttattagtacggtgaataagtttgtagaatgtgaccaaattaaatatgtgcactatcaattatttggctttaatgatttcaatccaaaatggtccataagtggacggggataaaattgcctctacaaaatcagtgcctctacaaaatccacatgactataataaatttaattaaaataggcttagataagcttagaaaagtatatggatatggttgacaataagcaacctgatccatatttaatcctacaattgaagcgccctatgtatagatggctaaatgggccgcgtggcctggcacgacccaagtaggactgggcccagcctgaggtcagtcgggtcaggccgtgcccacccacgggctacaccaactgcccaggcataacccaataagactcgagccgtgccgggctggcctaaggcatgataacccattatgcttctctatgaataagtctattttcctccctcgtctctttaggccatgtcttatatggttgggataagtctacttttgtattcctaatctctttggccgtgccttaaatgcccaatatgtccattttgggtccctcaactatttttcttcacgctcattagaccgtgcggagctggcccaccatgccaaggcatcggcccagtcatggcctaactatcatgtcgtgccatgcttgagttgtgccgtgggccagggcatcaaaccttgggccttatggccatctataactttatggagagtatagaaagttcgtacaaagatatccaactaagaacaaaatcagaactatttttttccacgatctctacaattccttactctataattgatctagtgtgatactagtaacatatgctcatgctttagaggcctagttttaatgactatgtgttttaaaaacatgtgtagtaatgctctagtcatattattatcttattgttattagtgtacggtgacataatatctagtcacaacataacaccctcgaacggtggtccatagatgaaaaataaatagttacactgtttaatacatagtcatgggctcatggcaatttatatcatcccaaggagcatatgccccgtttgtataatgacgggtggttcatagatgaaaatagcagttacatcgtttaatgcataggcatgggctcatgacaatttatatcatcacaaagagcatatgccccgttcttgtaatgacaggtgacacctaaggtctgtgaaacatactcctatattctaattatatgatggcgagtgacaactctaagaaagtgaagacaaactgataactatgggtttgtttggtagaactccaacctctaaatttaacttaggagttgggtctgaagtgaagttgcgaacccaactccacgtctaaatccaactccacctctgtagtttatttcgtaataacaactttactttattttctggtgaagctaaaattgtttggttggagctttggccgtgccaaatggaagctgagcgcagtcgtccctatgagcccaccgccaaagatcgcattgacgaaactacccctgtctgtgccacccatctctccagattaggaccagtgaattacattttttgccgatcccgtc

SEQ ID NO: 29753 - DNA, 2309 bp, Oryza sativa
  unsure (1)..(2309): unsure at all n locations
agtgcctcaagaatttcctcggcgttagactcctcgcaagtaagttcgctcgcccagtggcttgcgcggatctcaatccccgcaagctgagcagggggagggcgccgcctccgtcgtcgtcgtctgtcctgctgcttccgccgcatccccggtgagcacccatccgtcacgcacacccttttcctcatctgtctctacggacgttttttttttctcttctcgaatttgcgttaaccctagcttcgcttctagatctggaagctttttgtcttaatttgccctaaccttaatactgcctcccccactaaaatgtttgggggtttcaattgaacacccatgtcccgcgttagatccgcccctatgctcttctccattcaatcagcttagaaatcgttaagttattactgtctgtgtttattcccatcgtgatgattaactgctgccatttatactgattggaatctatcgtagtagtttagatgtgtctgaacaaaaactgtatgagctgattctggagctcgagaactctaatttactcacgtgctagacagataatccatacgaacccattttctgaataacaaggaggtgtcaccccacgttttgcttctgatattcgcggttgtattttgggggctgaattactgatatgttgtggtgtgattgggtgaagtgcgacacaggggcaaaactaaaatatgctttaccaggaaagcaaatggagctcatcttgtcaataacaattatagccacttctgtctagattatctttatttatctccagttgcttctttttatcactgtcagtgaagtgaagtgaagtgaagtgcgttttattgtttattatgaatgacagttttttattcataagcactaaatggattgggcttcttatttgctttgtatgagatggcatgttttacgtctcttatttgttttgtataagatatcatgttctatgtcaacattttcttatggttatcaactgcaggcaaatcttgtaaaaagcctatgggaaattcaaaaactcctcaaccatcaaagaagtcccgaattatgttgtcagatactgatggccaccaactggacaatgatgagttttcatctgaaagtgcatcaaatcaaatggttctgttcaaccctgaaactgtagctaaagggcaagatgaacttggagagaaccattcaccatctttgcagaaatcagccaataatccgaaccgaggaatgccatctattggggcattcactgtccaatgtgccaagtgtttcaaatggagacttattccgacaaaagagaagtatgaagaaattcgtgagtgtattatacaggaaccttttgagtgcgaacgagcccgtgagtggagacctgatgtaacatgtaatgatccagaagatatatctcaggatggaagcaggctttgggctattgacaaacccaatattgcactacctcctcctggatgggaaagacagatcagaataagaggcgaaggaggcaccaaatttgctgatgtgtgagtaatgcttttctgccactgatctaacctttttagtccatgtttctgcaaggacattgatttcattatttatttcctgacatttctgtatgtaactaatgctctaaaataatagaaactatccaagtagcccatgcgttcacatggcaaactttactattctcttacccattaattgtttcaatttgttttgtatttttatgttattttcccccaatcattggcttcctttggactgttaaccaattctctatgccttagttatgtacaaactttgactagttcaacttaggtagaaggtagtagctacagtagtggtgagcacaggtcactccttggtacttgcttatccactctagttcaatcaaatgaactaaatacacaaatatgcattaaaaagtgcatcttagttgactttgtataacaaaagaaccgtaccaattaagtgatccacgcccattgataagctgcagtatcgtcctttctattattggctacctaggaaaatgttatactatgtgtttgtagctgtaatctctttatatgatggtatttgagcctattgcttgctgtaaaatgtgattattgctgaccagatgtttaattagtccctagcattgcaataacctcatcctaattggtaatgaagtgaaagttgtatggatgaacatacttaatttgttcttagtacatcagtctaaaccaatgagaggcagttttggcatcatgacgagaatcaagttcttgacgctgaaaagcaattggtgggaactcggtcattttggttgn

SEQ ID NO: 29754 - DNA, 6793 bp, Oryza sativa
agagagttcgaatattgatatccacttggtaccctccaagttaatacaattgggaatcaagacagtgaaggtactgaatcatgtagaagaggatacggcgtttaagacttcacatcactgttagcagtatgaagtataaactccaacatttctactggcctttgtttaaccagtgagcatctggttcatgtagggttccctgcctatgcaatctagcctgtattatagatatttttatttcctcttgatttatgtgggaaattctagtctcgtagaattaatatggtggtttctttcaacattttgggctagtttggtttggttccaaattgtgccctaccaattcattggcaattttcaatagagtttctagttgtttggattggtgccaaattttaacaacacatctcttagatagtaaaagttttggccatccgaatttggtagtgccaaaagttgcccaaactttggcactaccaagattttggtatggcaccaaaccaaacttgccctttattttatatttgatagtagtactgcctttatatgatttatacaaacttttgtcttgatatatttactgaagttattgtatttatatgacactcttttactttctttcaggtattacacttctcctactggaaggaaactgaggtcactggttgaaattgataggtacattattatgttcgatttgtcaaatttcccctttgaattctttcactgcacattttatgttgctttcctcttcagctcttatggctggacaagtggatattgtaaataaatagaatgtaattcagtatgcccatgctctaactactcaatccatgctttgcaggtacctcttggagaatccggattatgttgcacagggtgtaacattaactcaattttcattccagattcctaggcctctgcgacaggactatgtcaaaaagcgccctaagatagtgaatccaaatgatgaagcaagtgtagtaacgaccaagtccgttaagccggaagaaggtgtgtaatggcgtataaatgaactcatcataactagttagcacataatcagtattaattctcaataaaaactttccatttgcatgctgaacaattaatgggtaagtcaccagcttcgtggttcactgccacgtcccaccaccctggattattatcccgattcgtgatatgcagttgatctggttcatcatcctgatcaatggttgggtcatgaaccggatcaccatcccctatggttgctacagaaggatataatagatatggaggtggggttcaagatatgtgcccgaaactagttggcagctatagattgggtaattgacctgagccatcgacccaatattaccggattcatgtcctgcatcgcaaactatcgtgctgaaaagatacccttccgtaccacatgttttggcaagtaaaatcctgtggccgtcaaccccgtcccttgaaccgattgaactgggttcgcgttgacctgctatggcttaaaatatatctacacacacagacccccaggagattgattggttagtattttgtcattatatggatttctgatcatgtagtccagttatctaataataaataattaaaagtaaacataagaagtcaaattagtttccttaaacttgagttgcataataactgacatgtgctggctagtggcgtgtactaaaagttactatgtaacaagctcgtgtttatgttatagaatcatactacttgctagatttatctttatccagctttgttttatgaaattagcttacgcaacaggttctataacagacacgtaagtctgtcttggatgtattgtattagtcattttggttctttccaagactaacttgctagagatcggtacttcctcttttagtgaattgatcgtagaaacttattcaacaatctcttcactcttttagagagatatatttatactataaactactcgagctgcccttaatttgttactgtatgtatgtccgctgaaggttagctctatagcatgccaaacgaactgcattcaccatttgtctgatcctatatgatatttttgccatttgtctgattccatgtgatgtttttttgctttagtgagccccatagcctgggcagcaccatcggtacatcaggagggtgaagctggcgaacgagcttctcatgctgatgagccacctgaagcagaagaactggagctaacacgaaaaaggaaagcggaaagccctctgttcgaagaggcacattctaaccatgtttctgatgaaccaaaaaccaagttagaggatactcaaaatggaggcccttcagcttgaagactgcaacacagtgataccttaagctccccatccatggttttattgattctcttttgcgcttcataatttgggggccagtttttcctgtaatgcaaggccttactggcctttatatgtatcatgccacgttggtgccaggttggaggctgaatctgactcaaaatcaagttttcggacacgttacaattgttgtatccaaaagccatgttggaactcttttcaggagtgtgctttttctagtatgggcctaggtaggaaacctgccgtgtaagattagctcctctccttgttttctctttgtaagataaggaaatgttgtagggacatgtttttcttgtatgtgggtttgatcccttttattatctaagacatgccatttctgatggtgaaatttctggttgagttcgtcaggcagtcaagcatggccaaattggagcatgatccatgcccttgtagctagtaatataatttctgtggcatttttggctgagcttcttttggaagttcaaagttggcaatgctcaacaatctggctctgcagcaatacatcagcttgtcttttttcactagttctttgttggcaatatgttatcttattcacttgacaaatactccctctggattcaagtatttgtcattcctttgttggcatatgttctcttattcacttgacaaatactccctctggattgaagtatgtcactggatattatgtacttttatttaatttcgaccgcctgtcccttttacaaagtttatgtacacttcaaggtataccatattggcaaggtgttgtgccataagtacaaccatactactttcatttatcgtaaattaattgtttgttaatgatcaaagctgaaagatcaatagcgagaagtaactgaggactgagtatttttacccagcccaaattatgacacacagcattatcacgcactgatgcatgaaaactattgcatgcatgctaaacagctacacacacctcaataacagatacacagcaagctcatcaaaatcatggtatgtttatcctgaatcctcctctttaaacatgtatatgtgacaaaaatcaaatggaatgaaaatgtacactatggtacaacaagggctacaacaaatttcccaaatcccataggcatcacacacacagttgacacttccctcaaaatccgctactcagaaatacaccaatgcaaaccacagctcctcacactgatgaagaatccgttaatctgtatagctcacgaggcaacagcaatggcaatggttggtttgcattggcaatagcgattgcagtagcaagaagatgtatacaacaacacattgggtgaattctttaccgtggaattggggggaattgggggtgatctgttctagctttgttgctgctgatcgtcgggcttcttgtaggaggggttgaaggcggcctgctcggcgcagtcgcggttgtcgccggagtgctcgcggccgacgcccatgaggtcgaggtagtactggtagtgcgagatgatgacgttcatgtcgtcgatgtagcccttgccgcagatctggtcgccgtagagcacgttcatggtggcgccgaacccggggaggcgcttggcgagcgtgtcgttcttggtgggcttccagttgcccacgaacacgtcgtgcgccgacggctgcttcttcttcatcggcgtcatccaccgccacatcgccgccatgaacgccatcgtcgcgttctgctccaggtactccgggtggtggagcaggtcctcgtgtatcccgtcgcccgccgcgccatagttgtagttcctattccgaatccgaatccgaatcaatcatcaaatcaagcgatcgagatggcggcgacgaagcgaagcttaccagaagacggggatggcgccgcggccgtagtactcggcgccctcgacgcagggatactgcaggttcgtcttgtcgcaataatcctccttagggctcatctcgtggttgtagcagagcccccacgccgtcggcccgccggtcgccacaccaaatccacctgcacacacacacaaatccccatcaatggcgagcttaaaacctcaaatccaaatcaaaccatagcgaaaacgaagaagctacacacatgaggtcttggagccgacatggccgaggaaggcgcagagctccatcatctgcatctgcttgccgccggtggtgcaaaagccgaggggctcgaagagggcggcggcggtgatgaaggactggtagtcccagaagccgacggcgtgggcgacggggctgttgcgcttggagaagaggttctcgaactggtacaccttgaagaagtcggtgatggtgtcgttgcagcagtacttgctacccgagcactcccaccccttgtcgcagatcttctcgcgcgactccttcatcttcaccttccatgtccccgccgtcaggatcagcgccaccgtcccgccgatcaggatcgccgccgccgacaccagcagcgtcgtcaggattatcttgttccgagtcttcctcttcatcctcgaaaatcaaccaagaaactgcctctctctctctctctggatctcgagcgagttcgtgggggtgaccggcgatctggatcttgggggggagaatgcggcaggtggtgggggatctggtggtgggtgggggatgaaattgggggggaggagtgtgaggtaagcgaggaggaggagggagtggaagaaagcgaagtggcaactgcagatgccgacgcggcgaaggcgaagctgctggtgaaggtggtgtcggtggcgggaggaagaagagaagaggcagcaagcgagagagctccgagctggtaagacgttgccgttgtgtgtgtctcgacggctgagcattctgtctttttttttccccttttaacaactgtctggagtttttttttttttgctttttttcgcgggaaattgactgttttagggtgaaatttgggcatgattttctcatcaagattcagatttttatctctattttcgttggcacgttttttaaactacaatatgtttcatataaacagaaaacctagacaacggtatcacgttaccttttatgagatagtacctgatacctgttgtggtacgagctgtatggtacccgatacctgtgatacctgttacctggaacgtatgatacttagggcctgatatctgtgatactcatgcaagagaatagttaatatgccttatcccgttgcaacgggatcccgttttgtagcagtcctcttcatataaaaaagttttatatagaagttgccttaaaatatcaaatatattcatttatcaagtttgtaataattaaatttaattaatcatatgccgatagctttttcattttacgtgcgtcaacttaattttcatcttcgtcagttttaaatatcacctttgtgtgaatttggttaatacaaaaggaaagaatatgatttttggaatatctgtttcctcacctgactgacagtcacggttcacatgggtttgtgaataatctaatggaatcgagtggttgatgtggggtaatcaaatcatgagggctcccaacaaccaatctgatcatggttttatacttttatccggtgatggcatagccggtctgtgaggactggggaagaaggatgactagaagagagtagttcccctattccaggctggatgttatatattgcagaaatcttctcgctgtcactgtgtatcgtggaggagtatcttgcttggtcactgtcactgtgtgttctcttgcatcccagctaagcattttttaacacgataaataactgtttgttgtagaagaaaatgaaagtatagatggccttatcgcccgaggcctatggtccggtccgaagcacgccattttggtccggcccaaacatggctcggcctaactggagtcgtgcctgtgctggcctgccccgacaaccgagccgtgcctgggctgcaccctcggtacggtgggccggcccgacccggcccgatcaaataaaaaactatagggatgcaaaatagacttaaataaccatataaggtaaggcccaaagagaagaggaatacaaaatagacttattttccagccatttcacacagcccacatagttgagggatgaaaaatagactttttctgtggagcagcacgatgggctatcgtgccttcgggtcggcccgacacgatccgagtagtattgggtcgtgcctgggccgtgttggcccgactagcctcggcccaagcacgaccgggtttgggccgtgccgtgccgggcggcccagttggccatctataaatgaaagtagggaagcattattttacagtgttctctttacttccaagctcaagatttattaacactaattaatttgtttgttggaaaagaagatggaattagggaaagcctcgttacttcattaaaaaaaggctaattattaaaccaactagggactatttcatgtcatatcatt

SEQ ID NO: 29755 - DNA, 6887 bp, Oryza sativa
  unsure (1)..(6887): unsure at all n locations
cccaggaaaggaaaaaaggggcacggcctgcggaaggaaaaggggaattggcccgggaccggcccaaaaggaagagagaaggttttaatttgtttttcattttatttaattgattcaatgaactttgtgccattaaaattatttcttgagctccgaaaattcacggaaaattccggagagtatattagggcataaagaatattacaaaatattctcggccaatgatttttaaaggaaattttaatttcctccataatttcacttgattaaattgatttatcttttatttaatttctagacaatgcattattaaatgatttttaatcctgaccgaaaatcggggcgttacaaatctaccccccttacaggaatctcgtcctgagattctgggatggctagaaagaaaactggttgtgcgggcagtctgaccgatctgactgatctgcacactgcactgtttttttttctgtttcggattgactgattgactgattgctcgatggaccaaacctgcataactgaactgatcagcatcgaccattctgttcttttgcttcaaacaactgaactgactggcctcattggattagatccctggagttctggtacccaacacgaccaattaactgatcaaacctatacgagtgatctagctggattcaaccctgctgtcccattgcttcccaaaactgaactgattggttctgcttgaactgacccaaactagggctgcggatgcttgtgaaactctcttatcttgggctgaaccgttgatactagcaatttgataacctgacagttcaccaagctggctagagaaggatggagttgttcctaaaacttatctctggcattcgtaaatcattgacccttaattcgcttgggctgctcttgacatgaacggtaagtattctaagaagctgcttgatcaatctttcgtctgaactgcaactgtccctgatgttgcttctctaagcggagttgttgaactagcctcacgggtgtaccttagaattcaatcggatgccctgagatcggtgtaactctgttgacaccttgcaactgacttattcaagtactacccgaattgttgcactaggttgaaccttcaactgaaacagcgatgaggtgagccaaagctcatctctacgacctaccccccttacaggagtagtcatacttttcacctaactaggaacaattgaactgctggccttggaaaaaaaaccaacacttctctgattttaaaaagagtcctggctttgaagactgaaaacttcgtcgatcaatcaacatgaaacaatgacggtgcactttcctcccgacaagatttgaaacttaacttcgttgatgataggaaattccatacagaggaactctcatttagctcataaacatactgactcatgactaacattcccaatcagttctactgctggcataaccgtcctgcttctagcctgacctcggtgccgtatgcctggacagattgcatagtcgacattctttgaagcacacactgaccacttaatggatcaaactcaagagtccttctcatgacataaccccacacgtcgattattattatttttttgctgactcttcctagattgatgaactgtaaaccctgtaactgctttcccaaaaatattgtaatctgcgcgactgccagaagctgactttgatgctgccgagagtttctgttctctagtcataacaacttcgctttcaaattttcggtaaagatgatccgttgaaaggggattctctgccatataccctgcttgactacacatttttgaacttgactctgtatacttctgacccatgtattagaacaatttgtttttttcaacttctgggaaacctcatgaggattttctggaatttatagcggttgccttgaactatggaaaccattcttgtttcgtaatcacaccactagggtgtaattgccgcttaccattctctaacggtttccaagggtagagattccttgtatgatgttacttccgaatatttttttcgttactccttacacttgaatacccttgatactgcctttggatagatttcatagtgtcgagcgccatggatccaaccattgtcacttcattggttaatcctttctttactggctcacaaacaggttttggagcagaacaaaagtgcgatgagttagaagggaaattcttgggtttcttgtaacttgcagatacacatgttaacttccttttgcatactcaaaggtgaaaagaagagaaccgcttgactcctactctattcaatattcccttttcaactatatcactggattgggacttctatgcacaaggaaggtatttcaacaccaaaggcctgtgcacaattgttgactcttgctgacagaactgctgatcagtagcacatttacccattgtaattctgacatggttgacttgtccttttgttggttactagctgaagctcccacaagaacaaaactttgacggatgacgttcctaaggcaaacatcaatcctcttggtagctgaaaggaacgaaaccttctcactgtcggtgcaactcttctgttaattacttgccagacatctgagttggagtagcatgagatgcatggctgatgttgataaccacattgaagtctaatgcttgagacattgactgcagtcgatgctgaagaattgagctgtctctctacagtaaaagtagatcaccgattccctaacattgattgcccttctaatgctgattttgtagccttgaagcggttgctagcgaaacaatagaatctttatcggtgcctttaatgacaattcagcaagatggaaactttactatcaagtgactattggaagcactcctctttctagtgtcattggactggatctgaccacttcatataggaactgatgtaacttgaggaggcaaaggcgttctaaccatgttgctgacttgatgagactgacgctttggcgctgaacaaccttttgggagatgataggtcttccaacagttggaaacaatggtggactatctttcttgttctcgagagtagacccttactgaggtggtgtcccggctcgaggcgattgagacacttctcacttgatggatctttgatgtgcactcttcctgctgtgcatgctcccaactgaaaccagagcaaataactcataaccttggtgacaatgttattactatcattgtgggttgccgcgacagatggagctggtggaagggcggaagtattgcttctgttgttactgactgccataagttgacgaacatgttgcaaagttgtcctttggtctcattgccttagctagtaccaaactcagttgattatccttgagcacatggtatattccctctcacaagaatcgtgcgtcctttctctgccaaagactggactgaggtgtaccatagtttttgtaagcaagcgggcctggacctttcttctctcctgggcacggtgccctattgttggtcgttttgacaaataagtccaacgggtgattgaacacttggcaagaaactacccttgaaacccataccttctgtaggtatcacttgttgctcctaggattagtggtggcttggctgtgctggtctgctgaagacttggtggcgtactgtctgaggttgcaggttgtaacgctccgcttttcgtgagacattaaaaactaattcggcaaaatcctaattgcgaaaattttcgttctttgtgtcagagtctaagtcgtgccaggatctcaattcaatcctgttgttccctctcatcgaaatcaaaattctccacctcgaaattcctccttcgactcaaatctccaaatcaaattccgaaattcaatcgcatcctttgaatcctcggcaaatactcgctcccaattcccaaaaatatcaaaccctaccttgagtcttccttgattcctccctgaaccctcgagttcgaatatcgaatttgaatctaaatacaaactccaattctctccaaattagctttccctgcaaaagtctattttacctccctcgggtgttgtgggccgttttccccccttagcccacctccctctttcagccgtttctcctccctcagcctcgcacgtgcgttgcacgcgccgagccgagccgagagagagctctctcgctctctcgttctttctctctcccatcttcactctctctctctgctctctcccctcccggcgccgattcccgccgctgcctctgaattccgccgctccctcgcattgcgcacgcgctcgcccgcgcgtggcagaccgcccggtcgccgccgcgtcagccctggccgcctgcgccgcgtagccgcccatgccgcctgccgctcgcccccaccctgtgcgcgcgtgcgtccaagacgtggaggcagcgcgactttttgcctcacgcgctctcctctccctctcccattccccgtttcggcaagaacagagctcccttttccccctcctttttccattttgcacgacaccgcctgtgacggcttgccgccgcttggaccatgggtgtgaccgcaagctcctctccttgacttcctctcccgggagtcggttcgttcccctcgaagctcttcacccggccacctataaaaccagagcccctcccctcgaatcctcctctcgtttcactaaacataaacgccgcactattgttgttgctcgctccgctctcgccgtcgccgttcgtcgccaagcaccggggaggccggtgcgtgcgaggacgcgtgacgcgggactccgagcaccccccttcttccccttccccggcctgagaacggagaactcactcccgcgccgtcggccactcgtcaccgtgccgtcccgactcggtagtgactccctccgttctccttcatcgttctccctcgccctctctagcttgcgtggtagctctactagcccctcgaacgcgcgtagacgccgccccgagctccgccgccgctcggcatggcctcgctgccattgccgcccgcttccggaggccgccgccgtcgctagccctcctcggtgctcctccgccccatccgatgccggaaacggatttcttaaccccggacatgctcccaccgccttgaattgaatccccgtcacccctccgccgtttcccccttttctcgccgccggcgtgcgccgccgcgattcgtcgtcgtcggcccctctccgaaggatccgagccgttggctcaacccctctcatgcttccctttgtaccgatgaactccctctcgatcgaatcgccgcgtcgtgctccggtgaaaccccgcgcgtcggccaccgttggttggagctcctgttcttcttcctcctctcgcccggcccgcgtggctgccacgtaggcgccacatcggcgccacctcgacgcgaccgggtcaaagctgacctcggtcagccgcctttctccgtcccccaccctcgcgcgcggtggaatcggtccaccgggccctctctttcccccgcgccccctctgttgggccgcctccccgtggccgcgcccggcccaatggctcggccgagcctccttcaaccctttgggccgcaccaatgccacccgagataagtccaaatcacatccctcacccctttaattttccaagggatttaataaatctttttcctttgttccataaataaaattctttattccaaaattccatgaatcatttttctttggtcccgcacgtcagtgactgtcaataatattcttgagaatattatttctataaattccataaaccatttctcgtcttccagaaattccaattaaacttccaaaattcatatcttcccaaccgctcttccgattgactccgttcaacttccagtaattccgtaaaattgagatctatttaatggcactattatttagtctaaatagggtctttttcttggtcttttgtttaggtttttgtttgtttgcgtatagttgcggttaccggattttcgccgatcgcgggttttctcgaagattcgtgaagctccgtgaagaccttgagcaaggcaagtcaccctttgaccaattgctcctataattggaaaatcattattattttgtttgcaacttgcattattagagtcacacacttaacttgcttggcctcggtttgcgtgccaaaccgacggacctacccagtagtcgcactaattcctataggttgtactaccctgattccttgtcgctccacccttttggtacttcggtatctgtgctctttgagcgcgtataccaaatatcccacatacactgttgattgtcgaaaaattgggaaatgggtttgagaagccttgaaaacccgacctgtggtgtcggtgtgtttaaaaataaaatgtattgtgaaaactcgcgatgcaggggttgtgcctgcgtggcactgtcccgtattcgcatataaggaccgattcctgtgggaaattcatcaagcataacaaagtgcaaccacaaggtggaatgggacaccctagctaagtaactagtcggttcagggaaacctcgcatgccaatagttggggaacgccggggcggggtcggttggagccaacccgggttcctggtaaggcaagaacgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgatttt

SEQ ID NO: 29756 - DNA, 4376 bp, Oryza sativa
  unsure (1)..(4376): unsure at all n locations
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatttgttttgattccctggttattggagtaatgttgtggttagaccgtattaggaactagagatctatgtctcaagctatcttgacctatcattctcgatgtaaaattcccgtgatagtcaatgtggacgtaaaatgcaccttcaatttgtgtgatgcacaaccataggatcaccttcgatgtcacctaggacatcaaggtcgtcctccgccgtagcaccaactattggaactcgttggtaacgaaaatctttcttactatcatgtcttaggcagggcaaggcaatcagggcacacacttgcgcctgtgaagtgacctccattgatatcgtgcatagtaggctttggtttaattgtgtaatatccacagagcctagcccatttctccacagccctctacttgtgaatttactctcgttcctcgcgatgaggaccccatgccaatttgctcccctctagctattacactcttcaattgtccaacttgcaagttgcgagtctttctactctaaactctgaactctgaagtctggaatccccttcacactttcacactttcacagccattgcgtctagcatcctgataataagttttctagtttttttttcttttgggattcactgttacattctattttttttttctgttttaaggatctggtttagggtaagaaagggctgaaagaaaaaggaaaaaatatattgctaatttatttgattattcaaagaaacatctatatatataaaaatctttacggtgtcattaagacaagtaactgaatcaaacagggctcttagctcaatcatacttggcttagtgacatttgcagattcatctctgtttcttgagcaattgggctgtgaaatgctcgccccagaaatggaacttttaaccacagacatatgcttattcctcttcgtctttttttggcgataactattttattttagggagcagaaagcgagcaaatcatctacgagattcccttcgggcacctaggagattccctgcgagcgattgtacgaaagtgacgaaggaaggaccacgagattccgtgggcgctacgaacgcgacgaacggccgagaaaagaaagagtagccgtttcgaaatttggtgacaataactggttttttttttgcgcaataagaggattaggcttgtgctgggttaattagcatgtgggctgatcagtaagagccagtactccctccgtccaaaaaaaaaagacaaaccctggtttccgtgctcaatgtttgaccgttcgtcttatttgaaaaaattataaaaaaaattaaaaagacaagtcatgcataaaatattaatcatgttttatcatctaacaacaataaaaatacgaattatagacggagggagtaccacactgccacagtagggctctgctgctgtctactgtgtattgttgctgcagagtggccgtagctacagccagccagttgaaacttgcagatatcatttcgaggttttctaaagcttatggtaataatggtatatgtggggctggtttgctttatgacctaaaattgaccttactaatttttgtcaatgtcaaatttttgtaagttttggcatggctaatcttggcaaggtaaagttgtgtttggactgaagccaaagcagtttcatttcattattgaaatggcctatttttttaggcatgccaaaatttggtttcaaaccaaatagacactaaacactattgaaattgtcaaatattggcaatgccaatttaggccacaaatcaaaccagcccatggttttttttactccctccgtcatataaaaaaccaacctagtaccagatgtgacacatactaatactatgaatctagacatacatatgtccagattcgtagttctagaatatgtcacatccaattctagattcgttttttataggacggagggagtacttacctactagattattgaaatgtgttctttgttatacgtttctaaaaatacatttttaccaaacaaagtttcactgtatttttcaatcagttggtttaagttatttgttaattttatctctaaaacatatctttataaccaaatcgataatccgatgcaataatccatttaataatcaaacttttcgttaccaataatttggtaaggccaggaacgcagctcattctaaatgccacctaaactaccggggctttcacacacctcacgcactcgacactttggaacagaagacaatagtgcatcgcaggtaaagaaaacgtgaacacacctcacacacacaaaatggatatcctagtctggccaaatttttggatgatctcatcgagcatttttatagatatttattttcgaatatcttatccacatctactcatcagcctaatacactcaaaagttaaatggacattatctatctagaaatatcttttccaccaaacacaccataagatgaacagatccacgtcagaaccagttgcatccaacagaagcctactcagcatccacgtcccagtgaagacagttaaaggcgtagctcccccgaaaaaacaattaaaggcatatctttatatactcatgatagacatacagcgttcaagacacttttataatattatactacctcagtcgctttgtcttatttcttagttaatttttttaagtttaattaagtttaaagaaaaatatagtaatattttcaagttaaattaacatactagtgaaactaagttggtgttatagatgttacttttttttataaacttaaataaaattaaagaagtttgaatagaaaaaaaaatcaaaacatcatataatatgaaaaaagagtaagattttaaatatttatatatttttaaaaggaaaaaaagatagcaatcaacgaaacgacgacactaccggtttaccacgccgcccacgcttcgccagggccatttcgtctttaaatacggacactagaccagaggcctacctgtaacctgttcgtccagctccaaagtctcaggcgcacgcgcactgacagcagcagacagggcgagcatggcggcggcggcgaacaacggcggcgagggcggcgacggcttcgacgtgatcgtggtgggggccgggatcatgggcagctgcgcggcgtacgcggcgtcgacccgcggcggcgcgcgcggatcctcctggagcggttcgacctgctccaccaccggggctcgtcgcacggcgagtcccgcaccatccgcgccacgtacccgcaggcgcactacccgcccatggtccgcctcgccgcgcgcctttgggacgacgcccagcgcgacgccggctaccgcgtgctcaccccgacgccgcacctcgacatgggcccccgcgccgaccccgcgctccgcgcctccatcgtgaacggcgccgccaccgaggtcgcctccgacgcggcggcgccgtggccgtggtccggggtgttcaggctgcccgaggggtggacggcggcgacgagcgagatcggcggcgtgatgaaggcgaccaaggcggtggccatgttccagtcgctcgccgccaagaacggcgccgtcgtgcgggacaggacggaggttgtcggcatcgccaagcaaggtaagacaccgatcgatcaagctagagcttagcttagcttagctatgtcgtcgtcgtcgtcgtcttcctctcgcccaaccaaccaaccaaccaatctcgttggaagtatccgggtagctcttgcatgattgcaactttgcttgcatcacgtgatcagtcgctgccaaccaaaatgccagcggcaaccaccatgcgagagctgagtgagctcctgctccttgcgggaccattgttcttgttgaatagtaccgcaggagagaagataaatattgaacacattgtactgagtcttagagacccggtatacataagagatacatatataaatatggggaaaatatgtagtgcaaaccacatatgtagtggaagcttggaaactactgttggatcgagcaatagacgtccgagattcgtccacggggatcctctagagtcgaaaggcggngcaccaagattgnggttgttcattntcaaanggacgcgcg

SEQ ID NO: 29757 - DNA, 33916 bp, Oryza sativa
  unsure (1)..(33916): unsure at all n locations
cgcgcgattaagccttgagaatcncttcctcgcnngccngcangncgactttagaggatccccgttaaaatttaactcgcagatcattcatgagttaaaattttactcatggtaacgtagacgaatctcgaatgtccattgctcgatccagcggtagtttccaagtttttactacatatgtggtttgcactacatattttcccataaacatgggaggagtccacataaatcaatcctattataatatgactttaactactggtcgttgttcagtctggacaatattggaacaggtagccaaaaattagagggagggggttcctaatggatcgctattattggtagttaattaatatttgaacaaattaagcaatagttaatgccgtttactccatcaaaattcctcccattctaattttgtcactcggaaaatcaattcctcccattccaattttcctcctatcaactaactaattttcctccatccaaattaatgcgtgattttccatcttgtgttcttatctcatctcaatggtttacacatgtgcatatagtttccccccaatcttctactctcatatcaatactgtactatgagaatcaaaatattcgtgctagtattgagagtgtgtcaccatgacggtaacactactgatctcttttaacatgaataaatattcaatgtaatttttattgccgtaggaaaaacgtctatcttaaagtttacaatttactataccttcatagctactactatagaaacggagtcgtcctcctttcgttctctcctcccactgctcgtgcccagcacaacataagagcataaaaggaacaaccattagatcacattcttaacctattctcagccatataaacccgttgcaatgttcagtcatgttactagtatatagtacaaaaagaaaaaaaaattaaatttagggcctaaacctaacattaagcgtgcatcacccaacttccaggcacggccttggctctatattcccaagtcagacaagggtgaaaacaagaaatgtattgtctcattatttaataaataaataaatctggttagcatctttgttattgcattattacaaagcatgtgtcagcttattgtacttttaattagaactgaacgtctgttttaattttatagcccccctattgcccacatgacataaactcagataggtcagtacaagattctagtcaagtagctatttttttctcttaaaaaacttatttttagtttttttattcaaactgcaaaacctatatatgtgtcaattaacaaagttcttgatttggttggacatgcatcaggaaaactatattttaaaaaagaaactcgtcttttataaagattgggtaccagcaatccgttattgcactaaaaaaacatttttcatgggtttaatttccattccatttttatttatgcccttcagaatcatatatactagcttgcacataatgttagtgaaatccattagctgatttagaagtgaaaaatcttttactccattagcatatcaaacacttaatttgatcaggagacggatcgatcgtggtgaagacatcgagcggcgaggagttccatggcgccaagtgcatcatcacggtgggcgcctgggccagcaagctggtgaggtcggtcgccggcgtcgacctgccggtgcagccgctgcacacgctcatctgctactggcgggcgaggcccggccgcgagcacgagctcacgccggagtccggcttcccgacgttcgccagctacggcgacccgtacatctacagcacgccgtcgatggagttcccggggctgatcaaggtggccgcccacggcggcccgccgtgcgacccggaccgccgggactggctcgccggcgccggcgccggcctggtcgagccggtggcgcggtggatcgacgaggtcatgccgggccacgtcgacaccgccggcgggccggtcatccggcagccgtgcatgtactccatgacccccgacgaggacttcatcatcgacttcgtcggcggggagctcgggaaggacgtcgtggtcggcgccgggttctccggccatggcttcaagatggggcccgccgtcgggaggatcctcgccgagatggccttggacggcgaggccaggacggcggcggaggccggagtagagctccggcatttcaggattgggcgtttcgaggacaatccagagggaaatctcgcggaaaataaggtcaaaaattaggtcctcacaggtatggtcgcctgcgaaaattggtgcaacgtgtgaaatgtggttatcagtagggggtttgtttaccgtaaatctattgaacattgtatttcataacttctatgtgtgctttatactcttggatattggtagattgtaataatttgcatcttctctgtccttgtgtataagattcaaaataaagttgttctgttgcatttcttcatctttttgcaaaacacaaaatgttcctcattttgatcttcactttttttttcctcgggagagaatcacactagtgctgttttttttttccctcgggagagaatcacactagtgctgttcctattcccagtcctattcatggtagatatgccgttggtgaattgaaagagacttgggtgttcgccattgtcggattcaggcagtacacgccgcaaacctcacaaagttaatcctttggaaacaaagggttattttggaggaattttgaagggattcaattctatagaaaattttctcatgtgatcctttggataaaagaaatagctatctaaaaatcctatgaaattcctttgggttcactctaaacatacataggggatttgtaggaatttcaacataaggtccaacccgtctctatctttctctcttctaattcctgtatttcctatgctccgttcaaacagttacatttttatatttcaaatgctcttttaatccataggattagagatgatagctccaatactatattttttttattgttcctacattttaagaattctgcattccaaatgggccctctgagcatgaggaatatgctaggatttgaatagctccaaaacgttgagtctttctaaatacgtcacgtcttgctgcaactatttcttagttttaatcatgcatgttgcatggtgaagaattatcacttacatctagctataacaacatgtgttacatgctagctgatgggtctcattcccatgactcatgagtgatgagtgcgtcaagtcatgtgctgagaaagtgacaattcacttgttgtttttgttaaacaatcaaagagatgggcacaatatctttgtatcttttcagtctgatgtaatggtgcaagtcctaaaaaatcagtagtgacaatcgaattgagccacacttcggttgcttgtcctcattaggtggcatcgatatcgcacaagtgaattaatgcctatcgatctgatctgaagacttggctgttttcaatttgcacaggtcatgttcttgatcttatcatttgatagattgtcgcatagtgcgttgtcatcttgatactatccaacactccatctgtatggagtatctggtgagacagtgatgctttagctttcgcagtacaaagctgtctctgttattgatgactggtacagtaggttcaagactgaagaacaacaggctagtggagatgatgaaatttggagtgatggattgttggtgtaattttcagaaggaaaaatcaggccggtcctgtgcacagtgggcacttggcaccattgacttgacctggacttggacttgttttttttttttttgcagggactggacttggacttgttaaagttcagcgtaatcaaatcagtttgggctgtgtttagttcacaccaaaattgaaagttttgttgaaattgaaacgatgtaacggaaaagttggaagtttgtgtgtataggaaagttttaatgtgatggaaaagttggaagtttgaagaattattttggaacaacacacggcgcaaatgtctagctgaaattcagtaaattcagttgacgaagtacatgcatgtgtctcgtcaatgtgaatatttctgaaattctgtccatgactactaatgtttctactatctagcaatatatttagatcttctgaacttgagtacaaagaatagaaaattaatgaatttaatcactgctaatatacacgaagaataggactaatctctgaacttctcgatcaactgatctctgacaagccttcttgatcgtgaactcgtaatctcttctttggtgcagttaattactactaggagatgacttccattaatggtgtgctcaaatttcccaattcttcatgcttcactgtcagatcagaaaaggaagacgagcagtagtagtagcagtagcagtagcagaagccatggctgggtgcatcgtgtgctcgccgacgacgccgtcatcgtctcaggctcatgtgctcctccaccgccgttgtagtatatcggcggtctactgccgccgccgccgccgccgccgccgcggtaagccggcggcgcatttccgccatcgccgtcgatgatctgtgctccgaggaacacggcgtccgacttattgatcctgcagcaagaatcacacagctattaaaatttcaggaatttcgatcccctcgaccagaaattatttcggctaaatttttgtttgggtaagacaattttcattcagatttaaccaaaatttgccctaatgtaacctttttggtccgaaattttcagaaaaccctgcaatttccgaaatttcgcttcaatgggtaaatctcagcaattccacttctatcggtaggttttccacagttcccaaaattcatgcaatttccgatatttcacttccattggtaaatgtccgcaatttccgaaatttcacttctatcggtaagtttccagtccctgaaccaaaacctgtccaagtgctaacttttttcaatccaaacatttcccgaaatttcgcttctatcggtgtatttccgcaagtttgaaaaattctcctggatctatcggtaacctgtccaagtgttaacttttttcagtcctagaatttcccgaaatttcgcttctatccgattttttttcgcaatctccgaaatttcacttctatcggaattttctatcggtgaatttccgcaatttcgaaaaattctcttagatctatcggtaaatttcagaaatttctcttctgtcgtaaatttcggaaatttggcttccgtagctgcatgcgtacccggaggtagggaggcagaaggcgatggtgtagtcgtaggcggccttgcaggtgaaggtggaggtggagtcgtcgtacgcgtagctgtaggcgcgcgggcacgccgtcttgaagatggccgagtacgccgtcggccggcacgccgccggcgtcccgtactccccggcgcagcagtacctgtcctgcccgaacgcctcacacgcgctcctgcacgcgatcgccccgccgccggcgcacttcacctgcaacttcctcggacacgctgcacacatcgtcgtcgtcagctccggcaatggcgaagtggcggcggcgtggcgcgcgttcgtgcgtgcacttacagcggttgaggtcggccatgcagccggtggcgttgcaggcggcggcggcgccagggatggcgacgacggggaggttgtagccgtcgacgaggctcacgtcgtagaagtcctcgccgccgcccctcccgagggtgacctcgaacagcgtcgccggcggcgcggcgccggcgccgcggcactccacgcgcccgccgcagtcgcccgtctggcacacgccggcgccgtcggcgtcgaacacgcaccccgtccgcgcccatatcctccccgaccaccccgccggcgccgccagctgcgccgtctgccccgggtcaagccggaaccccgtcgtcgacagctgtggcgtgccggcgccggcgagcgtccccggccatatcgggtgcgaacaatagttcgctatagtgaacgtcatcgccatggaactgcacgaccaagaagccgccattgccaccacaagaagccatagcttgcaagctcttggctctcccatggctcctatggctcaaaatttgggaattgatgttgataggaagaagattgagcagggaaggggaagaagacattgagagaattcttgcaagatttaaaggtgcaagtgccatgatgcattgcatttttgcatgtttgcatgcaaagaaagctttttcttggtgtgcttggtttagcatgttgcacggatggggtggcctaggaaagaagaaataccttttgggatgatgcaagcttatgatggtgacatgatcttagcatcaagagaggtgaatcttctgatgcttgtgctaatgcagataccttaattactagtcaaacatgctatgttttgaatactctgtagtctgtacacagtctgaacatttggacagagtacatgtttgtgagtttgagcaaccgggaaaatggaaatgtacagaatacttttcttatttggatacagaaaaaagacttgagctgaactctattacagtattagaatcagtagtcaggataacagcatgaagattctgaatttgctatcatatccatgcgctgcaagcctgcaattctcattatccttcttttttcttagtctttatttgggtttgatttactgctcgagtagctgctatctcagaacattagttcgctacatgtagttctgaacacttcaacctatcggtaagcttgtaaaatttatgatccatttttgcgtcagacatgctcttcaattccaatttataaaatcaaggtgcaagactgcaaattcattttgtctacaaaaatgtcatgtgttttgtaaaaagcgtacgatccatttcatacaagattctttcaggaggcaatcatgcctttggaggaaaactgcaaggaaggaatcatacaagaaaactatcaacatgaacaaccggcacaaagatcaatgaagatgacaaaagatgcacctttttgcagttccataaaatcaaataaccttgcaaccagaccagataaagaatctattctgatttgattgcacaaaaaggaataatcaagctggaattgtgacgcttatggtagctctctgtatattgcctacctttcaagatacccttgactgaacaaaacatgtgtgaactgtaagctagtccatgagaactcagaaaaaaatccatttcagaaagggttgagaacagctaactcatagtgcagcactacgaccttgtaaattattagaacccaatggaagattacatgattaggaagtttccatattgtacagtactcatgatcttatcagaggcacaacaaacaagtggagacctactgcagcatcactcctctgacacaggttcctcagcaccaccttcgggaacattggagtcatcaacaaccgtgacaccctcaagatccaaggggcgcccagtcatcggatgaattgggcgcctatcacgaggtccaccctttcgagccatagctagcattggaggtggaggcagaagcccagctcgaaaaaggatgcgctgcacaggatctgatggctgagcaccaacagacagccagtacctgcaacagaagtataattgtatgctgttacatggccttgcaagggagggaaggacatcatagcattcttctagcaattaactcaaagaaagaaatattgggaagatcagactcttgactctcgacaaggtgggcaatgaacactggcaactagacaatacaggatcaaagatactagttctgctattgatgaaactaagcaccatgcttgaaatgtctgaaactttatatctgtaattttcttccctgttacggatactgttaagcaaatctcatatgcttaaaatctctaaatccttttctgctatggatggatgccagtaagcacatctacaagctacaaaattcagaacccttgaatccatcattttctacccagagaatggaaggcacggatggttggaaggtacatggtaattggcaatacaattaaatagtacacagaagcaataacagcaccccaactcctggaacgaagatcgcattacaatgataactgaatcagtccattttgcctatcaaacaatcagtttccatcaaagaatcaggctgctatagcaatgtcagtcctagactagcatcagcaaaagctccagcacgccaatttttctccagaggaaatactagaacacatcaaacactccaaattacgagcataagcaaatgaaactcacttgaccctgtcgaatttcagccccatcctcttgccaccatccttccctgcaatcagcaacagaaagcacatactcctccatcatccatcaggcattcaatcacaagcttacagccaaattctcacgcacgtacagaaatgtttcacactctactaatccctctccaatctgatccgattcaccatttcaccaagacgttgaggccaacgccaaccaacggggcaaagacaacactcgagaacaagccgatccaggaggagcacgagggggggatatggaggaggagggctcaccggggagcgggttgtagtagccgaggacctcgaggtgcttgccgtcgcgcggggagcggctgtcggcggccatcacccggtagaacggccggttccggcagccgaaccgcgccagccggatccgcaccaccatgctcgcctcccctcgcgcctcctcctcctccgccgccgccgccgccgccttcccttccccttctccggctcgggtcgcgtcgtgttcactcctgtgggagcaagggttttggatttggattctggagaaacccaacaaaaaaagaagaaaaaaaactcagcgggctttacctctgtgatgggcctgatgtcccatagagtatgggccttccagctagagcttgttcacacgagacttctttctgggctttagcccatgggccaaactccggcccacttatggttatacttggttaggctcctgaatggttattagccatttaagctgacttatgcattggccaatcaataattcaatagtagctccatccattcagtgatgaacaaaattaacacgataaaagctcacataaactgtctgtaaaattaatgaaaaaaatcaatagtctgtttggacaatgtgcaggaatactgaaattgcacaagaatcggcccaaaagaagggaactgacaaggccagaattcatttgtagttctctgctcttaacacatttgataacctaactaatggaaatcaggaagccctggtctgtgttttgctgaagtctggaggcctggagaatatagcttgttgctcactcagtcacacccaattgatcattgtcatggttggtagacgaatgctttttcctgcacaaaagatggaagcacacatgctgaactttgcccaagaatgagtgcagtaagaatggaattggaagagaaggatgaggcacaaaaaactgaacaagcaaaaggcttacttgtttgtattggcatcgctctctaacaaaaccgaattggcaatggtattttgttgtctaacagacacaaaaagatccgtactggcatatggcatgctttttctcacctaagagcacctaaaagtgaaacaacctgcatgtaaagtcattttcttgctatgacaaacagctaaggaatctgtgtcaaaacaaaaaaactgattactcctttagggattagcatcactgaaatcatgagagaataaaatgatgtcttacattcaatgaactgatgcatcaaggaccttgtacctgtagaagtaggacccttcagattaggctgctccatgtttgaagaataaaactgtgatttagtcatccaaatgcattcatacatgttaaagaaggcaaaatcttttccatcacatacttttcctagcattagcatgaacaaacaattactgcgaacgtcaagaaagtaacagaggttcaaaaatgatataaataaattagtagatgatgcctaaaaataaaaacgataaagaaacaaaattttatatgcatgtcaggttgagagaaactctaaatgaggaagatgtattggtatgtctaggtagtttatttacccttctccctttcttttctccaactcccaatgtttaactaagatagtctatctcgcattattccacaggcatctattgccacccataattttatgtcccatttggtaagaaaaatgattgattgctgaacccagaagtactgaattgaattattgctagacaggttacttgtgctgccaacaatgtccatattgagtactctctactatgctactgctagatgtgaaaaaatatatatactcacacgttttccttgaatgtcttaaaaagcaaagagaaagtacacaaataatacaccaggaatacgaatagaaagagatgccataaaaaatatatgttctctggaacttcagtaatgatcctgtaaaatcaataatcatgaaagctacccctgtgatgcattcatccagaagaaaactagatactccacattgaaacttccaaatggctagccaatgtgaatttcataattttatatctctgttagtttctgtgtgcatatatgaatacttagctaacaaatcttggcagtggagtaaggatgtcgacaacaagcgattgcgtgcctaagcttcttacaaacaactttgatggcaatggttactctgatctggtcgttgtttggacgctgacgttaatgattttgcaagtttatcagtaacccaaattgacgcgattctatcaatcagtcacccagagtagttacgggtcaatctctctcacgtatcagtgatgtgtgattgatctgttcaacttcaaagagcacaaatgaagcccgttcctactttttgttttactccatggacggcttgcgcacggagtttaataataatgtggtcacaaacatgagtacatgactgccatgcaatttcatattatgaagtgcttgacaagtaaatatcattttcatcacaaaaggttctttgatgatatacattggaacttatgctgtgcattttgcagtgaatcggggagcataagaaagacaaacctgcattatggcagtaatacagggagcacaaaaagggaccacaaccttcactaccagaatacatgagtcatttggattaaattggggagcatataagggataaatctacattattgcagtaaaccagggagcataaaggggacaaaccttcattatcaatagatgagtcatttgggttgtgctgtgcacttctctcccttggataataccattgaataatatgcgtgtcagcaaagaaataaaagttttctcctaatttattagatttttcatcacattctcaactgcagtgcttcacatgggacacatgcaggagatgctttagtccataacatttatagttcacaagagaaaaaaaacaatcaagctctagaaaagagagtacaaacttaattataatttctgaacgagtagacaccgaccctcttctcttaattagaaaaggaactttaacaccaatctttgttttgcattagtttgaaatagcattccattttttctagccacaagcttcataatacttttgtttcttttagaaatataatgctcctagttctgtattgctttatttgtaaaacaaggaatattaagaaacatgaatgtgacataaaaggcattcacaaaatccttcttcagcgcaagtttttttaagagcatgcaaattgtgaaaacaagatcatattttctgagcccagaaaacatcagaacaaaatggaatactctatctattttaaaccactgcagaatcagatcacatctaatcaaggcgacatttctagttcacttgtcaaaaagtttaaatctggtagtaatcccagaacaggtgaattatcacattatatgcattttcttgtctggaaccagggacctagcacttaatcaaagaaatttgattacctatcttggagcaaaagtagaaaaataaattacttgaccaactagtatactagaacatcaaacatagaagaacaaactccgggctgcagcaacaatcataactccatatccagctttagttataacgtcaattcaacaacctacattaacacaggtgttttcttgcactgcattgttagggaaagaatacaggttgctacttcattggcaaagcataaatcagttgtgcataacaaactggttccaccaacagaagtaaacatgtacatattaccttattaggaagtgagtctttgctgtaaatctgcacctcaccctctagacaaaccaaaatgctgtctccagattacccagcacagaagtgcagtacacagctagctagcaagaagtgatcatgaagctgaagacagaatagagatttagttgcaactcaatcattagaccactaacatgagtacatggcacctcaaattagtattcatttgcaggctactttttgttggtgtattaaatccattttttttccttctgactaactcataagtacagtgttgatttagcaaattacatacagagaatttacaacctctatacataacagtagaaagatgtaggtaacaatcatgatatcaatgctgtggcatcatgataatctgcagcagtaaaaagtaggctctttacttgaacactttcccagagattagaattaataacttggaacttcatagcgattaccattaaggcttcaaattttatcccagtcagtagcaggagtacctgtttcttcttgtttgaacagaagaaagaaccatttgattagctgaaaatagttcagaatgccaaaattgggtattggtaggaaaggaaaccggtttccttgtccttactgtactactccttctgtcccgaaatatagctacctttgtacctttgtttgaactacaaaggcaactatattttgggacggagggagtatgtgcttagtaatgagatctaggcatatctttgtaaaatgccatctgttgctagaggcctagaagcatcggagacaagcaagctagcactttgttacagtgatatgtttctttaatatacacggaaaatacactctacaactccacctgtcaccaaaagaaaaaatattacgatcagttacctatcatgatatcttcctgcttgtcatctacaaataaaattttccatcttcatggcagcatcatgttggattaagtaaaaggattatacgttaaccttccatctataatatagttcaacgtctgcgatcatctgtaactctacgcttctacagagacactactgattacgatggatacagcaatgtgaacatgatctttgaagtttgcagcctgttaatcttttcagattaataaaacataaattagatgagggaggtagaagctacctttcaaaactgtagtaacaaatagtttttccagttttataacactacatctttactgtgttagttaaaacttatttcttgtactcaaccaccattaacttctcacgttcagggaaaacacaaaattatagtagcttcctgtgttctaaaatttcagatggctgggaaaaacagttcatgatgttgaatgaaaggaaataatctgcagattaatgccatcagacacattttcaaaacatttaagtgaaatgctcataaaatccattcctggtcatgttatcgtctatgtcagtttgaatcaactttgcaagcattcctatcatccaaagaggtcagctggaaatgtaacatcctgaccgccttttaggtgtgcgttttcaaagaaacatatccatgcattgaaagaattgtaatttttttggctgtggagaaaaacagagggtggtagaaagctccagtgtactttcctccagcaaatgaagtgcttcacaagttatgaatgattcactgaagccaaactaactaatgtcaaatggttggtttgccagatatgaactttcgctaacgacaattttgttagcaacagcatcaatatcataggatgctgttcaaaataattgctcaactaggctaatacctgtacttcaaacatttctgtttctgaactaaaaataattatgtgatttgagagccgttaaaccgcccattcggaaagctgaatcccaaggttcttggccttcaccttcacattcttccccatcactactgataccgagacacaacaacctgaaatgtagtccatcgtaagcagggacggatctaacttgggccatggtggttcagttggaaaacccccaaattcttttggggaacaaacaaactgttacttgtagtagtagagaagctagggtttaacgcaagcatatccgatacaagagagagagatgcggatgctcaccgggatgtggctgaagcagcaggacgacggcgcccctgttcctgctcctgctctgctcgctcgggagatggaaatcggcgcaggcggtgggcgaactcgctggagcggagacgagacgggagttttttcttcttttcttttttttctttacgctgagtttttttaaagaaaaaggaaattgcgcataattaaatgagtcaggggtactgtttgctattaccagtgatttgctctgcgtcgtaggttggtccagccgacggtccgcaaacgatctgtagtgtcatattttttttcttggcttatgcttttatttattagccaaaatttgaatttttaatcttagatttgaagttgattttagggggttttttatcatattttattttccaatctttgcttttagatcgttaagaacacgtatataaaagttttattcacaaattatttttcctttgcaaatatgccatttggtttattcccccagtaagccaaacaacggggcgctcgtctaactgattcaattttgatcatggacagaaaaaatgcatctaaatttgaacttttttggaaaaaggaaagtttttccaaataaatgtgaaattttaagaaaaatgcatctaattttttgttaacggataaagattgctcggattcgggtaaactaaaataaatgtacaaataaattactcgtcgttttagctttgtcataagtaaattgatgattaaagattagatatatttaatttaggagagaagtaaaacaagtaatttagaatggagggagtatcattttcatccagccaacctttggtctggtctttcgtgaaaaaaaaaatccttctcaatgcaacatggacacaccttgcatgattgttcaacgcaagatccttgactccatgcaaagttagcatagagctttcatgacgcaatggaagggaaataagcacaccactgcagtttagaaatcagatgaaatgaaatgttctgctagtatttatgacgctttaacattaacctttgaattaaccataaaaaaaactgacggacagaatgaaatctgacaagagcacagtgaatcagtgatatcttccaaaatggtcactagtacaacagcataactcatcaagtagtttgttgtgacacttgacctacactagttcttgcatacatctgtagtccattctctctgaaacagttatcatttttgtcatatggtgcatgcaagctatctcccatgtatattctacttccaaacatttctatcattaggagcagattaatgcaaaccgcaagcaagttgtcaagtgtttgtacgattgacagtgaggttacagcacatgcatgacacatccttaattaggagaggcaaaaagaagattaacccacaagaaacctgacataaacttgtgagattaagcaaaaataaacataagctctgaagaaaacacattgctgccagtcaggcttccaacaacaaccacgatatgatctctatcagagtcactgcatctgcagctaattaagcctctctcgagcgaactgtcaattcctgaacttgctttcacaaatcagccgtgtaaaccttaccctgaagaaatacatttttcaaaaatctcaaatcacctgagcagttcttgacttcttcatcccactatttcagctatcatctctctttctcagtggcccagtttgattgttctgaatagatgaataaatgacagattttctaattgtgtgatgaattttgagggtacgaatgaataaaattaactagtgcaaagtttaaagttatctttaaaaagtatttgaagcaatttatatatagaaagtttttataaaattcacactatttaagagattggatagtgtgccggcccgtgataatctatagtctgtttgtgaaaaaaaatgatgacctataaattctacaaaataatcttgtcagaacaagctcaagaaacataagacacaatcaaaatctttaccattcagtaaacatactctgtcactgaaacagtcatcagatattcacatatgtatcagtgtctcccaaataaagtggagtacatagaaaatgaaaggatgaaacatgacaaaactggtcagtagcaggagccagcccaagagggcaatttgaacggtcaacatgaacaagaaccctagatttaggaaataatattaaagaacaaactgtttttagggaataatttgggtactgtgacctggtgagtgatgatcaagaatcagattatttatctgaacctctgcctcggccacaagtgattaaattgctgtagtccttttagtcaagattgcatgatcctactgtcattgtcgtgatatccacaagacctggctcaatatggattacaggacaaggcaaagttcctgcaaaatggacagtacacaccattgttttctgctgccaacaattgcctacttgcctgtcactgtttgcaccagtgagcacgcactggtgcacctttcgttttggaattgaaggatgagattacaaaaatctgttgatttaaaatatctcacttttcaaaataaatttgctagctaatcctttctctaagcaacctgtaacagtcttcaggggaaatttatatggttatatatatgttcagatcatgcttgcgaatcacacaaactaattaagaagcactgctgattccctgtattgataaaaatgggatctttgaattggcaaactgatgtgatacatgtattacattaagtttttgaaaaggtcaccggccggggtattacatcaggtaatcaaagggaaacaaaccattcggccatcttgttaattacatcaaaaatcaaaccactccaatttctcacaatctggcctccaggagtgtatgatcattgttcgtttatcacgcccaaaaatcaaaatatatagctaaaattgtggatattccgatcaaaccttagctctagacgaggaagcacgcgaaaatacagttaattggttctgcatatatcaatacaagcattaattaaattaaaaagacaacaagaataacaacagaagttacaaaaccagacacaaattaaggatcatttgatgcatcatctctgtatgatccatggctctgaacagctagattacacactggcataaacactgtttgccccccaaaattattctacgagttggttgggattagaggagacccagccccggcgccccggcctgcctgaccgactgcctgccttcttgcctagcccccgggtcaaaggggcgcggtgggcccatctgacgtgggacccacacggccccccgggccccacccgcacgtgtcctgttttgctgagtcacgcacgctactactgtctactgtgttcatgctgttcgtcgctacgtacgatgactactcgtcggtgtgaactccacattagctgattaattgtgtgtcatatactatgtaaattagctcgatcgatcgatagatagttttgctgcgtgcgaccagcgatcgcccacggaatcagaagcagcggattaattatctgtctcctcttgagtggtaattaacgcggtttaatggtaatatagtcgatccgtttgatggtttctatcgtttgacttcagaaatcttcagagagaacttaacgcaggcaggttgctgccgtacgtgcctgtactacatacaaatacaatgaaattatgcaaaaacactagttcaacaccgaagataacaactaagccccatatgatatataacaattactacctttcgtctcaaatatagaaacttactccttttatgattttataatatagtaatctataagtatcatatgtatatgtgtgctacaaacctgaatatgaaaagtgtccaaattcattataatagaatgtgtcacacacgatactcatagattacttatattataagagcgtaaaaggagtaagttgaaatagcacacacgatactcatagattacttatattataagagcgtaaaaggagtaagttgaaagaagagctgaagaagcacagtaaaacctactttcctggacatttagagtactgtcatcattcacacattgatcatttcttcattatatttctattctcctattctcctagtcgaatagcaactcggtcgcgttgccgtgataggcgatagcttaattttgtccacatagctgaagagaccacaccgtcaactactgttgcatgcggcgacgacgacgacgaccacgccgccgggctagctagctaggctagcaaacggccggcgaggcgaggcgagcgagcgcacgcgtacgtggaaattacaagctgacaaaaggccgatcgcttgtagctgacgacgcccggttggtacgagcgtcaccaacacatttccgagcctccccttctttgtctccctcttatatcatcatccttctccttcgcccttactttcatggaaaaaaaaaacaattaatccgatcaaaattaaagcccaaaagttgagatagctagctagctcatcaggagagagtgagagacaatatccagcttgctaggtagctagctgccgtttgcgtgttcttctttaatttcttcgtcgcataatctgtctcgtctctgataaactttttatcttctttttttgggtggtcatgcatgctgcggccaattcgttcttgaattcgttagctactccattccatatatagattcgatcttgtcctagctagatacctagctgctgctgctgcttcttcttcttccttggtgttgaatttggttcagccgctgctagctatagctttgcgcggtgttcgtagggttagggtttttgctgtgtgttcgacgatggctatgggaatggaaggatcgggaggaggagggtcggcgaaaaagaaagaggagagcttgccgccggggttcaggttccacccgacggacgaggagctcatcacctactacctgcggcagaagatcgccgacggcggcttcacggcgagggccatcgccgaggtcgatctcaacaagtgcgagccatgggatctcccaggtaattaattaattaattaaacaaacatgtgtttgcatgcatgatcttgtgaaattttatatgctcctacttaatatctccccttctctggctctctctcctcgatcttactcacttagcttgctttcgctgtggattagcttttgtgttcatatgatcatattgaataattcatttttttcctgcaatatatgaatagtttgtactacatatattcagaagtgcatgtttgttgttggctatgcatgtatatgcatgcctagtccttttttcatgattttgagcatatatttcttacctatccttgccctgccagaggtaattagtcgcgtctagatttcaaacatgcatatatggtgcaagtttttcaatagctaatccaaaagtctaagctcttaaaactactacatgtgtgatcctaaaagaaaactatgggatggatttcaagttttctatggtattccttttttttttccttactgagtcttgcttgcttaaaacatgtgaatatgatatcattggtgatataatatcttggtggtacacatgcatatataacatattcaatcccccttctctcccttcccttctattagtgtgagtacgtatatctataatctatatttgcatcgtctttgttctcttcttttttaaaaaaaaactttcctgcaagagttggtggttaatttggaacacataaacttcttattgttatttctaggggtcttatattagaagctatcttaattctatgttctttataaaaaaaagtaaaatatcaacagaaattacaaaccaaagctctagcttcagcactgtatgtgcatatgcatcgtccttactctcatatatatatgtaggagatgtttatgaggttctgaatgttcaaatatgtggtcacattttttcacacttacacattcacaatctatatgttctatgtattaattttctctaataaatgtgctccagagaaggcaaaaatgggagagaaggaatggtacttctttagcctaagggatcgaaagtacccaactggcgtgcgcacaaaccgagcaactaatgctggttattggaaaacaacgggaaaggataaggaaatcttcactggacaaccaccagcaacaccggagttagttggaatgaagaaaaccctagtgttctacaaaggaagggctccaagaggtgagaaaaccaattgggtcatgcatgagtaccgactccactccaaatcaatccccaaatcaaacaaggtaaacaattcaattgatagtattttcaaactcactactatacacatgcttcactaaatttacttgtattaattgaaatgtttttgtgatgcatcattttgtttatactcattatatgacaggatgagtgggtcgtctgtcgcatatttgccaagactgccggcgtcaagaaatacccctccaacaatgctcattcccgatcccaccacccatacacactagacatggtcccacctctcctcccagctctattgcaacaagacccatttggtcgtggacaccacccttacatgaaccccgttgacatggcggaactctcccggtttgctagaggtacgccggggttgcacccacacatccaaccacaccccggttacatcaacccggctgcgccttttacactatcaggccttaacctcaaccttggatcctcgccagccatgcctccaccaccaccaccgccaccacaatccatcctccaagcgatgtcgatgccgatgaaccaaccaagaagtactacaaaccaggttatggtaacagagcaaatgattccaggactagccaatggtgtcatcccacagggaacagatggaggttttaccacggatgttgttgttggaggcactggcatcagataccagaatttggatgtagagcagctggtggagaggtactggcctggtagttaccaaatgtagtcctgaaggaaatgcttggggtactgccaagcaattgttggtctattatgtaggaagacataattatttgagctaccttaatttagtctatggatattgtatgattacttagctaatgttgtacccttgctttttagtttctcagttctcttgtacctctagattttgttttggttgtaacttgtcagattgtagaaactagaggactgtttgtttgacctgattgcttgtacatacaccttatatattagtgatcagatcatggatagtgctccgctgtgagattgtgaggggtataggcacatagacaaccaaagtttaaggctagttcgatttggaggaatttcacgggaattttggagaaatcgacctgttttctgtgaaaatcctataaaattcctacgttccgggattaatcaagatgatgcaaggatggaagaggattattcgaccagtatgtgcacgctagctgattgcattattgttactcgagagtttacgtactctttggcagtaaattaatcaatatgatgccaggatggacgtgcaagatagatttgtacagaatgggcataataagttagcgcaaccaatttcaatcatcaaacgtctgaaaagctcacgtatgtacgtacgtgcatgaggaactagtctcagaagaagaagtagcagtatacagcactaaatcagggcatgccatgacatgacataaaactatcagagagctgacacggattcattcatgaattgcgtcttcatgtagcaaggaggaagagaaaattaagaagaacagaaacaaaaaaaaaacctggagtaaaacaaagctgtacaaacttcagtgcagaaacaaatctgagatctcgagtggcaatggcggcaacaaagaactagcaaggtagcacagcagttgaaacttattaacaaggaagcaaacgattccagactgagcggtggagttctgttcgcccggtgtgcctgcagttcctgactgacttaaatttctcgccgggccccggcgtacggaagaccttgccggcggcggggggcgccggcgttgaagggggtcacgacggcggggagcggcggcgacgtgcttggagagagagacggatggggcggttcaccaaaccaggcgaacgacttgttaggggccgtttagtgtgacgcatcctacttgggccgaaatatgttggcccaatttcggatctccaccgctggtagtggatccatattcgggtgggctcaaagcctcaaaactctggcgagccaaactgggatgggccaactggatcattcagtggtactattacggaataagttcaccgaaggtctcccaacttaacagcgatgttttttgagctctcttaaccacaaaaccagaaatgtttacctctaaacttactaaaatcgttcactcaaggtcctataacagtatatatggatggtttcgctgacgtggcatcctagtcagtatttttctaaaagtacgtggggcctacatgtcagctgcacattttttttcttctcttttctctcctctctttctcttcttcggtgagagaggccggccgcaggcggagcggtgcacgcagatgcgggtggcgcatctgagggcgagcgcggcggcggcccgagcagtggagcgcgagcgtggcggcgggcgagcgcggttgctgccaaaaaagcggagggcgagcgcggcggcggaacggtggagggcgagcgtggcacacgattaactgcatgatgcatgcacactgtgcagtatgaacatgaccgattgatttaatttggggtacctcctcggtacgtgctgttgctatcggtgaagcagacgtcgccggtcctttggtcgacgtcgaggccgttgtggaagttagaacggcacgccggcggcctccgtcgtcaccacctcggctagcccgcctcgcaccggcgccctcaggaggcccaggtacgcgtcagccacgtacaggtcgccggaggcgtggtggaactacagccccagcggccggtcggccgcccgcacacgctctccggcaccaccagcttcttctccggcgagcaaacaccgacgctcctagtggtgaacaaatcgtcagtgcatacagcagcggcggagggagaggaggcagccggcgacggcgagctcggcggcggcgagctcaccttccgacacatcgcatacagcgccacgagcgccagactggccgaggcgtagaaggccagcagcggcgcggtctttatcccgtaggcgtgcgcggcgcgagcgggaaggaaggcggatgcgcggcggcagcaggaaatgacacaggagaggagctcggcgtcggggcgaacgaccgcggaggtggagaagagggagagggcctcccgggggcggcccgtggcgggagagcgcggaaagggtggtggtgtaggacgagtaggcgaggaagggagagagggtcgacggggagagcgtgtcacttgccggcgacagggcccgaggtcgagcacccggcgcgttcgaatatctctgccgctgagcttgccgtggcgccggacgccacctatcctctcccgctgctgctgtcacattggccgcctctctccctctcccgccgctgccgtccccgctccgccgccggacacctctccccttctgttgccacgcctgctcgagagaacctggagagaagagaagccaaaagaaaaaaaaagagagaaatgtgatacccacaccattttctcacttacatgtgagccccacatattaattttaattatttttgctgactaaaatgtcacgtcagcgaaaccaggcttctatactgtcttgggaccttttatgcacggttttacatagttcaggggtacacatttctggttttatggtcaaggaacctcagaaaatctcggtgtaaagttgagggacggccggtgaacttattcctactattactctttggcagcaaaaaaaaaaaaagaggatcgacgtgagaagtagattagatctgacagccagattaatcatcatgtctccagagcttacatgcataaagaaccaacaaaagtagtagcaactagcaagctccacatccgtgcatcccatgcatatcagaaagaaatcaatcacagcctcgacgctgaattctgtctgttaaacatgaagaagtacaatactacagtttcagtaagtgagagcccagaaaacgaggcagggattacacaaccacacacaagctctaaggaaaacgcatgaacaaaaactagaagacatgaccaataaaatgaataagcacatacagcctccatgtccactaaatcctactcagcgaagggcagatcgacagttacagaaccgcaattacaactaggtccatacatggggggcaaaaatacatagttcttgtgtgatctagtgtaactcgttaataatacaaaccaatgcttagcgatggcccgggatatcctactctgtatgccatccgagatctgcacaaatgcacagtacaaatcaatgtcaagccaatagcagaagcctataataatctgtttaggcctttataaacctcactctggtctagcttttagttcgaagtcatactgacatttgtaacaaaaatccgttcaagcatactttctttttataccgtatgaattgagaagagactctgtaacttcagagaaaacgggcaagcatatggttcgattgatccaagattccatgccacaagcagtatatcgcgagctagagcacattacatgaatcggattttaccacttaaataggaacaaagggtgcagtaccttctccaactacaatgtggcagaccagacatgaccaaaatccaacatatatggtctatttgtcagcatgccggcgtttgtgtttccgatggccatggttagcattaacattccgtgtggctttcttcttcttcttggagctacaaggaaatgaaaatattaagcttaaataacaaataaaaaacagatatactagctgataagcaaatagaaaacagaaataccaaccagaatgtttcaaccaggacattgtaaaaaacataaatgggcataatcagcaaagcagaagcctgcaaaggtagttaagacattatattatggcctttcatacttaaaaccacttgaagcacagttctattagtgccctaccaggtaccaggccaactcttcagtcgcaaattcttttgtcaattcatgttggtgcaggtagtccaagacagttgcttgagcctggaaaaagaacatatctgagattccggaatatatcttgaaaccgatatgtagtgtaccacacagaagaaatggtattccatgcatctaccaaacagtacacaatatatactgtatgcaaagagaacagacagaatgaggtttgagtatcacgacactgttttgtccaatcaattagctaaggaaattttggaagaacttgcacaaaggaacatcacactatggaggtgattttatccaagtacttgtgttacatccatagcatgaccaacaccaagcatcaaccaccagaaataatagaatttggagcatttataagcattaaaatgaagaactctcaagaggtaagacctcagcagtcactagggaaaatgcaccgaatcactattattacaacaatacaaaaggtgtgttccacacagtcttattctccagtaggataaaaaaaaacatatggaactatggaagttacttgacatgctactaattaagatcaatcacagctaccctaagaagcaaagagtttctgaattcaaaagcaatgggggaagtatggcagaagcataaagtatgtaaaccaataagctgcaatgcataggaaaaaatggaagggaaaaaagaaataacaatcacctgttgatgataagctgtagccttctcaagaaaatttccatatatatggactgctctttttgtataaggcttcaaataaattctaattttctcgacatgtggcttagtggccttagcaacttgatcaatgtaaggtttggatactttcttggcttcctgaaaaaagacgcaatcatctgattataaatcaatgattatatatactctaaaaaagaagctgcctcctatcctatcataatcaaactgcctcctggcatgtacaactgtgaattcttgaaacggcaggaccttagatgtacctggaagtagggatcagcaatcttatgtgctttcacaacatgaggtaagacaacatccttagatgcttgatagagctctatagattttgctgagaccttttgcacataaggctctgcgtttgtcttcatggtaacccatttttccttgataacaggtatccatttcttcaaaaggtaaatgccattgttagtgaaagatgatcaaagagtcaaaaacttaacagacttgtgatgctatatcacgtgataacatcaagagttgtccataaatacgtgtgattaatgcaatttttaaaatatctcagttttactctgcaaccaatttcttgaactgcagtatcaggaacaggtaataatattaccgtcttggcagcttctacatgtggctcggcccatttctttgcctgaactgatttctctgatgcctgcagtgatttagttcacagaatataaacgactgcataaatgacataattgacattttcaatgtttaactaaagtaatatgctcggtagcaccttctgcaataaactgttaacagcaggtttcccatgttcattccagtgacttaacatcatttcctgcacaagtcaatgactgatgagaacaagcaaactaagaagagatatttatactttatcatcagttataccttagcacgagctgtgtgtgtcactaaccaaggtggcaaccaagctccatgaacctgcataagtattaactggtagttcagtacgacacttattgcagtgatcagactgaaagtagtaggtgacttccatgtaacaatgggaagattacttttgtctcatttattctacagatgtaataggggctctaccctgttaatctaaggaaaacaatagaaatattacactcattatatgctcaatcatcatctaacagtcaggagttcctaattctcaggtaccaaatcatacatgatacattcataataaggttcagtggttagaagagtattgcgacgcacaattccgtcagaatttaacagctgagatgaccaactaggctgcattttgaacatattgttcaaaagtcaccggtacccctcaagtccagtttaacattggtttggatggcatgtcaagtttgcggagtaaatagctagggcagcctaaagtctgagtaatgttatcttactggcatagaacaaatctaaatcaaaacagatagcagatgcagaagaagaatatttacctctttcagctgatttaattgtgttgttgtttctaactgcaccctcataagctcctcctaagaacatgagaagcaaagactgaagagaatggcaccaagaaactatatcagagtaatcgcatcgatacaaacctctgcaactttaagagcatgttcagtcttctgaatcctacgcttttgctcatcacttgtcttttggagctattaagaacagtataatataaagataaggagaactgtaaccaaaaaagagaggtgctgtaaatatattaagaacaattaaaatataataacgttattcaacagataattaaaagatcatgaagggatatacccatgtttccaccaaaactttttaacaggagagcgaaagaaatgaaaacatacaggctcatctagcctgtatttgaagttacttcatgaagtactccatcaacttttggcaataccgtgctagagaaatatcaccttaagttttcacaggaatgcattgcaattcaagatattcagcaaatgcacgtgtgcaaattttctttgcggaaataaagaaatttaaaaccattgcagtaggaataaaaaatcagggcagctgcatacttactttctccagcttagcattcagctcttgcaccttcttatctgcatcaccagccctagcctccacagttgatttcttgctattttgtgcttcaatatccttcttcagtttttcaatctggaagaggttgaatcagaaaacacagtatcctaattgtcacactagaaatctggacaaatcatgcttccgctacctgcttctcaagctcaatagcccgggcattggccttgcctgcctgctcctctgcagctaaagatctctttgtctgtatatgacatggaaaaggactataatcacttcaagagtgtaaaaaaaatgcttcaaaagtattatcttttgtcaatagatacctcaagtgaagttatctcactctgcagggtagcaattttctttgacttctcctcaataagcttttccagcttctggatgccgtcatccttgctcttcaactcctgggtctgttttgttatgctcgactctgcaggatgaaaataatcaagctcttctacactaaactgatgtcttttggaagaatcatgcggcatgcatgctttaaatgacctagtcgaaagatcatatgattcaggctttataagaaagcccgaaaggaggtccatatagaattaccagaaattgatacaatccactctcaagtcacaacttatcgagactcggtaactaaatatgcatctgctagggacatgctggtagctaacttcttcagacttactggattccctaatagcagaagcttcctcgagcattataacctagttccaagcaagggtcactcatttcacgtgcatccttttctagactgaaaattccggtacatctcacgggaaattcatgacccgttacaggccaaatcagcaaatgcaggtaacgaccacaaggcttttgctcagaattgaaaccatttaaggagatactcccagaacaacctagcattcctccaacaattccaaatcagcatcaaccccctcactctaaaccactgaaaacacctaagcccccattccaaatcaccaaatcaccgaatcgctccccacattgcccattcaatcgcgtaagctccccctagccgcccgcatctaaacgcctccaaaaccctaacaggtcaactaaaacccatcgaaccccaaatgaagcagcaaaagcggggggcgcataagcgtcacgaattcgaatcgagcgtagacattacacgcacgcacctaaggcggagatcttcgccctgagctggcccagctcggccgcgagcgccgcctcctccttggccctcgccgcggtcgtctcctccgccgccacgtccccgagccccgcgttctgcgccaccgccgccccggcgacgagcgccagcagcagcagcagcctcgcgatccgcatcgcgagatccgcgcgaacctgccttcctccccgcctcggcgcacgcggcgcggaaaagtggagaggagatgggagcgctcgccttcgcctcgcctcgcctcgctcgctgtcgctttctctctctctctcgggtggccaagccaacgactcgttttatatggagctcacgaggggagaggggagcacgtgggcatggctggcactggcactggcacagtgcggcgcggcaagtggcggtggccggcgtgaggcatggggtcactgcccggtgggccccacccaacccggccagcggcgagcggcaccggcgttgggagagacctcggccgcggcccatttagagcccatcaaagccacaccccactcgcctgtcttaggtgggcgacgcgcggcaccgcaccggcgctggaagagacctcggccgagggcccatttaaagcccatcaaagatacaccccacgcgcctatgttaggtgggccgggcccacgggtaagggagatttggcccatttaggcacgggaggtagcgaaagaggaggaggagccgtcaggccgtcagtgtctttgctcctcttttttcttcttcttcctccgccaccacccgactcggcggcctctgctcctccgctcgttcctctcccgacaagggtgggtgggttgggttggggtgggggttcctggtcctccacagtccagggagctgagccgcgccgccggccgcaggtacctgcttcgtgccgccgtgcccagatttcttgtggttttggcgtgggcgtgttgttcgtctttgattctttgctttatccgtctagacgggtgcggtttgggtgtggcggtgtgcccttccccttctcaatcgctgtgtgatctctgcgttcccgtgcagaggattctgggagagaatcttggtaggaacgggttgcgtttggtgtggttgcttggtgtcgaattctgtttactgttcttggttggttggttgattggttgcctggttggccggcctagtcggttccacacttcattatgtttgtttgtcatggggataattgttgatcaagctaatgtttgcagtgtcataattgcaaatcccccgtttctcatcttatagtgcgtagtgcgttgtttcatcttaaggcagagtcacagagatgatttttcttacatgtccatgatgtgagtcttctattgttgctctgtgtaagtactaaagtgcccaaaagtccaatttctgcctgattcggcctattctatgctgtgtttaacaaggaaatatattgttcttgctccgatttgttcgtgtggttggtcagtgtaacagtgttcatagtaatgcataaacagttaacacaccttgtattggacaattgttctgggtcactagatttcaggatttcttaaaaaatatctatggtttcaggatgtcggatttcttagggaaaaaaaaaatctaagatcatcttttctctcagatggaatgtagagagcttttctgtatgtgagtaaaagttttagcaactataattatgaaacacccctttcattcaggcttgcttttgcaaagatgtttgacaataaataccatttcttgaatcatagagtacagaagtggtcagcttgttgggcactgtgaaggatctgttaacctctgcctatatcatatttttgtatctatttatgtcattgatattatttggcaatctagtttcctaaaagaatatttgtcaatctatttcttattgttgatcaacaaaatgtaatttctaatttctaacctttattctttgtttgttagccttatgacagacaggaatggaccatttggtaggctccctgaacatctccttgtagaaatatttatccggttaccaacatgcgaatgggttcaaatatcatgtgtcagcaagcactgggcaagcatatttcaaggagaatgtatgtggcaaactgctattgcaaggaactggccatcagctggtttacggaaacgctggcctgggccaattcccagaggttctgctagaaggttagttttgtaatctgatgttgcatatcttctccatcatttgatggtgttggaaattttaaagttttgccagagtctgtctgacgcatgattgcttgctgctgtatttgagtatccactttaaaacaaatacacaaatctgaaacaagatgaaaaaatctcagatatcaaatggtttgcatcaagtttattaccttacgttcctttagtaacatgctttactagatgcctagatctactttaagcagctgagtttgaagcggcataaagagctgtgttccgctatgcatgctcactatcccaaaatcttaagaatagcttctctcttcggatacgatcttccatctgaacattcaataaaaaaaagtatctctcggacatttataggagattccaagcattatacgtcagccagaaccttgtctcatctggtggggatattgatgaacttgttggccacacttatctctatttgaaagaacagcttgagcgcccagttgttgctccttccagcatactccatggcaccatcatcggtgaggttttctgttccaagttccaactagtccaaatatagagtttattgtagttcatgtgttggcgtgctttttgtgttgagtgatcattatgaaaatcttttctcaaagataaaacacatgggaaggatacgattaaaccatgtcaggtacaggaaatttcgatagcacatgttttgtgtctgacattacaggaagaaatggttgatcttgtaggattggtaacaatagtatgaactcgtgattcaattgcatggcatgctgagttactgcaagatttatgtatgttcttacttttttgagaaaattttgttctccaataaaatgaaacctgggcagattctcaaacaaatgaagttcctatttttcctaagtggattcgcgtctcaaagaggcctttaaagctgcttccgatctaaaactgataaccatggattgaattttgtggtacaatgagactcattttcagcatcaagagtagagcttcatcactgagtattgcttatactgacgttattggttgctcacactgaatttaacattgcctcacccttctatgtacagatcagttcattgcttgtggtaggacaggagaaaaggcacatgaacttgcttcaaagatatggcttgcagttattgacaacttggaagaaaaccagcaaactttcttgctgttaaaacacctttctcaagaaggagaagtaagttcagcgtcccaattttatttatgacctgtgtactcacatttgacatgtcaatacaatggacgtgtcatccctcccttttccgtaagttatcaaaaatatctcttgcgtgaaatgatgcatttcatacttcttagggcctggctaggtgcatcttcataaaatagctatagctactatggtgcattctgctgttatttcgttactagaataaaagtaaataaaatgaatgtcatatttgatatgcaactgtgcaaagtgcaacaacttgctgaaaactgttatatttcgctttctgcttgcagtttttccttccattcccatactccagatcatataaagtcttgtggagggtgttcgacaagctgttcaccgacttccgtgactgcttcagccgaggggattaccatgatgcactagcgggtgccaagtctaggtttcagccagtaccatctgcatggcttggccactgacgagcagttgctgctcttgttgtgcactgcacattgccttttagatgtagcagctatactttctgaaatgcaaaactggaccgaaggatggtacttccattccaatggatgatttgtatatcttttagtgtcttagcaacttcagaaacaccaaactgttgtctgatcgaaaaatatattctcttgtaaattctaaacattcagaattacccgacttctccattttcggcttatgatggaacttattatatgaactcttacctatatcaagtcagatgtggggtattggtacaaaacttttacttgaatacaatgtgtgctagtttctatacagaattcagtcctctagtaaaatgataaatcggtgtgctggaggttaaccggggatcctctagagtcgacaaacaggttccaatatagattcaaatggcgcatc

SEQ ID NO: 29758 - DNA, 714 bp, Oryza sativa
  unsure (1)..(714): unsure at all n locations
acggtgnttagatactcnnnnnnnnnnnnnnnnnnnnnnnnnnnnnnnnnnnnnnnnnatagacacagtccaatgagtagagggaggaaaattagacttattatgtggagaagcatgataggctgtcgtgtcttcggcacgaccaagtcttattgggccatgcttgggctatgcttgggccatgtgtgcagcccgtgggctggcacagtacgacccaacgtataggtcaggccgtaccggcccaactgacctcagcccagacacggccgtgcctacgccatgccgggcggggcggcccatttggccatctatacgtggaaagaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 29759 - DNA, 2663 bp, Oryza sativa
  unsure (1)..(2663): unsure at all n locations
gagacgagcaactcaattattgcttaaactatcggaggagggcttccccccggcttccgggcggccaaagcaaaagatgcttccttcacttcaacaacggactgggatagccgcggaatcgaccttccacaaggccgggatgggaaaatacggcttcttcaatcccaaccaacgggacacctgggtgcggttttttttaatttaaatcatcatcatcatcttcttcttcttcttcttcttcttgtggtggtggttgttgttgttgttgttgtggttgttgttgttgttgttgttgttgttgttgttgttgttgatttgaggtgtttggtttgagaatgtgggctctaatggtggtttcttgtttcttgatttttgtttgttggtgcagcagcagtggagtgcctcttcgagaccctccgctgcctccccggtggctgcgagcgcggcgcctccacctgcatctcctgtagctggttcatcatggaggacgacgaactgtcagccagtgtgccccttttgtgaatgatatgatattgttgtatgataaattcttgccatcccctttgtgaatgattgctatatgagatggtgatgcggtgatggaggataatgaactgttggtcagtttgaagtttttgtgatgtggtcagtttgaagtttttgtgatgctgtcagtttgatgatagcaagcaccaccattgtagggttttttcacacctgtgacgggttgcaatctatttttctttttttttgctggattgtagacatcactgacagctcacaaattaatgggccgtttgagataatagttacctgtgacgggttctatacgtggcccgtcataggggctggtcaccactgacggcctttcacccgtcaaaggtgaagagagttatcactgaccactgatctctgacgaggggccgaatccgtcagaggtgatggtttagacccgtcacagctagcatgggccggcatagtggaacggcatcccgacgtggaactcctcgacgtggagggcgctctccaggccacgcacgtcgcgggcgagctcccggagcgggcggacggcgccggcgccggcgcccctcagcgcggccgccgcatccccggactcgtgccggaacctctcgcgctgcgcggcggggctgaagtccgtggcctcgtactcgaggagctcctcaaggctcgggaaccacgtcggcatctcgcccctgagctccgcggtctcctcgtcgctcatccccgcccacgacgccgacctctgatccgctcccacgccggagcagctgcgctccacgcgcgcgcgggacgaacgcagtaggggaggatgaggacgcggcggcggcggcgtgcgggtggcgaggacacgggcgcacggcggcggcggcggtggcggccggccggaggaggaacgcggcgtgcggcggctgtcgcaagagatgttcaccgngcgcccgccatgatcgatcgatcaacgtgtgtgcgtggttgaccgatggatcggattcgttctgaccgatgaattcacctgacaccgtatatatatatcaagatgcagcgttcaggattccattatctaaccgtgtatcaaatcgaccccgagcagaagtaacttcataattattagagttgtttggcaactacaacttgatgaaacatcatatggggtcgtgggtgttcaaatcctaatgcttatacatattgcgcaagaaaacgggtggacgtccacccgagatattaggatccatctcctcttctttgaagttgtgggtgttcaaatcctaatgcttatacatattgcgcaagaaaacgggtggacatccacccgagagattaggatccatctcctcttctttggctttgttctccaaacgctgataggttatcatctagcttcctaaaaacagtctgaatttctgccaggccattttaaggcgtctttcgggcaacataatgtataattgcatataagcagtcgtattcttttagccaaaaatatacagtaataaggggtgatacatcatgaaggcaaatcagcatcagacatgagaactatggatgttcatatcctatccaaccttacctgtgaaccaacgcacccttagtatatttcactgacactcgatccctcttgtctactcgctatgcaaccctcctctcgctggtggtgtccacaataccatggtgttttcagcttttttgaaggcgttggcgagtggcaacattgttggtttggtcacgtttagtgacacatagcggcaatcggtgcagttctagccctttggtgtgtggtggtatgttttttcacttttgatttcgctaaaaattttggccattttggtagacccaaaattttgacgcttttttggaccatctttttaaaaaagaattaacatactttaattgaatttgactaaatgttgaccaaactcacaaaaaatggagaaaaaccgaaaatttcagacgagataataacttggggtggggggggggggtccaaagtttcgaactgaaaatgcaatcattgacaggggggtgttttttttttctgattataggctttcaaagttataggcttttttttttccatatcaatatgaaacatcgtgcactgtttgatcttggtcggtttaaaaaaaaaaatatttcacctgcataaa

SEQ ID NO: 29760 - DNA, 913 bp, Oryza sativa
  unsure (1)..(913): unsure at all n locations
tagtttcaatgagttgaaccaaattaggattctagttcgtgagcttaacgagacagctgctcgtttatctcgttagtccaacatattatcattaactaatatttagttccttaattacattgaaactatttatatgtttatataataaattttaccggcacttgccggttaattggattatagcattataatttatccgatcttaaaatatgtcattcaaattcgcgatattcaagttgtgccattaaaattttatgggtatttgagatatactactgcttaccccttcgatgcatttctcaaattttttttaccaaattaataagggtcaattggatccatggcaatataaatttgtccgttttaaaagttatcattacaacttgcgaaattagagccataccattaaacaatagtaagtatttaagatgagtgtgaacatgccaaggccatacctaggcgttgagataactcaccccagcgctaacctcgttggtgccgaccctagaaccatgttgtttcaccgagctgatgatgccacgggagagaggggtttggggggggggggtggttttggtgctattgtttggcgccaagttggtcttggtcggctgctatttttgtggatgcaaatgtggtgctaccataaaaatcacagccgaacaaccccgaaaagattgagggcctcatcttttcgcttatgcttatacttatcagtcaaaatttgaattttcaaccttaaatttaaagctgattttgaggtttttcatcgaagtttatttttagcatttgcttttaaatagctaagaacatgtatataaaattttattcacaaattagttttcgtttgcaaatatgccgagatggcaaaatatnntgtggngtngtgctncagtgtgtactattgccacat

SEQ ID NO: 29761 - DNA, 1424 bp, Oryza sativa
  unsure (1)..(1424): unsure at all n locations
cgctgcggatttgttagactaactcgattgactacaggcgcgaattcttctttgtacccctatcagcgccagcattctcctatcagtctataactagcgaccatggccatgtttggatctgaaaacatggcagcctgagctttctgtgcttcctctttcgggacatgaagcaatccgttttcctacagcgtactcaagaaaggtcaaaataacacccaaaagataatactcgattcgttagtggagtaatgcatgttagtatcaaatcaaaacattcagcaggcacgaagtccatcctgagatttcttcaatgcagattacaacatatactgatgatgtacagtctctaataactacaaaaaggctagcctttacaaatccttacttaattgggacagtacactcagatgcttcaagttgaattacctcgttagtgtaataaaccttgcgtgatttgaaggccttggccgggatgtactgcgaattgatcctcaggttcctcgccctaattaccacttgcctgtgaacaagcaaaaaccctcgcatcaacatccaaacatgaacaacatctgaacatgaaaaaaaacagacgcaatacagcacgcgacacgctcgtagaggctaaaattctaggaaaatccagcaacggggaggccttcggatctaggtctcgcggcgtcagatcgagcgaaatcggcgagcaaaaacagatcgcggcaggatcgagagttggaaaagcaacgaaccccttcttgacgagcttggggtcgggggagggcgacgccgacggggagcgcatcagcttggcgacgaagtagcggagcacgccgatgagcaccatcaccacggagagcgggacgaggacccagtcccggatcgccgtgtccagcaccagctcctccgccatcgcagccggcggcaaaggcctctcacgctaaggctaacccccccacctactagctgcggactgcgcggcggagggcggcggcgacccgggcgacgccgacggcgagaggagatcggggtagagagagatcgccgccgcgggtggattgggccgatgcggaagaggacgcgacgcgaggatattcctagccaacccgcctggttattgggtaatgggtcgggtcgggccgggttcttctcaccttttgggctccgctggaggaggaggcccattaggtttggatattgggccgagttggattttttttcttggaataagttccccggaggtccccctcaatttaacagagagattttttgaggtcccttaaccacaaaaccagaaacgtctacccctaaacttactcaaaccattcaccggaggtcccttgacagtatttttgcccggttttgctgacgtggcatcctagtcaacaaaaaaaaatannaaagtagggtaggagtgttctaccgccagg

SEQ ID NO: 29762 - DNA, 9718 bp, Oryza sativa
  unsure (1)..(9718): unsure at all n locations
cctacgctgcctacggtctactgccaaacggccgcgccacaaaaccttacccacggaaacgaagacggtgaaaaccagacgacgacggcggccacggggcggggctgctccgcctgcagcctgaaggagaagagaagagagagtaaagaaaagagaagaggagagaaggagaagaaaataggagaaaaaagatgtgaagctgacatgtgggccctatgtgtttttttaattttttttttgctgactaggatggcacgtcagcaaaaccgggcaaaaatactaccaagggacctccggtgaatggtttgagtgagtttaggggtatacatttctagttttgtggttaagggaccttaaaaaatctcgctgttaagttgagggacctccggtgaacttattccttttttctttttccccaaaatatggcccatattcttctcaaagaaaaacgaggcccatgttgcgcaatacgcacactagtattttttttctttagtttttttttcttcaccagattatccccactttcttaggtcacgagatcctaacaaacaaaacaaattctaggttggtagacttctatctgttttttttaaaaaaaaatgagctttggtcaaaccagatattcaaacaacccgttgctgtctaggacttcagttacaatgacacagaaagtgaaatttacaggattttgaggccgaattcttcgagctcggtatttggcaatcgttagacaagcagtcaagcggatagtcgtgtgcatgaacatacgtgtacgggggcaagtatcttatgttggtgatgacatgggcatgatgaacagttgaggacatctgtgacgatataaagtactgtagtcctctcaccgtaccaaggctttgttcatgcgagagaagaatatttgcgaaacgagaaaactcattaacacataattaattaaatattaattattgtaaacttaaaaaagagatttatttatttttttaacaacttatatatatatatacacacacttttggaaatgtgctaacgagaaagttgaagtttataattggagtatagaatggagcccatgtaggcaatttctgtgcaagaatccggcattaggttcgtgtttctttccaaaaataccgagtcttttgtactgtctagcgtagcaacttactacacactgaggttgactggtcaagtacatgtgcgagttttttaatttttaccccctttgcaagggaactacataatttgtctgagttagttaacgcatttaaatggttgaattgctatagggagacagctaattcaacacacaaatgcattgcctagctacccattttgttgacagatgcaatactagacatgtagatgtagtcaactatgatttggaatgaactatatagagttaagtgtttgcatgaacactttagccatagaaacctctagctaaagagtaaatggcatttgatctttttgctagtgggaagtggctagaaattatttatacggtctactttattcaattataattaatttagaaacgtatcctatgtacacaagttttccgtacgcaccaactagtaaatgtcgtaaaaaaatatataaaaggttggactcatactttcaatagtattacacctatgtgtgaaatcttatcttaaaactattatatttttcacttttttttgttacgactaaaatataatgaatttgaatacgagactttgcatatatgcctaatactattagaatacatgtccatctttttgaaaaaaaagtcatgatatttgatagttagtgtgcacggaaagctcgtgtgtacagtatatgttcccaattaactaagagtgtgttagaatgtgagtttgggctgggctaatacgcacttaccgtgagcacgcttcccaaactataaacaatatgtcgcgtgtaaaaaaattatataacagttatattaaaaaaagataaaccctttaatttagaataatcaatacataattaatcatgctctaataattaatcatgctctaatgactctcctctttttcgtgccagtattcagcctattcttctttcccaaatgcaacctaaatatcaacataaaataagtctgggcataatcactttgagtgtgagctagataaactatgtaggtaatgacatacgagtaaagcctaaaaataataaacgccaaacaaaaaggtaattatatgtgtagcatcccacctacaatacaggcaactaacctagccacccaccaacaaaatagatggtgcgagaccgacaaaatgcaaagcgccagtagcctcagatgctagcaacaacggttagtgttattgtcagcaattccaaaaggcgattgacgtagaaagtaaagttttaagtacacgcaagcaagagataatcacaacacaataagagtaatgtgtgcgcgcaccaactttcctatcagaaaacaaaatgctccaagatataccttttgctacacaaatatcagtatacataccaaactatcaacgtacatcctacatcctgtattgttctacatcattccatcatatatataataacatggaaatttcatagtaatatggagatgttctggaaaaaagttataaaatggagatgatcaaaatggctaaaacctatgtagtgcattcaggtaggaaaaacaacccaaaagaaacttgtaagaaaaggaaaaaactaccctaccctagggtacgcatagcaattctcctaggaccctagaagttgccgtcacctaggccaacgacgaggctacgcaccacaagcccattccggtcatttccccctccccaatccttccacccgcccatccctccccgcacatatctcaaaacgagggaaacaaacccgggattttgccataccattctcggggtggaaaggcagaggagggaggaagcggttagggggtttaaaaagggggatgcatgcaacgccttctcccccactcatctccacaccacggacaaagtagagggaggagaaaaacaaaggtagcaaaggagccaagaaaagcttagtgactaagagataaaaagggaaaggggagaaagagagagagggggtggagagcttggcggtgcgaggtggttggagtggggcacgcacgcaacacatgggagaggagggagagagagaaggatggaactagcggtgaaggcttggtggttggtcatcctagggtggcagtgcgccgtcctgtcatcgcaggggggagaggagagagagaagggtggagctagcggcaaaggcttggtggttggtcgtcctacggtggcagtgcgccgtcctgtcatcgcaagggtcagcgaaggtgaggccttgtttcctctaactcaattatgtgaacaacacagtttttatgtctataagacggtagaggtaggcattaaattatattgcacccatatcaaaccaatgtgaaaggggtggggtcagcaaaggtgagagtaaggccttggttccctaactcaattacgtgaacactgcattttaactcaattatgtgaacattgcatttttatgtccattttatgtgaacggtgcatttttatgcctataagatggtagagacattttttggaggcattaaattataccacaatcataccaaaccaatgtgaaaaatataataaaatattttccttttctattaccaatccttgaactcaagaccattggcaaatcattttatgttcaatacgctaaccaactcaatcccatatcattacttatatgtttgtgcattgtgttacttatatttagtcccttagtgtacattatcattctaagaagtgtctctaaagagtttaaaatgtctcaagaaaatacctttacatattagacacatttcaaagtactaaaaaaatgcctctacaaaatgtctctaaaaaaatgtgctgaaaaaatgtctctaaagtgcctctagagtgaaatatttttagacatttttcatgtgcctctaaaaagtgtctctacactataaaactcatggttttagaggcaattagcaaaacgcctctataaaagtgcctctacatgagatttttgttctagtgccatatcaaagtaaagcaagtccggtgataatcacttcaactatgaactagataaagtatgtaggtaccgacatagaaatgacaatgaaagcttaaaggtaagaaacatcaaacaaaagataattatgcatgtagcagttcacttgcaaaataggcagctagcgttgccacccgcaacaaaacaaatggtgcgagaccgacaaaacgcaaatcaccagcagcctcggttgctaccagcaacggttagtcttatcgtcagttccaagaggcgcttgtcgtggacagatgtaagtacacgcaagcaagagataagaacatcaaaacgagagtaatgtgagagtgccaactttcctaacataaaaacaaatgctctagggtatagctcttctcgatgaaaaatcaatatgtgtaccaaattactgatatatacatcgtacattatctagtaaatttatgttgttccatcgtgcaaataatagtatgggagttttatggtaagacggataatcacatacgaatgacgagtaaaacctaaaagtaaggaacgcctgacaaaaggtaattatacatagcacccacctacaaaacaagcaactaaccttgccgcccaccaacataacagatggcgcaagatagacaaaaatacaaagcacaagcagcctcagacgctagcagcaatgttattgtcagttccaaaaggtgcctgacttggaaagatttaagtacacgcaagcaagcgataaacacatcaatacgagagaaatgtgagagcgccaactttcctaacagaaaaccaaatgctatatggtatagctcttctcgatgaaaaatcaatatacatatcaaattaccaatatatacatcgtacattctctaatagccttgtgtcgttccattgtgcatataatagtacgagagtttttatggtaatacggagatactcttgaaaaagttgaaagcatggagaggataaaaatggctaaaacatacttggtgcattgagattgaaaacaaccgaagagaaattattttttttagaaaaaaagtgaaatatagcactaccctgcctaccctaccatggggttcgaatgcgagtttgggttgggctaaaacctcgcttactgcgagcatgctctccaaattgttaaataacacatcgcatgtaatatatatatatactgaatgtagcaatccacccacaaaacatgcaactaaccttgccgcccgctaacataacagatggcgcaagaccgacaaaagaacaaagtattagcagcctcagatgctagcaatagcggttagtgttatcgtcagttccaaaaggtgcttgacgtggaaagttctaaatacgcgcaagcaagagataagtgcaataaaaagagaaaaaaaataagcgtgcgccaactttcctaacggaaagaaaaagctccgagatcgctacaaaaaaaaaggtacacgtaccaaaccattaacacatgcatcctgcatcctataccactctatatcattccatcatatataatgataacatgaaaatttcatagtaatacgaagatgttcttgacaaaaaaaaaggttatagcacggagatgatcaaaatggctaaaacctacgtggtggtgcattcagatcagaaaaacaacccaagagaaacttgtgtgtctaaaaaaaaacaaagaaagaaatgtcactaccctaccctggggtatgcgtagcaactcccctgggacccaggcagaattccccctgccgtcgcccaggccggcctaggaacggccagggatcacaccgtacattaacgacaaggcccctcgcaccccacaggcccatcccatcccacccgcccatccctcccgcacgaatctcaaagcgggggcaaacccgggattttgccgcgccccattcccggggcggaaaggcggaggaggcgggcgagaggcgaggagggaggaggaagcggttcgagggtttaagaagccttctcccccaacctctcctcggactcaaagcagagagaggagaaaaaacacaaaaggcagcgaagcggccgcgaaaagctcgactcggagataaaagggaaagcgagcgagaaaaagagaggagaagcattggtggcgtgaggcggttggagcggggcacgcgcgcggcccaaggggggagaggagaaaagaagccggggtggccccgacgccggcggcaaaggttggttgtcctagggttcctgtcgttgctcgcgggaagggtcagcgaaggtgagggcctttggttacccctaactcaattatgtgtgaacagtgcttctccgtttgtgctctgtttatgtgtgtgtgtgtgtgtgtgtgtgtttattgaggctttgagtttttttttcttgagggggttgcttttgctgtacaggagaagatgatgtttaagtttaatttaatttaatttattttttttactcgctgcggtttgagcgttcgtggagtggtatgtgttgcgagcacacgggtgggtttgtggttatgaatgtgtgtgtgtgtgtgtgtgtgtgtgattctgtgcaatgcttgatcaggtggcgagttcctcacttcggtatgttttaaatttatcctttttcgggcttcgtttgatgttgctctgcggtctgcaccctctagcttggtttaggcatgagattgtatgcaaggtgttttctttttaaccaatttcgtgatttttgggctagttggagacttgtttctgttcagtaataagtatttggggcagtaaacttttcttttttggaagatgtaatttctgttttcgatgggcgaatgtgtgcgtgatctcaccagcaagtccccgcctttggtgtgcttcacgtggtgtcctccatggcctcatggggcaggtttctctaggcggtggattttatctgctgtgctggatcacaaaaaccatgggtaaaaactaaaaaatcgcatttatttggcattttgctatgatgatttcgatggttaaagttcttgagttttttttttctttttgggtaatggagcttgcatatttgcttgctttgtagcattacatgtgtagttagtctgtactcgtataggttctaaaattgaactgaacttacagaattcagttgagaaattatcactaaaaatgatcaccttttgttgtccagcaaaatggctacagagagtgctcggccgttgagtggaggaactggagcagggaagtggccaccaagcaaggacacgggttcctatgattctattccagctagcctttcagaagatgagttagcggagttggccttcatgccaaatagtggcggcatttttgggaagtggaggggttctgtcctggaacgcagtggaagcgctcctcctaccatggaaggttctttagttgcacttggtcacctcacaggtcaaccgagtggcaaccttggggccatactgccaaacttgggcactgaagctaacaattcagagtctaaggagaatatatattatgattcggcatgcgtcaaatactatatgtccaaggtgaatttgaacccaaggtttcctccaccactcgtttcaaggaaccagtttggcaagtctgaagaacgaaagccgttctcccttgatgacagcagcagcaggtccttacttcttggtcatcctactctgccaacacacaaggaagaacctgaggacgaaaagtcaccaagtttggattcaagttcagcagacgatgctcaatgtgattctgcccaaagcacatctaacttagggggccacagtccaaatcttgtagattcaattaaggtaattcccgtattaattcaagaactagctctgattgttttttccacatgcactcaaacaaacttcgtggcgctgttcggttgtgggttttgcagcagctgcacctggtttctgcggctgtggtgcacagctgtggctactagtagcagctgcagccgcagccaaaaaaatggcagccggagaaggctaatgttttcatccgtgacataactccatctttgtatcctcaaatattaaagtcaagaaatctttatgcacggctatacagtagcagtcggcttcacagaccacaagaatggcagtcagctaagacttagtaaggtgaaataatacagtacaacatatgattaatgccccctgtgatatacaaacaaacatttccaatattcagtggctaagacgttttccaaaaactcacttatttgaaatagtaactggaaattctgatttaaactaattgatctttattatgtagtatctgctaaataaaatcaaaacatgtttttgtttcaaggaaatgtgatgggaatcgcactaaaccttgcaattccttaatacaagtacgacaagaaaagaagtattgattgtactcctccataaacattgttatttaccaactctcatgcatgcagatgaactccctaatatcttataatcatgttctgttttgctacagagtttgttgctgcagtctgcagatacttattgataatgatttctttttgtttaggaaaactttcatcggagcaatggtttgtatgataattcttccgatcttttaaatgcaaactctggtgatggagggtcgatttattctggcattagttcattgaagaattcctcactttatgttgtccagtcatcagacttgaatggatttccaccagatgctcatcagcgttcccctagacctattaggactccagtcagtacaaaacttactagcgacagtctgccagcttcatctcctcccacttcatcctgttctgactacagtactattactgaagcttgtcagcaaagaaatccaagcatggccgttaaacctggtgaaccagttggtaccatgcttgatagttcagacttcagtctgaagaatttgaatattagtccggatatcctaagtagttcatatgtcatgcaacagtggcagaaaaatgccccagtgtggaatggcctatcaaatgtagtccatggcgatcatgtgccaatgattcctccaggaattaatcttcctcaagttccatttgtggacaattccggttttggtcatatgaagttccctggtgatgttcaactgatgtcccagatcgggatggcaacacctttttgtacaccaaattcttttgggataccatgttatcctaatttgcagtcgcctagtgtttgggttcctccattcggaatcggcggctatggtttgcctggtccatttgtcccacctgttataactaacttcactcctcaacttcctggttttccttcagcagtaaatcttgctgcagcaactgacttatttcacccatataagatgtatgagcatcttggggtacctatgccatcccctgttcctgatcagagccttacgcattattttcaacagccccctatccatccgtatggtgttggaaatccatatgatacaatggtttcaagtaataattttgtagggaatcctgctggcgtttttggttcaccaatcattcacccatcagagcagaagtttcagataccggttactactgtagctgctaatgcctctactcccatcaaaggtggaaaggggatcctctagagtcgncntgcaggcntgcntgggaggngttntcagtcaatcaatgacac

SEQ ID NO: 29763 - DNA, 11321 bp, Oryza sativa
  unsure (1)..(11321): unsure at all n locations
aggtgggttagaatcatcntcacnccagcacgccngcaggtcgactctagaggatccccgcaggtccaacattacatgggcaacctgcttctggaacatctcctcgtgacaaaaggaacgatgtcaagggattccaaccccctcgaaaaaatatgcctgttagttccgagatacaaggtcagaaagggagggagaagtttgatgatcccaaggcacacttttctgttgaagaactaatatccagcagaactcatagggttgagctggctgacatcaaaggacagatagtgaaatacaggttagttttgattttggttgtttcattcactatctagatgcacataacccaatgaaaagcttgagatattaattgttattatgttcttgtcctcagctcggaccaaaatggtagccggttcattcagcagaaactggagaattgcaccattgaagaaaaggatttactttttgccgaggtccttcctcatgctttggaattgatgactgatgtattcggaaattatgttattcagaaggtatagtatttccttttcttatatgattcattttatggtaatttttttatgaatagtacacctattgaacttgaacaattgtacccccttttaagatattacagtatcatagcagcaattatgaaaaataatttatatttgtatgaaatgaaaataacatgtagtacatgcagttcttcgaaaaggggagcccacagcaaaagagagaaatagctaataagcttgccggtcatgtgttttctttgagccttcagatgtatggatgcagagtaattcagaaggtagtcttgacttctttatgggaagtataactttatttctgcttaatgttttggataccatatcatgaaaaccttttcagtggcacactatagcatgtattgtctgaggcggtctgagcaaattttcttcacactgttatgctatccatagacttatttattctcaatatcagttggcaaagtattatctgagtaaaatttcttcagactgttattctatccatagaattgtttattctgaacatcagttggtaagttttaaagtggttagcctgtgggacatcatttctcatattatgcatggtaatcagcatacattcttttaataagttgcaatcccactgtagccagctattcatggattagcatgtgttggaaatgaaaaataatgtgacttataagttgcaatcccattatatcccgttattcacacattttacttgctatattcctggagaactcattttcagatgagttttgtgttattctcatatataatggatacatagaaatgctctcttactaccacacacagactaagtggttgcacattaatgtaattaaactgaatcacaactaaaaagatgaggaacacacaccagacaagacaagtagtcaatgtcaggttatgtgtgttcgcattttcatcattcgtcgtaagtttttattagcaattatgctatttagacagtcttgtgaattgtttgttgacactgctacactgtcttttctggacgttatcgctatttgaactcaaatgccaatttcactgcctacttcactgctacaattgcaggcccttgaagtaattgatcttgaacagaaaattgttcttgttggtgaactcgatggacatgtgctgcgatgtgttcatgaccaaaatgggaatcatgttatacaaaaatgcattgaatgtattccattggaacatattggttttctggtgtcatcttttcagtgccaggttgccaaactgtcaatgcatacatatggatgtcgtgttattcaggtgaattggtaacgatgttgtatttttgttaatttcttgtcattttcttgtggtgttgatcatattcacattctgcttggcagagaatcctcgagcgttgcagcaataattctgaatgcctttgcataattgatgaaatcttgcagtctgcttgcatcctcgcacaagatcagtatgggaactatgttgtgcaggtgattttcttcttattctccaaaacttagtggctgatttgactaaattttcattaatataaaccatcagcatcttgttgctgtaatacggatagctattttgagttagagcaagtgtaacttaagtagctgatgttgaatttggcaacctgcagcatctttgcctttattataaccatgtgtattttgcagcatgttttggagaaagggaatgaacatgaaaggggccaaatcatcactaaattggctgggcaggtagtgcccatgagccaaaacaaatttgcgtctaatgtcatagagaggtgttttgaacatgggggcagtgcagagcgggaacttttggtcaaggagattctgaagcaaactgagggcaataactatttgctggtatacattattactgtaactcaccttttgttttttttcctttgccattccatgctcttttgagccaaatagctaaaagctcttgtttgttcaaaatttgactaatgttaaactcaattaaaagatatggtaggtaccttcatgatccaaataattgagtaggagttttacttaaattgaaacatataacagaagcccgtcattttttttggataacagaagtaatcctcataaaattctggcgcggctactgtttctaaggctacttggtgcaatacaaataacggtgtttccagctatttttgtttcgttatttgtgttattagtctaaatctttactcaagtaagcgatttacgaattacctgcactgctatacaggtgataatgaaggaccagtatgctaattatgtggtacagaagatgcttacaacatgcaatgaacaacataaggagatccttcttcagtcgtgtgaaaatccatttgccattattgaagaaatacacctatgccaagcacatcgtcagcctagtcgagcgcctctgcggtgacggggagtcgtccgcgtgccactcctccagccctgctaaatttctcctcctgatcctctacttcaattggccccaaaatttactgctcccatatatgccatttttcaggagctgtgcagtccgaatccaaaaaaactgtaaccaagggctgctgaattcgccacaggaaagccgactcttttctgccaaccctgtcaagttcagcgtagaaggcctatcagtcgcaaaagtggctaacaaagcaaccaaaaaaaaaaactgtcaacctgtcaccatagatcatcatcatacagatatagtcgttccaagcggtttgtccgtgtatttaagctaggaaatgatagtgtcatactataggaatggtaataatcatctgtgtgggctgtggctgtggatgctgcgtctcacagaagagagtctgagtgtggtggtgcgttgccgtacagtacatatcccgtagtcttgagtcttgtacccctgcttggtgatgtgtagttatcgccgcatccagcttgcttggtcacttgcttctgtgtgcttccgtgcttgctcactggtgcgcgtgattgcgcctaccacctcgcccggatgcaaatcctctacagcactgtcgatgtagtaacaatggctgacatgtgggtccagacccatacgttaatatctagtgcatgagtagtactgcagacaatcccggccggcaggacgatctctcctactcccccgtcctataaaaaacgagtctaggaccggatgtaatatattctagtacaatgaatctggacatatgtatatccagatagtactatatatgtcacatccggtactaggtgccggccaatctctcctactccctccgtcctataaaaaaacgaatctatgaccggatgtgacatattctagtacaataaatctggacataaatctggacatatgtaccggatatgacatattctagtacaataaatctgtaccggatgtgacatattctagtacaataaatctggacatatgtatatctagatttgtagagggagtactttccatttcataatacaaaatgctttgacttttgtaagtcaaattttcttaaatctgaccatatttataaaatattatagaacatctataatactaaattagttttatttaatctagcactaaatgtgtgtttttttgaacactaaatgtgttttgatattgtattgaaagtgttgctacattattctataaatttttattgaaattaaagaagtttgactttaaaaaattcagaacattctaataatataaaacagagagagtacccacgcagccacaagcttggaacggagatttgagagaaatttcacaggatttgatagtattcacctgaagatcaggtagaggtacatgccaacattttcagccattctcgtgtgtaaaccccacggttaacacttagacaacatgtaattaatcaggcattccaaattagcgagaaacaacacatgctctcccagccaccagccaaaaaaaagaacagcgtctcctatctagccactttttcggcgtcatccagggtgggactcgaaaactgggaaaagatcaggaatcccaccgatacaagaatcttgtaactcattattgttttctacgttgcaaatatgcaatgcgtcaggttgcagttgctcgatgccacattccccttaagctttgcgcttgtccttgtccgccaaaaggatgtccttacaggcctcgtagaacatccaggtgatgccggaattgggcatcaccttcaggcagctggccccccacccgcggtagagccccgggaggccctcctcctggatcacttctgccagggccgcgatcatgtggggtgggcacttcccttgcagggcacccaccatgagccgcttccgcgccacctccagcgggaagctgattgtgcttgcggtcaggcctgcagattcaacagccagatatgagcaatgcaaccagctgtttggtcaaatttcaagctaacattttgtttgaaggagcagtagttttgcatcttcattgtatgtagatagtagagaattgcacaagtcaaaacaggggataacctggtacacagattttaagacagtgctgaaccggctaatgaagatggtgaaatgatatagatgtagatgaagcagaatcatttacctgacagagctccaataactagaagctcaggccgagtcaaagacgtcttcttatgtaagcggcagtaagaagtcttgattgtgtcgtacataaagtaatagcatgtgctataaggaagcatcccaattagtgttggacagaggccagcatagagaccacgaattccatcagttcggtatatcttgctgaaggtgacgctaatactaggatagacttctcggttaatagttaagcgatcctgtcataaaatatggaagatatcaggcgaagttatactgttccaaagaaaatgaatatatggaatgacaaatagtttttattttcaacaggtcagttcagcaatcaccttaatgacttcaagaggatgacacaccaatgtgccagctattccagcagctgcaccagctacagcaacaggagataaaaattgaagtggaaattcaattttcactttaccaatttgtatctttgggcatccatcttctttccatttctcttgcgcttccgccattgtccttttgacacactcgaatgttccgagctcaattgcttgagttggaataatacggatcatgttgattgtgttacctgcccaaagcccttgccatccattttgttcgatgatttctacaaagctaccaccgatatgcctagatcctactcctacaaccattcttgtcctgaaattaataacataccaacatattacgacacaggtacaaattagtctttgatatgcaacaaactgcatgcttgaacaacacagttgggaatcatatatctaaaatgatgtatgcatacagagactacaatctccactgctcataggaaagcaaacaatcctacaaatactggttatgttatgcactaaacaaagaatatgtttacacgtgaaaatgtgactattgaactttgagactagaaatatttcctgtttaactattaaatggtgaaagttggttacaacattaaactatatgcctcaaggagttaatttacagatgatgaattttggagcatatcattgcgatggtgtttgcaaaggttgtagcacgttatatcttttggtttttaagatttacatctaagttgtaagaccatgctcaaatgctttattagagagagagagagagagttcgatagatacctgatagtctcgagaggagcaagaacagctttagacatagcaccagctaatgctccactggcaaattctctaacctctcgactcctaaaaaaggcctgcaatgaaaatgaaagggaacatctcaaaaaacagtgtatattgtataggcatcaaaatcacccatggatattattaaaccatgcatatctgtgtgataaggacagattcagagccattcagttaagtacttggtcaaatttgttttatatagacaggcgggttcagaataagaacatttactacgttatctaagcccatcatcaatcatcaatattacagcaaaatctctaccaaaggtttggttggtcagtggttaagaatgaaaaaatggaatgctgaaacaagagctagatcacaataaaggtatctttagtaaattcatagtcacatatattataacacaagtatgcaactcaattttgtagttggaataagtaattgtaaaaaggactaaaagacaattgattttccacatgtttggacgcattcaagatactttggatgaaaatgacacagaactttagcaccgaagaagaaatattgttccatctgtgaaaggaacagctttgtccaaacctgtcgtcgtggagaataaccccaaacatagtcaaagttctttatatatgttggctaagcgtataaaattagttgactgaatcaagtataataaaacaaaatcaatattgaagcttgtttttttccatttgactctttgaagccccttaatctttcctaacattttctgtctccataaaccagggtataaagtggggattcgggattcctctgccgttaattgttcagtatcactcccgcttgtagcaaacactacgacgacacatcgctatctaaaattctgaaatcagatccgattttcacctaaccagcaacgtaagttaacaaaaagaattgggaaggaatatggccacaggagtacatgacacatgcgtgttggttgtacacatcaatatggtcctaacaagtagtaaagtctcatctgcatctcttacgtgtcaacattaagtcggcagatgatgttgggtctctcaaccaaaagaacaggatagaacttgcttttctttatgaagctagactgatatgaacgcctatataagcataatagagagagaaaatgaactacgcaacatgagaccactgccgttgacgagattagagatgcttgcttgttcgagagtaatctctggtaagaacagataatcaaccatggatcctggtcgaaatctttcacatgttctgcagcaaaacagctcgttcatgccacgaaacctgtgaatcccgagcaatgtttcgaatcgtcgtaacaaaaatcctaaaaacgaagcaaacgcgtcgcatgggggggaacagcgccattcgccctctcaatcggattggagataaaaaaataatcaaaccgagcaaaactgccaagatttcccacctttcgccgcacgagcaaccaagaaacgcaggcagggatgggcgagggctccttaccctcacggccccttccacgtcgggcagccggaagccgaggacgtcggcgaccttgccggcgtcgaggtcgtcgtccttgggaagcgccatcacgagcagctccttgtaacccccttcctcatcttcttcttcggcttcttcctccaacgccgccgctccccccgcccccggcgccggcgaggccgacgctggcgagcagcgacagcttcccgcccccggcgccgccgcggctcggcgcgtcgtggagacccatggcggatggcggcgcgcgtgcgtgaatccgcttgcctcgcggggcttgccctttggatttgggagggaggggcggggttattaataggaggatcccgagggggcgaggcgcaaaacgctgtcgctgactcaacttttttggctcggcggggtggggggagtgacatgtgagagtgtagagagtggaggggtgagaatgtaaaagggatccagggctacggttttgtgggaacgggaactctggacgaaagcgtatacgtacagtacagtggtggggcggacgggcggtgtatttaccggttttacatctatatatactccctccgttgaaaaaaaatcaattatctctcttgatgcaatgaatttgaatatattgaatctgaatagaccatatgtccagattcattgtatcagaagatgtcatatccttttataggttgttttttttaagaaaatatatacttactgtatctatcagatgtatttttgtttatgggccggtcccatctgtcagcccgctttaacaatccagctcagtgtgccaccgtagcaaaatcatcttgggggttaactagtttaaattgagactgaacatggctataaatagtatttgctataaaagttatatttttttctctagaaacttaatggattatccgttaacgagctcggagagctgcacgtagtaatcgggcgtaagtggcgtcacttcagcatttgatatcttttgcgagttgtgtagacttatttcttcaatctattggataataaatttagccataacgtaagcatgttttattgtgctaaaatttgattagcgatgtggtatgcaaaaccataatagcggagttatgccatgtgacaaaacctcgtggtttactaacttggatcgtaaactctattttatttctattacacgaaagatgcatgcactttgtactactatacatgtgtcatactcacacatatgtgaatgtactttctaagatcatctccaagagaggcctaatcctgtttctaaaagttaaatttcagaaattaatggtaaaaccaaccctccaacgcgaaaaggctaagccctcctccatgtggtttccttttttagcaccgcattgcttttctactttacgcacctaaaatttgtacacctcaagtttacacatctaaagtttagagacctaaagtttataagtcaaaagtttatatattcgattcaaatttgaatttaaattcaaatattttttatatatagtatttctatatatctaaagtttgtagacccaaagtttacaagtcaaaagtttacatacccgattcaaatttaaatttgaattcaaatattagtttatagacccaaagtttataagtcaaaagtttacatacccattttaaatttgaattcaaatacttttttatatatagtatttctatacataattttttccaactttgttttttatttttttaaaattttatagtgtagtaggaagagaagaaactgaggagaaagggggagaggagcgtataggaggggatagggggtgatcgctccaagtgatcgatcgcccgttaaccacacccccctccaacaggctcccaaaggaggtccaatagttaggtgcatccaaaatctatccaaatatgagctaattctgggcacctccatgcactctcaactggagaaaaatcagtttaagatgacccaccagtgatgacatggtagattttaaagttctcttggaatcaagtaatgggatactgttggagatgagggtgatttttgagcctaatatttttggttagtcctaacacatgtcttttaggtgcctaattttagacatcttttgagatgctctagcacatatttatagagctggggattagcaaaatctcttgccgaattatccgcaacatcatcattatccttaaaaaaaactaattgtaatatctccaaatataaagattgtgaatcaataagttttcattattgcgccgtcatgtaatgtaatgtagtaaatactagtaacaacgatcgaaaaatccaatcaagagcatataagtataccatggttcaaggacttgttcagtttgccactagtattatttttcaacccaaccaaaatttagtacgcgacactgacgccaaaaaatgataatgaaacaattgaatcatattcaaataccttatcataccattccataacaaattttgataatttcctaaaatctcccacaaaagaattggtaagacatcaaaccgaacatcacaccacgcacaacataccttctaaccttactaatttttttcatcatcaaactttgctaagttttgggtagggtcaattttgccatcaaactgaacccatcctataaatgtactccctctgtcccataaaaattgtatttctagatccaagtctttatcccataaaaattgtatttctaggcatgtggggcccaaccaattgattcatctatataactttccttccatcccacgtaatttgggctgctaatgcttgtaattttattaagtatgctaattatatgggttaattctctcaaacttctttttaatcatttgtatatatggaatgtgtgcatacagtgggttcattaaataaggttattgtggttattttccaatcctactattttgtcttaaattagctagaaatgtaatttttatgggacggaggtagtattatcttgccaaagttttttttccccacttggtgctggctgagatacggtcatattaggttgtgtttggcagctgagtttcttaatttatctctctcgtttttccatacacaccttttaattagttaattgatatgttttttaaaaggtttatatacgaaagctgttaaaaaaacgtattttcattaaaaaaatacgctaataagtcgttctttttgttgtgcgcaggagattagatcccaactaaaagaacgaacgcagccaaagtatatacggaaccccggcgtacgatacgatcatacgggcatgcggccatacccaattcgtcttctccgcccgctcctggcgcgcgcgagaacgcccgcggcctctcgcggatttccccccaaaaattgcagcgcccaaaatccccggaaatctgctacgcgcacccaacccncactaacccccttttccccttccataaattccccggggcgcccgtttccttttcccctttcctttcccccgtttagaaattctctcttcctaaatatatcgcctcctttctctct

SEQ ID NO: 29764 - DNA, 23614 bp, Oryza sativa
  unsure (1)..(23614): unsure at all n locations
aggctgtgcatattgtgattgtaatgtctcaggtcattttcattanagtatcccacggacggctcgttgttcgctctagatattctatgtgcacgactgttttttccgtccttaaggactgtgttatcttccttgttttttgttgtgggtgagccacccccactaaccccctctccccctcccataacttcgcgcggccgccgcttccctttccccctccccttcccccgcttggaatccccccctcccccactcgcgcgccgccgcctcgtcggaaccctaggcccacccgatcggtggcgcggcgatggcaatgacggcgcggcgggttcagctcgccgaccggtggcgcgggatccaggaggccgaggaggccgatgacgacggcggcggcggcgagccgtccgcgcccaggcagcgccgcctcaaccaggccaaggaggaatggtacggccacgccacgcatcgctctccgctacacatcacttcgcggcgatggggggcgtaacgtactctacgcggattagcgcgggtttagttagtgtttggtgtgtgggtttaggactttccgctgatcggagcgagacgacgagtaacgcctgtgctgacggggaatcgccgaatcgggcagggtagctgcatgttagcacgcttgttttgtttgcgtggttgtttgattagataatgcgaatgtaggttgctatgggccgatagactctcaccttcgtttcagacaacagagtggattgatatattgggtggaaacctctgcagggctcattatcattttgagcgtgagcactgttatgcacttatgctattggtagttttgtcactccgtcttgttaggggtatgtgctatcgatatgcagaactgagcaatcatttgattacaatgtagacttattgggatgtcaacagcatttcttggagtaatgttgattagaaatgtacatagctgtgtgaagtccgacttatcatggaccaaatatatatcactactcccttatggtcatcccatttgccactatttcttacactagcgaagtacccatgtgttgcaaggacgttgaatatgttcttttttcttctctctttccatagcctggggaatgaataatctacatgcttcactgttcaatggaacccacatgtcagtttatagtgggagttggtggtggcagattcaccaatttcaagtccccacatgtcggtgggtggtggtagattcaccgctcaccaccaccattagagtttttttttttttaaagagtgtagattactggcttgttgctgtacgcctccaacgctgtattgtactttgtagtcatttggttgaagtaacttttagttaacaatgatgtgagttttcaaatgtaaggcatatagaaagtcacagagtattattttgcttgaagtttttacaccacatgaaatgtgatataatgtatatgtttgtgtctaaaagacatttagtttatttggaatttagctgtgttggaacatcaaaatttatgtaaatggacagttgctcttcttgcaacatgccttgtttctagagtcaagagtcaaagacatgccctaaaatttcgcttgacagtcctaatgagatttgatgtttgtgtaaccacctgcaggttttcacattgttttaattttctgggaagtttgccaaaagaagagcatatttggtgtggatatgctgatattatgggaccatttctggagaccttccttggttactttgatgaccaagaggaaaactcacctcctaggacaatatggaaacggatttctgaagagctgaatgtttgcgcacaatgtgtttgcgaacaccaccaggcacagaaggattttgattctgaatatcggtctggcgttgacgccctcctgaaagtgttacggcttctcgatgaagagagggttacagaacatcttaggcagatgaatgcaaaagcacaattaaaggagtacaaaccttcatgccatgatgcagaagttagcataatgtttgaagtatgtatcgtttatgtgatactttttagttttccacatatacctcaaataaagatactaaattccttctaaaacattttaatttcttccttttctgtttatgttccttttgcatgcatatatatttataacagcacactacggctaccaacgttgtacaaaatctctcggcactagtatttatttgacccttttcaccgtaattgcttttgtagacatgtagtggcttacagaattgctcttagagtgaactgaatagagtgctctttttatctatcaatataatataatggcatttgtccagttgagttagttgggcttattttgattagcaggatgttggtatccattgaatcatgtgcattcctgttctctgaattctcagaatcactttgctaatactgagaatacaagcagcacataattagtctgcccctgtgtttctgatcagtaatggtgcagcttattttctttctttctttttcctttgatactttctgttatcaagcaatttcaatatcttaacgagtcacatttgttatatataccatcacctaggaaccagaaccctaagtttcatgcagccatgataaaccattgctcttctatatttgcaggttttgatgtatcccattttgttagatgacctgtcactggctaatcagttccagacattcattgaaagaattgatgaaatatttgaagtgagcctttctactaatcagcaataccctgtaagtcacttctttccttgaagataaacttagttttttaaataatcaagtaatccaggatactattttttattaaaccaggatactctatttacttctcaccgattggtttttgggctgttgctcaaaatagtatatattaagtttctttcctcctcatctatcaagttcacctgtctcacagtatctccgaacttacaattgtagggtgtttatgcattacttttcttcaaaagttgtaaagctcgagcaattgggcttcgcttagcccggtctatggggaaattgaggtaatgtgcttgccactttcctgttcattttgaatcaataaagttaccaattagatccatacacggaaatgcatctacatagtgtaccatgtaggaatagttaggcaatgtcatagaactgtgcctgaaggtggaagcttccaaccatgtgtttgatgatgctgtttgactttgtcatagtctgatatttgttaatagcatattacatttacagcttttaaacctatacaccgaacatttaatttgctaccatatttaagcaggatcccatttcccttgttttccccagatcattacaatgtttgaacaaaaatacttgccaatctgactactgatgttttccgtggccaaaatttgcattaaaccatgcatgccctatatggtcatgaaaacatgccaaaattatcaaaatgccaatcttttcttctttttctgctttaactcctacatagtgtttgtgcaacagcaaaattaagctttggaaagccagtcaccttgtttcatagacacgtaactctttagctcttggcaaaataagtaagataagagatagaattgctaataggggtgggcgttcggtttttccggttttatcggttcggtttgttcggtttagtagaagatcggtttcacataattgctagctgaaattcctcctagaaaaattaaaaccgaacctttttaaaccgaattaattcggtgcggttctttcgggttaggtttataccgaacttgattttgaccactccatcagttcatcacgctgccaacaataatcaggaatcaacaacatataaaaaaagaagttccatcatccatcttaggggaaattaagagtattagtatataccattggccatagaaccagaacaacagcaagatggcagcaagatgtcagagaatcgaaaagccaggagtccaagattagcacctgctggcctatgaaggaggaattgatcgatatctgactgccaccgctatggttggctgagccgtctggccagtcgtctgcgagggccgaggagccaaggacgagctcgttgggcggtgctagggttggataaagttgcgctatctcttgggctggatggaaggggatgagttgggccttgtatagttgtattaccttgggctgtcccttcctcggttttctcggtggaccgatttattcttttgaagaaaccgacgcgatgaccgaacaccgagctacgttaaaataaaaaccgatggaaaaaccgtagaccgcaaaacccgccactttggtgcggttcggctcggtgtccggttttcggtaatttcttgcccacccctaattactaactacaggcctagagccttatttaagatatcttagcaagatccaaaacagtgattacatgcaaaaacgttgcaattaaggacatttgtttgaaagattgtggttattttttcttagaaagatatgatggttttaggaaacagaaacggaagtctgaaactgtgggtataatacataatgccgtgaaaaagcttcaggatggaaaccacgattatatccaacttgtaccattaatggacttgcttctggctttgacttagatagtggttggcaactattaattttatggaccaaaaactgtttcacgccacaaggtggtgttatgtgtaataccttagctgattactcataagattttcagattttgcacccttttaatctacaagaagaatcaaatgctttgttctcatattggataatataatgcctctttccatatttaacactggaaagttctccctgccattccttttacatttgattcaatcttcaatgttccattagtatcacttatattttttttgtttagtaagaatattaagtatgttgaaatctgtagtaggatctgacctctataattcaactcaatgtacaagttgtgttcgatcaagtgctctaatatcatgccaggaggcatgttgagattggtttagccttgtatggctttaacacatttggtctgatttgtctgctttaatttcttataactgtattaacattaacagtaatatgcaggaaagcagttgacttggaccctttgcaacccttactgcaaaaatatattaattttttggaagccgaagttcttccatctacttcagaatctccaaggcctagggtgcagctcaaaagagccgatatatggcttggatttaaatcactgtatgtaagtttaacacatgtattacatatgacttaccatgttgcttcttccaattttttacctgtcaatgtattgactttgtttttgcagccttggatttcttgatgcacctgctttcgaagatggaatcttggagagataccctatattcctgaatattgtacttaaccatgtcagtgatgatagatctgatttatcatgtgctgttagttgcctgaaagcatcatttgaaatgcttggtaagtgtaactactatgagtttttgctgtcctatgaggctatgatgaacttttcctgttgcaaacttacacattttcttgttttaggttgcaaactttggttgagaacaaccctatcacctaatgtcatgcggaacacattgttgggccattgttttcatactagagatgagaaaagccacaaagaaatttttgaccttttcctcccatttctccaggcatgtttgttgttcctttgaatccaatgatattcgcatatactgatcattagtgcattatgatgtgctcaatcttgtatgcagtcacttgaagcactgcaagacggtgatcatgaaaagcaaaggaggaacatactgtattttcttctttatcaagtaactcggagtagtaacttcagttctctgatgagaaaaaccgctactaaggttagcttcttttgttgctaactggatattcactttagttatttgacttcccatgtaaatgcttactaaaaataacttgattgtattcccttatttttactattaagtacagcatatttgggacttttaaccatttgtaatatcgcacattgtttgatatcatacttcaaatcttaaagatgctagctgtataaaacagtacaagacctatacccacttcattagttgattacatatattagtcatcgactttgctacagttggtgatgaggtgggtgagtagaagtattcatggaaagccattagagccttctaggttttgtggtctgttattccttcagtgctgaaaggattattccacataagttaaatattgctgtcagtactactgttgtacttgtggtcatctttgttgttgattttttcactcaccatgattggtgtgcttgctgctctccatcgcaatcactggtaacagttgtcgttggcagctccatgggttacaacagcagaggacacgcaagggggagggagggaaggagagattgcatttccctctgtaattgctgctgcatgctgatttttttcctgctgtagttgctgattcatgctgtttatatgcttacatggtgtcgattaagatggcttctaaatcgcctagatgcccaggcagtgttgcagtgcctccctgcgctcatgattatctaagtactacatttgtattgcaaggagaaaatgcaacaaatcattttgagtagttttgtagtgcgacatggtagttgacagttataattgtttctcctaagttgatgctgtgctttaagcctgtggtttgaactttcaaccttttggtaggttacattgaaaatatcatgtaagtccacagtgttagaatgcattctatcactgtttctaggaatattataaaaactacagatttcctttcacattaatattttcatacttatttataactaactaaatatgaaattctgaccaagctatgtacaacaaaagaaaatagcctttttctacatactttatactgtaccaatcatcaacctccccgcagtcttggtttactggaatatttattatgcacacttgccatttaatgccctgatgtttttccgtgtttccttccagattgctcttcttattgtacaaagagggtacacaatgaaccctccttgcccagcatctgaatgtgtccatatgtggtaaggaccaaacatacttctcttcacaacgtggcaaatatcctactcgttggatgacaataaacaagttttactatacaagttttactatggtggctgaaccgctgaagtcaaaactgcttctatattttattaaaacttatcatgtatgaaaaccattgttggaagttggcccacttctagatatcattgtccacatattcgatatcttgtattcttgtttctagctaacctccgtttttatttgctgctggatttccctatttaatttctattatgaggttacatttatttctctactgttgcatatcatcccctgacctggattctgtacaggggaccatctttgattggctcattaaaggacaaatcattacataattctttgcgtcaacctgcactcgatctcatcaatatcctcataatttctgatgcttctgctttgatctcttttaaaatgaagtatgagtctttcacaaagggcgatgtaatcaattctgtcatatttgttgatgatgacgatgaattgcctgtcttctgtgatgctgaagagatggattacggctgttggaatgatttcaatgttctgtacaagttgacatgtcgggaatgcaaggattggagatgtgtccctttgttatggtacctcataatggttcagttggaaccttctgaactgcccatggccttttcaaaagcagtgttttgggctctatctcatatttctgtgttggagcctggagtatctacagagtcttcagtgcctgtgaatgattggttgtcatcacatgctgaagaagtattgccaacattttcatggcaagtcccaaatggtgcagatgatggtggagttggaaaggagtgtatcaatactctcaaggtgtcacaatcttgtaccctgctattaaaaatatttaaaaggttgactctattttaccagttcctattcatcttaaaatctttccatgccatatctcgtacttattgtaatccataaatcctgaatttctccagtatattgcacttgaattctttctagatttgccattcatgtcatcatgcaaattgagcaacgtgggcttctaaagcaatgggcttgggaatcaatgatggcggaaagcttgattttgacactagttgatcataatgatgtaagggtattgctcttgtcttccattctaccccttgcgcatctgagcacttagtatttcttcttcttgctatacccactgtagaatctgcggcaagttgggcgagctgtcttggagcttgcgtcacaaggacggggtttgacatctgggcttcaatttctgtgctcgagtgcatcttccctgactgccacatttttgggtctaagatatgcagttcaatcggtaagattttgatttttttacatttatttttattgatgttgggaatttcctggttgctggctggtgggtacaggtttctggcgctggcaggaggaaccccaccaggaataatagttaaaagttttaggctcaaatttgaataagaaccaattgcctgatgagactgtccagttatcaactacaaaccaatgaataccatgaaagatcagagcacagagatttgcaaacagatttcacattgcagttcatttgatgattcatctttgctagtttctaatggttcattcaataatagttccgcaatagatgtcatattagtgtctcatattgtttgctttggcaccaatttttttagcatgttttttttagacagaaggccaacggcccagcttatattgaaagctagaggttttacatcgctgggggttacccagttcaacagctacacaaaaacagggggggtagtgatccttacatcagctttatagctgagaaaaaagattgcacgcaggccaaaacacaaaaaaacaaagccctaagaaccgtgataacatgtcatcccacaatcaatcttagcaactgcacggcagccatcatcttctcttccaactgctccaactggttccttggcgccttccttagtctacgccactgtctcaaaaagaaaatcactcgaaagatcagcgtgagaggcgtagaagggatcttcttattgaaaatcatgtcattcctgggtagccaaagtgcccaggctgacgcccccaacaacattagtaacaggttattagatttatgtcctggtaagccaacaaactcttcaaaaaactgttgaaaagaagagggaggggctcccaatctagtgcatctcttagaatacaccacaggaaagtggccaaagggcaagtgaaaacaatgtgatcagcatcctctgagctgtggcacagggtgcagctgtcctctcccccccattttttcttagttaattgcgaagtggactgaattctatctctgatggccagccaaagaaagtgcttaactttcagatgtaaagtagcctgccagatgtctccacacacgtgatcgtcgcctatgtcttgcatttccaaatattagtcacaaatctttctgaaaattgcaaattggcaactaacttgttgcagacctccttgttatggctgtcaaaactcaaaacaagaaacagtttccaacgctcacgtccaaattgtctgggttgagcaaagtatttctagtcacaactgttataatacatattgtgcattatggaacttaatgcctccaaaatccatttgctaaacatgcacccaagtaatttgctaagcgtgatttgcaggcaaaacttggcgatcatttcctaatggttgaactaattgttgttatatcaagtatatgttccacaaattgaagaagtgggtggacatggactgcagactttgtattctaaaataaaaagattcagacttaaactttaaatagactgccgtgtaagcattccaaatctagcccaggaaatccagtttgttctggttatcactatgccaggaaactgatcctttgcatgaataacacagaaacatttatttgatattcaaagcttcatttatttacctgggtttctgaaggaaaatagcattgctcattttaaggagtgaggattatcaatctctttggttccaatataagcatggttctctgagagggtctaaaaaaatattatttcaatctctgtagctgttcagtccaaacattttttcctttaaactggaattttttttgagaattttctttaaactggaaataatcatgttctaccttatttgaaatgttcaggtggaaacaaaatcagttttggcagattttcctagtcttcatcacttgttttttgtcatatgcaaactattaaaggatgttgttgttcaacaaccttcagttgcactgcaagcaaaaccttttgaagggggtttcctgcgccagtccttttcaaatgtatcagtcaacctaccacaacattcagttgacattatttcttgggagaagttcagcaccttgctttcaggagctctctggccttttattttcacatgcctgcgaaagggagatgatctaatcaataccaaacagtgtcaggtacatctctattgctttgacttactgtattattgctgtgcacatcttcatttctttgtttcatcatgatctcaattttatttcagatatcatgtgttcgattgcttgagttggttccccttgtgtatgaaagggtttcttcatattcttctgccaagtcatgtggcgtgccaacaatggttctggaccctactgatattacgtggctttttcacttgattaattggggcaaatcatcactccttgtaatcattagacattggaagcagtgcatgctatctctaattaaaatattaaaaggttcacttggtggtactgttcaacactacattgaagatcttggtagtatcatttcacatggttagacctctaatattttcagttctgtatgttgtttagatgtttcaagaaatgtttggtagcaacttatataccattctttcagatgcagtcaatatcgatgaactcagcgagaaaatttcagatctcaaacttgcattgtccaaggaggcttctgcaaaatccgaaaggagagtggtagctggtgtatcaatgttcacagaaccaattgctggtattccttctccagctactcagacggctcaggagagaaatactggcagggacaatgttgaaaccatgaagtcttctcgatcgacatgtactgaacatataattcttctgtcagatagtgaagaaaattcattgacagctgatgtgtctggtgaggatgttttgtcatcagttaaagatagtgatggatctggtacttcagatatgcagaaagaagtcgagcattctgaaccaaggatgcctactgaagatagacacgtgtcactaaaacaacagatttgcagcccggccagtgatattgtagcatcttctaaacctgtatcaaaagatagaagtataattgctgccaaagaaggattgggtagagcaaaaattccaactgttccagtgaatacaaatgatacttcccttttaccaaagaagattaaaccacccgctagcaccatttctcagccatcgcgttctaatttgtcatctggtgctgaaaaatttaaatcaatcttcagagatttatctgatgacgaagatgatcctttagaacatgcacttgatagctgccgaaagccacaaattcgtttaacaaagtcatgcttattggttcctaaaagacaagtagtccagcttcctttgtctgctgaaaagagacatacttctggaagaccagatgctagttctcgaagactgaaacctcctaaactggacagctggtttaagaacatcttggaaatggattattttgctgttgttggtctaccttcttctgagataataaagaaacttgctttgaaagaaattccggtatgctttgattcacaagctcaatatgttgagattttccagccacttgttctagaagagttcaaagctcagttgcagaatgcttatgtagaaacccctgctgaagacatgaattgcggctccatatctatcctctcagttgaaagggttgatgagtttcttgttgtacgtggccgcccagataaaaacgactgtctgaaatccaaaaactgtatggagaatgatttaatattgctcagcaaggatccactgaatagctctggacagcaagttcatgtgcttggaaaggtatttttgttgcccatgaatatttgttgccccaacaaagtatttttgctattgcgtaacacatttactatattttcaggtggaccggcgtgagagtgataaaaccaaggcgttaattcttgtaataaagttctttctctctaatgagaatgcacgtctaaataaagtgaaacgtcttctcgttgaaagaagtaagtggttcctgaataggattatgagcatgactcctcaagttcgagaattcagtgcgctttcatcattgaatgatataccagtgcttccagtaatcttaaatcctgtttcttgtaagtcaatccaccatggatctggaaaagtgcatcttgataaactttcacaccctatgcgaaaagttttgaagtcatcatacaatgacagccagcttgaagctgttagtattgctatcagatcaacaagcttgaaagcaaaattcgatctctctcttattcagggccctccaggtttgtcctttagttacgtttaccagcaatttgtcacaattccaggcataaacaaaggaaactttacacttgtgttttctgcaggtactggtaaaaccaggactattgttgcaattgtgagtgccttgctttctttacatgcagccaactcctcacaaagaaatgaatccttcgctagtgctgaatttaacaagccaagaccaaggctaagccaatctgttgcagtaactagagcttggcaggatgcagcccttgcaaaacaacttataaacgattctcagagagaagtcccaacagatcggctttcaaaaggaagggttttagtatgcgcgcagtcaaatgctgcagttgatgaacttgtgtcaagacttagcgaaggattgtatgacactgatggaaagctgtacaagccttatatagtacgggttggcaatgcgaagacagttcattctaattcagttcctttctttattgacacacttgttgagcaaagattggcagatgagttaaagaagaataatgatagcaaaagtttatctgatactgaatcctctagctcacttagggctaatttggaaaagattgtagacagaattagatactatgagttgaggcgaaaattattggaggctgataaaacagaaaatgactcacttgttcccagtgattacgagacagatgaagtttctgatgatgcaattggtgcaaagctcaactttctgtatgcacagaaaaggaaagtttctgccgaacttgccactgctcatgcacgtgaaaagaaaatagctgatgaaaacagatttcttaagcacaaagtgcgaaagtcaattcttggagaagcagaaattgttgtgacaacactcagtgggtgtggaggtgacatttatagtgtttgctcggaaaccgcttcagctaataaatttgtgaatttttctgagcatgctttgtttgacgttgttgtcattgatgaagctgcacaggtattatcgcaatactaacttttttcttctaaatgatgatcgcactatgttttattgaattaaaactaagtttgtttgggcttattctgtaggctcttgagcctgcaactttgattccacttcagctactcaagtcgaaaggaactaaatgtataatggtaatttctgttacttcttttcctacaccttcatgcaattgtatggcacttgcttttgcttactgatgtcttgcttgaaggttggagatccaaagcagctacctgctacggtgatgtctggattggctagtaaatttctttatgagtgtagtatgtttgaacgcctacaacgagctggttatccagtgattatgctcaccaaacaggttattttccgtgatatgctccgtgatttctatagtatagattttttatctgtaaattttgcagtgtggaagtaaagattagtgaagtaaacaggaaattttgcaggttatttttgatttggtaaaatactatatcgtagctcagtgatgcttggttacttgtgtcagattgcatggtcccatgcccttgttagactggttcctgagatttagttctatgcgctaattttgtgcatggactcattcctatatatgagcaaaccttagcataccatttttacaaaacagactcagttgttaacatgattaaaaggaaccaacatgattttgttttttttcgtatgttaaaaatatatccatacttcatagttcatacagagttccaatgtcttttagtatgcagctacgtacatctgtatgtgagaagagcagtcagtgtaaaccatctgctgatttatgccaattattatttttgactgcagtaccgaatgcatcctgaaatcagcagattcccatcgttgcatttctatgaaaataaattgctggatggtgctcaggctgctgacaagtcagctccattccatggtcatgactgtcttggtccatacatgttctttgacgtagctgacggccgtgagcagtgtgggaaaaatgctgctacacaatcgctctgtaatcaattcgaagcagaagctgcacttgaaatactgggatttttaaagaacaggtaacaatattttcttcttcaactacatgcttaaggattttcattctgtagctaagtgagactttatacttgcttcatgaacagatatccatcagagttctcctgtaggaaaatagggatcataactccatataggagtcaactctctttactgcgttcaaggttcaattccttttttgggcctgaaattgttgcagagatggaaataaataccgtggatggatttcaaggtcgtgaagttgacatcttggtgttgtcgactgttagagcctctaattcatcagacagcagacatcacactggtgaagcgcgcagcattgggtttgttgcagacgtgagacgtatgaatgttgccttaacacgtgccaggttttctctatggatagttggaaatgcaaagacattgcagaccaattcacattgggcttctttattacagaatgctaaagaacggaatctgttcatctcagttaataggccataccgttcgttgtttgagaaagttcgttcacattcagaagatattcatggttctaggcatacctactatacaagtcattgtaagaagaaggaaagtggaaaaaccagtatgaccaactcacagaaaattgatgcacgaccccacaaagaacatgcaagacatactgtcaggactgtggaaacagcaaatgaacgtttaccaaatgaccaagcaaaaagagcatcacgctgggatcggaagagtccaaaagctcatgaacccttccatagaaaatctagcaaggaaaaggaaccagtaattcaggatactgaccaggacaatgcggtgagaaaggaaaaggaaggagaagggctgactatccataatgataatagcctggagcttgctaatgttataaggcagagggaactgaataaacctgtcaaaccgaatattcatacagatgctggtaagaccttatgtaaccaagattctcttcagaattctgaggttagaaaggatgtcaacaaaaaatatgataatggaaatgtgaagggctcacaaaatcatgatacaaaagcaacagtcatgaaaattgatgcttctccaccagcacaagacatgcagaagttaatacaaaaggctaaaggagcaaggaagttctctgaaaaaccaagatttggtaattcgagtcaagttgattcctcagttaaacatgaggcaactctggaatcagccaataagaatggtggtgcttgtacaccaacaaactcagaaatgaagaaaatggccggtaaggccaaaaaggctaggaggttctctgagcacccaagatctgggaactcaaataaagtggaccattcacttccgtcttttgatgaagaaagtagccaaatgccagaactaaaagaaaacaacttaactgcaactcgtcaaaatcatctgactgcatctaggaagcgacaacgggaggatattgagtcattactttcatcagctcttgtatcatcaaagaagccttcttcaaagtgtccttccaagaaacaaaaatgagatcctgcagcaaaggtaagtttttcatgctaccttcaatttgctgtattataacaaagttaatctgttctgaagttagtgtttgctcttttttttaacctgatacagagggggaatccttccatttggaagtcagtattgttgactttagaagtttatattcttttatgcaaacgtttcttgcactctatatacaaaattccatacctgtggttgcagtacatttaaggactataaaatagaattggaagaaatcaccgaagcttagctagtagtggtagtagcctgtctgttatgagctacttcctccgtttcatattataatactttctagcattatccacattcacatatatgttaataaaatctagacatatatgtgtgtctagattcattaatgaatgtgggcaatgctagaaagtcttataacctgaaacggagggagtaatagttagtaccaatcatgttcctggtctatttggatttgctattattttcttctacatatatccccctctaaatactcgtatggaggctctacttaccctataactgttaatcagctattcctactaatttgaccagcccccatacagttggatatgcgtttgtactttggatccactaagctttatatgctcagttagacatgtaaatcagtgatcctggaacctcagcttgtgatacaatttccactttttttggaacgcatctgcgttccacctattggtggttcacttaattgctgtgtgctggatattttgacatgctatcgattcaattatctgaagctaatactcttatcttcaaactcaggtggcagcagatcatttatccgctcatggacccttgtagcttttttgacatgccgacgagttcatctcatgagttctgcggttgctgtaatgtgatttctccaccgacgccatggaggcacttggattttgagactcataagctaacatagcaagtgattttcagagagcaggaattcttctgacattgatagattgttcttcggagcttttctccctgccgaccaccgcccaatctggatgtgaaaaaccaaacaagacaacccatttagacaacatagaaggtcatttttggatgctgcttgtgtcttttgcctagttcagagatgatgcttgtagatatgcaagccaattttgcgctgtaaattatctgtacatagtgcacatatagcatgaacatgacggaaccatacacatgcttgtccatgtccaaaatgaaaaaaaaaggacgtggctcatcttccgaccagggtgaaagcttgatgcaatgtagctcctcttgtttggactccaaattcatcagtacttgtagtactttacaaactttaaaatgattgcgttccttaacatggtaaagcagtacagaataagcacaggataatcagtgtcaacattttcccagacagggtacggccttcagctcagtcccaaaacggcccatgggtcatcagaccgtcagctcagtcccaaagcggcccatgggccatcaggttaactgcgtgggacatgatcaggcatgcagtcagcacatgagacaggtgcattatccaatatctgggaagaaacttggtgcttaagtatatcactgacgtagggacatctcattgtacgtacaccctaaatatgaatgaaaatatgatccagacaggggcatctgattgtacatcctaattttgaaaaatagagaattccttgatagacataataggacgagtaaaaaagcttgagactgtcatgcactttccgtctctttgttttttctctactactttacaatgtcataaacttatataagaggggaaagaccagttcggttgtttcgaaggccgtgtttagttcacctctaattacccccaacttttaattttccatcacatcacatcacatctaaaacttttctacacacgtaaacttctaacttttttttttaaaacttccaactttttttaggatctcaccatctcaccatctcacgccgtatattcttctgaggtctcaaagtcgaagcccttgaagatcagagggatacaatattttgcatatttcttcaaacctttcatttcccaccagactgaagataaatacatgaagaaaattgccagcctgcgtcgcatggttaacaggaactgcgtaagcaattaggcatgaaataacttcaactgcatttcgcgaacgcgccattacttcaactgcatgcttgacatgtccaacaacatcacaataagtcaataagaacacaaccttcctccctccaaaaatgtaaggcgcataagctttttttacgtggtctctaacttaaaattttgattattgatttctttcataatatatcaccaatataaaaagtaattgcattagtgatatacaaacttattagatgtgtgcaatttaatatacgaacttgtaaaaagctcattttgagacacaaacctatctaattcgtgtgaactaggacaaacatagcttatcaaggttaatattaccaagttaatcttgattagtagtgagtatgcataagacatgctatacttatacttggtctctactttccttcgtcatttgaaatgctgaatttcatatttttctatcccatgtatcatagttctgttttcatatcttcctctgtaatcacaatgcctatctttttattgaacaaatatatatctaaattgcaacctatatatttatatagtatcctaagcaacacctaaataagattagcgattaatgttattttggccctagttcacacacactagatgagttcgtgcaccaaaacggacttttacaattccgtgcactagattgcactcatctcacaagttcgtgtatcgtcaatgcaatttactgtaacataaaaacactttaaaatatgacgtggtatgcatagtttaattattagccaaaagttagaaaggttgattttcttaaaataaggatgcatatgaggcaaatggattatagtttaactgacgagaaaatatactacaaaatgagttttatcacgaactttaactataacgaagatagatatcatatggttgtctggttggtttgggatatataatttgtgcacattttttttatgtaccgcaatatactgtatgtagtaggggtcgtacacacgtgtggttacattggtgtgagtgttgcgtgtcatgcatgcatgcattgtcttactccctctcccaatcccaacaaaaatgagttattctttttcctgacggaaaaatggagttgacttataaagttgtactgacctgatataatcaaggggaataatctttttgtggaagtccttgatgagcataatgatagtgattactgcaattggagcacgcgcatgccgtcagagatcttaacaaaaaaaaagttaaaataccaaatgacatgcatgtgttcactccgttctacattatagttttaacgtactctttactcttctaagattcactaatattcatatatatttaaacatacatacatgaagcatatatacatataaatacatatataaatctatgtattattaatgtattaaaaaaatcatacattttataatgtgaaagagagatgtggtagtccgctaggcttgattacaaagctactcccccgtttcatattataagtttgatttttttacttgtcaaactttgattaaatttatagtattaataaaatatgaagcggagcgagtaaaaaaaaatctaatatcgccattgtccattgaggcattggatcatgtagtacttcgaaatcaatagcgatcatgaactcaccgaacttaagccggatgagcaggtcgggggagaagccccgtcgccggagatccgacgccatgacgctgagcttgtagaactcgtacgccatcgcggcgtcgaggcacacggccggcgcggcgcgccacagctgccacagcgcgaggcacgccatggccgcgccgaacactacaccagattctcacatctctgacgggatacctgtgacgggcaaacgaaatggtcactgatgaccgtcacctttgacgggtcatacgggatgccgtcatcggtgaggcatccggctgcgacccgtcacaggtaactagtcacctatgacgggttgaaaatagaacccgtcacaggtgaggttacctcacctcaaacgggtttaagtcctaacccgtcacaggtgactagttacctgtgatggaaacatcataaaagtcttacataaatgcagcggaaagaaagaaagacaacaggagctaagccttgacttgaacggcagcgggaacaccactccacaggcatcctcgacggcacggacaaagcctactcctcggagaaaccttcatctgacccgaactcgaactctggggttgggaaaagtagagcaagactgagtactacccactgtactcagcaagtcataccggaataggggtatgatgcagggaatcatcaaagaagagctgaagtggttcatttgcgtaaagcgagcatttataaacagaaattgaaagatttaaacagttgtaataattaattaacatcaactatccactgtccaacgctaacccatgttgcgacaggcccaaccgtccacctgaactatccaaattcaaaagattacactaaggtgagactaatcacggtgaatctggttgaccgcccataaccgcgggcacggctattcgaatagttttactctgatcagaggtgtacaactgtacccacaagacacagccccacgacacgtttccgtgcgccgacatgtcaccacgacataccggaaagaggccgtgacaggacccttcgcataaccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcggctagaggaaagctacgctacaagcccagccgttgcccacgctggcttgtggtaagtacgataagttcttccagggcatcccgcgaaccggtccttaactgccatgggtgcgaccagcaaaaccatgcacccacagcccaccatgtgattcattttatttaaccaacaccagagcggtggtactaatccaacattatcatataaacctatagtctaggttttaaatgagatttccccatagtgtgctagttgaactaagcatggctaagcaattcctagtccaaagtctaatcatgttataacccaagctaacaaggagcatggtgtccaaaaagcatggctgtaacaaaaggtaaccatcccatagtataattgcaaaacaaatgcggtatttgaaagaaaacattaggacatttgcaatataggatcaatatgatcaagtgacaagcatgacttgccttgctctgctgctggaggaacctcggcgactatttcgaagtacaccggagcgtcggaagagccggaatctagcgacatacaaggcaaacattgcaaacaggctataagactactgaaacagggaacaaaaccatttttaatggattctacacatttttcttgatttactgagacttgattgggcttaaacggagctcggatggattagttatgatttttagaagattcactgtgtttattactatacaagaaaaaccttaaactatttattgcgcaatatattccagggctgacgtcagcacggagggggtgcggcgccgacatgcgggccccactggtcagcgactcaagggtggccggtctaccgtggaccgggaccacgcgagtgatccaccgccgatccacgggatcgacggcccggatcggcccggggccgatcggacggtgcggcggcggtcaggctaggctcagctcggcacaaagccggccgaccggtcacggcgacggcgcgcgcacgcgcacgcgcgttgccgacgacggcaaccgacggcggagacggcggcgcaaagncggcgccgaagggcggtgatgctaaagcgacgactaatgggcggcggcgctaaaacggcggctaggagggagaggaagggaaaaagagggaggggggtgcctcaccgagggtggccggcgcggaggaagacgatggcgaacagcgacggcaagccacgggaggacgacgtcggcgggcggacgagcttcggggtgccctaaggaaggagaagagagggattagagagagggagatgagccacggagaccggaagccatggccgaaggcggcggtagaggtggtgctcacccgagtgcgagggaacgagggctccggtgacgaacctcgacggaggaggggtggacggggtggatctcggccacgcgaacccgacggcggcgacggcgcggcctggcggcgaccctaacggcggctagcggcggccggagtagcggaaaaggcggcggcaaggggttgcacggcgcgggagcgatgggaggctcgagagagtacggcggaatggggaaaaagtgagagggagcgacggggaagcttaaatagggagagagaggaccgggcgtggccgggagaggcgggaatcgccggccgacgtgggggagtgggggaggagagaaaggcgggattcgaaaatcgaatcccggccatctcgggcgcgggcgcgagcgggagagaaaggggagtgggcgcgggaaacgcggcgcacgcgcgggcgtggtcgacgtggcccgaaggaggcgaaaacgtgggcgcggcggcggttgcgagcgcggcggcgcgagcgagaccggcgggaggtgggggaaggacccgacaggtgggccccgcctgtcggcgaccccgaagaggagggcggcgggacggcctggctgggcctcggcctgcggccggcccagcaagggggagggggacggaaaggggagaatgggccggcggcccattcgaaaaaaaggaggaaaaagggagggaaaagaaaaagaaaaaggaaaaaggactttccctggaattacaatattgcttgctcaattttaattggttaaaattatttctagagctctgaaaattccactaaaaatcctgttaatgaatttcgacatgtagaactcaagaaaaattccacatgtcaaatccgattattatttgcattaccttcttagggttttcttttgatttgggtaccgagctcgaattcgcgctatagtgaatcgaggtcgtcatcaaccgtc

SEQ ID NO: 29765 - DNA, 4259 bp, Oryza sativa
  unsure (1)..(4259): unsure at all n locations
cgcgtgattgttgtacaacnnnnnnnnnnnnnnnnnnnnnnnnnnnnnnnnnnnnnnnnncacgcgtgatggcgtcgcaggtcttgtcctctttgccgtactccctcgccgtcacgcgctttggcactgcgccgccgccacggcgagccgccgcgcgggtcagcctccgccgccagcaaacgtcccgcgacggcgccctcctccttcgctccctgacgacgacgcgctcggtacgtaaagctcgtgccaccgctatcgatctctctcttaaattctcctctcctctgatgatcagagatctctcttgatcggtggaaaattgcagcggtgcgctccggcggcaaaaggaggcgacggcgccaaggaggcgccggaggcagctggcgaccccgacgacaagctgtggccgtgggacgagttccccgagaactccgtgttcgtcagcaagggttagccgccgtacagccaagatttggtgcgagtcggggaagacccgggccgcgctcaaggacgccgcagcagacgtgctccgcccgttgctggacaacttcaaccatctccgctccctcaacaccgtcttcgacaccgaggattaccatgtcggcatgccctttggtaagtaattaacgtgagtgatgcaatttcgtactacctagcaatcgcattacaactacaactagcccaatttaattttacgagaaacaatttttttcctcattacatagattataagatagacgcacacaatcgcacacaccacactaaactcgctcctaaatacatggctgtgttagcatgcagggtatgggaacacattcccttcgcacggaaaacggagcggttcattagcacttgattaattaagtattagctatttttttttcaaaaatggattaatttgattttttaagcaacattcgaatataaacttttttttaaaaaaaacatatcatttagcagtttaaaaaatgtgcgcgcggaagacgagggagagttgttgggaacatggggttccaaacacagcattcaaagagatggagttcttcacttaaatctttcgcagcgcgtggtctgcctctttagcatggcgtctaagtgttgacgagtaacgtgatgtgatttgatgagcgcgtaagtaactatgttttattttgctgttgaaatattaggtatgctcattgcatgcattgggtgttataacctcttcaagatgaatccaaccacgttcatagacgcggccctcggttacacgttctacaggctctgcatcgtgtcgtcgcagctccggagaagaggcttttccaacgacctcatcatccgggttaaatttggtcagttactgcatccgcaatctgattcagctgtttcctatttcttaaaagcaaattcttttggtatcgctatgcctctcgatgatttttcctttgcagtcgtcatgttggttatggctatcaatgatatcaacaactgcatttattggcttgatgctatcaggtatgaatgtatgatccacacactcacaatgtgttatggttttttttttaaaaaattttaaccatatcgatccaaactaaaaattagacataccgcctaatcgagaggggttgatcgatcccaaagactatttggttgtgttttttgttttgagaggttgggagcccctctccttcgcacataaaacaaaatgatagattaacgcatgatcagacatgtaaaacgtctctgatatgtaaaacaaaaagatcatggacgtccctttaaggggcaaaatgactaggccagattagataaaatttgaaggaaaaaaataattaggtgattgaaaatagtagaccaaactattgtttcatgcatggttgcatattcctttacatattgacttgctcctttacattatattgacttgcgttgacatgctgtaattaactacgcgacatgcatgcatgtacagggcacctgtctatttcctctagagcttaacgtttgcttttgagttggctggtattacggcagtcccaacccatactactagacatggttttcataaactctacagcatcaagaaactagtattagacaatattcttccaatgcaaacatcactattccatacttcaatttaatactacttatctcacatgatgtcgatgtcttggatgttgtgtagaaaccatgtctcatgcaatacatggttttcttctctttcctcatttattcacttgctacatcaattttttttgtcctaggtgacaacttatttaatgctatggacactatcctagtcattgggttggaaatgcccttaagaagtgtgtgaagtatcttttggcctcagttgccctcttgggtaagtcatgaaaaaggaagacgcgagctgcgcaagctgctgcccaagtttgaacttgcacctgtgtctgagaggctatcaaaatggtaataattaatacttcatccgtttcatattataagactttctagtattgtccatatttattatatgtatattaatgaatctagacatatatatgtgcatatatttattaacatttatatgaatatatgtaatgctagaaagtcttataatctgaaatgaaggtggtagatcgatgtgtattcatggatggccaggctatactacataattggctgaggaaattttgttctgccctacttggcacactttgagagatggttatttggttaatcaattactttgcgtttcagaagatatgtgattcaggctccaatgaagtgcagttgcttctgtaatttcgtccagtttattatgcgtttggatcaaacaaggggggttaacaagttaattctcactgtaaatagacaaaagcattgctgtctgattgagatcgagaccatgttttacaatggtgctgctacgtgtttggccagtttttgaacctatgaccgatgacagtcaaatgaacaaaaaaaaaatcagtaagttggtaaaaacaatactccatcacgaaattatacaactactgctttctaaagacaccaggggtggatctacccattagatagggtgagtcgaccaactcagctacgactcgtgtcaccccaaagtccaaattgaaaattaaaaatatagcgaagggtgatccaaagtaaattccttagcaatagaaggtgctccaaattgtaaatttactgtatggagatatatagttaggacaaaacattcttctgaaattcacccttggttttcagaagattaattgtgaggatcagataattccttgcatatttttttcacaaaaatatataaaataaacaaatgtagaaagatactatagagtaaatactggcatcctgcgtcaagaaacaaatagtcattaaccaagtcaaatgatgcacagtgacatatataagaacataagcaaaagtatataaaaacatcaatgataatatcccaaatgggaaaaataaggatatcggtacgagaacagaagtgaggcatataaagaaaaggattgcacaatactgttttaatcaaacgacgaatttagaaggctgctgtgccaaacaatggtccaaaacattaacacagtcgtaaggaatacgtaatgctagaaaggtcagcttgaaaggtgacatggagatatatataaaacagacacacaaaacaaccatttcatttctgaaatataccaaatgtgcaaaatataaatcttcattggccaattacacaagtatttcaatcaaaagactagaacggggaaaaaaaattacaaaagtattacagcctacaaaccccatacccccacccaaaaagaaaaaaaaaatgaataagttcactggaggtcccttaaccacaaaaccagaaatcttcacctctaaactatacaaaaccgtctaatttaggtcccaagtcagtatagttgcctggttttgctgacgtggcatcctagtcaacaaaattaataaaataaatatgtgaggtcctacatgtcagtgagagaaaatgatgtgggccccacatctattttttcttttatttttctcttctcttctcaacttctcacaggtgggcgggcagatgcgagtgggcggcccatggcggagcgggcgcggcggcccgcgcaacggggagagatgcaacaatcgccgcggcggcgagcggccggagcggcggcgtcggaggtctaagtcggtggagggagagtgcgattgctaagcaggcacgacggggatcctctatagtcgtcntctggnggcgggaagcgatgttctagcgcgcg

SEQ ID NO: 29766 - DNA, 5393 bp, Oryza sativa
  unsure (1)..(5393): unsure at all n locations
ccgtggattcgcatgcnatcaggtcaccctgcctgcatgtccaccgccggcactagcacccacgctcgcccgccggcgcccgttctgcctgcttcgcagccgcgctatcccgccgccgtcgcggcgactgctgcatctctctccgctgcgcgcgaccgccacgcccgctccgccgtcggccgcacacacgcatatgcctgcctgcgcgtgagaagttgagaagagaagagaaaataaaagaaaaaatagatgtgggcccacatcattttctctcactgacatatgggccctatatatttattttgatgctacgtcagcaaaatcaggcatctatactgtcttggaacctaaattagacagtttttgtatagtttaggggtgaagatttccggttttatggttaggggattttaaaaaatctcgctgttaagttgagggacctccggtgaacttattccaaaaaaaaggtggtgatcaccttgggccaagtgggctttgctcattgggcctccaaggtgcaaaccaagctgtgcctattcccctcctccggtcgtcggtgtgtcgccgccgccaacccatcgcctcgccgcaaccgcgaccgcgccggcgagctgcaccgcccccgtcgaagtttcccgcggagctcgtcgttctcgagcctcttccgatgctttctgcacggcgagccggcgccggcggcgccgccgggaagacgtcgcatgctcgcccctgcaaccctggttacccgcggcgctcgtcggtcccgatgaccggcggcgacgcgactagaccagccgtggcgagggcgcttcgccttccgggtagtgggggaggggcgggtttccagcggcgggagccccaccgatggctccgtccctgctcctcctcccggagtggagatggcgccgccgccgttctcgcctcgcgatccgggagcagcgacatgggcctcggggtttcttctttctcgccgtgctcgcttccccgccgcgtcgacgctcctcgccggcggccagtggtaggtgaaagtttctctcggatttctctcccgatgcagaaatgctgagttgctgcctctgcagtggtgttcgccggctgctcctcctcctcctcctcctcctcgtgtggaggtgcagagcgtccggaagaggcgaatgagcgaggaatgggaggcgttgaaggcagccatcgccgacatgttccggcccttgctgcgaaacctagctgacatttgctctctccgcagcgcctacgacttcgaggactatcaaatcggcatgctctttggtgtgtttgagttgagttcttaccgcaattaacaatgccgtcgattgtatatccttctgatcaccagaccacttatgttattcggtgaatgtgtatcaacatttgcaggtgcgtttctcggatatgtcgggtgctaccagctgtggaaggcggctccttccgtcttcgttgatgctgcccttgcctttgtgttttacaagctcagcgttgtgtcctcagagctgcaccggcagcgcaagacaaacagcttgatcacgcggcttaaattcggtattcattttcttcgtatttgatcagcagtttaagtcatatgtagaattgcatctccaaaaaaaatagagacataacattaataacctcaagtaagaagctggcctttttccaaggtttgatcactcattttgagtattgatgaatcactgatggaatatttaccctgtttggatgggaggatttccgtagctcaacagtgctatagtatcaagttgatacatcatgtagttggcaaaatcaaataaaagaaatggtataaacttacagtcccttttcttagttagaaggtggatatgttttggagcttgggtgcaagtagttctcagtttagtttgttctatgcctagaaattataacctcaggctatcttatttattgactactattcaatgcagggaccatacttatcatggttatgaaagacatcaagaagaactatgtactcctggacattattaggtcagtatctattttaaaactttttctttgtgagagagaggtaggaattctatcgaacttattaacagatgaaaaggaggttcaaagttgcaggacaaaatcactgctacaactgacaggtcaaactaaaatgaaagcaattgacaggcctaccatcaggactgccaggagatggttccttgttgcctgatactaatgttggaaagccctttgttcttgttatactacaagaatacttggtggcagtcgctagttatagactgataggagaatgctggcgctgatagtagcgtagtgctgtagtttcatggtggttttgatatgcttcctgcttttgttggtttttgtttaggcagtgaagccagagctggagattgagaatctgagataatattatgcccctgtgtttagaaatgaacttcttctcctaccatttggagctccttgcccctgggatctgaattccgagagccctcttaaacgatactttctaggactaaatatttttcaaaatttccagatatcctctaactatgaatttcaaatgttaatacgaaattacttattctctagtgcacatctatctaaattccatgtgtgatgctgtggataatagaggttatgttatgccatacacacagtggttgctagctctttctggcatcagtaaaatccttatttgcgaagattatcaccatcctagaagcaatgatggaaaattatgtttgcaaagagcagaccagaacaacacaattttttattgaacattttgtataattcaaagaggaatttacataaaagagcaccatatgctgtagaaagtgttgcatgtttcttagggccaaaaaagtgttgcatattgaggtcatgttacttttatactaagaatatgggtgacaaaagaagttaagttactgagaggacttacagcatactccctccaccctgaaaaaaacgaatctaggactggatgtgacgtattctacctctatccagattcgtagtactaggatgtgtcatatccagtactggtagtaggcaaaaaagaaaaaaagggatgggaaaaaggttaaagaatcacagggccatagggaagtagctggagtgttagaattttgccaattaacttgtgaatttcaaagagacaatgcttcttctacagttctactgcaataatactggggctgttttctcatagttattttatttctcttgttgatatttcattcgctgctaactaaactttgtttcatgatacagaatgccggttttcttcctctacatttgtgcgttcgtattcgatgttgctggtatgaagaagtatgccaggcgctcacttatttcattgtttaatctgctgaaatctagaggtggcatacaagaaatatataggattatgtggtatcctggttatatatctccatatgatgattctgctgactggtgatgcatttgtgtgagtggttcccacttaggagcttgttctaggaaggatggagcttgttctaggaaggatgccctccccttcacaaagttttgtaaagtataataacgaataaatagctatgaacgtatggtgagtctctacaaaagaaacattcttcactgtttaaacatcgacctctcgttgattagtactgcatctgtttccctgtggagtttccttcttgaaaagcctttttagctgaataagttgtgcttaagcttggaataaaattagctcagaatttgtgtgaccatgtgcgtatatatatatgcaatgttaaaaggaaaaataattactagtgagaattctgaataaattgtattgagtcatttgaagatccttaagcttgatactctcttttgatagaccgcgaattagattttcaagtaaattaattgcacattacactatctattactctatagctagtaccaagtatcaaagaaccttaggataggacagtttcacatgactccgtctacactagttttggagcaatttggtgcagagaacatctctcccaataggcgtcgagggaaatatccagcgaaaacccctaaaagctctctaaataaatgaaaatattacagatatagatataggcaggaaatccattaccatcaaatctccaaatcttaagtacaaacttgatttgggagtaagaaaaggataaattcaaggtgaataaatcaagatgaatacaaatagaaagatatattaaaagtaactcgtgcatcttccttctcatgtttcagtcttcactacatatcgatatatataagtcagtttcagaaacacgctggtagatcctccatcaaagctggaagagcatattttgcgtatttcttcatcccggacaagtcccacatgaacgaaagataatatatgtaaaacataggaagcctgattgcacaaagaaagcatggtcaaagcttgtataatacatagtgcatgcttaagcaaatacggcataaaaaatgcaaatccctcaagaacccccaaatgccgagatagagtttgagtggatgatttttttaaacacaaacctgataaaatcaagaggggatatcatattgcggaagtccctgaaggttatgaaaaagaggataactgcataaaagaacacattagatcactcgtgcaatttgaacatcatctgagcacttacgtagtttctttatatcacaataacatgagcaattgtatgttgattgttgcctttgtaatatttcccttttacatttttcacttcctccagttataaataatattgactaaattatactttgcactaggtttagcgcatatttctactttacaccagagtgttccctcgaaagcttaaaatatattcccacgatatatatgccttataggtacactttgcttgatataaagtgtgattattctaaatattttgtgtttaggacaagattatttgatcaaactcctgaaactttaacgagcaataatttcttaaatgcatggttaaaaaattgatatgcatagatttgccttgaagggcaccattataatgttataagcatattagactaagataaaagcaattaccaatatcaattccaaaatattcaatattatgactagatgaaagatcttgtaacccaaagaagcactacctccatttttaatgaaaccgtcttattaaaaaattacaaatcaataaaattataagtcatgcttaaagaacatttagtaacaaattaaattataataaaataagtgatatttttttaataagatgaatggtggaacgtttctttaaaaaatcaatggcatcatatattaaaaataaaagagaagggagtacctaatttaatgcgtatgaacantcggcgggtccaatccatttgcattcatggcacct

SEQ ID NO: 29767 - DNA, 1153 bp, Oryza sativa
  unsure (1)..(1153): unsure at all n locations
tttgctcccagggatccgcagagaccaatgtgtccgggtgatgtcgatggaatgaataaggcgcccgtgctcaggtggggtgaaaacccacgcccacggctcccccaaaatcagcctgttgtcgtcgccgcccacgccaggagacgagatgccaacctgcgacgccgccattgcgccggcgagaggtattagctagttggtcgcgtcagcccgtatcatgttaggtcatacaactataattactccgtattatatacagagaatacttagcaaacgtgaaacatgccaaaatgtacgtgttcatcgaggagtgaaactcaaccatgctataattaattaggttcaaagcgattcgtagagaaccatatttgttccgtgttatcccggacgtagtcaatcatgttatcatcaggttcaataatacagcgacttctatagtagcccgaattttcttttttctccgtattacatacatgcctcaagtagtcaagtgcaccatcatatcgtatatcactcaaacttttctaaactgccgatcgcgcgacagcgacgacatcagcgggcgcaggccaatcgagttagcaacaagttcgcagaaaaaaccaaagcacatatatttcagatataaaatgggccagcttaaaatgtgccaacatgtgtcgatatgacgatatcccttcgagcatcacggtgctacccatcaaaaacaaactggatatatgtgtgacatagggcagcaaatcaaatcctgaatatatctagctaataaatccaaacaaactggattatatgtgtgacatagggcagcaaatcaaatcctgaatatatctagctaataaatccactgaacctatctaggtaaacttcctattgcctgcatagtatcaacctcaacctcctattatctgcataatgtcgactcctgggccaaagtactcttcacatcttcgatggcagttagctaccgtctgtataaagagaattccattagaaactatacaggaaatagggaaggaaatgtttaagtaaatggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttcattcaggnnatcaaaagcccaca

SEQ ID NO: 29768 - DNA, 705 bp, Oryza sativa
  unsure (1)..(705): unsure at all n locations
cgtgtggaatgattgnctgtcgtctcncttccangccngcaggtcgactctagaggatccccagtttgtacagctttgttttactccaggttttttttttgtttctgttcttcttaattttctcttcctccttgctcgtgaagacgcaattcatgaatgaatccgtgtcagctctctgatagttttatgtcatgtcatggcatgccctgatttagtgctgtatactgctacttcttcttctgagactagttcctcatgcacgtacgtacatacgtgagcttttcagacgtttgatgattgaaattggttgcgctaacttattatgcccattctgtacaaatctatcttgcacgtccatcctggcatcatattgattaatttactgccaaagagtacgtaaactctcgagtaacaataatgcaatcagctagcgtgcacatactggtcgaataatcctcttccatccttgcatcatcttgattaatcccggaacgtaggaattttataggattttcacagaaaacaggtcgatttctccaaaattcccgtgaaattcctccaaatcgaactagccttaaactttggttgtctatgtgcctatacccctcacaatctcacagcggagcactatccatgatctgatcactaatatataaggtgnnnnnnnnnnnnnnnnnnnnnnnnnnnnnnnnnnnnnnnnnnnnn

SEQ ID NO: 29769 - DNA, 1445 bp, Oryza sativa
  unsure (1)..(1445): unsure at all n locations
cgtgtgcattgtantacttgannnnnnnnnnnnnnnnnnnnnnnnnnnnnnnnnnnnnnnnnnnttgcaccttcatccacaagaaaagatgtttccagagccaagtgataggctgcaaagactccatattgcacaacatgcttcacttttttcagctcatcgccattagctcctttgagcaatatctacagattaggaatagttagcacatgaaattgacttcaattttattattcaattctttcgtaaagtactagagtaagtattaacgttgatcgtgaagcgctacactcttcaaggagcaaacatccacgccagggtaataccaaatgatattagttgtttgtgaaggaataggttcttaacaaatcatattgcacagaaattaatacatgatcacttgcaggttatttttcaatgtattgatttgattcaacctcaaccttcactgtatccttgaaatgcattgatttgttttttccccctttccattgttatatttcagctgaatactcatattagggtttagggaggaaaaaataaagtacggtatggtttaaaggaatgcttcacagactaaggattaaatagataaagcaaaggagctgcaacatatgacaaatggtaagtgttatacctgagatactgagttagcaactgaatacttactgtacaacccaagggctttggcaagccttcaaaaaacataagggtcttcagcattttctttccaccttctccagcagtcccatgctcttcaacatatttctccacatggaatagatcacaatgcccaagcttttgggatgacacgtaatcaattgacggaactatatgagcaccagtgcaacgtgatatcctttccagaagtggccttttgatattcagaacaagtgaaatgtttttctccaagaataaatcctgagcatatcgagacacagatttctctaccaacactacacttggttggtgggctttgatctttgcaactgccattttcaaataatctgtttcctggagcaaaaaggacatgacaacgcatcaccaatagcaacataacattcaatctataccgcccttaaaatgaacttcggctttacaacatatgcataaaaagatattaatggcaatacctgctgcagtaaagtatcaaaacttgaaagcaaattcgatatgcgctgatattcaagtgcaccaccaaggatcaggatgcgtggcttttctttccgtgacgccatgcgccgatgagcaacattcttcttacaaacaactccttttacaacaaaactggaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcncactggcaaatcaaagccaggcg

SEQ ID NO: 29770 - DNA, 851 bp, Oryza sativa
acggcggcctggcgaggctcttctcgcaggtgtccttgtagtccgtctgcgcgcacatcgccttgatgatcttgaacacgccgtgcaggctgggctgcgcgccgccacctgacgctgaaccggagaaggaagaggagccaccatcaccgaagctcgcgttgtagccgacggccgcgccgcccatgacgatgatgataagaatgaccgacgcggcgccggctgcaaccatgacgcgcctgcgctcttgcctctgcctctcgacatggcggcgctcagtgatcggatcgaagtccgagaaggtcgttgacatggccgacgaccttctcgccctgcctgaagaatgttttcggcgtcgccgccgccgctctctccctccctctgcccttaccacgatcggcaaaggcagagagagaggatcgagcgagagcgagagagtgaggggggagaagagcttgtttattcagaggattcaagggtggagagagattttagggagtcaggttaaatttgggagctggttcgttctcgtttccttgtcatgcaaaggcagcaacgcccgcgcgggagctcctgacgcggctgccgatttctcgcttcattcccagcaaaaacaacgtgactacacgggtgtgtttgcaagagcaagttcccaacactccccacgcgtacgtttttcaaactgctaaatggtacgttttttacaaaaagtttctatataaaagttgttttaaaaaaaatcatattgatccatttttaaataaaaactaacacttaattaatcatacgctaatggattgctccgtttcagtgcataggaggagtcgcatgtgccaattcaaatcaaaggcgca

SEQ ID NO: 29771 - DNA, 1351 bp, Oryza sativa
  unsure (1)..(1351): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacttataaaaaaaaaccagcacgtataactataagctgtagccttggacgtactctctctacatggtacgcgcatatctttggacatttcctgtcaagttcctatcgtccagatgatcgatgttccaatgatatatgcagtagcaatcagccaaaatataagtgtagtactgtagtgtaccaaactaatttcttccgttcctttttagggataatgcagaggaatcatttcattttcgtgtagcgaccaactgacgaccgtcgacatgattcctgatttctgcctatcatacttcaatcagaatgatttggttttactccaccgattcgatgtgacatatttttatgttttctagtatttcctccatttcaaaataaattatttttgaagttaaaattttgttctataaatataataagttaatttacatcattttacctacttaggatctataaatcaagaagtatatcattcaaaactctttacgtacctacccaacaatactatttttttaataagcgacactttggttattttctctccctactaaaattgccttagaatacaacatatgcttttatttttggatagcaggagtagtgcaacgtacaagaggatttttcctacaatagaagtagaggatttttattgtaaatctaaaaatttacaatagagcaaactcggtctcggtccttggtctttcagtaaattctaataatctaaaactggaattgcaatatccgaataatttgagtctcggtcatgaccaaaatttcataaagatcccaaaattaacatacaaatcaccaagaaactttagcggatctaaaaaaaatcatatccactatttgatcgttcgctgccatcggccaccgccagcgtggaggcggcatcgcaaattcatcgtcgctaccaccgttggagtggaggatgcaccatgacgacggtgcagcaggacggtggagcgggctcaacggccaggacctctagcggtgcggnnnnnnnnnnnnnnnnnnnnnnnnnnnnnnnnnnnngttgcttcaaacaatcaaacacacg

SEQ ID NO: 29772 - DNA, 785 bp, Oryza sativa
  unsure (1)..(785): unsure at all n locations
atagctcgagctcaaacgttccaacatccttgtgccggaggataagnaggagatgcacatcgacaagccgcctcctcgagcgcgagctttgcagcttccctgcattgaaggctgccaggtcaaggaaggatgggaagaaacggcggagttcgccaacgaagcacgacaatgtcggtgaagaagggcgaggtcaagatgctaccagatctattcgcgtggccatcctgttttccctcctccctttttctaacaccccctttcctccaggccaatggttgtagtcctggtagagaaagtggtgacggcgtggagaagccgggggtcgtctgtgtagcgtgaagggagaaaatgtcattgagggagctcgagacgacgtcgggttcatcgccaccttcgctacttcactgctaccgcagctgcctctgtgcaagcttcggctctgccaccctctccaagtgacgggggtgacggactggtagttggggaggcaatgctgctggcctccggtggttgtcgtcaagcatctcgaggcgctcgatgctggtggacgtcggaggcctgacacgacggtgacctcatggatcctgtctactccctccgtcccataatataagagattttgagtttttgcttacactgtttgaccactcgtcttatccaaaaaatattagaattattatttattttatttgacttactttattannnnnnnnnnnnnnnnnnnnnnnnnnnnnnnnnnnnnnnnnnnnnnnnnnnnnnnnatgtgtagtcaagtcaatgggcca

SEQ ID NO: 29773 - DNA, 9694 bp, Oryza sativa
gttaacaaacaaagtggtgggagtcgcacggagtccctttctgcatgttgcttcgacggccccacagtgttctcgaacgtcacgtcccgcgccatgaaccccttcccgttcacagctgcagaggaggtggatgcaatcatgcaatgtcaggcactactagtaattaacagtctgacatcattaattactgctgttaaaaatgcaatcaaatgattgaatcgagtgaatggtcagagggattgatgacttcatgcatgtgatctgcaactgttgcttgagtacatgccgtgcaggagagtgtgagacaggaaggtgaggtctcgtgacttgtttaggaaaacacaagggcccgcagatcataccgctactttagttgaaactacaagactttgttaacaacctcgtaaatgagggtgcaggtggctgatggaaccacgagttggatcattgttttggcacacaagttgctgacaagcagcgaaacaacgcggtttcatatatggcacccggatatgacgagacgaagtaaaaaagattagcagcatacggagtactacgcagcagctttgagaccagagccgaagatcatctgtgtcggtgatctatgtccactcctacctttattactctcatagctacagtactaatggatgcatttggcttgatagtactcctgtcacttgtcagttgtcagtcctggcggcaccagcaccaacatcactgtaccactaatccactatagggtcgtcgttgcaaagggaaactattaaacgaaatcccacaccgtgcacggtgcaccacatgcacgaattttgtggaccggaccagatgaaaaatgcaccgcagcatgtggcaagtggcattgacatgtagtagtaaaaacaaggaggactttgtagtttgggatagccggcccggcggcccaggcagatcgccgctggctcagctcagctagttcattgaattcgttgctggtgcacggcaaccactggggagttgcgttaatgcagcatgtgtgtatttaaggctgggaaggtggtaaaccggtcggacttgaatgtacttacgcggctaagatgaaaggaacagtacacccttcttcagttctactactacttctcggaggcttccgagttccgtctaccatagcaagtctggtagtacatccaaacatgaaacatgttggcacgttgctagcttgtccatgtttaatgccatgtgctctgctgcccttggggttttgggtacggtgtactcctatgtatctcgcccagcagagcaagatacggactggaccctacgttgtcacggccccacggagcacagttccaatgatggtatattgaccatcttacgtaagtactcccagtgacacgaccgtctcatcgtggttctgatgatgagctaatcctaggcatgagtcttagcttgcccaagcctcacgcatacaggtacaacgcgaggtgcaatgcagctactaaaactagcatgcatggcattgacccatgcacttgagagctcgttgatctatactcctataataagcacgcgacgacattacgatcgatcaaaccgtttaagtttaattaacctaactaattagcatacgtaatgaacttctagttcatgatcgaacaggatatgttggtgtaagctagtttggaggcgtggatgcactcaccgactgtggcgctgcggaaggtggtgtagccgtcgacgtagttccggtggccggagatgacggtcacgcccatgccgtcgccgaccagcatcaggttccacttcttcttcttgatgtccaccgtctccttgtacacgccctttttcacgtagatcacgtaccggctcgcgctctccgtcggcgccgcgtccacggccgcgctcaccgtcgtgtagttgccgctcccgtccttggcgaccacggcgtccaccggcatgccaccggggcccaacggcatctgcagcagccggcgttcccgggctcccagccagtgcggggcgccgccgccctcggcgaggccgcggcgggacgacgaccacgcgatcgaggcctcgccggcggccacctgggcgaggccgtccgtgaggagcgacgtgacggtctggagggcggtgccgacgagcgagccgagcacggagccggtgtcgtcgaggccctccttgcaggtgtcctggttgctcagcgcgccgcccagccacgaccggaggtcggagcgagcgtcaccggtgccgacgtgggacgacgtggcggcgccggcgttggtgggctggtaggacgacgacgacgtggtggacatcgaccaggacagctcgtcggaggacaggtcgagcaggtcgaggcagtcggcgatggcggaggagaggcggaggtcgccgccaccgaggatgccgccgatggggaacgacgagatgatggacgcgacgttcttgatcgcgtccagcgtctcgcgcagcgtggagacgagcaccggcgaaatgccggtcacccccttcgccgccgtcggaggcgcggccgccttccgcggcggcgatggcggggccatgggatgcgcattggcgaggaggaagacggtcagggagaggaggaggatgagctggggtatcgacctcgaacacatcgacgccatggcttgcacagttgcacttgctagcttagctagtgacaaagtgtagctgtacgtgtgctttgctttgggccgtggactgaagggtttatatacagagaagttgatcggtttcacatgacactctttttgaactcatgcactgacagtcataatcaggttcggggaaaattctgaggggggccgacacctttttgaataacacatttgtattttgaatggcttttcaaatttgataaaattcaaatagtaccggaacttttggcctgtaaaaagagtgtctcaggagggtcagggacatagagagatctccgggagactctgatctttagatgtgatagaagaaagtgatgcgtgatggcctctgcttctgtggtgtctatggtaggtactgtggagtaaagttggtaaccacagtttggtgcgtctcgctgctagatgggtcaggcaaggtcaagagtttggacaggaatgaaactcacaactcacaaaacatctgctttttcacgtgaggccgggcgtcggttgctggcactgcagctccgtccagtttgggacaaggaaatgaccggcattatacacagatccatcctagcttttgcaaacagcataccagtagaccagaactaatcaggacatattcttcgagaatctctgccgcagcaggcaggcatcctattgtgtgcgcatcagctaacacaaaggggtgtttttagatccagggtgtaaagttttagcgtgtcatatcgggtattatataaggtgtcgcatgtgatgtttaggcactaataaaaaactaattacatgatccgtcagtaaacaacgagatgaatttattaagcttaattaatccattattagtaaatatttactgcagcaccacattgtcaaatcatagagcaattagacttaaaagatttgtctcgcaaattagtcacaatctgtgcaattagttattttttaagtctatatttaatatttcatgcatgtgttcaaacgttcgatgtgacatggtgtaaaatttttgtgtgggaacgccaaagtgttctttcatacaaaagggttgtggctgccatgtgctacgagtcgatactaacgcgtttttgctctttctgaacgttctcatgttcgatcttagccatgaagcatcgaccgatcgagcaccgggccaagccagcgacgccgacgcggctcgttggacgcatatgcaaattatgcatacgtgatagctgcgttcttcgtgtaaagcacgggaagctcgctgcttttctgtggtacacgcgcctcgtgctcaggattctctccggcggtggacatggaccaactggagatcgatgctcctggctcaggctcacctcacagtttcagaatgcagctcattgtctccaagatgtttcattgtttcgtcagttattttcgtgtttatattggcgttagttgttttggaatacagtattcgtcaggtaaccaaacgaagatatatccaccagtgcaattagctacttcaactttgcattggaacacacatacgctgatccactcacatgagtgtgaattgaccaaattaaacatcagtaatgcacatcattgttcgagctggagtagattggatatagtacaagttgttcatgccagaccgacactcactctcacaaccaaaacactaaatggattaaatctgcttttcctggtagtcaaggcagtaatggcagcggcatggaataatcgattgaggcccatcgaaaggtgtcctttatccaagtcaggatcagcaagcctgtgtgccaccatgtgcttcaagtacttatgcaaaaagactttaaagcggagagcgcgctatcagagtctgttttcagtaaagcccagttgcttagagcatcccctggagctcagatcctccgaatacccttatagattatcatccaaaaaaattcatcatccatatcccttctagctccaacagatcatccatattacatcatcctatattttagtaatatcttccaactaatcttacatttgtattttaagggatatattttgaacgacttgattttaacggtgttatttattgcgataatattttgaaatgagtaaattttaatggatatatttttaatgggtagtttttaattaatatattaaaatgataacccaaggaattaacataactatattttctctcctcatttaactgcttcttctctaccttttatgccttctctgctagtactacttttctctgcagggtttgtagcggggcggtcgataggcggcggcgggcgtgcagctgaggggcggcggtggctaggcgggcgaggtgcagcggcggacgacgaccggataggcgactggcagtgaggatgcacgcggcggccgtggaggcgagcaactgggcaggcgagggccgcggatggccggagatgaggcagccgccgacagacgtgcgagaggcggaggacgcctatggtggccgcgtgcatcgcgacagcgcggcggaggagcagcggcatgggtggagtcccgatgggggcggcacagacggcggggcctcctcttcagcaaactccaacggcatactcggtatgtccatcctctccattccccacggtacagtctggatggtggcgcgagttcgtcagagggaggatagcgtgagaagagagaaacaccaaatttggcatggagagagctcggtttggatgacatctaaagatggcgtgtgtgatggagactttggtggaccttattttttcacctccatacgctaaatataggatggatggccggatggaagatctgctgggcatgttcttagtgccggcagaattctttttcgaacctttttaattttaatttaaaaacaaaccattccaaaactcatttctaaaatctgaatttttagcatgcgcaactcgcttagcgtgacaaaataacactgacacgccacccgcaacgggtatgtcagttttatcctaatacaccagctacaatgatgtaataagaccactaccatgccaactagaaacaacgtgattaatattgccacactagttagaccggcgtgacaatattgttttgacatgactaaaaacttcaaaattttatttaagtttttaaaaagtttattttgaaatttaaataaaaaatttcgtgctagcacacccctcgccgagtcgcatgacacattaatgatggaagtatacacacattttggcgcgattaaagcctaaatttattctaattgaaaacccatttgtttgggccgatctacttgtgatttattgcactcaccaaacctatcaagaggttaaaaaaaaagctaaagttacgaaaagtaactatattcgtttcatattataaatcgttttgatttttttaaagccaaatttcttcaagtttagaaccaaatttagaggaaaatataatactattttcaacgtaacaaagagactattaaaatatattcggtattagatttaataacataaaattgatattgtaaatggtactatgtttttttaaaatctgattaaacttttaagaactttgatttaaaaaaggttaaaaatctattataatatgaaacagatctggcacgtcatggagtatgtacgtgtacggtgcactgcagcttaccaccgacacgtgcgtacaggcacagccgcacaggcccctcgcggtagacggcggtaaacacgcggcgcatatggttcgacgccgacgcgacagtttgcatctctgcggcgcacagtggctcgtcccccgtgtccgtctagctcgtctgggccgacgtcgcgatcggaagggcgaggagagaagcaccgaaaaatcacgcgcccgcgcatgtgcgcgtcgtgcatgtgatgtgttgggtgagccaattaaaagctccccccacccaactgtaactgtaaactgcacaggcctacacggcctcctcctcggcctaccatgcgcagtgctgcggggcgccgagtactcaattccttgatttggaaagcctgcgcgccggggaaatgcaaatttcatgcttagctcatcattcagaacagagtctggacttcagaccagcttgcgaccaggggatggcagaacaatggttgttgccctctttgccgccgcgagactgagacggcattgcacctcgttgctacttgtagatacaccaagaggatctggcacctcgtctctgcatgggtgggctatcagcagatggacccaacggaatgggaggaagcccagtcagtcatacagtggtgggagaacattgcaaacacgcctagtgtcccgaaaaaaggacttcgatcgctcattctgttagtcgtctaggaaatttggaaagagagaaatcggcggatttttgatcacaaagaggtggcaacgaatttcctactaatgaaaatcaaagaggaggcgagcctttgggctttagcaggagctaagcggttgcgtgagttaatcccgcactctgtatagtgtacagctatagtggttcttcgttttccttttacccctaggggtttgtattttctcctgctcttagatgaaaaggcactctagtgctgttttccgttcatttttttttaaactgcacaggcgagcgtggccgccgactcgtactagtgattccattcgtgtggacggtgcatgatatgcgtgcagctgacgagcgggccaagccgctcgatcatctaccgctcgccgcgtgaaataaatcctgaccattaatgccatgttcggtcgcgcgcaccgcagcccagcgtcgagttgtcgagttgaccgagctaggttcggatgcatgcatcggttgagtatgcgcaccaaccaactttctttatgatttaggccacgttggtcgagaagatatatagtggaaacaccatctccagtgcaaacatagaaaccacacttggatggaaaatgtaggttccagataagtccacgtcaccccatgttgaaatgttcaggaaacaccccgcctagtgacaaactttagcatctcagccctcaaattgttcaacagcacaggaccccgattcaaaaggatccatccccaaacctaactctctacggtagcacaacggtggggacggcggcggcggcggtggcggcacggtggtggggtgggttggggcagcggcggcggtgacggcgtcgcggcagtggttggtagtagcgccgccgttccacgcgattcgcggcaacacgaatcaacccacatgctgttccggtgatgtcgagacatctacgaacaccggtgggaagaggcgagagcggggcggcggctcaccggcagagcggcgacgccgaggcccccgtgcacggcgctctaatgccgtgcacggctctggtgggaagagacgggcggcgggtggctcgccggcggagcggcgtcgctgaggcccccgcatgcgcggcaagctaatgccacgcacggcttaggcggcggtcaaaaccacggcgcaccggcggagcaaaatccgtgcaagctaacggcggtgggtcaccggtggagcggcgatgcggaggccccagtcggcggcgtgcttgatggcgacgtgcggcgacgctgatgccgcacgtcgtctcatcctcccgcctcggtcctcctcctaggtgcggccggagccacaccgaggcgagcctcgacctcacgcggcgatggactgatgcgagcgtgaggccggtccgagatggcggctaaggggatgcacggcgacgcgtgaagccatgcgccattcgcatgaagacagtgaggagctcggagacacacgcgcacggcggtgctcatgccacgcgcggcgagactccgacgacctgagccccaaatcggtgagtcccaattccttagggttttctcatgatttgggaaattgccaatcgggatcaatctaattcgagaattcatcatgctttgttcttaatttggggaaatttcagaaattagggtttcgggttttaggaacttggggaaaaaaattggggattttcttaatctcaaccccgatctgagtcccctccttccaattgctgcccaagccataaactgagtagggatagcaatctaaacataaaacttagtctaatatcgatcaacagaacatgaatcacaaaattgaacttaattgcgacatgaacaaaacctaacagaacataaaccctaaaactttaacaagccggcgcttagggagacttgatgcggcttagtggcttcaccaccggagtgatggaacatgcaaaggcctaagaaggctctgataccacaatattgtacttaaatcttaaattcataaacctaggctatgcatgatcacctaatatctcatatgcggaatttggtggtatactaaccggatgaagaagccattgatcgccttagatgcgttggtgtagtcgccgtgaggagccggtgatggagatcaccgtgcggtggcggcgatgggaattcgcccttcgctcccctccaatacgccttaagatcgatagtctgagggtaatcttaggggttttgggaaggcttagagtgtgtgagtagaccctcgtacccgtgagtcaaggttccctttatatgcgtattaaggggatcgggggcgatttcttcttgaggaaaaaaacgcttccgatcatagcgctagaaagagcgacgtgtattcgggaccgagggaatcggtccttaacgttaggtgcgcgtgggcttggggtgggccaagcccattagagcaattctctgactcgatggccagagatcaatctaacacaaacatacccataccacatggagtacaaatttacccctccaccaattctactgcactactaccgggtgcagtaggacagcatctccgttggatctaacccaataaatagctagtgtccactttaatgtactccaaaaatccccttcatatttaatactgaattactccatccgtttcaggttataagatggctactctaagtttgactaattttatagaaaaaaatagtaatatttacaacaccagtatagtttcattggggatcctctagagtcgacctgcaggcagcaagtgtagataacaaggaca

SEQ ID NO: 29774 - DNA, 11020 bp, Oryza sativa
  unsure (1)..(11020): unsure at all n locations
tgaattactacttgatggttggtgcattccaacgaaaaaaaatatgcatcaattgggcgccggtatatttatggattatggctcagttggtatattgacaagttcgggtaataaacgggagtaagtataattgtgcatcgatgagaagttcagttaaaaaaaatgggagtttcctttcaagaaaagcagtgcatcaatggttcacctgaacagtatatgtttcgtgatagaggtttgctccgatccggtccaacaaaaaaaatatctcgaaataccggtaccttatggtacctcgtttccgactgttagatttaacaattctcattctacccagctagatccaacgaccgaaaatgatttagtacaatgaggtaccagtatcttgagatactttttgccggaccggagcaaatctctttgtgataacccatctgagaatcatggacactttatgagaagcaagcatgtaatttgcaagaccttgttctgattgcttggtagttataatccctgacttttcatcaaatttctagcagcattatatttcttatgctgtaaaatcacggcgaacaatcaacatttcaatttcaagcccctacagatttatctcatatatttcctgctctaaaacctgatttgacaaaatatatttcacaacctgtgaaatcttgccccagtttttcctaattgcttgatggttcaagcaaaattttcataccatggattgcttgattcccacaagaactagcaagttatcactatccaaatatcgtaggatatcgatagttttgctaaatcttcatatcattcaactacgcctaaacgtgtggcgccattcaagaacgcctgaatatgtgcagcgtgtggcaccatgcacacaataattaaagtaactccaatatctctaacagcacaaaaatagctgctgcaacgagatccaattatagcatatcatcaaggaagaattataccacacttgaccccgtacatgaattgtaaaacctgcaacttactgtagcagtctagcagagatcatgtaaaaacaggtaaaaaccatatttgtggagcaatacgattgaggcaaatagaggtactcgtggttccatatttgacaatttgcaaaaaaaaaaaagaaaaaaaagaagcactatatgctcaattacacacgcttgggtcaatcttcggatgttgattcatttttgtgcagattaggcacaacccacacacagttcaatggctcaatgtgaccataaaatgatgggtagtacatcttgttatccatatcatagaacactggttttctatccacagaatatctagggaagtatatcctatttccatgaccaccatcgggagatcctacaccatgcgatgtcctgtgatcaagaaacaaggcaccaccaccaatgtcctctacttcaacccaggacatttttgtcaaatcaagtttgaacactcgaggcgcctcactggcattatgcaagagtacagatatcagttctccttctaaatcaaccaagtagcagaactctcttcccctatgatcattttgtaagagatccatctcaacatggatcggctctggcttgtcaagaatctcccaagtattgcttgttggatcaaaggcaccaaggttgcccttccttccgaggcagtagaacttcccacaaaacatgacggggttattgtaacctactgggaatggcacatcgtactcaaagcgttgctcgatccattcagtttcttcatgccgccacgtatgaatgttgagaaacttcccgctgagactactgttgatcccaaaaaaataacagtttggacacattggatttggtgaagaaaaggatacaccgttgtagtggtatctacgttcgaacataggaggctccacaatatcctcagtgaaaggatttatgatgaatatatcgtgaccatagatcccagctgatgtgaacacccaaccatctttggaggagcgaaaaatgtgtcgatcttcattagtgtcaaatattgagacttgcatgttgtacacctcaccgcgtagagggtcaaacaacctacacatcccatcttgcttagagatgtgcattagccaaggccaaacttttgcttgctctattggattcgacaccttgctccatgccatgcaaacagttggaaatcgtatgcggtctaccaaggataagtttgagacaattaactctagcaagtctactggtagatgttcccatagacataaagaattccccagtccatcgtgctcatcaaggtcattgagtagaatatcctttgacagctaaaaagaagaaaaaagaatagttttagttactactccgtatttactagtataaagggaattagtttttcactgcaacatacttgcacggatttacaaacctttgtcgatagaagactatttggcttgtctgatatttccatgggcaagattgattcgatgctgtagttgcatattaacaatagtcatactcatacatgattcagtaaaatgtggtctttttggaaaaaaaaaactattgcagacaatgctaaaaaatagtcgtgtgtgctgaatcaactcaccttgctggaacagtccaaaatgctctacaccagggttttgtaggttgagaaagaatctgttggaagctaatggtcatgtcgtccaagcagaacttataaagcctctcactgtcgcagcttgaccatacaagataaacacagtttccttgcaatacaccttctattgaaggacatgagaaagtgtaattttcagagataagaaaggtacggtcgctgccaatgctctccaccctctcccatgacatcaactcaagatccaagcaaaaaacatcaatggcggtgagcaatccatcgttcccaaagcacccgagctcttctatccacaagagaaacaactttccacatgactcgacaacatggtaacaaccacttccacgggcatatttttcttcatccttgatggtacccactcgctgtagttgtatcttaccatccaccatatctatcactacgagattagaacaagcagaacagatctttccttcgtagttgcacataaaagcagagagatggatgtcattgaacggggaaaccagtttggtccactcgtcttcaccggggcggcagtatagaaggtagctctcttcttccacctccggtgagctggcaattaagatggtgcacttcgggctatccggtgactcgagcatcttgattgttgatagaaaattcagaggctgatgcaacggcggcaactgaatcttggtccgtggattggtgctgatgcgtaggaggaagcaatcggcagtagactcgtgcagcatcagcagccagtcaccgtgcatgccgcccaagcacgtcttccctcgaacctcaggaacaacggtctcgtgcaggctgaggtctgacacatcgacgaaagtcagcgtgtcgccgcgtgatccctgcaccagccatggcctcgtgccgaagcccggcggcagcgagtggtcgtcggatttcgcggccatatgtgtttgtttttctggttttcttttactctccaggtgtattgatccttctgtcttggtggctgggttttgtgcagcagggaaccaagagatctagcaatcggctagtccctttcagtttcaggaatcagagtcgtggtgtcattgcgctttatacagcagggatttcgctcgatctggaaatagatttgattcagaaatcagagttggtttcgtccgtttgctgatcagaagcgtgtgctggccggaggctttgatcgggcgctgggacgtctgggagggacggcggctgacgtccccgtcgccgcctcagatcgcgaaggtctctcccgcgtcgctgccgccggattactgcctctgccgccagccttgagctgtctcgtttgggagtccgaattggagtagaattgtagcttttttttgtcggaatgaatcggagtccaatcaggatttgtgcacaaaatttgacttcttaattttaagtccggtaaatttgtatttgtccgatcagaattgtgctactcttttgcctagtaaactttgttactgcatctgaatccaatcagtaagttagtgcacaagttttggctggcttatctctactattatattactccctccgtttctaaatatttgataccgttgactttttaacacatatttcactgttcgtcttattcaaaaacttttgtgaaatatgtaaaactatatgtatacatataagtatatttaacaatgaatcaaatgataggaaaagaattaataattacttaaatttattgaataagacgaacggtcaaacatatttaaaaaagttaacggcgtcaaatatttagaaacggagagtataatagaaaaaatgcccctgagttgcaacgggtaaaaacgtttattatcctatacattatactcccttggttccttggttttggaccagatgctttcttggttttggaccgaacgctcattccttccctctgcttggtctacctctcttcggctcaacccataagtggagctataggcccagctcgaacagtctcgtacccataccattacggagctgatcctcccatcaaatccggtaatccgctcgagctcacatagtcccgtaccatgacggagccgatcctcccataaaatctggtaatccactcaatctcgcatagtcccgtgcccgtacgatgatggagccgatcctctccttcaaatccagttgaatctttctccatctccaaaattgttctcgcataacctgtgcacgtatgataatggagttgatcctctccatcaaatcaaaattgttgagagattttgatctaatcgatctcttttttccgttttttatcaaaattgaagcaatccacaaaactcgagataaaaaataatgacgatgaaatggagattcaattcggtgaattaaagccaaattgaaaggggaattcaaggggaaaataatgagtagtgaggaatcggtttttacaatgaattggaggaggaaacatatggggaggcaaataaaaaaatggtgaaagagaaaaggaaaaggaaaaaacggtgaaagaaaaaaaaaagagtaagaaacgcaaaaagaaaataaaatggacaaaaattataggggaatcggatctacggttttttttctgccacttcttaggagaatcatacttttttattttaggttgttttttcgctttttttttatttggacagatgaaggaaacatcttcaattttttaagtagtagagatagaggtagagataaaaattaaagatgtttttgttagaattttggtacgtcatccatgtttaaatcggttttaattttatattttcatccacgcgaattaattgggaacgtgtttgtcgcccgtaattaaaaaaaagggcgaacaaatccgattccgattccccgtaaaaagggtgaaaaaaccgtccataaaaaatgaaaaaaaaggtgaaaaaagtccaccaaaagaaaagtctgattcccctaaaacgatgaaaacaagtcgttcgtaaggaaaaaaaatcgggatttgtatgcaatgatttatataaaaagtaaaaaaaaaggcctaaaatacgtaaaaaggtttaaaaaaggcagtcgaaaaaaccaaaaaaatccgtgaaaaaagtccatccaaaaaataaaaagggcgaaaaaccaagaaaaataaaaaaaagaaaaaatgccttaaaaaaacaaaaagaacaaaacgttttcgtcgtaatctctactaatgattttaaaattaaatatgtttttaccagtattgtggtacgccatccgcgtttggatcggtttttaaagtttgttcgcttatagaaatattacatgcttgcaaattttatattgtgacataggaaaatgcttttcttgtctcgaaccccacatgctgttattctattaacgtaacacatggatatggcgcacctcctcctatttttagtcggataaattgtttgtatggatgtatggtatacataatctccaaggtgcgtctttgcgtgatggtactgctgccgcttgctggagatggattttagccagccagcgagcacaggcgctcgtgcgtacgagatgaaatcttacgctgacagatattctacacaaatcattactgatccatctgatatgggttttaatataagcctgactgtgagctgactttttttttgtcttgaggttgaattgcattggaatactgagaattgtgtggctcattaaaataatgtgatctattgacttcaggcataatgcatagatctatgatgacatcttttcctacattttcatataagattgaaaatctaggttgaaacaaatcgaagctcaaaacaataattgtgagatgcatggtacaaaattgacgccttccaattgacttaagggcctaatgtaaatgtttgcagagggatgatacacaaaatccttcctcctgtgaatttctctcgcagcttattttcttcatgggttcccttacattttcgtttaacaatcacattttgctcgcttagttgcatcccttacattactgtgttaatttttttttcatgtcaacaaccaaaggcgttcagcattagtactagcactggatccttcagccgattctacaccaagccatcggttattagctatcggcatgccaaaacacttgagattcgagcctgcgatcgtcgtcagcattcgagtctccaagtctccaacaaccgatcattcaacctatcggctaatcgctgatatatcaacatcttgtaggatcaaactaactggtatgcccgtacctcatcaaattaagatctacggtcctatactggagctaagtagatctcccaggcctcagtattggcacgattgacgcacatctgacataaaatatttatgttttccaaagcgcggttatattttcctaattttcccttcttaccataaaatattttacattttagaaggtcggtgcgtaagaatacaaaagtgaggaacgaatgatgagggacctatacaaattattagttacatcaatggcttttttttttttttgcaaaatgaccagagccgatgctccccacgtacgctcactcgcaaattccggctgcttgtggctttcggggtgacgtggatagcgcggcgaacgaacacacgactctgaattgttgtgggagcgccattcgcaaggaggctgtaatataactgtgctagatagctgttgtgctagatagtagatactccctccgtgctagtttgatcatctcctaactaaatgacaccaagatcaaggacactaaaattttcagcattctcaaattaatcctcatcagttatgatgcttcatcgcttcgtgtctcgtggactgctcatgttttaaatattgcaccaatgaaaagtaatcttgattggttgcataccacacattcaatgatgcacatttactcattgcacatttagatgatgttgtttttgggaaaacctcaaaaactttaggggatgatcaaaatgggatggagggattattattattgaacgttgcaatgtcccaaacttactgttttcttttgttaatatttcttccatccaaatcatgttgcataagatttaataaaaaacataagatagtatgaggttttatatgatatggtaggaaaaaaaattacaaaccacaaccctggaaggctatggtcaaggaaaaagaaaaccaagtcacaccacgcgcctacaacaaaagaccttactgactagcagacaagagtatgacatcctgaacacactcatctccattcacgtctttggattggagggagagaggtcgacagaaaaaggatctgctttcccccgcacagtgctgtggatgtggccaacttgtactggatacaagtgtcactgcaaaagtacaaagcgcatgtagaagagatttaggaggaaatgcaactttaaatcgacgcctccaaggaggtcaccacgccaaagatgccaccgcctttggtttttcaccgaaggattccactaaggaggggaggatgccacgaaaacgccaccaacggggaaacggtgttcgaaacattgttgttgtcgacatggaaaccaggccgagttttcgtccgaaagcacatcctaccctcacaacgcgtcgcatccccattgtctccgtcagccgccatcctttgaacaccttcgtcatgtgtccatcgtaccgacgccccaccgccaaccgaccagcacgagagccgtcacctcggctctcggttgtgtcgaagtttggcagcccaatgacctccggcgagccgaccatacatcgtcgtcaccatctccccgcacaccgccaaaggtagcaagctcacgcactcaactaccgcagctttgcctacgcctaaaccccaccgtcagctccttgtcaccacgacacctctggttgcgtggagctcgcgccaaagcctcgctgctcgcgtcatcgccaccacatgtggacagctcgcgccaacgttcgcgtacgggacgccagctggcccgcgctcaccagatccaacggatttggccatgggacgctagatccaccttgccgccacctccccacctccatctactaccgtctgggacgccactagttctcccttcgctgaatttggccacatgacgcctgatccacaccgttgtcgcttccctgcctcatgaccatctccatcacccccacaggaggtcacccagctgccgcctccatcaccacacctgtagttggccgtcgcccacagctgcctgcagccggctgtcgcctacatcgttggcgcgccgctcgctggcctcaccgaatctgatcgtggaggttaggatctgagcagcgcgaccaccaccatccaggttgccttggtgcccaaccatagctgcatcatagggggagaaggagccccctgccgccgtctttgttagcgtagatgagggaggaggccagcggcggtcggcttgcattatattttggaaaataattttagaatttaaaggggtatgatgcctggatttatactttaggtgtaaaccgaaccaccactatatagagaacaatttagactttgtacctcttattacttattctatactttgggtagtttgaatgtgctgtttgttttctggcatcttcatcgtttttcttttatcacgtttctaaactgtcaaacgatatgttccgtgcaaaaagtttttgtataaaagttacttaaaaaatcaaataaatacattctttaagtttattatagttaatactcaattaatcatacgccaacaacttgtctcgttttatacatcggtgataatctttaggggttatttggatgggactaaaaattgttagtccctgtcacatcgaatgtttggacactaattagaagtattaaacgtagattactgataaaacccattccataaccttgaactaattcgcgagacgaatctattgagcataattaatccatgattagcctatgtgatgctacaataaatatgtgttaattatagattaattaggcttaaaaaatcaaataaatacattctttaagtttattatagttaatactcaattaatcatatgccaacaacttgtctcgttttatacatcggtgataatctttaggagctatttggatgggactaaaaattgttagtccctgtcacatcgaatgtttggacactaattagaagtattaagcttagactattgataaaacccattccataaccttgaacgaattcgcgagacgaatctattgagcatcatttatccatgattagcctatgtgatgctacaataaatatgtgctaattatggattaattaggcttaaaaaaattgtcacatgaattagctctcatttatgtccaaacatccgatgtgacagggactaaagtttagtcctggatccaaacactcccttagcctacaacacattcaaatgaactaatgaaacatttttttcttacaaaaatcatctcaacctaacaaggctgaagatttttaggactaatatgcccctttcctcttcttctactactctacttgcctccacaatctatactatttataaagttacaacccactaattctaaagcttaacgtgcaaacatatcatctcatctactagcaatagttacatacaaaactcatccaagcatacaacaccatttacaattcattgaattatacaaatcaatatataatcatctaccttcatttttatgatacttactccctcaatcccagaatataagaagttttattgttggacacggttattaagaaagtaggtagaagtaaatggtggagggttgagattggataagtagcggaggtaggtgagaaaagtgaatggtggagggttgtgattggttgggaagagaatgttggtggagaagttgttatattttgggacaaatccgaagggctaagagttgttatattttgggacagagggagtgtcacgctcagaaattcccgaatagaattccaagcagaatgtgcattaaaatccccatccaggacaggccggggtacacaaacgacaaagttgatatacagatccacgtcttacaaacattataaaagtcttacataaatgcagcggaaaaacaaaagataactggagctaagccttgacttgatctgcagcgggaacaccactccacaggcatcctcgacggcacggacgaagcctactcctcggagaaatcaccatatgacgcatactcaaattctggggtttggggaaaatagagcaagactgagtactaaccactatactcagcaagtcataccggaaaaggggtatgatgcagggaattatcaagggatagctataacggttcatttgcataaaacgggcatttataaacagaaattcagagaagtaaaacagttgtaacaattaatcaatattaatcatnnnnnnnnnnnnnnnnnnnnnnnnnnnnnnnnnnnnnnnnnnngttnaacaaacaagnacccg

SEQ ID NO: 29775 - DNA, 772 bp, Oryza sativa
  unsure (1)..(772): unsure at all n locations
ttaacccacccatgtggaaaaagtttaacactaaagaggttgaagaaccagcccttaaaagagaaaattgttgaaagtagaaaccaacttaacatctctagcacccaagtaatgacgtggacctccaaaataaggataccagcatcacttaaaaatatgaccacaaaaagatagtgttaaatactctattgtgactatagtttacaagacaccgatggaagcatttaatctggctaccatttagttttttctttagggaaatatcgccgcagttaacctttaaattataggcagcacaaatcaagattagttaatttattcgatataccaccagtttgagctttattaaatttgtggtaaaagaacatgactcacacatgagctagtatttataagacacaacaggttgccagatattgaatatatattatatatgccacactgcagctgaaggtacctgactctgttctggagtctacaccctcgaatctggaaaaaaaggggaaaaatcaaacattaaacaggcagtatgtgccatattatcttgctacaaaattcatggtgcataaatattaacatacaacggtactagctgaataccagtgtcttgcaataatcaacaaatatatgttctaaactttaaagtcgtatatatttcttggaaaaaaaaacatatacaattcgcaatccaacatcaaccagaaattgaaannnnnnnnnnnnnnnnnnnnnnnnnnnnnnnnnnnnnnnnnnttngacaacaaagcacacg

SEQ ID NO: 29776 - DNA, 1504 bp, Oryza sativa
  unsure (1)..(1504): unsure at all n locations
aaccgctccngccgccgccggcgtcgcaggtgggtgttgggggtggtggtggcgcggcatcgccgcagccgcatgatttgtcgagggacttctggatgcgggaccagagctgccgcgtgtgctacgactgcgacgcgcagttcaccatcctgaaccggcgccaccactgccgccactgcggccgcgtgttctgtgcccggtgcacggccaactccgtgccgcgcgcgccgggggacgccgcgcgtgaggacggcgagcggatcagggtctgcaattactgcttcaggcgctggctggaggagaaggcggcggctcggagggacgtggcgcagccatcgagcccggtgctgagcccgtcggcgtctgccgtgagcatcgggagcgacaagtccagttcgactgcgcgtagcagcgccgggacgaacggccagatgtcgtcttacacgaatgttagctacactgacttcccatctatggcagtcgagggccagggtgagtgctgcgagagggaaggttgtgcagagaagcagctgcctgcaatggagccggctgggggcgtggagcctgcgacttatgtggacaacacatcggatccatacaattttggcataaataggtatgcctttatgagctttttgctttgctcaataagaaaatgaagcctaactagttgtactgccatctaggaagtaagatcacatatatgcatggttgtctgatattctgataggaacttgcattcagcttctgagaacattgctgcatatcatgttggattttgttaaaaggcattggacaaaaggtagctgctaatttgttcaaaatatttttgttttccttctggatgcttggacttgaaaatccatgtagttgcgctttgatattttatattggagagcttgcccgctgacattgcttttgatacatgcgcacaaatgctatctcaaacttagagtatactcgttgctttcatttggtgttcattatagggtgccatcaaattagtctcaaatctatgccttatggtgctcatttatgtttgttcatggtagtgtaatataagcaattaaaattaagcataggttatgggctggctggtggttagccaacaagtgtgattggaactagttacacgattttgctcttaatcatcagcattgaaacagttgtctggaaggtgcagacgggaaagtatggtcacatgctattttccatttttcaatactccaattgtgtggtactacctccatttcaggttataagactttctagcattgcccacattaatatagatgtgaatgaatctaggcacacatatatttttagattcattaatatattttttgaatgggggcaatgctataaagttttttaacatgaaatggaggaagttttctttttttaattcatagcataaaggattactcagctttttttagaaggcttagtgccttattacttttaattgcaaatcgttaactcaatatggtgaaattacgttttg

SEQ ID NO: 29777 - DNA, 4230 bp, Oryza sativa
  unsure (1)..(4230): unsure at all n locations
ngaacttggaaaacattcttatggactactttgctcatttctataagaaggcagaaagataagcattggctgttgcatcctcaggaattgcatccntgctgcttccaggtggacgcacacctcattcgcgttccanaatcccttggagattttccaaaattcaatgtgcagtataaagaaaaatccaattcttggtgaattgatccaaaaacatccctcattatttggaatgagtctcctgttaatcataagtactgctttaaagcattagaccggactctacgggatatattatctgataccagcccacattcaacacacaagcaatttggtggtataacagtagttcttggtgaaaattttcgccaaacacttccaggtcatccaaaatgcaacaaagcaaaagattttgaaatcttgcattgttaattcttatttatgaaatcagtgcatactacttcatttaactgaaaatatgagacttaactctgcatgtctttctgcatcgaaaaaagaagacctcaaaaattttgctgaatggcttttgagagtaggcaatggtgcagaaccttatgttgatgtcccagaccaaccaaagggcatgtttatagagatccctcagtctctccttctatctccagattgtaggaatttggatgggttgatttcttttgtgtacgactcaggttgtcaaacaacagatcttagatcgtacttatgcgagcgtgcaattttagcacctacaaatgatgtagtttcagaaataaacaacaaaatgattgctcagctagcaaccactgaaatgtcatactatagctcagattcaattgatgatagctgttccaaccataccactttagaggcactatatccaacagagtttctaaacacaatttcaataaatggacttctagaacatgtgttacacttgaaaattggtgtgcctataatgctcttgcgtaatcttgatgcatcaagaggactttgcaatggaactaggctgattgtcacacagctaacaaatcgtgttattgagggagagataatcacaggaaaggcaaaaggtacaaaagcatatattcctcgcatcattacaacatcagctcagtccaagtggcccttcaaattgagacgccggcaattccaatacgtctttcatatgctatgacaataaacaagagccaagggcagaccttgagcagagttggtctgtatttgccttctcctgttttctcccatggtcaattatatgttgcattctcaagagttacttcccccaagggtttgaaagttctaatagaaaatagccctgcttcttatgaaaactgcacacaaaatgtggtatatgctgaggtattcagccaaatatctagacacaggaactaaatatctaggtatattgtgcatgccctatcttatacaatgttttgtttcattctacttttatctacatattctgctcaataaaaataataacttagttatctaatattatttgttattgtttcagatttatttcgatggcaagctcagctacagcactcaaagatgtaactattggccagcaaaactgcaaggtttttggccgtctaataagattatgggatgctctaaacatgagatcaaaatcagcagatccattgatcagcattgatggaatcctattagatgaacatgtgtgtcaatctcttttgtcttacaccaaatattaaccattcatttacatttcgttggtctactcaatattaaccataacaatcttatgcatcacaatcttgcagggttccatggcacaaatcagtgtaccaaaaaagcttgaaaaacaatttcgccccttgctaaatgaaggatcagtctacctgattactaatactactgctgttgatgctagaagaaagacttatatctatcagcaccaaagctacatgatccagttcaaacacgaaacaaaagtgaatcatctggaatctagaggatcaaccataccaaaattctctttcagcttttgcccatttgatcaaattccaggaaaaaccatcacctctaaacccctcttaggtaatccttgctttttaatttacccctaaacacttcctattatacttgacattcttttaactttttccttcagatttaattggggtagtcagccgtattggtccatatgatttcgcgagcccaacatcagacaaaaaactcagaagaattcaaattcagaaccaagagtatatgtctttttcaaacattaaactgataattcaatatttcactaattgtttttatgctctacctttgtagagaacagactcaagaagtacttctatggggacaatacggagaatcatttaatgaagctgtaacacttgaaaaatcaaaggaaggaattgtagtagtcatctttgctggtcttactgcaggcaattttgcaggttcattccatgaaaagaatatgcctcctcacataacatacctacaaaatttaaacttatcatttaccacatacaattgtaggtaaaacagaagcatcttcaagctccgctactcaaattcatattgacctcgatataccacaggtggaacaatttcgctccaggtaatttcaatttaatcccttaaaactacttaaagttcaagtttcctgttcaatagttttctttttcgtatcaattatgatgccaacctatattgttgcaattttaagctataaactgggatctccaagccttcaacaacagctccctaagattgtacgtttatccccagttcaagcagcaggaaaaatttacaacttagaagaaatatctgttatgcctgtttcagcttttcaggtaaaactgaacacataaacaaccatctatattcttattggaattccatatttttcttcagacaacatataactcttataattttcttcacttaagggaggagttacttatagtgcaattgcaaaagtgtcttcaatactgtcatcaattaagtggtactacataggatgtcatcgttgtgacaaagggtacaacaatagttctgactccccaagatgtgactgtgcggtttcattccccaaaccaatgtcagcttctcaccttacattccaacaattaaaaataatatgatataaataacatatatgccactgactattttacaatgctttaggtataaactccccgtgacaatcacagataaatcagggagtttagatgcagtggcattttcttttgttgctgaagatttagttgagcttgatgcagcccaagcttctcagaacatgaagatagactcagttgaacatccagtaactcttaataaagccattggaaaaacaagactttttactataggaatgaatactgattcatcttctaagttccctatcagctatgtgctcaaaaggagtttctcaattgatgatactatgccaaatcctctgctgacatctgaaaaggttagtaaatatcatctgaagatgctatttatcattggttcaatatttcaactgaattagcttgaactatctaactaattcagttctccaagaacaaagatcaactccaactcccacggtcccaccacctatgacatatacaagtagcccaatgtttactgttctctcaattttttctattcatcatatccatataaaactatacttactaactgctaatggcaaattcatttcagcacaactattgataatacaggattatccaaagatagtacacctccagaatcatctgcagctgtcaacatatccacagaaaagaacatgtcagaattacatattctaactacttaattaaatacatgcatttattcattaaatctattatatatttcagcagcacatctacaaaacgaagcattgatttcagtgaggactccactgacaaaactaaaaggtatacctctactgcacatagctcatttagttatttaaatttctcagttacagtttatcccttgcaataattttcttcttcatggcagtatcaaacaacttgatatacctgctgtcaaacgtcagaaggaagagtacgtacttctaacccaccttccaaattgcaaagttaaactataatgctaattccaatttcttatgaaccatttcaaacagcaaaaagctccaaccagcaannnnnnnnnnnnnnnnnnnnnnnnnnnnnnnnnnnnnnnnnnnnnnnnnnnnnnnnnnnnnnnnnnnnnnnnnnnnnntgcaaggggccc

SEQ ID NO: 29778 - DNA, 747 bp, Oryza sativa
  unsure (1)..(747): unsure at all n locations
cgtgccttgatggtttgtataacnnnnnnnnnnnnnnnnnnnnnnnnnnnnnnnnnnnnnnnnnaagaagatgtgataagagagttaatttgagtggtaatgaagagaggttaatcatggagtagtagaaaggggttgatcagaatattgggtcagtattttttgtttctattttttgcgtgttgtaatcctagaagggatatgcaacttgttgttagatctgtgtgtttgtttgttatacacgtacgatccgatatggttgattaattatattctggaaggttgcatgcaagaaagttaagtggagaacaataagagattctgtgtgcttgactgcttgttgctgtgtgattcgttaggtttcagttgtgtccaacgtgtaggttctccctggtaacactagtggttaaaaagggtgcccaatttgatgcctccctatggaattggggaacaaaggatggacaattctgcggcatccaaacaacttgatgggaagaatcaatgtgcaggcgaaaatgggtttctttttcaaatagtacaaactacaaaatgtgagccgaatttcacatatatgcgttcgtggaaatgaattcttcctaatgttggaagaaactctaaccaccattaggcccctttgtatatttcattaaatacctatacatcgagactccgcccaacatttttagcggtgtgcatagtaagatgaattggggaacaaggatcgttgacaattcgtggcatattcaa

SEQ ID NO: 29779 - DNA, 6720 bp, Oryza sativa
  unsure (1)..(6720): unsure at all n locations
gcgtgccttgttgatataacnnnnnnnnnnnnnnnnnnnnnnnnnnnnnnnnnnnnnnnnnctccgtatgctgctaatcttttttacttcgtctcgtcatatccgggtgccatatatgaaaccgcgttgtttcgctgcttgtcagcaacttgtgtgccaaaacaatgatccaactcgtggttccatcagccacctgcaccctcatttacgaggttgttaacaaagtcttgtagtttcaactaaagtagcggtatgatctgcgggcccttgtgttttcctaaacaagtcacgagacctcacctccctgtctcacactctcctgcacggcatgtactcaagcaacagttgcagatcacatgcatgaagtcatcaatccctctgaccattcactcgattcaatcatttgattgcatttttaacagcagtaattaatgatgtcagactgttaattactagtagtgcctgacattgcatgattgcatccacctcctctgcagctgtgaacgggaaggggttcatggcgcgggacgtgacgttcgagaacacggcggggccgtcgaagcaccaggcggtggcgctccggtgcgactccgacctctccgtcttctaccgctgcgggttcgagggctaccaggacacgctgtacgcgcactcgctccgccagttctaccgcgactgccgcgtctccggcaccgtcgacttcgtcttcggcaacgccgccgccgtgttccagaactgcaccctcgccgcgcgcctcccgctccccgaccagaagaactccgtcaccgcgcagggccgcctcgacggcaacatgaccaccggcttcgccttccagttctgcaacgtcaccgccgacgacgacctccagcgcgcgctcgccggcggcggcaaccagagctccgccgcggcggtgacgcagacgtacctcggccggccgtggaagcagtactccagggtggtgttcatgcagtcgtacatcggcgccgtggtgcgccccgaggggtggctggcgtgggacggacagttcgcgctcgacacgctctactacggcgagtacatgaacaccgggcccggcgccggcgtcggcggcagggtcaagtggccggggttccacgtcatgacgagccccgcccaggccggcaacttcaccgtcgctcagttcatcgagggcaacatgtggctgccgccaaccggcgtcaagtacaccgccggcctcacgtcttgatcaccaattcaccatcgagtacgtgcttcttgtgtgcgacagtagtacagcacatgatcatactacactttacactacgttggagggaggtttaattaaggatctggtgtataaaatctttaggaattatggcattctgggagctatttagctgtttaattggtggttaatggaacaagtttgccttttgtttttgttccatgcttctctggtggtggtgctctgtttttggcacaacgaatggttgaaatgtgcatgcacggcgcacaagtaaaaatcacacagaatgtacatgaaacaggcaggtatcagatattcacattggaccgtcttctctcgaaagcatatgtacatggcgcacgcatgcaggtgcccgggtgtctgcacaaatatttttcacgcccacatgccgtactttaccggcgtgccggtcggcttgatccatggctcggcgtgcaagaagttctgcacggtgaacttggtggcctccttcttgctgatcaccttcttgtaccccggccagctgacgcggccggcggtggcggcgccggcgcccttgttcccgtactccgcgtaccagagcgtcttgagcccgaagtcgccgctccacgggaggtagccggccttgtctacgaaggcggggatgtcggagttcatgatgagcgtgcgcgagtactcgcgccacgggcgtgcgaggtagctgcggacggcggggcgggaggcgtcgccgagcgccgactcggcggcgaagcggtagtgctggagcacgaagccggtggcctcgcggcggtcggcgcggccctgcgccgtggcgatgttctgctggttgtcgagcgggcggcggagcacgatgacgcagttctggaacaccgccgcggcgtcgccgaagatgaagtcgacggtgccggagatgacgcagttgcggtagaactgcgccttggagtgcgcgtagagcgtgtcctggtgcccctccatgcggcagttgaggaagatggacttgtccgactgcaccagcagcgccaccgcctggtgcttcgccgcgcgggccgtgttccggaaacccagcgcgacgcccatgaacccgtcgccctgcgcgtctacgtacatgcacgcgtcagcctgtgcaggccatgtaaatcgatggagaagctagcgtgcaatgcgtgttctggctcttactgaaggtcgccgtcttgtaggtggtgaggccgtcgacgaagttccggttgccggtgatgatggtcttcttggcgccgtcgccgtacatggtcacgttcgccatcttcttggtgatcgtcacgtactcctcgtacaccccttccttcacgtagatcacgtacctgaagaacacgattcatgcccaaagctttggttagtagtactagaattgatgagagatgttgaacattcaggtcgatcgtgcaggcgcattcaccttccggtgtacttcttgggcatggcggcgagcgcgtcgttgatggtcttgaacttgccgctgccgtccttggccacgacgacgttgggcttgagcttgttctggaacttggccttgagcagcctcctctcctgccggttcacccagaccaggacgtcgtcgtcgttccctttgggctgctttggggcgttctcgtcgaaggcgaagctgagaagtcgccggaggctgttcccggacgaacggttcacttcgggctgcttcgtggcgtcctcatcgaaggcgaagctgagaagccgccggaggctgttcccggacgaacggttcacttcgggctgctttgtgacgtcctcatcgaaggcgaagctgagaagccgccggtggctggccgccgaagacgctgggaggtggagcgcggcgaggaacgaggacgccttcccgatgagggccagcgcgttgctcgtcagctccttgccggactccatggcgtccctcatcttgtccttaaggtcgccgtcggggaagccgtcgatgcacgtctcctggtgcgcgatcaccgcgctcagccacacgcggagctggtacccgcccttggtgagcccgtccacgccgccggcgtcgatgcctgcgagagtgcggtcgaggtcgtccttcgcgttctcgtagatctccttgcaatccgcgacggcggccttgacccgcgggtcgtcgctgacgatcacgctcgacttgtcgaacgccttctcgatggcgtcgccgatcacggccacggaggcgcgcacgacgtccttgggcgacgacgacgacgacgacgcgctggcgttcgcggcggccttggcaaggctcttctcgcaggtgtccttgtagtccgtctgcgcgcacatcgccttgatgatcttggacacgccgtgcaggctgggctgcgcgccgccacctgacgctgaaccggaggaggaagaggagccaccatcaccgaagctcgcgttgtaggcgacggccgcgccgcccatgacgatgatgataagaatgaccgacgcggcgccggctgcaaccatgacgcgcctgcgctcttgcctctgcctctcgacatggcggcgctcagtgatcggatcgaagtccgagaaggtcgttgacatggccgacgaccttctcgccctgcctgaagaatgttttcggcgtcgccgccgccgctctctccctccctctgcccttaccacgatcggcaaaggcagagagagaggatcgagcgagagcgagagagtgaggggggagaagagcttgtttattcagaggattcaagggtggagagagattttagggagtcaggttaaatttgggagctggttcgttctcgtttccttgtcatgcaaaggcagcaacgcccgcgcgggagctcctgacgcggctgccgatttctcgcttcattcccagcaaaaacaacgtgactacacgggtgtgtttgcaagagcaagttcccaacactccccacgcgtacgtttttcaaactgctaaatggtacgttttttacaaaaagtttctatataaaagttgttttaaaaaaaatcatattgatccatttttaaataaaaactaacacttaattaatcatacgctaatggattgctccgttttccgtgcataggagatgggttcccagcacccacctccgaacacagccgtacgtgagcactgagcagtttgattccggcgaagtagaccgtttcaagttgtaatgggccgttgagcccgtggtgtgtgtcaactttgtttcctcgttgggcctggtggttcgtttacggcttatctgttgttgccttgttggagacgagatgtgttggcgtgtgcgctttctctcccacctttcggcttttcacggattccaggcctttcgttgaggaggacattgtagatttgtagactgtagtctttcttttttttgttcaaccacgttgaccaagcatggtttgtatcggtataaagtggcaaacacgcgtacttgagccaagaaaaacatgcaattagaccttttccggtggcacaagcacagtgacaaaaacccaagtggcaaccaagatttacaattccgagatggccttccgttttaggttctgacagaatgatggttttcgtgaaatccggtgaaaagccgatagattccgaacaaatttcataaacaaaaatttgaatacaaattccctgagtttaccgataagcttgcgaaaacatgtcggctttggcaaaattccgagcgaaatcatcgaaatttcaatccgtaactagaaaaagaggtaaactaagggtgtgtttgaggagaaggggattgaggagattgagaagatacgcaaaacgaggggagccattagctcatgattaattgagtattaactattttaaatttcaaaaatggactaatatgattttttaaaacaactttcctatataaatcttttacaaaaaatgcatcgtttagtagtttgggaagcgtgcgcgcggataacgaaacaaactcactcactatctcaccctctcaaacgcagcctaaaattgttttcctttttttaattcgctattcttttctttcttactgtaaattttagtaaatacatggaatacatcgtttttttgaaaatttatatcccaataggttctatgaatatcataatatttataagattttatttgattttttgcttttttcttaattcaaatttaaatttggatgaaactcatcgaaatctcatacggtttctactttcgagcctcatcaaaacctcgaaatttcgtggaatttgaccggtttttgtcggaattttgtataccctggtggcaacagtgccattgacagagaattatactcctctctgtgttgatttacgtaattttaaggagtcaggttgattaaagttagtcaaactatggttatatactaaagactactttatacagctataaatattggattttaagatttaattaaacttttaatactttaaatattaatttaatattaaaacaaatttataatctaacaagtttttatatcacgatggtccttgaattaagtataaacatgtatttcagcacatacacatagactcctttcagtagagtatatctctattaattgctctaatgtaatccaacatagtcgttatcggcacatcgagtattaatttctcgagttaaaattccacatccataatttcccgtcacgctacaacacaaatactttccacgctgagtcaaataaataccatattatataaatgttacaagtcatataaaaaaagaaaattgatatgcatacgatctaactgtccgactcacatacgattgaatttaatcaacacatataaaaggatgtagtccatgtaaacatgctctcattggattgatttatggttggatgtttcttgtacatgagcgtatagcagtacttataaaaaaaaaccagcacgtataactataagctgtagccttggacgtactctctctacatggtacgcgcatatctttggacatttcctgtcaagttcctatcgtccagatgatcgatgttccaatgatatatgcagtagcaatcagccaaaatataagtgtagtactgtagtgtaccaaactaatttcttccgttcctttttagggataatgcagaggaatcatttcattttcgtgtagcgaccaactgacgaccgtcgacatgattcctgatttctgcctatcatacttcaatcagaatgatttggttttactccaccgattcgatgtgacatatttttatgttttctagtatttcctccatttcaaaataaattatttttgaagttaaattttgttctataaatataataagttaatttacatcatttacctacttaggatctataaatcaaaaagtatatcattcaaaactcttaccgtacttacccaccaatattattttttaaataagcgacccttggttatttcctccccctaccaaaaattcctttagattccgccgtataatgcgtcaccnngctggaantgcgcgcatatcaccatgcggttacacaaacatctc

SEQ ID NO: 29780 - DNA, 1427 bp, Oryza sativa
  unsure (1)..(1427): unsure at all n locations
aatccttttatatttatttaaatatacttnctctatatatttatataatttntcttacantctactttntgtattttttctcatcncccccccccccccgcgtttttgttgatttgactaacacnagacagccngcacgtcgactctagaggatccccttgatgaaaagtcagggattataactaccaagcaatcagaacaaggtcttgcaaattacatgcttgcttctcataaagtgtccatgattctcagatgggttatcacaaagagatttgctccggtccggcaaaaagtatctcaagatactggtacctcattgtactaaatcattttcggtcgttggatctagctgggtagaatgagaattgttaaatctaacagtcggaaacgaggtaccataaggtaccggtatttcgagatattttttttgttggaccggatcggagcaaacctctatcacgaaacatatactgttcaggtgaaccattgatgcactgcttttcttgaaaggaaactcccattttttttaactgaacttctcatcgatgcacaattatacttactcccgtttattacccgaacttgtcaatataccaactgagccataatccataaatataccggcgcccaattgatgcatatttttctccgttgcaatgcaccaacatccaagtagtaattcagtattccttgcagaaaaaatagtactccctctgtttcaggttataaaacgttttgactttagtccaagtcaaactactctaagtttgactaattttataaaaaaaaatataatatttttaacccaagataaatatattatgaacatttatttttattcaattatagatttaatgaaactatactggtgttgtaaatattactatttttttctataaaattagtcaaacttagagtagccatcttataacctgaaacggatggagtaattcagtattaaatatgaaggggatttttggagtacattaaagtggacactagctatttattgggttagatccaacggagatgctgtcctactgcacccggtagtagtgcagtagaattggtggaggggtaaatttgtactccatgtggtatgggtatgtttgtgttagattgatctctggccatcgagtcagagaattgctctaatgggcttggcccaccccaagcccacgcgcacctaacgttaaggaccgattcccttggtcccgaatacacgtcgctctttctagcgctatgatcggaagcgtttttttcctcaagaagaaatcgcccccgatccccttaatacgcatataaagggaacccttgactcacgggtacgagggtctacttacacactctaagcctttccaaaacccctaagaataccctcagactatcgatcttaaggcgtatttgaggggagcgaanggcgaatt

SEQ ID NO: 29781 - DNA, 976 bp, Oryza sativa
  unsure (1)..(976): unsure at all n locations
nagaacattgtacaaaaagctggcgtagtggaatggtaaagcccattgagctgcatcctttatagcatttgaccattcttggtcatcacaaagaagacctaatgcttcacatgctgctcaaaatgtaggatattcaacacgtgatacagttctgattcaagcaaaggatcttgggcccctaacaatgtgcagtagcttctgtaggtagtaagcttctccttgtgaagggctgacatgagcaatgcggccaattctgcgagaagcaccacgacggccatcccaatatttttctttattgtgccatgtccaatattcaggaaattctatatatgttagttgtcgggctgaagggttctccatattggcttctaaccatgcagtcagctttgatttagagttgtttggatcatcaatgacctcttcaagatcatcatcttctgtgaaaacaacattattcttgaagggaagatgtacagggaggcgttctatagagggatctgtgtggtgaatgtcaaattgctgcaatcgccaagcagcatcatttggagtgacacaacggcattccaaataattatttatttcatttatagtttcacttgatgattctgagtttgatgaattagagtggaatccaactcttgagcaatcaaatccttttgtaacatacttgaaaagatatttatgcataccatcataattaactttttccacatttatgtgagcctgaaatttgacaactaagtcgacattatgaggaaccacaaatctgttgtcaatttctacctcatttcttttaaaagttattccattgtttggccgtgcatactgtgtaaaaccattttctaatatagtagtttcctcacagaattctttggggtagaatttggtgcattttccttcagacannnnnnnnnnnnnnnnnnnnnnnnnnnnnnnnnnnnnnnnnnnnnatcaaaanccaannnncggcccatca

SEQ ID NO: 29782 - DNA, 755 bp, Oryza sativa
  unsure (1)..(755): unsure at all n locations
ccaggcattgatgatcgaactnctnnnnnnnnnnnnnnnnnnnnnnnnnnnnnnnnnnnntttctgttgttgatgtggtggtttgttttttctttttcttgtcactggtctcggtttttacttttacttattaaaatataattggtagttcccttccggtttattatattatgggacggatggagtagtaaaagcaatttgttgtaaaaacttgtccgcaccaacagtagatggatgtatttgcagaaatggaactttactctttgccacggtcacttgcttcgagattaatagctcacttgttaacaacttatcataaataggttccgtttcattagcatacttttcaaactgctaaacggtatatttagtgaaaaaattcctatatgattttttttaaaaatcaaataaatccatttttcaagtttaaaataactaaaactaaattaattatgcgctaataagtttctcgttttgtgtgtcagtacttgatagtcttcgaacggggccatatacgttataagcccataaatattaccaaaantaaaaattataccttcatctgatctccggtatctgaggggagttcagaggaagggtggtaattgatcggattaaacgtacgtaacatggggacttgggtggctcgtatggatttgaatatacgatagatattttttcggtgaggacagagagtgacaagctcaaagaaatcgctaggtgggcccacctatatgttaatggatcgatcggat

SEQ ID NO: 29783 - DNA, 901 bp, Oryza sativa
  unsure (1)..(901): unsure at all n locations
cgcggccttgatgaatcaactnctnnnnnnnnnnnnnnnnnnnnnnnnnnnnnnnnnnnntttccatttttcaccattatattaccatttattcaaacctcaccgtgcaatcacgtaagtttccatacaagatattatttccaatttcatgagcatttaatgtttctatttttgaaatgcacacacaattatggaaattctctcatccgcactgcatgcatgcatataaatgtattaattcatttttttaatctattcaaatatatggaatccattcactattaaatcccgcactctaaacaggtctatacccattaagctcatacactcaaatgatcaaactgaccagctacatccaacggatctcaactttggagcccatactccatggagtcccattcggacgtcctatatatatagtcgctaaatagtcatttcggactgcaaggtgccgagctataagagcaagttcaatagtatagcccactactagctccaattcatctatagtcaatctaatagccaattcatacaatagttgcttactatactttaatatatggtcccacctgtcatatacatattgcgtcttgaagcccgtgctgcagctggctacaaatctgtagcccgctgctcttctctctcatcggttatctcattaaaatatatttatagctggctaatagcctgctattgtacctgctctaagatgtgactgcgagagccaatagggagaagggagagatgcatggcgagctgctgattattaggcgcgacaacagcggcttgttatatggacacagcccacaagatagatgattgcttagctcactttcctattattagcttatctttaaaggcaacatatgttatattttattgatttgctataaagctgctn

SEQ ID NO: 29784 - DNA, 719 bp, Oryza sativa
  unsure (1)..(719): unsure at all n locations
cactgttattagttgtcnaactnnnnnnnnnnnnnnnnnnnnnnnnnnnnnnnnnnnnnnnnaacactacacttggttggtgggctttgatctttgcaactgccattttcaaataatctgcttcctggagcaaaaaggacatgacaacgcatcaccaatagcaacataacattcaatctataccgcccttaaaatgaacttcggctttacaacatatgcataaaaagatattaatggcaatacctgctgcagtaaagtatcaaaacttgaaagcaaattcgatatgcgctgatattcaagtgcaccaccaaggatcaggatgcgtggcttttctttccgtgacgccatgcgccgatgagcaacattctttttacaaacaactccttttacaacaaaactggaaataaagaaccaaaatgaagctcttacatggagcactaataagatacgaaaaagtaataaagtgtgaaatttcaaaggccaataacttgataaaacaaaaattgccagcaagtttgcatcatgaatttgaattacaaaaagctgagtcactgtcggattcatatttttttaactattaggaaaatgaatactccaaagcggaccagtataaaatcattaaagtttgaccataatctgcagaagggtaaattttgtttacctatcacttggacgaccacaagccaagcattttacctttacatagccaccagggccct

SEQ ID NO: 29785 - DNA, 5052 bp, Oryza sativa
  unsure (1)..(5052): unsure at all n locations
tccgaatgggactccatggagtatgggctccaaagttgagatccgttgaatgtagctggtcagtttgatcatttgagtgtatgagcttaatgggtatagacctgtttagagtgcgggatttaatagtgaatggattccatatatttgaatagattaaaaaaatgaattaatacatttatatgcatgcatgcagtgcggatgagagaatttccataattgtgtgtgcatttcaaaaatagaaacattaaatgctcatgaaattggaaataatatcttgtatggaaacttacgtgattgcacggtgaggtttgaataaatggtaatataatggtgaaaaatggaaactaagtatatggagaaatggactttttttaaaaaaaaaactaggtatgtaatactaaatactgatcattcgtatttggaaacatggaaactaattatttggaaatatatttggaaacatggatactatatattgcagcgcatttatatggtaatgtaactgtacctaatcattacattcatgacaccattaatttagctatttgagtcacaaaatatttaagtttagggtttagagtttagggtttaaggtttccggttgcctaaatccgaatccaaataaaacagcggtttgattcatccctacaacttataattcaaatcaaacaagaaaatccaaatagattttttggcaaccactttctgcattgatgcaatccatcagatcacacacattcatagttcatactgcatttatagttcacacacattcatccatcatatcatactgcatcacacacacatttttttgctgttcttaagtaaaaaccaatggttgatcatttgcaaaatcagaacaaggtgaaaaggcagaaaggggatggatggattgcaatcacgtactccctccgtcccaaaaaaaagacaaaccctagtttccgtgtccaatgtttgaccgtctgtcttatttgaaaaaataatgaaaaaaattaaaaagagaagtcacgtacaaagtattaatcatgttttatcatctaacaacaataaaaatacgaattataaaaaaaattcatataagacggacagtcaaagttggacacgtaaactcagggtttgcctttttttgggacggagggagtacgtagttaacgcacacgtctcctccactgccgccatagtcccttggccacccggctctatcgccgtcccctcccttggccaccgccgccaacccaccccgaccagatctacacggcaccggtgggagcctgatggagagggagaggaagaggtcgcccgtgggtagattgcccaccgcctcccttggccaccgttgccaccgccaacccaactacccccttcccagatttggctggccccagtgagaccaacggaaagggagaggaagagggggtcggatctgcgccttcccgtcacccgtggggaggtcaccggtcgcatgcgtcactgctcgccgaagggaaatgtccgcctggctagaagaggggtggagggggaggaaagtgcaacccgcccggctagaaaaggggggtcggaggggaaggaaagtagccgcccggctggctgggagaggggtcgaagaggaaggaaagtgggtaaaggggctgcaggtatgggggaggaaacagccgtctgagagagggcaaggggccgccgactgaagaggaaggaaaagaggaaggtggtggctggatggatcgagatcgatccttatctcctcacatgggccccgctagcttgatccgattggctcgttttgttgccggctcggctcgactattaggcgtcggttttttaagaaaaccggtacctgtaatatattattggtgtcggttattctttttaaaacatgtaccaatagtattggtgtcggttttttcttaaaaccgacacctatagttgtttaaaggtgttggttctttattttttaaaccgtgggaggtgggaaaaggttaataggtgtcggttttaaataaaccggtcctatgagggtttttgtagtagtgtttcatccaagttacctcttttttacataggtataataaagtcttcacatactttcttggactgccacaaatgttggatgctcgccggagacacctagttggctaggaggatgacctccaagattatcagctcaatgacgaagattggatgttgatccccaaatgctcaagatcaaaccctagatctcataagcacaaatccccaaacttcattcaaatttcacaagtgtagcactagatcctatgtgggttgagtgaaacaaccctagaaatgaataatatttgaaattaaactgttgaagtttttttttctcaggatttaaaaaataaaccgtcaccgcagttcgacagtgcgaaatcacgacgaaatagcaagactaacgcgcgatactgacgaaagcgtgatgaaactagcaaggcgaaaatgtgagacgaccggcctcggtgtcgctatttggctgagcgagaggactattgagcctcaggtctcgcttgtggcccagcgagatggccacactggctgctaataacgcaattaatcgtactaaatagtgagattaactaattactaatgatattaattaaagaaaattaattaatgaaagtaattggtgactccgctaatctcatgcatgaagcctgtcggcgcgaactcaccgaattttttttgggactgtctatgtaacaagcagctgaaaattttgggtttgtcagccgtttttttggctgaccgtgcgatccgcgcatagatgagcgatgcacgtgaaaaaaaaagtagcgtgactcgtgactctgtttctgttttttttgttgggccatagcccacctctttttgtgaagaaacaaaaggcccatcacaatttgtacacaaaaatacaacaaaaagcccactaagttcacatagcccatagcccgcaacacaccacatgagaaaaggaagtccactggttcgcgtgaccagagcccagagcccacatcccatcacgggaaaaaaaagcccaaatacaaagaaatcatgtacagcacgcaatgtcacctcaccaatcctgcgtgcctgccaaaaatagaaaaaatcgatcaacaacatcagcacaaagaattggtagtgtgtaaaaaaagattaaaatataacagtgaactaaaatggagaaggtaacattgaaccagtgtgtggcatacatgttcaatcctatgtaacaagagcttgccaagtcaatgagcttagctgaacttgacaaaaaatttctaacaaaagaaacacaaaacatgtactactagttggaatttggaattgtcgtttctcaaagtattttaaagctgaatacacagttacacttgccttttggttgcattgtcggccatggcccctatgctcctctttctctgaactcctactgagaaaaacaaatcagaaacttgagcaagaaagcggcacaaattggggaatggttccgagaaaggagatacagcagcaggaagtttgaggcgtacctggccgaggtggtggaggaggcccttgaggaggatggaggcgactacaatgaggacacagacggctgccatgacagggataaaaaactgtagatctttagattaaaatttgaggaaaatttgattttatagttgctatcatttagatagcacaccagcttgattaatatgtaggaaaattttaaaatctgacaaagacaaagacaaagacaaaatacaaacacaaatatgacaaaattttaaaattgtgagatgctgacaaaatatatataaaaaaatgacaaaatgcttaaaaatccgttcgccgccatcgatagcatcatggccacgtcgacgctagttactattatgaagatagagcattaatttgattaatatgtaggaaaattataaaagttgacaaagacaaatatgatagacaaaaacaaaataacaaaggaaaaacctacaaaattgacaaaactacatctacatatatatgaatgtgggtaatgatagaaagtcttataatatgtaacggatgaagtagctaacaaaattgacagaattaggtactgttagtagcataattagttttattgctggtaaaactaaataatgtaagtatatgacaaaaaaaaacttagaaaatttactactgatagaaattttaattcaaaactattttagtagaaattgtacttaattgaaccagagtaaataatctttcgtaaaatgtcaattaattgcaaatctaagacttaattgaactactcatcacaaaaactaaatgattgaaatttactttaaaaaactactcatttatagtgagaacaaaacaatttctctaatagtttcccccacatctggcaaagagtaattactagaagaaggaggccaaaaatacacacactagtatacaaactcgcacgctcaatagttgagagtcagaatttctccaaggataatgaaaaaagaagacaattttcctcatgtcaataaggagaagctggagcacatgattgtaccagctaaacactacactgctcagtgagccatctcctccctggcatatggtgggcaccccctaacactacttttgcgtgaagaaaagcaaagctttgcaaatcaaagagtacttcctagctagagagtctcctctcctctcctcctcgaccataaaaaagtaggtactcaggatcacatatctatgtaataacaaaacaaaatgcggttaaatagtagtatcagactagttgctcttacagtagcatgctaagaaaacttgctactcagatatggagtcactaagctctccttgtgaaaaaacataatgtattacaaaacttcaaaagttctgaagatttatgtaggtttgcgaagttctcttaacagaaagcatatatagatcaatacgtgtctatcaaaatttatagaaaaatcacaattattcctttaatctaaatccaaataaaacaaaccagccaccatcaattccagctgcatatcatgcactgnctncancancaatttccgactcaacttcttgctt

SEQ ID NO: 29786 - DNA, 2487 bp, Oryza sativa
  unsure (1)..(2487): unsure at all n locations
tctcgcggtcatgcattcacagtatgcgtacgtcacgtttntctgagcctcttcccatcacccttgttagttttctngctagtactcacntnncnntcnnnnnnnnnnntagggccccttgatacctggatatctannnnnnnnnnnnnnnnnnnnnnnnnnnnnnnnnnnnnnnnnnnnnnnnnnnnnnnnnnnnnccacggagaagacacgcaacgagccagtgagaacgacaggtccagcgcccggatgaatgtgagggcctaaaactcctatcaccaatcttggaaacaaattcaacgacctgaaattcagctgatagaacaaaaattctcatcaggcagatgtctaacaattcccattttttatttataataataactaataatatttaaattaaataactagtactccatccatactcatcaaggaagtcatttaggacaaagtttaagtcaaaccttgggaatataaatcatgaatctcaaattgttgagtttgaaaatgtaaaaattatatgaatagatttgtcttgaaaaatactttcataaaagtatgcatatatcattttacaataaatatttttatagaaacaagaagtcaaaattgcgttttggataccgtgtcgctatccaaaacgacttcctttacgagtacggagagagtaattctgtgggagaattaaccaaaatagaatggacgttgtttctaacagcgtccagagatggacactctttcaaacagtgtccagatctggatactagtagaaacagcgtccaccttccaggtgcagccagaccatcaatacgccaccaataagttaagagaagtattgaaacaagagttgttcgacctaactagggttagggatcaccgccgtcgtcgcatgcgcctgttcgccttcgatcgggggctgtaatccgtacgcttcaccctgcaaaccacatcgtcgctgtcaacgccggcgccttggatttgtccgttactcagcgccatcaatccagccacggcgtcttcagcgcggcaagttcgttttggctgctcgctggcaacaggtgaactgcaagagacatgtatgtctttcacattgatctgcatatgtctttcggtgggaggcaacaggtgcccatgcatacgtttaactaataattagcattgatcagctgctgtatacattgtgttcatacgtactttatatatcgtcaggctcaggtgcaccctgaccgtagcctgaggccgtcagcgtgctgcggttcgtggcgccgctgccgagcctcccggcaaagatgttagtttacacccaaatttagcatctatgaacgaaataggggaaaattgccaaagtttgaaaagtatctggttttcttcacaggaccggtcagaccgcaggtatgtgggcggtcagaccggctagtagggccggtcagaccgcaggtatgtggacggtcagactgttagggcctgagttcaagtttgttttcgtcgggtctcgggtttccttgctcaggaaggcatgttttgtgtttcctttagtttctatctcgagttggacgtggagaaggacctgtagagggcaagaccaacccctatttaaaggacaagaccggttcattgtaataccccgaatacaatatacttgaatcgttcttttaccatgttttctactttaccctagttttagtccatctttgtcgatttgcgctgtaaatcgtccgctgcagctacgagagtgcgacacctctttgtaggtttgtcctgaaaaccttccgttttgcctatgagactggtagttatcctcatatcgatctaaatcggcctagaggctgattttgatctctaaatcggctccgctagccggtttagctattttttctacaaaacccatcttgatttggctgtttggctagatcgaggtggttggcgactccatatcaccgcaagacgtttaggtgttgtgatcgtacttgtcaacttgtcaaaaaaattgccaacagatgccggtggcgagttcaggctgccggtgtccacagcgccggcggccagcagcattgatacctccacaggcgctacgatttccatggccgctgcaggccggctcaccgcatcagctactgtccaggtagctcgttcatattgatgaaatggcaaaccatggatgcaaatctcaatcgaattcactggtggataaaccatctttggtcggtccggcaaaatccacaatagtcccgaatccaaatagaaccgggagtaaagattatttttagtcctggttataaaaattttgatctttagtcccggttggtaacatggttcatcccctgtcagatgtatgtcagggggcccaggatctttagtcccggttggtgtaaataatcgggactaaagatcaccactttagtcacggttggtactaccaaccggcactaaagannnnnnnnnnnnnnnnnnnnnnnnnnnnnnnnnnacattgccctcaccngnaagctt

SEQ ID NO: 29787 - DNA, 11112 bp, Oryza sativa
  unsure (1)..(11112): unsure at all n locations
agatatgttgctctcaaaatgctttggagtgcaaagtgtccaactcttgaattcatgagtttggaacgagaaaggatcttgaggaatttcctaagaatattgagatgatattgagttgtaaggaataatttgggggataaagaactttgatttgtgataaagatttgagatgtacttcgatttgtggattgggggtttgatttgggatatgtatcccacttgatttgggagaaaatcaaaaagaaaaaaaaagaaaaaagggatcctgtcactgccgcaaccctctctttagtcccggttggtactctctttaaacaccaaccgggactaaagattgatttttagtaacggttatttgaaccgggactaaagataacgatctttagtcccagattcgtagtcccggttgaaaaaccgggactaagggggggttacgaaccgggactaaaaagcatttctcccccagtgattagcttattattcagttgtctcgaatctcgatgaatgcgtttgagtattagagatccagagttgtcttgggctcttggccgatgcgaaatttgaactcgaaggaatagttggataaaaacgtctgaatagaacgtactgaaaaatgagtttattccaggtgattaataccatatcatgagttggcaatgctgaaaatcttgtcatgttcttcggatattctgaattcagcatccgttcacctagttcgtgttacaaagctgcaaccatcgtgtaatcaacatgttttgtgtctgaatttctgtcatcaagtttcgatcgagatggaacacgagctgctagtgtcgtcgttgccgccggtagaatgaattagccgccagcgccgtacgtgggcgcgctcggatgacattcgcacggatcggacgcacggcggcctccagccgtccagcgccggcagtgccagctggatatcctccatccgccgccccacgtccccgctccctgccgcccgtcggtcgttgcgcctggagagagagagagaggaggggaaagagataaaaagaggggagatgagagagagagaggaggaagagaagagtgagaatgacatgtgaggcacacatgggcccccaccatttttaaattattcattttaagtataattggcatgtgggcctacgatttctattatttccaaatcaaattgccccactatttttaaattattctttttagtataattgacatgtgggcccacgatttctattatttccaaatcaaattgtcacataagcgtcatgtcaatgccacgtcagatgatgaccgagtcaaattagccacgtagacgccacatcagctgaaaccgacgtccaaactgtatactttgttttaaactgatttttatagttgatggacccattgtatttggtttttcagttaaagaacgaaaatcaaatcggatttgttgagaagttaaaaaggacctgagatgaacttaactctttgaaatacgttgaatgagctagcctggcctggcaggctctaactgcgcgaattccctcctctgatgggccacatggcgagtcaggtcccatccaagtcagtccggaccgggtacacgcagcccagcccgtatggcccgacgagagctcgcagttcaggacgtcatcggcgagaaaccctttcccccacacacacacaagccacccagagaagcagagctcgacgacgccgccgccgccgccaccgccctcctccagactccagtcctccccccgtcctccatcctcgtccgtctgaggtcagatctgatctccagcgatcagggcgtttccatagcaccttatatctgattgaatcggaagcgtaggactgaaaccctgaacactatgcttttgttttgcagcggagcaatggcgggaggcgacgcgccgcagcataagccaatcgagtgcccgaaatgccacggggtgttcaacacccggcgcgagttcgtgaatcataagtgctccaacactcgtctattcatgctcgcccaggccaagaaggccgctaagaaagcagtcctgaagcaggtaaaccatcccccaccctaaatcccctctcctatccaaacggtctttactgcccctccaaatcgtctgacgattaagatgtccaatcgatcgatgaaacaatttgcgatctaacgttgtgaactatggatgctggcatccacctgcatttacaaccccctttcatgcattttattaacttgctgtaagcatcatggaggctattactgtaacatagatcggccgtcgattggattctttatatattcgcttgaatgcagcaataataagtaaatagttataacattgaagatttgaagctgtcacataaacattatactacccgtgatgtcaaataaacattataatacccgtgatgtcaaaaatcaaaaagcattactttttcaagcaattaggatcctgaatttattgtgtacaccgagtttggattgggatcgaatggaactggaaggattcatctgcatttcaaatcaacctgcctgcatgtttgtactttgcactttagatatatgtgttggaagaaatgtttcggaaatgtgtatagaatatacaatgaaaatgtatggtagtgatatactggttacacgacagggatttgatgatacttgtgagatagtgatataccgattacactaaagggattttcggttcataaaatcccttgtgcttttgcactttacttgaatttgatttgcgtaaggatatgtttacatggaatgtgtaattgaggtttagtcaatgaagtttacagatcttgttctggttgggtagagaaaaggcaacactggaatatttattacaactaaaattgtaaggggcgctttctttcatggtagttcattgtggtaatttgcaaggatactcattgtacactaaattactaaataatacataaactgcaacatgtttcaatagataaaatgtactccctccggtttcattgtaattgacgttttggacaatgacacggtctacaagatatatctttgaccttattcttctattataatacatataataaataaatgcatgtttacttttattatagtactttaaaagacaaatctatatgttgttctagttcctttaaactaaatatttttaaagttattgatggtcaaagttataaaagtttgacctcaaccttgtccaaaacatcaattaatatggaaccggcgggagtagtggtacagcaaaaagacttccaacaatatatctgagtgggtgatttgcgcatgaaatggttaagtctctactactcaagtataaaacagttaggttagggaaaagtgttatacatattttatgttccttcttttacacacgaattaaggcttcaatatatacctgttgttatgcagccttcacagcttgtttttcttctccctcttcatctgtattgttattcctgaagcagaaatagacatgtatttattcaattagttgaattcgtgcaaagcatcaacatacctaccagaagaatgttgcattagctacaaagtcattctcatattgagcaatttcaaaaaaggagaatttaaaacacacacataatggtttccttactaaaaggaatgcttgtatccctaggtgtggttttacaccatgcagcaatgagaacgatgcattcatgtggattaaatataatttgcaaagaagaaacagagaatagcaataaactatctgcaatgacaccataggtcaaaatatccattgatgtgggcaataaactttagtatctgtgcatcttaaggttccgttgtgattttgagacaacatacttgcttaatattattctgattttttttgtttgaacagatccgcaacaagggcaacaagtttaactaaggtggtctacgtaaagagaagttctgatgataaggtattgttcttttctgattctgtgttttggatttttgtttgcacactacccaagctcctaaacagtgtgtttcgtgcaaaaagaatatatgtgtgatctaaaattttgttatataatttaataaagtaacttttgaactttatagtagttaatccattcatttatatcttcaaaaggctatcacataaatgacaagttctttaaataattgtctagtacttactgatggtattagtgtttactgatatatatttttatgacagatggaaaaatgcaagggtatctgaaagataactggacctgaaacgttaccttgtttgagagtatatgtgaacttctattatatatgtacctcttacttctattatataacctcctatgattttggggatttagatgggaatcatgacagtctgttttgtttggttcccttgcccaccattatagcattgctatccttttctacgattagtaatggtctgttttctttgcatgattcgatttttatcaaagactgagatcacttagtctatccagcaagtttaaaaggctggcactgctagcataagaaaacaatttgcatgcttttgacagggtcccaaagtagacctcctatcctagtagaggttttcgttgcccaaaccggtacaatgcctaatctttgagcttacaaaatcagaaaaacccaaattatctaacaaaaaccagaaactgaccagatgttgtatcacctggatttttttttaatataaatggcgcctattgcggtggtgagtacactaaggatattgatgggctacaactttcgaagttttcatggcatagcgtgtccaagtccaaccattaacgcaatacagatagtcgaggcaaacgatccagagatgatgagctgcaaatacgtacctgtgatttgaaatgggtacttgaaatggcaacaggaaagattgggttaagaacatgtattgaatgaataactttgtccaaggcttccaaaggcgatatgtctctccactccagtgggtaactgggtatagcactcatctcgtttacttcacactcccctatagactattcaccttcaagcgatatatcataattgatttattaaaccaagtagaagaagcaagaccacaacaggcaaataaccagtagcaaaatcattttcaccatgtgctcggaacgctgtagtgattctaatcgttctagtagaagaagatccgagtagaagaggcaataggagaaaaaccagtagcataatcatatatatttccccatgtgctccgaatgcttgtggacgatctgggcaacacaaagaaaatacaaagtgggcaaatcaatggcaacacaaagaaaatacagactggacaaatcgaagcctacaaacgaattcattctttccgtataaactcgtacactgctaccagatcaggtagcacctgacaaaaatttcatagataattgtatcaccagcgtctgaatcctcaccatgcaaattcaagtgacggatcaaccaccaaataatcaggtcggtggcatctcgcatctctcggtcatccagagatcaaaagaaggacctagctcaagctcgtgctcctcgtcctgtctcagagaaacccaaacaccgccacgacgccgcggtcctcaagctcgtgctccccgtcatgtctcagagaaacccaaactccgccacgatgcgatgacagcttacgtgaaagagcgatatgacgaaatagaaacagcggtatgtcagatcctgtcagatctgaaaagctaccggtagaaacaagtatattggctaagtggctaacctcgttctgatgagaaaacccgcaaagacctcatcgccggaggataacctcgccggcatcggagctatttgccccctatatagcgacgctcgcgatgtgccggaccccttccggctgaacacaggtggcatcagccacggcggcgccatgatttcagccgacgaagttcggcggcgaaccataaccttcgcctttcctgacagaaaagggacgacgctagactaaagcctcggcttccttcgtccgtgcgccgacaaaggaggcgacggagcccggccccaggcagctcaagcctcgccggatagtgccagatctgtgcggcggcgccgtcgttgagaacgggaggttagggttggggaatcgattttggagataagagataaggatgggtgccaactatagaagtaactaattacagggagaggggtagacgaggctttctcacgtatagagagagaaaccgcatgcgaggcgttggaataggaataggaaccgccggtccggtgcgtcacgcgttttttttttcgttttcttttcctttcaatttatttatttattattatattacttgcaacaccgggtgcgtgtccagatctagcattggaaaaaagaaagggaatattaaaagttgtaccgtgcgaatattaaaagtcccatctcatcagtataaaggggaaatacacatactgtactaccgaaaaggccccagctcacacatggaataaaacaggttgacctaggggtaagctagtaaatttaagtgaagtaagcttgcttgctacagagcggccgcatggctgtcggtggctcactggctcggtggccgcaggaccactcgctcaacactcatcttttttaagctgtgagtgacatcacgtctagtagagggagtttggatccatcgctggtcctcgacatatcagatatttgatataaagtattaaacatcgactacttatataaaaactaattatataaaagagagctaattcatgagataattttttaagcctaattaatccataattagtacatatttactgtagcatcacataaaccaatcatggattaattaggctcaatagattcgtctcgcgaattagaccagggtatggaataggttttgttattaatctatgtttaatacatttaattaatgtccaaacatccgatgtgatagggattaaaaaattttagccccatctaaacagcccctaagagcaagtttaataatatagtccactatactagctctaaaatttaaaacatcatatatataatcaatctaatagctcgcttatataatagttagctgtagaaatattgggagtacgtcattaatgcataagggcatccacaatgtactttaaaaccagtccatagtcaataaaataatacattcagctacctaaccacattgaggaagtagtccataggagagaaatagcaaaagtcatccataagcatatgggctgcccatatagaataaaatatgtcatttgtctctatttcctctctcctcctcctactacttactaactatatacattgtgaatgttgcaatagttaaagtccacaaatataggtcccatctatatggactactttagctatatacattggtgttgccctaacctacccatctctctcacataggagtagtttattggaactcgtgctgcagctggctacgaatctatactagcccgcttttgttatctctcctccacacaagcacaaatctgatgtgtcaacttctatagcatgcttatgttaccttattgtactcgctctatattttaaaatgtacgacaccattgactttttgacccgcgtttaatcattcgtcttattcaaaaattttgtacaaatataaaaatatttatgtcatgcttaaagaaaatttaaggataaatcaggtcacaataaaataaatgataattacataaattttcttgaataagacgaatagtcaaacgttcatcaaaaagtcaatggcgtcatatattaaaatacggggggattagtaacttttaatatatttttaatactcaagctaagagtaaaaattataatagttattaacaacaaataaaattgatttttcaaactatgtttggagataaataaatttagtagacgttatacgagattgtagatgaaatatgatatcccgcactttgattatatatatgaatatatgttactccctgtcacaccctgaagttctccccccaagcctaaattgaatttataaatggtcccaagaaaatatcggtgtaaaagcgagagtaaaccctaatagatcaatgcaaataataatcggaattggcatgtggaatttttcttgagttctacatgtcgaaatttgctaacaagatttttagtgaaattttcagagccctagaaataattttaaccaattaaaatcgagcacatgcaattttaaatcccaggaaaaatcctttcttccttttctttttcttttccctcctttttcctcttcttgggccgtcggcccagtccgcccgccgccgcgcgcgcccttttcctccttgtgggtcggcccaagccgcccctccctctctctccgggacgccgacaggtgggccccacctgtcagggtcgtcccctttctccggccgcccgccccacgttggcaaccgccgccgaaaccgccgcgcccaccttctccgcttctcccgcgcccacgccgggccggcccgcgttctccccacgttgccgccctctttccccccccccccccgagtctcccgggccgcgcgcgcgctcgcaaggggcgggattcgcattttgaattccccccattctctctctctttcctccccacgtcactggcggaatcggaggccttcccggccacgttctcctttctcgagcctataaaatcgctttcccgagcctccttttcccctttccgctctcgccgctccctcccgtgcttcctaccgagctcgcgccgctcgccgcccgcgccgccgcttgccaccgcactccggccgcgtgccgccgccgcgctaagccgccgccaccactagcttcgccgccgcaagatctttctcggccgccaccttgcgtcgccggaatcccaccgagaccccatttcccttgcgtcgccggtgagttccctctcccctccgactccggccggcatggatggccgccgtggggtttttcctccgccctaattcctctcctctcctcccctaggtgtcgccgtcgctcgtccgcacctcggcatcgccggtcttcgccgcctccctcgttttccgccgccggtcgtcgccgccccctccggtgaggactccctcacccttcctttccttccccttcccgcacgcgccgtcgctttaggccgcgccgctgcttcggctgtgcgccgccgccggtcgccgccggtggtcgtgcgcgccgccgcctctagccatggccggccggccggctttgaagccgagccgagcccggcggttgctccctgcaccgtccgatcggcccgaggccaatccggaccgtcggtcccgtggaccggcggtggaccacccgcgtcgtcccggtccacggtggaccggccgctttgtgccgctgatccatggggcccacgtgccagcgccccctccctctccccttgcgccgctgacatgcgggccccgcatgtcggcgctgcccgctccctttgatgacgtcagccctgggcatttattgcgcaataattcaattaaggatttttctgtttatagtaaaaacacagtgaatcttctaaaattcataactaattcatccgagctccgtttaagcccattcaagtctcagtaaatcaagaaaaatgtgtagaatccattaaaaatggttttgttctctgtttcagtagtcttatagcctgtttgtattgtttgctttgtatgtcgcttagattccggctcttccgacgctccggtgtacttcgagatagtcgccgaggttcctccagcagtagagcaaggcaagtcatggctgttacttgaacatgttgatcctatattgcaaatgttctaatgtttttcttcaaatactgcattgttttacaataatactatgggatgtttacctactgttacagccatgctattttggtaccatgctcctttgttagcttgggttataacatgactagacattggactagggattgcttagccatgcttagttcaactagcacacaatggggaaaatcctattaatgtatggactgtaggttctaatggtaatgttggattggtgccaccgcttcggtgttggttaattaaaataaatcacatggtgggctgtgggtgcatggttttgttggtcgcgcccatggcagttaaggaccggttcgcgggatgccctggaagaacttatcgtacttaccacaagccagcgtgggcaacggctgggcttgtagtgtagctttcctctagctgacgcatccaggcaagggtgggcgtgatggagtttggatgggccctgcgacggcctatgcggcttccggattcacctaggtacgagagaggactgtccgctgccttgcgaggagtggggggtgaaaccttaggtgtggtgtgcttggttagagggggttatgcgacgggtcctgtcacggcctctttccggtatgtcgtggtggcatgccggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtttagtctaatgaaattggatagtataggtggatggttgggcctgttgcaacgtggtatagcgttggacagtggatgattaatattgattaattgttacaactgttttacttctctgaatttctgtttataaatgcccgttttatgcaaatgaaccgttatagctatcccttgataattccctgcatcataccccttttccggtatgacttgctgagtatagtggttagtactcagtcttgctctattttccccaaaccccagaatttgagtatgcgtcatatggtgatttctccgaggagtaggcttcgtccgtgccgtcgaggatgcctgtggagtggtgttcccgctgcagatcaagtcaaggcttagctccagttatcttttgtttttccgctgcatttatgtaagacttttataatgtttgtaacacgtggatctgtatatcaactttgtcgtttgtgtaccccggcctgtcctggatggggattttaatgcacattctgcttggaattctannnnnnnnnnnnnnnnnnnnnnnnnnnnnnnnnnnactgacaataaacaaaaccaccg

SEQ ID NO: 29788 - DNA, 763 bp, Oryza sativa
  unsure (1)..(763): unsure at all n locations
atgtgcattgttnaacttgtacaacnnnnnnnnnnnnnnnnnnnnnnnnnnnnnnnnnnnnnnnnnnncatccattgctccggaattacaataaaataagcagacatagcttttctaaaccgcttcttatactgcatgggtgaaatcacagttggaggggcattcttcggcccgccgagaataccggacgatttgacccatgtctcgaggtgcttgtcccatgtatactgcctcataaaatcaattattcccagaaccaattcatgtttctcctcgtcaactcccacaagcaatgagtaatccatcacatcaattccctacaagaggacaagacttcattaatgagtcatatgagaagatatatcgaatgctgctactggcctgcaataaatcttatcagcctgtctcataaaccctaccaaaattgaagagaatgaaaaacattaaggaaatagacaacagcggcaagtatgaagttaacattgtatatgcctctttcttgaaaaaaaaaaaaaaacattctatatgcctctgctaggaacttataaaccttagcttcaggtgctacagccaaaacatcgaaaggcctgttcactttgatgccaaaaaaaaccttaccaaatttttgcattgccgaaattttggcatagttagttgccaaaattttggccaagtgccaaaatttttgcaggatttcttatatagttaccaaaattttgcagcaaactaaatgccagcactttttttgacaaatttaacaaan

SEQ ID NO: 29789 - DNA, 764 bp, Oryza sativa
  unsure (1)..(764): unsure at all n locations
ccgctgcattgaattgtcttcacgtccnnnnnnnnnnnnnnnnnnnnnnnnnnnnnnnntatctttatttaccagggcataaaaaaatttcttttacctatggtttccctaataactgcatttggtttattttaaaattgcacaaacatataaactgcaagacataacgatgagcacttcgcgaagcatacaaactacaaatcgcaatcaactaactgacacctgaaccaaaatcgattcacatacaggcctcaccaacatactgcatggcacaatgggacaagtaaagatgttcatgaagctgagatcactaaaccagtgcacggaccaaaaagcaaaccgaacagcttaaaaaaatgactgaaaaaattgaatatttcaggtgactgaaaactgcaactcccttcacgaaatttccagccaaaatcagaacaaacaagcaccaaatcgaaccaagcgaaccgaaccgaatcgaatcgagcaaccataccaggagacccaaatcgacgagcgcagcccaaaaccccgcgactccgagccgctatgacaccggcggcaggatgcgctcgatttgtgcggcgacggctagggcaaaagcgtggaggcgagagagcatggaaccctaaattagccgccgcacaaaatcccctcttcgaatcattaataatacagacagaacgagaggggaataaacgcgtggtgaatcgcacgcgagccgacccccatcccgtaaaaataaatccagtcaaccacttccggaaaaa

SEQ ID NO: 29790 - DNA, 765 bp, Oryza sativa
  unsure (1)..(765): unsure at all n locations
atggtgctttggtnaatcgacataacnnnnnnnnnnnnnnnnnnnnnnnnnnnnnnnnnnnnnnnnnntgttaaattgctccggatttacactaaaataagcaatcattgctcttctacaccgcttcttttactgcgtggatgaaatcacaaaaggtggggcattcttcggccaaccgcgaggactggacgacttgacccatgtccaaacgcgcttgttccgagtataccgccctataaaaacacacctcgccagatccgatgcatgtgtctgctagcctactctccacatgcggtgattaacccctcacataaactccctactagaagacaagacttcattaatgagtcatgtgcgacgatatatcggaagctgctgccggcctgctgtaaatcgtatcaggcagcctcataatccctaccgctattgcagcgactgcacaacattagggacatcagcaacttcggcgaggcttgagttcacattgggtaggcccggtttttgcaaaaaataccaaaacgtactatattcctatgctacgaacttataaaccttagcttcaggtgggagggcaaagacataaaaggactgtacactttggtgggcaaaagaacggtaacaagtcttggccttgacggggttcttgcatgcttaggtgcccaaaatttggccagctggcaaaattttcgcatgaccttttttttaggtaccgaacattgggaggcaaccaaactgaacccacctttttgaccattttccgaaatn

SEQ ID NO: 29791 - DNA, 726 bp, Oryza sativa
  unsure (1)..(726): unsure at all n locations
tttagagggttccccctacacactccttattatacttgacattcttttaactttttccttcagatttaattggggtagtcagccgtattggtccatatgattcggcgagcccaacatcagacaaaaaactcagaagaattcaaattcagaaccaagagtatatgtaatccttatcctcttcggggcttctttggaacgtgagaaattttcttgatatattcctattgtaattgaattgaattatgaatatcctataaaaatgttgtatatattgcaaagaatgtctaaattggagttcgtactactgataaagattgacgtgtacaagaaaaatgaggaccattgtgtcttcttgtaggaaaaatgattacatattgattttttttatgctgtttacctctagtagacccaacatacccacagtaatgatttgcataattgcattgaattgactgagttaattaatttgggtaaatttcagaaactgatcagctctattcgcgtgatttttttggaaacaaattattcattgacctgacatttaaaagaaagctaaacgcacaaacttgaatcttggacagaaacaatttgcgattctattaaatactctttgtctatagttttgctacttaggttagtagtagttagtttatgctgtcagcatttattaactaattatctaatcgagggtacccagtggcatatcaaanttcaaangtgccacat

SEQ ID NO: 29792 - DNA, 713 bp, Oryza sativa
cgccgagtggaacgactactataggcgaattcgagctcggtaccctgggaaggggaggccggccgggaaggggaggaggaaggggagagaagggggaggagaggaggaaggggagaagttggagagttagaggatagatatgaggagagggggtgagattcgatctgttaagttgtaactgtggaggagaggataagggatatggattatatactatgtgtttaattttagtccccgctggtacattattgatctttatctacagattgcacgccccttacttttttaaaattgtttgacccatttccttattttacactttcccggtactacttattctttttccccaatttatatcatgactaaccataaacatttttatctaccctgttctaatatcgaatttttattacccatacaactacctcctatactttcggttaaattcgacccgaccctatattgaaatactgccgacccttcataaataacttttccatccatctatacaattaaaatttccatatatttttattacttaatcacacgagcaagctaccttgacagatttaaaaggttattaatactataactgttatggcaatctatttacctgtatgttttaagcttttacctccattaatgtttacacttccaaccttaataaactaatgattatatgactcttttctagtcatttacatcttcctatt

SEQ ID NO: 29793 - DNA, 780 bp, Oryza sativa
  unsure (1)..(780): unsure at all n locations
atttcccgcggggccgcggtgttttgacccccgctaaagctgtgcggggcattagcttcccgcgcatgcgggggcctcagcaacgccgttccgcgggcgagccacccgccgccggtcttttcccacaagagccgtgcacggcattagagcgccgtgcacgggggcctcggcgtcgccgctctgcgggtgagccgccgccccgctctcgcctcttcccaccggtgttcgtagatgtctcgacatcaccggaacagcatgtgggttgattcgtgttgccgcgaatcgcgtggaacggcggcgctactaccaaccactgccgcgacgccgtcaccgccgccgctgccccaacccaccccaccaccgtgccgccaccgccgccgccgccgtccccaccgttgtgctaccgtagagagttaggtttggggatggatccttttgaatcggggtcctgtgctgttgaacaatttgagggctgagatgctaaagtttgtcactaggcggggtgtttcctgaacatttcaacatggggtgacgtggacttatctggaacctacattttccatccaagtgtggtttctatgtttgcactggagatggtgtttccactatatatcttctcgaccaacgtggcctaaatcataaaggaagttggttggtgcgcatactcaaccgatgcatgcatccgaacctagctcggtcaactcgannnnnnnnnnnnnnnnnnnnnnnnnnnnnnnnnnnnnnnnnnnttgtgcaatcgaaaatcaaanccggtccctc

SEQ ID NO: 29794 - DNA, 732 bp, Oryza sativa
  unsure (1)..(732): unsure at all n locations
cgcggagttgagtgtcannnnnnnnnnnnnnnnnnnnnnnnnnnnnnnnnnnnattgaaggcacatcataataagggaacgacgaccatgatttcgcgtaacagacaccgggagtaactatgttaatggcagccatcaatgacctcgttggtgagcgtggagaaagaatcgccggggagggggaggcggatgagaagcggcgcacgcagggggtggggcaacttggggcgccccccgggtgtgtgtgtggggggggagtggaagggtgtcttnttgacgaaaattgtcgcttgctcaggtggaggagaagccgcgccggttgaatgccccagagattggggaaacccgggtctgtaatgacgccatctccattcaggagaggcagtcagggcgtcatccgccggtcctggcctggtacccccccatgtgagaagcaatggctttctcttgtgggcccgcgcttgttgcgctctgctatgggatagtgggtaaggaacctaacacccgccatcgcgagaggaaccactcccccccccccatgggaaaacccgttgccgttgatacacaaatttttggcttagggatctccctaatatatagtattcaaccgcctgggaagatttcatccgaccggctgaaaaaaataagcgatgtggttttacccccgtctctgtaaaacttcttttaactcaactatggggggccaattgtttaggtttattgaatcccaac

SEQ ID NO: 29795 - DNA, 599 bp, Oryza sativa
  unsure (1)..(599): unsure at all n locations
gggggggggggggtgggggggtggtaattttggggggttaggatgggggggggggagggtggattttaanncccccccccgggggacatggtgaggcttccannncnnnnnaaaaaaaaganaaaaaaaaaaaaaaanaaaaaaaaaaaaaaaaaaaaaagaaaaaaaaaaaaaaaagggggggggaaaaaaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 29796 - DNA, 1254 bp, Oryza sativa
  unsure (1)..(1254): unsure at all n locations
cccgtgatnnnnnnnnnnnnnnnnnnnnnnnnnnnnnnnnnnnnnnnnnnnnnnnacttaaaaataatgctaaaaaaatagtgttgaaaaatactctgaaataaacttcaaaattaattcataaatttaaattttgacaatgactcatgggaaacgagaagcccttaaagagagtcgaagtgcttgcttgcatgtcccaccatatgcaatccctggtgaatataacatcgtccatgtaaagccatacaaaaccatattacagtttttagtggtagttttcttcatgccagaaaattcttaaatggacattttttgagtttatttacctaaaagaaatgattttgtggtccatgagaagctaccatatatagcttttaatatgttaatttgcggtagctcttgataccttaaggtgctaatatctatgctaaacttgtggtgcctccttatttaaggacatcaaatcctttttttattatcagtttatatcctatctatatctatacattgtatataataatagttacacttcactaagcatttaaaactcaactacgtgcaaccctagtaatcacatctacaattatattacattctaaaatacaagcattctaaaccataattgttcttcacattaatttaacctaaaactatttaccatttctataacatttaaacatatattcatccgtatatttcgcagtaaaacacatgacgtcatcatctaattgccttagtacacaatcctatttaatgggatcatccgatggagaaaataatcaccatatgatctcatgttgtctcggtaaatatcttagagaaaagcaatcgtgtcaagagctacaatcggaatgtcgcaaacgagaaaatgacctataataattacggacgtgcatatatgtgagggcaacaaacaattggtcaaacattgcacaaaataattgaagatggcgctacaacgtaccatgtgtccattatatagtcatgcttatgatcgattttcaaaacggaattgctatatgtcattcgaatgaaatgttatagattttggatcattggatccatgccaagattcgtgcatctgcttctctcctccaactctggcgggctccccttcttctccggtgccggcgacacccctaactccggcagggagcatacgggttagggtttggagttggggtgagggtaggagaggggttnnncnnggggnannagggggggttnntttcctgggtgctttntgggatggct

SEQ ID NO: 29797 - DNA, 2853 bp, Oryza sativa
  unsure (1)..(2853): unsure at all n locations
gggggcttttgcggcgaatacaagattttgcattggacggttccggatagcctcaccagtagggtaagtcattgtggacttttaaaatgggagggggagggggctcgccggggggcctcgctgacgccgttaactctttccgattagccggcgaggcgggcagcggcgcggtggggtggtggcggcggtggatcacgcgtgggacgggaggaggagggtggcgacgtgatctggaatggggggaggaggagaggagttaggttaagtggtctgcatgaatcttgaagcatatccaatggtctaaaattcgaatgataggaggtgggattttctgtcacaagatgtatagacaaccccttttcaaaatgtagaatttcagcatgcaccatgattgttcattttgcatttggatgcttcacaaggggaaaatacaggatctgaagagagttaaatacaacaatttttttataagttccaatacgatgtcagaattcttaatatatatattaacatattggatttgatgaagaataggaatttaatggttagtcataaactttatagtgctatgagagagtgtgcaaaaggtattatagaagaaattacaacataaaaaataaactagggaactgaagtccaactcatctcatctatactttctatatagttggtacccactaacaattattagaagctaaagctcaacatacatgcatgctacatcatcacccactagcaattatattattctagcccatttaaaatcccatgcaagtatgccacatcttctctcactagcaattactattctatcatattttaaatcctatgtaagcattgacacatcatctataatactccctccgtttctaaatatttgacaccgttgactttttagcatatgtttgaccgttcgtcttattcaaaaacttttgtgaaatatgtaaaactatatatatacatataagtatgtttaacaatgaatcaaatgatagaaaaagaattaataattacttaaattttttgaataagacgaacggtcaaacatatttaaaaaagtcaacggcgtcaaatatttagaaacggagtattatattatagagatcaacaagtatgtgtcaaatcatcttcctcacattattttctcaacattttaactttcatcatttcgataatatttatcatattcatgaatcccgcagcaaagcgtggggcatcacctagtttagagaatgcatgtccgccgaaaaaagatttaaaagcatactgcttgttataaatataaaatgcctacgaaatcatgtgcacaacccattatttcacattttttttactaaatatattcatattttatgacaaaatagagaatattatctttaccatatacgcaggtgaccaaattgccatacgaggtaaaaaagaatataccatatggaataatatgatttggtctttaatctgccagaaaccttatagggtttcaatttaaatagatcaaaggctattacccacaagtcaaggataagttaacccataaaaatggtcgatacatcatcccgtacttgttgtactgccaacttaattaaccccttaatatggtcaaacactaatgcaaggtctgttaaataggttacttgtttgtcacgcccagaaattcacgaaccagaatttctaagctgaatatgtattaaacccctgtccaggaccagccagggtacacaaacgacaattgttgacatacagatccacgtcttacaaaaatataaaggattacaaatgcagcggaaaaggtaaaagcgagctaagcctgaagacttgactcctgcagcgggcgattccattcctcaggcaacccttgacggcagcgacgaaaccaatctcttcaagacatctccaactgagaagaacttcaactctggtgtgtgggaaaagagcaagactgagtactacccactgtaatcagcaagtcataccggaggaggaggtatgatgcaggatataaccaacggaggctacggggttcatttgcataaagcaggcatttaaaaccagtagttgaaaacagaaaaaaacagttgtagtaattaagcaatattaaccagtcactgtccaacgctacgccacgttgcaacaggcccaaccaaccacctgaactacaccagttcattaagctaaactaggggtgagactaatcacggtgaatctggtcgaccgcccataaccgcgggcacggctattcgaatagttttactctgatcagaggtgtacaactgtacccacaagacatagccccacgacacgttcccgtgcgccgacatgccaccacgacataccggaaagaggccgtgacaggacccttcgcataaccctctctaacgatcgcaccacaccttagggtccgcccccgtccccagcaggcaacgggcagcccccctttcatgccgcggtgaatccggaagccgatcaaccggacaccccggccgacccaactccatcacgcccaccctcgcctgggtacgtcggttagagaaaagctacactacaagcccagctgttgcccacgctggcttgtggtaagtacaataagttcttccagggcatcccgcgaaccggtccttaatcgccatgggcacgactagcaaaaccatgcacccacagcccaccatgtagtgtattttaattaaccaaccctattgcggtggcactattccaaaactattgctaataatcaaagcctatgctttagtgtgatccccttttgtgcactagttgaactaagcatggctaagcatctnnnnnnnnnnnnnnnnnnnnnnnnnnnnnnnnnnnnnnnnnnnttgatctaccnggatg

SEQ ID NO: 29798 - DNA, 2028 bp, Oryza sativa
  unsure (1)..(2028): unsure at all n locations
gggacgggggggggcccagctttgcgaaccggccggcgtcgacggcgcggtgcggcaacggctctaacggtggcggagtgcgcccggagcttggcggcgaacgccggatgtcgggatgagaggcgcgggaccgatggagagctcgggagggctcggccgagaaaggaaaaagagagaggaaggtgcgggcgtgcttaaatagaagggggccggcgagttgtgcccgggaacggcgcaattttgccggagtagtgaaggaggtgaagaaggagagagagagacaggcgggattcaaatttgaatcccggccatctcgcgggcgcggggtgattggagtggggcgtgggcccgggaaggccggggcgcgcgggggagtggccaacgtggcccggggcgcggagtggggcgcggaaggcgggcggcgatgggtggtggtttcggcggcggttggcgcgggcgtggccggccggaggttagggaaagggctgacaggtgggccccacctgtcagtgcccgagagggagaaagaggccaggtgaacttcgggagtaggagggaggagcgggccggcgcgggaggaaatgggccggcggcccaagaaaaggaaaaaggagggaaaagaaaagataaaaaggaaaaaggattttcccagggatttaatattgcactttgcttattttaattgattaaaattatttccaaggctctgaaaattccactaaaaatcctgttagtgaattttgacatgtagaactcaagaaaaattccacatgccaattccgattattatttgcatttattaattagggattcatctctaggttaaattaaacaatttcttcggatgatttattttatgaatttagagcaagggaggggaacttcagggcgtgacattgttgaacacaaaatctgagttaatttatcatatttggtttaagctggttattctaaccccaaactgaactcatcttagatctttggtacaaagtggaggcaaatagtataacgacaaatctacaatcatcacaactgataaaggtagtttgagaaataaataaaatgttacagttctttcttttgcttctaaaggtaatactctatccatttctttatatttatcacagttgactggtactgttacaactttaaccactaaaaaaatttaaatgaaatcttaatatttatgtttattatgctatacattttgacaatatgacatctatttaagtatgtagaatttctttttgcaaaaagaaagatggtcaaagtttaaatgtgaatattgcttggtgataaatataagggaacggaggaagtagtatcaagagttagtatttgatgaggacttaattgggtttagatgatatttttatgagagaatctactcaaagacattgagtttgttctaatttaataatttttcattgacattatcttttcctataattaccattattttaaaatgtaccactggggtcggtcttttttttttctaacagacctattacccgtaagatgcaaggctaatatttatctcattagaagtttcaaaataatatatgaattttttatgtagcctccttatacaatatagaaatttgcatataagttccatttttcatttttattttttaaaagttatttttgtgcggtatatgaaattgtttacgcaaaagataatgtcacacaaatattttgtgtacaatataaaagatgatttacattaaaaacaacaactggaaaattctatttatatatatatatatatatagcatctaacaaataaattacattttaaaaaagaaatgcaaaaatcttttatacatatcaccctatgctaatgtttagcctaccaattcatgactaaacattagctctcaaaattagccatgggctaatcttttaaacatggccttattcatgtatgaaagatacacannnnnnnnnnnnnnnnnnnnnnnnnnnnnnnnnnnnnnnnnnnnnnnnnnnnnnnnnnnnngagcgccatcaattccacggcggngc

SEQ ID NO: 29799 - DNA, 2566 bp, Oryza sativa
  unsure (1)..(2566): unsure at all n locations
cgtcgtgctatccgaatataagagccaggtggtgtttttaaggccattttgtcagggaaagaaaatacccaagtttcgcttattaaaaaataagattgtggggaggaacgtaaaaagttttgaatgagaacttctggatgatagatcctaagtaggtaaattgatgtagataaacttgttaatgtataagacaaaattttaacttcaaaaatgatttattttgacatggaggaaatgccaggaagcataggatatatgtcacatcgaatccggtggggtagagaccaaatcatttctaattggagtatgataggcagaaatcagaaataatgtggacggttgtcagttggtcgttacacaacaataaaatgattcctgggcttatcccctaaaaagtaacgcaagaaattagttgggtgcgctgcagtactaccctagatattgggttgattgctgctgcatatatcatggtgtgggcaatgctagaaagtcttataatatgaaacggaggaagtattttttttttcaattcatagacataaagatttacccagctttatttagtaagcttagtgccttataacttccaactgacaattgtttaactcattatggtgacattctgttttgcttttcctgctgatatcaacatgtttcacactctgtgccaatttttattgtctaattggcatagctgccaatctgttattgctcatctgtgccaaaaaccatgtcaaattgttgcatattctgtagtccttttttttaatgagatgccacaaagttacttgataatcagtaacccagtttttgcactagtttagcattagcacttaatttcatgataattagtaccccagtttttgcactagtttagcattagtacttaatttcatgctttattctctggaaatatcttgcacatgaatcaacaaatgaaaggaagatatgcattattaaggttcaaggagcattattttgacaatccaacacctgttttgtgccaggagtgatgatgaggatgatgattatgcagttttccactcagattcaaaaacacaacacttgcaaaattctgatgagtacttcaaaactgtgtgttttgatgctcatcaagttgattgtagtcatgtaaaagaatctgtttctccgatgcaagatacggaaaattttattggttctgtgggagtagataagactggagatcacatcatggataatactgaggaatgcaatactcgatcttcttccttgtatagcatggaaatgctagaaaatgagcctgtagattttgaaaacaatagctcactctggctgcctcctgaacctgaggatgaagaggacgaccatgatggtgctttatgtgatgaggatgatggggaggatgccacaggagagtggggatatctacgctcaaacagttttggcagcggacattgtcgaagtagagataagtcagctgaggaacacaagagagccatgaaagacattgttgatgggcattttcgggcattggttgctcaacttcttcaggcggaaaaggtacagttggttgataaatctggcaaacagagttggctagatatagttacttctctgtcttgggaagctgcatctattctaaaaccagataccagcaaagggggacggatggaccctggtggctatgtgaaggtgaaatgcttggcttgtggtcgtccaagtgataggtaaacaaatttacccttctgcagattatggtcaaactgttatgattttatatctgtctgctttggagtattcattttccttatagttaaaaaaatatgaatacgacagtgactcagccttttgtaattcaaattcatgatgcaaacttgctggcaattttgttttatcaagttattggcctttgaaatttcacactttattactttttcgtatcttattagtgctccatgtaagagcttcattttggttctttatttccagttttgttgtaaaaggagttgtttgtaagaagaatgttgctcatcggcgcatggcgtcacggaaagaaaagccacgcatcctgatccttggtggtgcacttgaatatcagcgcatatcgaatttgctttcaagttttgatactttactgcagcaggtattgccattaatatctttttatgcatatgttgtaaagccgaagttcattttaagggcggtatagattgaatgttatgttgctattggtgatgcgttgtcatgtcctttttgctccaggaaacagattatttgaaaatggcagttgcaaagatcaaagcccaccaaccaagtgtagtgttggtagagaaatctgtgtctcgatatgctcaggatttattcttggagaaaaacatttcacttgttctgaatatcaaaaggccacttctggaaaggatatcacgttgcactggtgctcatatagttccgtcaattgattacgtgtcatcccaaaagcttgggcattgtgatctattccatgtggagaaatatgttgaagagnnnnnnnnnnnnnnnnnnnnnnnnnnnnnnnnnnnnnnnnnagttngacatcaaagcagct

SEQ ID NO: 29800 - DNA, 5022 bp, Oryza sativa
  unsure (1)..(5022): unsure at all n locations
gatgaactgatttgctttgnnnnnnnnnnnnnnnnnnnnnnnnnnnnnnnnnnnnnnnnnnntctagtgccgatagatccatttcaactatacctattttacaaatgcctactgcttcatcaccaaacgatagcttgcaagcatttgatgtgcaaacggatggttcaacatttaatggttttcaaacaatggaccaaacaatggtaatgtgctctcctgagtataaaagctgcaaaaaactgggagctggttctgcccaaaccgaatctgcccatttcaatggccaggataaaaatattgcctgtttgcatggtatggttccttggtcatctactgatcccttggttcagcaatcggccagttcactttgtcattgtccttcttgttctagagatgtagttaataaaaagcattttgaagaacgtcaacctgaaacatctggacataccctggataatgatttcaatgcgttgtctgcacatcgaacaaatttggagtctgttgagagcggtcacttatttgcctataattctgagaatggtgacaagataagagctaaactgtctgttcctctcaatgtgcaaatttctcttgatgatgacagttcaaaggatgattcagtaataaaaaaagatgaaattccggcatctcctgctgacaaccagagtatattggtttctctgtcttcccgttgtgtttggaaagaaactgtttgtcagcggccacaccttctccgcataaagtattatggcaactttgacaagcctttaggaagatttctgcgtgaccagctctttgatcaggttagattgtcattctcgaattcaatttatagaaactttatatactgcttaactttgacattttgtttcagaacaataattgtatctcttgtgagttgccaccggaggcccatgtttattgctatgtccacccgcaaggcagcttaacaatttcagtgaggaaacttgcagtgaagttgcctggtgaacatgatggtaaaatatggatgtggcatagatgcttacgatgtcctcgtgttattgggctccctccagcgactaaaagagtagtgatgtctgatgctgcctggggcttgtcctttggaaaatttctggaacttagcttctcaaatcatgcggcagctagtagggtagccagttgtggccattctcttcacagggattgccttcgtttttacgggtatcccctcactcctcttcaatttcattaaattggtaaatactatggcttacatgtttgtattttagctttggtgaaatggttgcttgcttccgatatgcatcgatcaaggttcattcagtgtatttgccaccaccgaaacttgatttcacttctcagcaccaggaatgggtagagcaagaagcaaatgaggtaggctgtttaattttgtgagcaattatgtgataatttctggttgacgctaattgtctatgattcaggtggttgactcagctgaacttctgttcactgaagtactgaatgcactccaccaaatttcagagggaaggccaattacaggttcttttgatggcaacatgaaaatcctcgagttaagaaggaacatcatggagctggaagagatcctgcaaatagagaaagcagattttacggtaaattattatttttatttatgttttgttatggagccatggctccatttggctctgttcaaaaaaatgacacattattaaagttgtatgctaattattggagcattcacctttaggaatcattgaagaatctactgaacaaggagatcagaaaggggaagccattcattgatattcttgaggttaacaaactaaggaggcagctactgtttctgtgttacctgtgggatcagcggctaatctttatagcaaattcaggtggcaagtactgtgacacactaggaggtttacgggttgggagtaggagttctgactctaacgataaatcagttgataccaatgcaactacaaaactagagaagagctcaaagggctccgaagttctttcaaatgctaaggaaggatccttgaagcagagccaaagtccacttcatgctaatgacaaggagcccaaccaacctgatcaatctaatggaaatagttcaaggattggtgcagggttgaatggcatggaagatgcgattgccaaaatcaatcattctaacagcgcagatgttaaggataacctggatcatcaagaatccagtattggtgttcgtagggttctttctgatggtcagtttccagtaaatgctgatatttcagacacattggatgcaaaatggagaggtgaaaatggaacanttnctgatacaagtannctgaaaccattagctctgctagaaggttcagctgatcttaaaaaccaagctaaggcagtgccaaccaatgcttctttatctgtcaggtctggagatacagtagaagacttatcaagctggctcaaaatgccatacatgacattctatgactccttaaacacaaattctgggacagcaccgagatttggggccctggctgactacaatcctgtgtacattacattgttccgtgagttatcacagcaaggtggagcaagactttttctgccaactggagctaatgatgttgttattccagtatttgatgatgaaccgaccagtataatttcttatgcacttgtttcacccatgtactgtcaccaaatgttggatgagaacagcaagaacaaagatggtccagattcttcacttccattgcctgtatatgattctggaaattttaatccttttcatttatttgaggatttcggatccgctgatgatcttgcttcgtcaatatctggaaccagagggtcatttgttcccgatctagttcacctaagagttccctttgaggatggtggcccactcgggaaggtgaaatacacagtgacgtgctactatgcgaaaagctttgaagctcttagaaggtcttgctgtccatctgaacttgactttttaagatctatcagtcgatgcaagaaatggggagcacaaggtggcaaaagcaatgtgttttttgcaaaatctctggatgatagatttataataaagcaggtcacaaaaacagaacttgaatcattccttaagtttggactagattattttaaatatttatcagagtctataagcaccggaagccctacatcccttgcaaagattctgggaatctatcaggtatatccctttgaccttctgttttctgttttattgatcactttggttctaagaagaaacttaattcttttgattcaagagaaaaatagctaggggcatttggctatcaagcagagcctcgattttaaatgtagctctgtctgtcactcatgagtagtgacaaatctttgggccacagccaaattgtacagcaggtggaagaaataataaaatgtttctttccatccaagcaacttatgtgatactcatatgttgttaacttacttgtgggttaacttatgtactagttcctattttacagggaaaaagcaaaacctgacttttctagaaaaaaaaaccacatttatgtgatactattcgagttatcagattaaaatagtagcatttgtaggaaatctcactcaagttctatgttttatgtgtctgatattttctggtgtttaggagcacagtttttatttcttatccaattatccactttacaatcatattttaagtttaacatggtacaagttgtaactggaagggatatgtatttattctgttaacatttgcttgtttaagttacattcagctctatttctttatctttaaacatgatcaattgcaaatttcattaaatatatgtaagaactgcgatctatacaggttttggaggtctatttttttcgtacaacttgttaggcgactacctgcaattgcttaatttgatctagtatgtgttccattaaacgctccttcagaaatctcaacccataacccagtatttggaggaagtattgcaactttggaccgatggacctatttttctctctctcagaagctcctggattaatcaagagcaataatccatgatttatatagtcatagcattatgcatgctgtattgatgatagatgctcacatttattggctggaatggccttgctgaagtatctgataggtagattttccactatgaagcttacttatactaaaaggtctatgtttttgcttaggttacaattaagcatgtgaagggtggcaaggagtcaaaaatggatttacttgtgatggaaaatcttttatttggacggaatattacaaggctctatgatctcaagggatcttcgaggtcaaggtataatgctgattccagcagcaacaaggttcttcttgaccagaacttgattgaggcaatgccaacgtcaccaattttcgttgggaacaaggcaaagaggcttctggaaagagctgtttggaatgatacttcctttctggcagtaagttcagattctgatagtgagaattatctcattcatacatgaatccttgagctaagacttaaaaattattcaatattttcaaatcttcacctttaactttggcctcttacagtcactacctaaggtgctctttttttttttttcagtcttcatcttgatttatgtctaaaagttgcttacaatttataagagggtagggaatgttgcacagtttccttaaagatctttatttttcactcacaaaaaaaatctttatttccttgcaaattattcgttttcccttactagtatgaaaataatcaggagaggagccactgcccgggctcagtggcaaaaacaccattaaatttatatgttgttgaatgaaattaatgttcaatcaacaataatcttgtgttggtttgcagacaatatatttaggatttagtgttctcatgcttgaagccttgaagatcatcctgtcttcaggcctgttcactttgatgtcattttcaaggggatcctctagagtcgacctgcaggcagcagtatgaggtttacaaccgg

SEQ ID NO: 29801 - DNA, 27115 bp, Oryza sativa
  unsure (1)..(27115): unsure at all n locations
ctggcatccgtataggcgttgggtttggtttgtggtactggtaacgccctcgcgtctgctaccttttcnggttacctcatgtgtatctcatcgtgctgctttcactcaccttccnncaacgccncccgnccnttttgaaactttannnnnnnnnnnnnnnnnnnnnnnnnnnnnnnnnnnttccttaaagatctttatttttcactcacaaaaaaaatctttatttccttgcaaattattcgttttcccttactagtatgaaaataatcaggagaggagccactgcccgggctcagtggcaaaaacaccattaaatttatatgttgttgaatgaatttaatgttcattcaacaataatcttgtgttgttttgtcagacaatatatttaggatttagtgttctcatgcttgaagccttgaagatcatcctgtcttcaggcctgttcactttgatgtcattttcaacattactaaattttggtaaaattgtcaaaaaaagtggctgcatttagtttgctgccaaattttggtaactatataagaaatcctgcaaaaattttggcaacttgccaaaattttggcaactaactatgccaaaatttcggcaatgccaaaatttggtaaggttttttttggcatcaaagtgaacaggcctttcgatgttttggctgtagcacctgaagctaaggtttataagttcctagcagaggcatatagaatgtttttttttttttttcaagaaagaggcatatacaatgttaacttcatacttgccgctgttgtctatttccttaatgtttttcattctcttcaattttggtagggtttatgagacaggctgataagatttattgcaggccagtagcagcattcgatatatcttctcatatgactcattaatgaagtcttgtcctcttgtagggaattgatgtgatggattactcattgcttgtgggagttgacgaggagaaacatgaattggttctgggaataattgattttatgaggcagtatacatgggacaagcacctcgagacatgggtcaaatcgtccggtattctcggcgggccgaagaatgcccctccaactgtgatttcacccatgcagtataagaagcggtttagaaaagctatgtctgcttattttattgtaattccggagcaatggatgcctgcaataatcaatccgagcaaatcatcatcaaatctttgccaagaagatcctcaaaatgcttcacaagagtagtacaatattcagttcattatgccaggcagagagcacctggttttttgtcttgatccaatcaaaagcgccaaacgatcagtctggatgctgcggcatcaatgtggtattacgactgcaattatcaaaatgcttggactctcatttgcacagatccgattgcagtggagtcgtcttggctcaagaatcatcgggtgtatatatccttgaaactgtaattatgcattagtttttttattttctttttgatttattatgtaataatataatgtcgtcgcttctctctagttcccattccattttggttggatgtaaacaatagaagtggggcattttttttttgtaagtgctcgttgtatattattatatatatatgccatgttatttatttgggggggctattgccgtctgtaataacaaaaataagagtagttcatgcaaatgtcctgcgtccaaactcttctggcaggagaatgttgaggtctggaataagaaacagaaactgccataaaagagaggccagaaagctccttctgtgtgcataacagctactgttccgcttatgtgcatatgtttggaaacaatggctatatggcttgcctaatttcgcgctctgaagaataataacttcttttgcaagacaaacgatactgaattggctagactggtcgaatcagaggtttgaagacttcagatatagtattccacaaaaataaggtttggataatttcactatcctccaccgactttatagtacaattatacatgatgggattgaggttgaaagacaatatgaacattttcatgtgtgttaccggaaaagttcatttcaattccacctgcctccatattgattcgaattgaaatttggaagtaagctattcatttttctctagcaaccagtaaccctctcccgatccttctttatgccattagataggccggtagtgccatatattggaaatccatccggttttgggttgatttatttcctccaattatcccatccactttctttctatcaagatttcaatccactttctttctatacatttctctgattcgtgtagtttatactatattaacagcagcttttgtgtttccaaaaaaaaaaaaagtagtattgggttcagcttaaccccatgcctccacacgttaactccgcccctgccgggatagtttgagcaattgncgccggacgncgccgacggcagggcggcggcaaggaaaacnccgtgnacgcaggagaaggacaaggcgctgcgtcgcgcggtgcgcgagcaccggcggcagaactgggcggagatcgcgctggcgctgccccggcgcgggcccaagtcgtgccggctgcggtggtgccagcacctgtcgccgaagctggacagccgggtcttcaccgccgaggaggacgcgatcatcctcgcgcagcagcgcgtgcacggcaacaagtgggccaccatcgcgcgctgcctccccggccgctacgacaacgccgtcaagaaccggtggaactcggcgctccgcaagctgctgcaagtgcaacacgccagcggcgccggctccccgccggccgctgccgccgccgccgccggagacgaccgggacgatgccccagtctgcctccagctgttccccgcgagggccgggggcgtgaaggaggctggcttattcgccggtgagaaggatgtggaggaggaggacgtggcgaccagcctgacgctggggttgccggtgctgtgcgaggcggagctggagctcaggctggggcctgcgtggccggccaccgcgtgaacccgtttcgtggctggccattgcgaccggcgtcgaaccgtgcatctagctagaagtttaaaggtttactatggttcaatttggggacatttgtgcgagtgcaattcatttttaattcccaaagctaggagaaatcccaaaattagctcttccaccgtgccacgtcaactactttctggaaaatgtcaccggatccacctcctgattcggccggggtaaaattctagcgtcgcaccaaggctaaaatgcagcccagtagcccaccaaggccatgtttagtatgggccaaaccatgtcgatcctcccgagagaaggcccggaattttgaactaaataattcggcctatgccaaacaaggccgaagtgaagcctcaggtccattatggaagcccataatctttagtccactcctattacaggccgaaatctaaaaccacaatgggccgaagatgtgggctgccgaaacaggccttacaaactggtatggtaagcccataaatgtaagcccgtacgtggcccacacaacacgtgaagttgggcccaagtcccaaaattccatttgacacaaccaaaacaggccctacgtttctcgctcttccagtctttctcctctttctctctctctcgcaagtctcgattactaccgggaaggccattcccagtgctccgaccggcgcgccaatcaaccgccgtcagccaccggacagccggccgccgccgccgggcgtcccacttggcccgcatcgcaacgccaccaggggacgcgaacggcggctccccaccccttcggcaacgcccgcccggggccgcggccgcatcatccgcccgccgccggggacgcccatggcgacgacgccggagacgctgcccaactcggaggccgtctcccacgcctacaagttcgcctccacctgggagaaggtcggtttcctcgcttcgctgcgcgtcgggtgggtgtgtgatccagtggtagcactggtggatctgatctgatggacttgggctttcgctgctgcagaacgcgccgctcacggagcagcagaatgccgcgatcgccgcgctctcccgcgccgtgtccgagcggccgttcccggccaacctggtgaggcgccacatctcgggattgtgtgcgatggtttgatccataggccctgttgcttgcgatgactaaatgttgtgatctgatgctaccatggtttggtttagtttagtttgccgtgctatgctcgggatagactagcccgtcaattgtacttgaaggatttgagatatttcattagttgcaacacagcatacatactccatttggtagttcagcggtagcggttagtttggtttataattgacagtacatgagtcaggtgaatttgcagttctgtttcgttggtgatgtttctgtgccactattagctcactctccacaattcaatactctagctagtgctggatttgtgatgatgtttgatgtttcaattgggtatcaaatgggtttataagtgcgttgtttttatggtcttgttatgttatttcattggagggttgctttttttaatttgatagaaggctgtattttgaggtctatttcccttccggctttatattattgcttgacattaaaacatattgctgggtgttacatcaggagaaaagtttagtgaaggatgggggtgtggttgtgccaaaaaaagaggctgcattagaggagggtgcaatggatgcagtcttggtgaatacgcatcagggtagtttcataatcttggtgatatatcacttggatgattgatcagaaaatttcggtattctatctattcaaccttaagttgtgtcaggatagaaggtaaactatttctgcaggttgagctaatacctttattacctcctgtagttctacaaatggttttctgaactggaatcagctatgaaatctgaggtttgtgcatgttcatttcttttgttagtgatggcaacttgtggtaaaacaatgattttacccctctagtttatttgacagacgaaagaaaagtatcgtctctacgagagtacattaaaggaacgtgttaaaacatgtgatggtattcttcaacaagtaggtttatgaacccttttgtttgttaatatttgcaaaatcttttaaggaacatggatgctcttatccttttcaatataacatatttaaaatatgtccattcaggtggatgacacactgaacttatttgaagaactgcaatcgttgcatttgagtgttgccacaaagacaaaaactttgcacgatgcttgcgaccaacttgtatgcacccttttctctaagattctaaatacttgcacttttgctattctttctgttatttttttggcattttgtcagattagttatttatagtgaaacttccactctaaaggactgttactctgccatgtgcacataaaccacttttaagaatgtattcaatattagtgaaacttaacagatcgcctgccttgtattgtgcagctttggtaaatttacaatatggcattttaggtgcccaaaggaaaaactcattggcctgtttgtcatcttggacctcatgttaatgatcttattagtgatatattttgtatagctcttatctactcttttagtttgaacagaattacaaaattctttgatgcagtttcaacacatatagatttaacattacaaaactgttgcattaataaaaacaaatcattctagtaatcttttgtttgtaggaactgtattatgatctacaagcatgcttcatttcatatacccctgtttgagataattttttgaccagattattgctaaggattatctactttaaaagcagggaaaaaggaaatattttgagaaataaacttaacaaacagcttagaacaagtgatctaagcaatgcagtagttttttttttggaaaacgtatttttcgaagcatgaagcaaataatccgtttcaacaatctggtgaataatctgaaaagaacagggcctaaatgaacacatgagttaccttttaactacccttttttgtgtagtattctcttagtttattcatgtcgtaaatgcaaatatatattctcattttgccatattgctggtccctcttccgtttttttaatgaagtgtttcagtcaatggactatcatttctaaattcgaatgtaatgcagttgttggagaaacaaaggctgattgagtttgcagaagcacttcgaagtaggttgaactactttgatgaattggaaaatgtaaggtttggcatccctagtttgtctattgagcattagattaataaatttgattaaattaatgcctctcctacaagttctacatctcacacaagcataatgaattctgccatacatctactttgaaatttaattgttgaacttatgtgaaaccttattcaaaatttccaacgttatctactacatcctaatgcttgcatccttgatcattttgttagttggagaggtcagcatggtctccgtggttcatttgttccagaaaatgtttattccatgtttcggaggatatatactttagatttgatcccaatggatgtcttagatctgaattttgagctgattcgtattgtcaccttgtggttagtgctaacttgtacatgatgatgagtggcttgtatttttgaagatcccactgtttgctactgttctagtatattctgtagctgcataatcttgaacatttctggccactaaccacacttattcaattctaccatccaagtacacaatgtatcctgatgatctcattcatacattatctgtaatgttgattacacaatctgttttttttaaaatcctattttttctctggttaacctgcttcatatggtttaaaatactgtctccattttgcaggtctctactagcttttattctcaaactatgaacatcggaaatgaacaatttcttccacttttgaaacggctcgatgattgtatttcgtaagtagtaatagacaatgctctgtgtgtagttttagggtgctgagatttaaggagttcatgctgtatcctgtttgggtgcttataggtatgttgaaaataatccacaatatgctgaatctgcggtgtacttggttaagtttcgccaacttcaggtaaaggtctacttgaattgaactacatggatagtcatcacaggttagatactttgacctgataattatatgcttcttttattgcagtctcgtgcattaggtatgattcggtcacatgtcctgtcaatacttaaagccgcttcatcccaggtgattttcagttgaactttggtaggtaaatgcgatatgactactaaataccagataatagcttgattttatttcaggttcaagcggcgattcgaggtaatggttcagcaaaaaatgttgttacagagggtgtggaagcatcccttatctatgttcgcttcaaggcagctgctagtgaggtataccttttcatcaaatgatctacagttatatagaaaggcttaaacaaactgtagctatgtgatctatataccagtaacacctcaaagttataactctgctgcctctggttcttgttttccagcttaaaccaatcttaggtgagattgaaagtagatcttctaggaaagaatacacgcagattctttcagaatgtcacagcttgttctgcgaacagaggttatacttggtaagatcaaacaattattggttttatattttccttttttggcatggacctgattatttcttatcacttgttatgcaactaaagatacgaggcatggtgcagcaacgaatttctgaatttgctagaaaagaagctttgccttctctaacaagatctggatgtgcctatctgatggaggtaactgcatgtttaatactttctagttttcttattttcatctgtgttgtaggtttctctttccatattcagaaagttacatcttacagttgtacacgatagcattctgtaatgtagaagaattgagcaacacattgtatatttagtttcctaatattacgtgctctgcttactcctcatgctgagtatgatgcacttatcattattatttttggcatatttattctaaagcattgaaagttcttgatttttagttttatacaactgaaagtctcggggttcacttattagtatctcaaggtcacccaattcctcattttaccatttccatccttttgaggccaatagaagttagttatgatggcttcccctcaacctgggactttcaatgtcataaaactgaattctgagcctttgacggcacataaccaattttatctaatctccagtattcatgcttttatttttctctcctcttataatattcagctgattttgactgcaagacatattttactacttttcctgttgcttctcaggcatgccaatttgagcaccagctttttgctcactttttcccggcatctgcatcagatgtttcaagtattgctcctttaatggacccactgtaagcttttagtccctctggttcttatactgcaatgtaagcatctgtaatttgttctgcaaattcgctaaaacctgactttagacttgcataagtttttttattagctaaccaacaatcaaggaataggctttagaataaataggattttcaggaactagaaattatctggatcttaatataagaccccccaaaaattcctcaggcctataccagcttcctattagtgggctagtcaagtataaatgtgtaatcgaaccttaaattcctatgttaagatgagtttacagaagatttcatcaacttaagaaatagatagaagttcctttcctaaacaagagagatgattattgaagttctgtcatacaaaaagtttagaacctatagatatgttgacattgtaaatatattttcttgttaaaacatatggaacacagattatttggttagtttctgcaacacccttgttgtatgattcaaatttatattgacgtgtgtattgtgtagcgttcatacttttatgttatcaacttttcatctaaggtgattaactgaatatctgatatgcctttgtattcaggtgcacgtacttgtatgatactctgaggcctagactgatttatgagggaagcattgattctctgtgtgaactcgttgacattctgaaggtcgaagtgctaggggaacaactaagtagacgaggagaatcagtagctgggcttcgacccatattgcaaaggatacttgcagacgttcatgagcggttggccttttgtgctcggactcatattcgtgaggaggtactatttaaaatatgccccttattggtgacttcatgtttttttttcagtcagcatgttctcgtttgagtacgtggtgcatatttcgttcatttgttcgcaaataatgtatggttccaatgttgagaacagctgtcatgtggacttatgtcaagtttgttgtagaaccggcaatgcttttggggaaaacttgatggttaaatggcacttaaaataatatattagttatttgaagtgcttgacgttcttcactggtgatctgaatgagattcttttatgagcattgctggatgttgcatgccaattacaagggaaatggttgattattgtgtcatttgaagtttttgatagtgaacatattgttagcaatgtctgcagaactagaatgaactagccatgaattgaaaactgaacttgaagatcccctgacttttagttattatttagacaatcttgagctcaggaatgaaggagacttttcttatatattgtttaatctatttcatctttttttttttgttaattttgttttcttactattgttcagattgcaaacttccgcccttctgatgaagatctggattatcctggaaagcttgagagatccgtagatgcaactacaagttctaatgttagttttgttcttagtttaatgaaagttcatttcaatttaactcttcatggtcctagtcattcaataaaaatctgtcctaacagttggttcacacacagttttactggctcagatgtgtgcttaagatggtactatcagttttatagattttgtaatttcttcactcccttatgtgctaacatcatttttctccatgctgtcatctgatgttaaacaaagcacatgttgcttataactgaatccagttttaatcacgagcattatgaattatcagtgtagttaaagcattaatctaatttcttatgtttcaatctgtaggttagtggcaactcggacatatatgtgacatggtatagaccactggagaaaacagtgtcttgtctgtcaaagctatatcaccgcttagaacctacagtttttactggattagcccaggtattggacctcttaaagcttaagatattttctgttgttcattgttcatttcttgatcgaggccatggcatcgaacttgacatataatttcgattttcaccaggaagctgtagaagtttgctccacatctcttcaagtctgtattctccttcccttattgttcatgtcttaacaagatctaaagaacatgttttatgtgttgaactgcactctttgatattcagagcgtatctgtttgatcctgtgaacagaatgcaagcaaggtcattgcaaaaaaagcaactgcaatggatggacagcttttcctaattaagcaccttcttattttaagagaacaggtgatacaatttgtacagtatgtcaagtcaaaattttatagcatgcataagtccatcgggcaactcatgtggtactatacatgttttcagattgctccatttgatattgagttttctgtcacgcataaggagctggatttctcccatttgctggtatgtgcaactttgttcttttcattttgagtatgaactgcttacccgttgcataaccatgtgtaccattttttacatgaagcttgatgtttgaggaagttatggattggttttgcttgtattacatgtatactgttcatgctttttacggaaactgtttcacatgttcacctttttttataagaaaaggagtattcacttgttacatgcatggaaagatgtcgttaaaactattttactgatatataaaaaatgccagtatatttgataactcttgtcgccatgaaaccagacttctaatagaccatctggcaacaaacaaattacttgcgttttttattgctttcatcagctgtttcatatttgtggtaagaacacaaagaatcattagtactagatgtctccgtagacaaattcttattgttattttctcttgcgcccatataacaaatggcatttgctttcttttctcttgcccattcaccagatgaataagttgagagatttctttttgcctgtagtaagatataaagtaggaaaaaaagtaaaatgacctccctggctcatcagctgagacaaagatattaatgtctattgcattctatcaaattaaactcatgggttggtcagctgaacttagcaaacataaggtgctatccctgaaatataggtgtcaagtactggtgtgcggtcttgtcctcataaatgatacgttgacaagatcaactgttacattctagactttatttagagaactttctaattgtattgatgtttgtcagaaatctttgtaaaatgtctgaagattctaattaggttgccttgtttcgtgatgaaccatttgaactatctaatattctttgaattaattacctgaaaatcctcagtagaaaggttatgttttatttgctagttacacttgtgctcccataaaaatgcataccgtgcacatggtttgtatccaattaactaattgctgcatataacaatgtttctttttacaggatcacttaagaaggatcctcagggggcaggtctcgttatttgattggtcaaggtcaacatcacttgctaggacgttttctccccgtgttctggagaaccaaattgatgccagaaaagtaaccatcttgaactgatagctgatagttatttctttttggcctaaaagtaaaaaaaaatgtttatgttaatttctcattagttgatctcataaattcagtccacattgtgaaaattaaaataagtccaaacgtgatgcggctgttcatacataggacttgcacgtgcaacttcacatgcataaaataaggcagcagtctaatgtgattgctttgtagatgcccatatcctcgattttttaatattttttcagctaattttgttactactattttttcaggaattggaaaaaagcctcaaatctacctgtgaagagtttataatgtccattacaaaattagtagtggatccaatgctttcttttgttactaaggtatggaattgacctcttttcaagtgagaaagggggaagcctttgcagtagttgactcacttctcaatccattttttcttttttctctttttctgggaaaggctcagttctcactttaaggcctcacttgccattggcagttggcaccctttccccgtgaatggataataagggttttagttcaaaataccagtccacgtatggggattggctgggatttggcccatgccaaatgaggccaaaacctcttttgattctttcagtttgtccatgcagtattagggttcaattccttaatgcaatgtttcacagttctcctgcgatttcgagaacagaagtattagggtccaattctaacatccctttttgggatttcgaaaatttcagattatgaacctgcattctagtattcttttcaaaaccgaaaagtagtttattctaatggagatgaacatgattgtctgggccaggtaacggctgtcaaagttgtactgtcctcgggtagccagggtcagaaattggattctgttctggctaaaccccttaagactcaagcatttgcttctcctgataaggttgcggagctggttcaaaaggtattttccaagatgatgcaagtcagatcatgcttctttttccatgtatttcataaaaatccctttttgtaggttgggactgctattcagcaagatttacccaaagtaatgaccatgatgaggttgtatttgcaaaatccatctacgcggttgattttattcaaaccaatcaagtaagtatttacatctccacagcatctacaaacctatcttttgttcacgtctgctttttacataatatcctggtgtgatggcttaataaataatgttatttcaaaaacaatatctcaaattaagttcattttgccagagtgatcaatcagtacaatttgttgcctataagaaatcttatacataaataattcatgtaaccctatcccttaaaccatacgaggtgaaagagaaagctatcatgggcaagctatcaccagttggtcactaataattttttaacctagagtgcattatgatgaatgtgtatacatagcatgtctgatttctctagttgacttcttgaaggatggacttaaatatcactgggggcattttcatcttttaactaccacaaactttttccctctcaagtccttttagttgagcaagctttaaccttttagttgagcaagctttaaacttaaaatcccactacttttacaaattaatgtagttctatatttcagccttgtcaattcttttggtacattttatgtgtaagttatgtttagcgtcagaatcttttatctgagttcctcattgatcaatttatcaattcagtgaacgtataactatcatttggtgttattcttctttacttctaatgatttggggtgtaaaaaattgaactttgtacttttgaagaaacattaatccctctgaaatggattagaactaagctgtacttagatgtgtgcggaactaaagaaaatgttcaggcatttctgtacttgcaaaaatattgctcttctctgtatttgttctaattccatgtttgtctcaggacaaatatagttgaggctcatatacagctacactcccttctgaagtcagaatacacagctgacgaaatccaatcaattggtatgttgcctatacccgacctccagtctcagctcgacgctcttttgtaaccgttatcaagatgcaaatgcgaccctacgttttgttcgttgagacggtaaatggtatcctgaagtacagtaaccccgttgtaccagagtgatcagtgatgttgtaaaaatgtactatgttactgtggaatggagcatcattcttgtgtggaggtcagtgtgcacaatgccatgcttgacgtgatgttcccactgggccagcaatggcgggtccgtgattgcgtcttttcagctaacaagttactgtacacaagtggttccgtttggccgaggataaagtgctggaccaccacccccaacccctgcagttgtatcgtgtgatcacactttaatttcttcccttttaatacacctgagattgctctgtcttgtgattttgtgaggcctgccgattagcgttgcagttcgcgaatttctccggccagaacacctacggcggccggcggcgtcggccattttcgccggtgtgggcgagcaccggcgagccggccggagaagaagcagaagcaggggcatgggtattctagccgctgcaacggaccagcctcgaacccatccgttaccacgcaatcgggaccctacctcttggctcttgtcgcaatccagctcgctctcttttcagcgcgacgcacgctgggttgctccctcttgctgtcaaccgagctggccaggatatgcgatagaactgagcacgttacatgctcgatatatcagcttcgagggcagcaaaactaatcgcatcacatcacatcgcattcattatgtgtgatctgtgtgccagcttagatgctaagccctctgttctaaaaaaaaaactcaacttaggacaactcaacatagaacaacgaatcctccatcccatagaaaaccatctttcgaggatgaatctaaagaagtatctgtctaagttcttctctgaaagttgattctttttggaacggagggtgtaagcgtacaaccattagcttcatctctgaaagttgattctttttggaacagagggtgtaagcgtacaaccattagctaatcattcccgataagacatctttcattttgagcaatggcttgctcactaatccctcatattaaaatatacatttcaaaccttttgttttttaaatgttaaggatgaaagaaataaggggtgtctaaagaacgggaggataatagggggtaagattaagtgaaaattaaataaaggatgattggtatagactgggcagtaacaagttagatttggacacattttagcatggtgttgtgatggtgctaggttgctatattctggaacggagagattagttgttagcaagttggtgttgtaagctttcttcagttggcgctgtttgaagtgctcggcgaggtttctgttgttgatgtggtggtttgttttttctttttcttgtcactggtctcggtttttacttttacttattaaaatataattggtagttcccttccggtttattatattatgggacggatggagtagtaaaagcaatttgttgtaaaaacttgtccgcaccaacagtagatggatgtatttgcagaaatggaactttactctttgccacggtcacttgcttcgagattaatagctcacttgttaacaacttatcataaataggttccgtttcattagcatacttttcaaactgctaaacggtatatttagtgaaaaaattcctatatgattttttttaaaaatcaaataaatccatttttcaagtttaaaataactaaaactaaattaattatgcgctaataagtttctcgttttgtgtgtcagtacttgatagtcttcgaacggggccatatacgttataagcccataaatattaccaaaataaaaatttataccttcatctgatctccggtatctgaggggagttcagaggaagggtggtaattgatcggattaaacgtacgtagcatggtgacttgtgtggctcgtatggatttgaatatacgatagatatttttccggtgaggacagagagtgacaagctcagagaattcgctagctggaccaccctatatgttaatgcatcgatcgcatgagatgaaatgattaaatgaaatagtttgaaaactttcgtcgttcaaaacttaaaaaggcaaaatagccccatggatggatactgctgggaaggtgactggcttgtggccccacgtaaccagcgactagtgtgccctacaggagaaaaacgaaatgctggcacggtcgacgtagcaaatcgaagctttgcttggctaagaacgcatcaaccatctaatccaagtcgccctcgatccgtttaataagagtattgagaccaaggaaaaatttttgtttcggaaaagtttatagattttaccttgatatatagattagtatatgttgaatttgatggtgcatattcaggcgcatattcattttagcctggaaaaagaaacttagcctgcaggtcagattctatttaattttgtatgggtttgtgtacattttcaccaatttattgtgattctatatgggatcgggatttaaagggaagtctgaggcctgtcttaattaatctatgattagtatgtagtgtgacatgaaaagtatcacaatgtcggctttaatatacagggtgattgtgttagcgattcttatgtccaacaaaaaagagatcagcaaatgtacatatatgggtgaatttttttacttaggaatattctaaagtattgaatccatgagaaacgcaagtgcacttctccgatcaatccttcggtattttgaagttttcttaaacaaggtaagagatagttttgtaaaaatacaggtttaacatcaatttagtccaaaacttgaacgttaataactcaaacataacatgaggatttgaatcccaaaatctatagttttataataattttattattagatttgtagttttgcgatacttagtcttaaacctatagttttatgataaatttattattaaatctatacttttataattcatcaccttaaatatatagtttgtgataatttgatcaaattatctgtagtctttttaggaaaaaaactacaaataatttactcccttatttatgaaatattttgtgaaagttaccggagttttgtgaaatttactttcttatttatgatctaactttacaaaacatgttaaattaacaaaactcctgaaaatacgagtttaaggaaagaatgtcaggataacatgttgtcttctctttatttattaaaattttgacagacgaattaggatttaacacaaccgccaacacacaccatgttgaaccaaggttgtcagtatcccgattcgtattctagtatcttacgatactacgatcctatcaagccgaaacgataccgatcccacctagtatcctaattttcatagtatctcgatcctactattaattactacacgatcctacggaatcttaggtggtatcccgattctacgatccctacgatactacaaaatattatttaaaataacatggtttgaaaataatgtaactaaatatgctcaaatttatatgaaaatcagttaaatatatcaaaatcaacgtggtttctctttaataaatgtctctatttgcatgacatataccattactacattattttatatagaatggctatatataattaatataaatattaattaaacttaaaaaaagaaaaatctcatagtatcccgatactacgatacgatcctacgatacgatattactttgagcaaaacgatactacctagtatcccgatcctgataaccttgcactgaacattgcttgtcccgagcaaagctaaatgacaagggtaaaataatattaatacattcatagggataagatgtgaatcttacctcctatcaaatgattaccgaaataaattatttcttgttttttgcatttgttctccacttattgtttgatcacgttgactaatccagagaactactgacactgtaacctgaactttaaattggtggacaaaagtacatgttcacctgtaaatcatggtcttgccgtttgcagccattggctcaacaggtgaagattattgaagagtggcatccacttggggggcacgacacgaggttcttgagtttgcttactgctgagcacagaaccaaatcaaccaaaaagaaaggaagatattgaaaatgcttgtttgtacgacttttttgacctagcttggtgtcaaaagcactaagctaggcaagagagaatcagataactaatacacaaaggacctttttttcttatcacctacttgcattaagcatgtaagagtactaaccagtagccagtagaccttgctcaaggcttgtttggggagcttaagattctgagaagtagctggttggtagtcaacttttaaaaatctagaaaagctgggtttcccagcttttagcttcgagtgatcattagaagctccccaaacatgccctcaacagctgaagcggcatcactgatcaagaattggtttgccaatttggcttcttgtatgcacttactactactgctgtgtacgactgtacgattgaatatgcatgtctttttttggcttcgcgtattggaattatttactcatgatctaatagcttagtttaacacaatatcaccaattctaagattaatgtggaatttcgatgattaaaactgactggttgaattgaagccatgatcaacttattttgtttttccttcttgattcacctgcgcggaagtgaattgcattacgaaccccttccagtgctatgagatcaatcaggctctctttagagtttcgggatttagcataggaattagtcatcacttgttctcaacgccttctccttcttttatatgcgctggtgagggcttgggggcaatccggataggattatgatttgttaccatctatgattgtaacattttatctcttatctcttatttcttatttgtttcttccctgttagagatgaaaacattggaattatctcctccctaattatatcagtagggaccgataaaatcaaccaacatcatgtagaacatgttgttggcttgtttgacaaggctggcagcacttcacacttatcaacacatatataatacttaatcaacaagctataaaaaatgtacatgcatagggttatatatttaccatatagtataggctaatttacataattcttccactccgttatttctctctactcatcgacatgtaaaatagggacaacatgtaccacattcaacaggaaatcccccccttctgccccaatttcaatcaggttttggatggctcggaccattttaagattcgtgttgctctagtaaaccctttcttctcaccctaatgcctctcctccccgatgtgtgcgtgcttgtgtaaaatgtcgttgccacctcctcctttcaccccagcatccaccttgttagtgacctaaaggcacaaatgacaccgatgagacccgccataccggccacctctctttcctctttctccccctccccacctttcctcctcaagctagacgtcggtgagatgcctccgccctaccatacttcccgtttccaatggctcccttgccgtccccgccttataattcctttcttttccttcgtccccgcttgtgatgctagcccgctaccctccttcattccagtggcttcagtgttgctaccggcgcctcgctgacgcccattgccaggccggcgtctttcttaggcgccatccctttaagtctagggaaactccctgttccccctccttctacctacattccaccctcacctcaacttaagaccctaactagctagcgttatcgtcgccgatcatcggagttggaggagaaacctgccgaagcaagaatcgtgaagcggatctaaaggctagaaatttataaaactttattttcatttttctgtcgagtatgatttagcaattcagtataaaatatgcacagagacccctctctcgttccctccgcgtgttaacatcgtcctcaacgactgtacaacttttctttagcaaggctagctattatcactttatccgtgttcaactgttcatgcatagagcatcatcatcagcagtggccagttgcatgtgctgcaggtacaaagcatcttcgtgttctacagtggccagtgtacttacaggaaataataagacagacgtgttttctcatcattgtacctatgtgttgcgcatgcatagattgcatgacatgcatgtgaatggatcgatgcttcacatatgtgcatatggcacgtccactgttaatttctagctaggctataaaaataacaacacaaattggaacagtcgccatggaatcaatttatgaatcgcgtgtactgcttgatcgagcgcatcttaatttcctttagtttgatctttcctacactttacaccagatctggtacttccaatattcccttgagaatatatggaggccaatatataaaaaaagagtagtctaattaacacatgcaaaaattaagctacattgagaatgattgaaactataagataaggtctagcaactatataataaattaaaaagtaattaatcgtagctcgatcaactagttagatatctagtagaggaacctattcatttgggttgaagttctagacatgatacgagtgctcgtatttataattaattgttctttcagtacccatcgacacgacatcgaggcgtctacgatgactttacaaatctcaatatatcactagtacataaccccctgtagctgccgtttgggaactggctataggggtgtcggtttcccagtcggtacctttgcctcattcttatcggtgccggttctaaaaccggcacatatactattaaaaaataaaaaaaaacgatggcacctacactaccggcgggcttttncaccggcgccaccaccaccttgttcggccttcacgccaccacctagccgtgcccgccttcgcactgccacctcgccacgtcggcctccgtgccggcggccgccacccaacgccgcactggaagaggggggaggtcccctgggagagaaggggccggcgagatccagcgaccgcgccgctacctcgccgcgtcggccatcaccccacgccgtgctagagggggagaagggaaagggggcgaggtccctcgggagaggaggccggcgagatccaggcctactccaccaccaccgtcgtcaccgccacctcgccacaccagcctttgcggcggcctccaccttacccacgccaccgcgaggagaggaaggcaagaggggcgagcctccgggatggatggatagagctctcgatggtaaaaatagccggctcggttctattaaaaaaccggcacctataatataataatataggtgccggtttttttaatagaaccgtcacctatagtgtttaaattttttttttatcgtgcggaggtgagaaaagactcataggtgtcggttttaaattatccgacacctataagattggtccctatgaggtttttttagtagtgtatgttggtctttagaggtgctttcataggagtagagtgtgcgtgtgtatgtttatagaggtaagtgtgcatgtgtttatgtgagtgtatgtatgtgtatcgtgttttgaaaaaacaacttataattgattagtttgttttgttgacggcacgtattaccagcgatggttcatgctcatgcatgcaaacacgatcgatatattgttgattcgtgcaaacaatcataaggaactttgtctgcccgtttcggaacatatcctgagagcttttccatatatatctctgaatgccaattcaagatattgctttgcatgggcagcaacagcaaggatgccctccttgtgagtttccccctagaaaacgacatttcgtatctttacatttgtcatatattgctctaaagtgaaaaatatatatataatattgtctccatctctcacatacgtagagatagttttttttttatttttgaaaaaaaaagatcttagagataagttggaaatatgtagtaacaaacaaaataactccattttgaaagggaaaagcgtacgcacgatgctttttgtgcaaccatgtctccatttttcatggtgaaaaagacatccacaattattgagattccctcttttatgtattgtacacgagcaggaaacacgttgcttgaggacaaaatattatcgttgctgaaatattttactaagcttgggccctcttggaccactttgatctgacctcaatattttcatctactcctatctcacactcaacacacggttttattcatagggtctcttttcatgtgcacttttgctttggttgaactttttcccttggtaataacccattttttctctgttttcaaaaaggtttcacttgtgatttaataaataatagttcagagaggtgaacctaacacatcaaattgtgaaccaattaactaaatatatgcacatctgatagagttaaatcctctatacaaaaaataatgttaccatcgtatcaaaggaaaaaaaaacttgataggttttagagagttgagagatatccgctaccgcgaaagcgattttcgtagatcccctccccttaatttcgctggtggcataaattggcaatgtatgcagtacatatcatttgtacctttcaccatattttcagaaaagataatcagttaataaatgttgagagcataaactaactactactaacctaagtagcaaaactatagacaaagagtatttaatagaatcgcaaattgtttctgtccaagattcaagtttgtgcgtttagctttcttttaaatgtcaggtcaatgaataatttgtttccaaaaaaatcacgcgaatagagctgatcagtttctgaaatttacccaaattaattaactcagtcaattcaatgcaattatgcaaatcattactgtgggtatgttgggtctactagaggtaaacagcataaaaaaaatcaatatgtaatcatttttcctacaagaagacacaatggtcctcatttttcttgtacacgtcaatctttatcagtagtacgaactccaatttagacattctttgcaatatatacaacatttttataggatattcataattcaattcaattacaataggaatatatcaagaaaatttctcacgttccaaagaagccccgaagaggataaggattccaatgaatgacataatatgttcatccaaaagtgttcgacatattttattatttggtttcttcaaaaattaagatggtcatatttgtagtttctatgtgcaaattagttgttgaccgaaacccaaaattttttttatacccattgattacaatgcatacgtaaagtttctttgttttattaattcctccttaaactttttttttaaaattacacagtacaacgcagacactcacaacgcacgcgcactcacccctatgaacgcacgcacgtaaaccctacccctatgagcatcttcgaagactggaccggcaaatcttggagagattgacgaagtcaccacaggcgcctcgctatcgacgggtacatcgcctaccactgaaagcacaacatcgttaaatcctggaaaattcctccttaaacttgatgactccttatatggacagttttagagagagcatattacaaccttataccatatattgggccccaatctcaatagaagattcttcttctatagatcagctactattgagtcatatggaagcagtgaacacaaaataaaaaaaaaacatattttgtggacatggggtggttttaaatatccatcactcctctccccttcacttcccctcatccttccctctcatctcctaccgccacaaggggcgcctagctattcggctccaagcgtggtggtctcaccgcctcacctgaggtgaggtgattccacccgccgccgccggcagccatgcttccaagaagccagagcatcttccacctcggcgaggagggtggcgtcgtccactgccaccgcggcggtaaccacctcgtcgcggcgtccatggggatgggcggcgccggtggacactacggctccggcacgcgcggcggcggccgccgcgcgcgcgagcgcgagcgcctcgtcgtcgggctccagatcatcgtgcacagccagcaccaccacggtcggcacgcgcacgcgcacgcggcgagcgtagtgctcaagcagatggtccggccgcgcgccgctgccgccgccgccgcagggcgccacggcgccgtctcgtgcagcttcctcaaggcctgctccctgtgccggcgtgagctcagccctaccaaggatgtctacatgtataggtaccaaaaacctaacaaacctcaagaagacatttatcatgcatatgcatccatgcatgaacatgagaaaaatgttttcatcctcgagaaaatatcccttcgatttttacatgtcatctaaatagttattaatttttttttaaaaaaataagataggttaatataaaatatatcactctcatgtacatatatgataatctcgtgtacatgtagaggtgaccaagggttctgcagcgaggagtgccggtggcagcagatcgccgtcgacgaggcgcgggagcgggaggcggtggcggccgcgggccggccggagcggcgaggtctggctcgccaccacagccctcaccgtgcggcggcgcccgtccgtggcaggccaaggaagacactagccgtagcctagagttattactatgtagtgttaaagtacttactgagaagaggagcacgtactactactgttcatggagaactttgagaggaagttattagccaggtatgtcaataacagaaggactttgcatatgtgtatgcatgcataagaagaagaagatgtgataagagagttaatttgagtggtaatgaagagaggttaatcatggagtagtagaaaggggttgatcagaatattgggtcagtattttttgtttctattttttgcgtgttgtaatcctagaagggatatgcaacttgttgttagatctgtgtgtttgtttgttatacacgtacgatccgatatggttgattaattatattctggaaggttgcatgcaagaaagttaagtggagaacaataagagattctgtgtgcttgactgcttgttgctgtgtgattcgttaggtttcagttgtgtccaacgtgtaggttctccctgtaaacactagtggttaaaaagggtgccgaatttgatgcctcgctatggaattggggaacaaaggatggacaattctgtggcatccaaacaacttgatgggaagaatcaatgtgcaggcgaaaatgggtttctttttcagatagtacaaactacaaaatgtgagcagaatatcacatatatgcgttcgtggaagtgaattgttcggaatgttggaagaaactagaacgacgattaggcccattgttatatttcatcaaatacctatacaatcgagactcggccaaacatctttagcggtgtgcatagtaagatgaaattggggaacaaggatcgatggacgattcggtggcatatccaaacaacttgatgtgaagaatctccgaaaatggccgggtttctttttcagatagttaaaaaactacaaaatgtgagcaagatagcacatgtgcgttcatgaaaagcgaattattctgaattggaagaaactagagacgattaggcccattgttatatttcgtcaaatatctttagcggtgcagtaaaatatgcaaatatttttcattgggattaccaaactatatccctactggaattagatttattatcatcgatctatcgcggttcttaaattataaacacggatcattaatatacgacttgctaaaaacgtcatatgttaatgacctaagggagtataagcgtataacttagagcatctccaacgtacatatcgatttatctcacagacaaccatactcaaattaatactatataatggtgggacccgtgaaacccacactcagcaaccatgagtattttccggtggaatccaacagtgagctcctttgcatttgtatttaagtaatggatccatgattttttttatctcttctgttcgaatcaagaagcctgttcgattttatgtgtcagcatgattagcatgttgcagtgttatggttcgattttttagcacactgtagatgcttttagccccatttccctcttaaaattggactaagagcatctgcggtgtgtcagaaagggattttatcatcttccatatcactgcccactcccaactacattcctttgtgccacttctttttcccatcttgttggcacctataatattgtatatgtgtatcctcttgttgtcctgtactaacattggtttgggcttgcaatccaatccactagtggttccaagttccaacaccatatgcttggctgcttgcttggccatccccaccaacattgtagtaggattttacctcaacaccaaaacaaaataagctgatgaggtcaccaccatgtcattgtcgccaaacaataaaatttgccaagcatgagttttggagcaaattcaaagcgagtacatgttatcaattaccattttttaaaaaatctttccagaccatctagcattttttttcaaacttttacaaaacattatattatactcccttcgtctcgaaatataagccgtataagatttttatatggtcttcacgattatattttgaccattagttcctttcataatatatcaacaagtattataactatgcaaagcactttcaaaatcgaatctaatgataccttatgcatctattagtaaggcccaattcacaatccaaggcccacctcgagtttagccggccctttgtgcttgaatgcttgtgctccaagtcgattcggatgatgcgccgcattgttcgtctccgactcgnnnnnnnnnnnnnnnnnnnnnnnnnnnnnnnnnnnnnnnnnnnnnnnnnnnnnnnnnnnnnnnnnnnnnnnnnccatngnccaaggggccata

SEQ ID NO: 29802 - DNA, 1056 bp, Oryza sativa
  unsure (1)..(1056): unsure at all n locations
tagtaagacaaagagggcaagcggccatcctcccagcaagctcgagcgatatgccggcacaatggcgtcgcggcaagcgagagccctcctctcgtcggcacgggtcgccggcgctggcatcgccgccgtgagctgctgctgccaccgctccttctcagaaagcggcgtcngcgtcggtgagtcagcaagagcctgctacgacgcagtcggccggcacgacgtcgaagctgcaggcggcggagggagcccccgccgggagtaaggaggggttcttctggatgagggagcccaggacggggaactggatgccggagaaccacttcaacgacgtcgacgccgccgacctccggtcccagcttctcttcgccaagaaaaactagctagatatgccctagatcactgatcattggagccaccatcaagatgatgcacatatgcaagcgcacacacgaacgcgcaccagaagtcttcattgtgtgttgtattgtggattaatcaccaagtagcagattcttcgttgtgtttttgtgtgtgtggaagtagggattaatcacttcgttcattgtgcttttgtatgtgtgccacttcattgtgtaagcacattttttattcaaatttctgtgttagtttttgtgtgcgcggaacacaatttgaaatttgtgttagttttttctttttgttggttcaaattgtgtgcggaacacaatctgaaaattgttggtctgtttgtggaacacaatttagaatcacggacagagcttgcccagtaacccgatcaagaaaattttttagctacaacttatgtattttcatcatatgtacacccctccaatccaaactcagacactcatatcagcctaaacttggtctaaagtagagtaaataaagtaagtgagagtagcacatctctccatttccttttagctcttggtctaaaatagagtaaagcaaacgagtagcacccctctctatttctagaatcgcaatccaaannnnnnnnnnnnnnnnnnnnnnnnnnnnnnnnnnnnatagatttctaattcaaannntgcccac

SEQ ID NO: 29803 - DNA, 1317 bp, Oryza sativa
  unsure (1)..(1317): unsure at all n locations
gcccgccgcggaattgatgacactcgcatnnnnnnnnnnnnnnnnnnnnnnnnnnnnnnnnnnnnnnnnnnnnnnnnnnnnnaccagtcttttccccacgccggccaactcgcggtgaggcgcccctgcccctcttttggccggggtttcccttctaaagccgtgcccggcccagccgccgcttcagctgtgggtcgccgccttcgcgccggcgtcattcgccgtcgtttcccacgcctccggatgccgtcgtcggggaacgggcgtgcgcgccaacacccttgacataaccggtcggccggttagaggccgagccgagccgaccgggcgtctcctcctccccttgagccgccgctcggtggggcccgcttgccagccgcccctctctctccttgagtcactgacccgcgggtcccgcgtgtcagcgccacccctccttgtgctgacgtcagccctggggcaatattgcgcaataaatgcattaaggctttttctttattagtaaaaacacagataatcttctaaaaatcataactaattcatccgagctccgattaagtccattcaagtctcagtaaattcataaaaatgtatagaatccataaaaaatggttttgtttcctgtttcagtagtcttatagcatgttttgcttgtgtgctttgtttgtcgcgtagatttcgcccgtttcgtcgattcgtggtttctcgaagacgttgctgtggttccatcagtgcgagagcaaggcaagtcatacattgcaattgatcatattgtacccaatttacaaatgtcccgcatttctattaaatattgcactgttttacaatatcatgtgggattggtcctattactcagctatatgttgtttcccttacgccattgataacttgggtattaaaatgactagatgttggtttaggagatgcttagccatgcttagttcaactagtgcacaaaaggggatcacactaaagcataggctttgattattagcaatagttttggaatagtgccaccgcaatagggttggttaattaaaatacactacatggtgggctgtgggtgcatggttttgctagtcgtgcccatggcgattaaggaccggttcgcgggatgccctggaagaacttattgtacttaccacaagccagcgtgggcaacagctgggcttgtagtgtagcttttctctaaccgacgtacccaggcgagggtgggcgtgatggagttgggtcggccggggtgtccggttgatcggcttccggattcaccgcggcatgaaaggggggctgnccgttgccttgctgggacgggggcgg

SEQ ID NO: 29804 - DNA, 732 bp, Oryza sativa
  unsure (1)..(732): unsure at all n locations
cggggaattgattgcgctcnnnnnnnnnnnnnnnnnnnnnnnnnnnnnnnnnnnnnnnnnnnnnnnnnnnnnnnnnnnnncaactaaaaggttaaagcttgctcaactaaaaggacttgagagggaaaaagtttgtggtagttaaaagatgaaaatgcccccagtgatatttaagtccatccttcaagaagtcaactagagaaatcagacatgctatgtatacacattcatcataatgcactctaggttaaaaaattattagtgaccaactggtgatagcttgcccatgatagctttctctttcacctcgtatggtttaagggatagggttacatgaattatttatgtataagatttcttataggcaacaaattgtactgattgatcactctggcaaaatgaacttaatttgagatattgtttttgaaataacattatttattaagccatcacaccaggatattatgtaaaaagcagacgtgaacaaaagataggtttgtagatgctgtggagatgtaaatacttacttgattggtttgaataaaatcaaccgcgtagatggattttgcaaatacaacctcatcatggtcattactttgggtaaatcttgctgaatagcagtcccaacctacaaaaagggatttttatgaaatacatggaaaaagaagcatgatctgacttgcatcatcttggaaaataccttttgaaccagctccgcaaccttatcaggag

SEQ ID NO: 29805 - DNA, 4414 bp, Oryza sativa
atgatctcgggtgcttttatgatgacggcttactcaccgccatccgtgtgtttgctttgaatcttgagacattgtcatggaagagggtggagggtattggcaacgaccgtgcatttctcatctctggaacttatgccttctcatgtccttcaatagaaggtgtattgcaaggaaactgtgtttatcttgtatggtcaagctgcgacagtgagaggctttataagttctgcttggatgacatgaccattagcttccatcaaattcttcctcaacctacaaaatcctggtcccgagcattttgggctattccggcaaggtgagttatatttctaatatatgcttgcatcgctaattttatttccaatctatgctcacattgctaatttttagcattcaagcttgcagtagttaatttttgtttccagcgaaccatgctttactgattcatgtataattgttcctaatatccaattacagcacccaatcaatttcaatgccacaagaatcaaccattcctaataatcttctatggagaaaggtttgtaaatccatgcaaagcatgttacaatccaaaatattattcacgttgtactagctagcaaattgtaactaaacctcttgtttttacttcttttctagccatcaaaggataatccacccaatgattttgatgaacacaaagaggacggacaagaaaattcactgcggccatgggatcacctccctgtggaattgctagagttaattgtctcaaacttatccttggtagatcgcatacgatttccaactgtttgtaaggcatggagtgaggtgttgaacccaatagagcaagcaaaagtttggccttggctaatgcacatctcaaagcaggatgggacatgcaagttgttcgatcctctacgcagtgagaattacaacatacaagttacaatatttgacacaaatgaagatcgacacatttttcgctcctccaaggatggttgggtactagcatcagccgggatctatggcaacgatatattcatcataaatcctttcacagaggagattgtggagccccctatgcttgcgttttatataactacaacggtgtgtccgtctcatcgtcaaatccaatgtgtttagattgtgccttttttggaatcaacagcagtgacagtggtaaatttctcagtacttttacatggcagcatggagagcctcattgattgagcaagagttcgagtacaatgtgtcgttcccagtagggtacaataatcctgtcatgttcgatgggaagttctattgtctcgggaggaagggcaaccttggtgtctttgatccaacaagcaatacttggagaattcttgataagccagagcctatccatgtagagatggatctctttgaagaagaccacataggaagagagttctgctatttggttgatatggatggggagttgatatctgtattcttgcgtaatgctaatgagttgcctcgagtgttcaaacttaaccgtacagagatttcatgggttgaagtagaggacattggtggcggtgccttgtttcttgattacagatcatcatatggtgtagcatcgccagatggtggcaatggaaataggatatactttcctagatattcgaaggatggaaagccggtgttctatgatatgaacaagaagacgtactctccatctttctatggtgtcatagagccacttaactgcgtgtgggttgtgcctaatttgcgcaagaatgaatcaacatccgaggattaataaaccacatataacaacatgtgatatttactttcacatttttccttttttcatttgtaaattgtcaaattagaacattaaggatctgtattttaagatatgtatttatttttctaccttggtcggatttgctcttgctcctgaaagagagaacatgatgttttgtacgttctgcggatgatctctctgctaaggttgcacccttagcaggttgacaacttgttaattagatggtttaggttgtttagtgatatgatctccttgcagcagcaacttttatgctgagagtatatcgtaatagtagtttgccagggtgtttatgctctgcctcgccctctgcattttggaatcaaaacaccctttcctgaaacgcagcgctatgtcctttgcaaaacgttgacacgaaaaaaaaataacacagaaatgtaagggatgcaactaagcgagcaaaatgtgagttaaacgaaaatgtaagggaacccatgaagaaaataagctgcgagagaaattcacaggaggaaggattttgtgtatcatccctctgcaaacatttacattaggcccataagtcaattggaaggcgtcaattttgtaccatgcatctcacaattattgttttgagcttcaatttgtttcaacctagattttcaatcttatatgaaaatgtaggaaaagatgtcatcatagatctatgcattatgcctgaagtcaatagatcacattattttaatgagccacacaattctcagtattccaatgcaattcaacctcaagacagaaaaaaaagtcagctcacaatcaggcttatattagaacccatatcagatgggtcagtaatgattcgtgtagaatatctgtcagcgtaagatttcatcttgtacgcactagcgcctgtgcttcgctggctcgctgaaatccatatccggcaggcggcagcagtatcatcaagcaaagacgcaccgtggagactatgcataccatatactcgcacagacagtttttccgactaaagataggaggtaggccatatccgtgtgttatgttaatagaacaacagcatgcgggttcgagacaagaaaagcatttatcctatttcacaatagaaaattcgcaagcatgtagttattagctaaatccagtaaacaaaaaggaatcagcagagcttagatctacttgctgcaagtgtggtccatgcagattgtatggagtaactggcaacttgtgggagtaatcgataactatcctagaagagaagaccttgaacaacctcgagcacatgattttgtaatctaacgacctgggatcttcacgattgggatcagtttggtcttcatactcaaaggttggcttggacatctcttttataggaggcagtcagcatttgaggaaatgccgagtgacttgttcacctagcaaaccggttttattcaaatcgaggattttttataacaagatattgaccttagtcagctcttggtcctcaggcgagaaattccagtgagactggtggatgggtgcaagaccgataaagtcgggaaggctaggagctagattcgagatgtaaaaccaatctgagtgccaacttttatttgaagattttaaaggaagtgaaaaataatccttgcggagagctccgtacagctagaaaccagagttgctgatggcacaaggattttctttagtcagttgggctttaagataaagcattcgacaaagtaaattgaaatgaggtcgtattccatggaaagcttcacaaagatgaatgatgatggcaaggtgcaagatggagttaagttcagatgataaatctaaatcccataaaaatccagaagacctcggaagaatttagaagtgggaagaccaaaaccgttgtagaagaaaggagtaaataccccgattttgccagtgttcaatgttgggaactcatagccgaaggctgggcaccacccgataatttccttcgctgggatcacgccttccttcaccatatccttcagagttgattccttcacagagatgccctattgatcgaaggggaattctctctcttccgccatgaatgaaatggaggagaacttggaatagaattttttggctctgaacttggggatgggagatgaaaggaggaagcccgcgttggattttcgcggaatctagagcacttggattttcgcagaatctggagcgctttgatggctggatgtgaggggaagctttgcccaagttctggcggcgacgacggtgaacaggagcgtgaaagggaaaatttggaagctaaagcggcgaggaagatgatgaagcggctttggtgattattttacgggtttcgttgaatagctctctttgggctgaggcccattaggcatttataacccatatttctgggtgtggcctgccacgtgtcaccatatttatttttacagtatgcgaatggataaacacccaatacctttaaaatcctcttttccaagtagttacacaacttatcctatcctataatactatacaattgatccccacttagtgtagttattagggatttttctgagcctgggttaagccacgtcactctttttttttcagccgttcgatcgaatccttatcagccgttggatcgcaattcaatacgcacattccttcgccaccgat

SEQ ID NO: 29806 - DNA, 3313 bp, Oryza sativa
  unsure (1)..(3313): unsure at all n locations
cgcgttggatagcatcaccnnnnnnnnnnnnnnnnnnnnnnnnnnnnnnnncatagttactcccggtgtctgttacgcgaaatcatcgtcgtcgttcccttattatgatgtgccttcaatccacaaaagctcagctccttcgttcttctccgccatctttgtttcatccgagttttcgcctctacgagattgtgcgttctcccacggggtccataggtactactcaaaatgcttccagttattatttgattggcagagtgctatagattcttcttagattcattttcatctcttcgttttttatatgtccagaacggtattccttgatgtgtcaccaacggccttcctcttgactgtattttgctgctcctgtcgatattcaatctgcagagataattctggtatgttacacttccagcatttcttacttcccccctttttttttactgttcagtttatattcagttcaagcaatttcctttgtgtgaatatgaataccttatatgtccacctgaatatacactttagttataccccctggatggtcactatatcccctatgtttgctctatcctctttgtctgggaaaaatccaatgattttgtatccctggttatagggattctttgtttgtgctgccgggtagaatggataatgcaccaggtacttctcatcctattgtacgccgtcgtggtcggccacgccgaagtgcctttattactcccatgccacagcctaacccaactgctgctgctgagtctcggcgcaggcataggcaagttatcgatgcaaataggaacagaggttggttagaatatcataattccttgaaattaatttatgcataatggccaagtagctcgcattataaatctcttcctttttatctagcatcaacctctgcagatcaacgtccagtgcgccaacggttcattggagaatcctctatttctaatcttacagagcaaaatgaaccccatattcatattggttccattccatcaaatcaatcattcaatcacagacgtaaggtttttttgggctcctcagatcttactgtcatgaatcattttatctttaaaaaaatcattacatttatgcaaacctttcaggcactatatatgaaccattaaaccttggtggcccacaccattcttgcgtgcactgcggtgccttcttttggtatgaagaacgcatacgtagagagaggcacacttcaaatccttcatgtaatttgtgttgtaagggtggaagtatcttgctgccaccataccaacctcctccacaaccattattgaatttgttgacttcacaggacggaactctttctaaccacttctttgatcatattcgtcaatataatagcatgtttgcaatgacatctatgggagctaaagtaaatgagtccataaatgatggaagggcaccgtatgttttcaagataagtggtcaggtctgtcatagaatgggctctttgctgcctttagagggtcgtcgcccagaatatgcacaattatatatttttgacacggaacatgaggtctcaaaccgaatcaacgttgcttcatcttcctgttctccctttcatgcaaaccaagaaattgttgccaacttgatagaaatgttcaatacaaataatccaattgttcagctattcaggacagcacgtgagcgattatctgtagacacatctaatcagattcagataagattatttggcaaaagggatgcacatggagatatttacagtgctccggttgcttctgaagttgttggtctaattgtgggtgatattggatcaactgatataggacgggatataataatacaagaccgttcttcaaatttgcagcagataaatgaaaaccattgcaagtttatgtcaatgcaatatcctcttttattcccatatggagaggatggttatcatgagaaactgacctacaatacaacagcacgtagtcaagccattaaacgcaccaaaatgaccccattggagtactttgcatataggctacatgatagaccaagagacttcaatactccattaaggtgcaaaaggctaactcaatcttatgtggtagattcttactgttgtgttgaagggagccacatatcacattatcgcaatccaagcttccagtctaaatacatatcatcgccattcaactcattgattaattctgtctcaagaggtcttacatccggttcttctgttggtcaaagggtaatattgccggcttcatttaccggtgggcctcggtatttgtatcaaaattatcaagattccattgctatttgtagaaagtatggttgtcctgatctatttgtcacattcacatcaaatccggcttggcctgaggtcagggaggctttagcacgaattccaggtcagaaaccatctgaccgtgctgatattgtcaatagggttttcaaaatgaagctcaatattttaatagatgatattaaaaaacgtgaattctttggccctattaatgctggtaatacttttctccctttgtttttttccaaacaataattttcccttaaacttccctgtgcaacactaatcatgccttacatgtcccttcaaatttttctttttacacagttatctacacaattgaatttcagaaacgtggtttacctcatgtccacatcatcatatggctggccaaaaaagaacccctagatgcaaaaaaggtcgatagctatattttagctcagtttccggaccctgcagttgacaagattggttatgatgctgtttgtaactttatggtgcatggcccttgtggtcctcacaacccttcctcagtatgcatgtctgaaggaaaatgcaccaaattctaccccaaagaattctgtgaggaaactactatattagaaaatggttttacacagtatgcacggccaaacaatggaataacttttaaaagaaatgaggtagaaattgacaacagatttgtggttcctcataatgtcgacttagttgtcaaatttcaggctcacataaatgtggaaaaagttaattatgatggtatgcataaatatcttttcaagtatgttacaaaaggatttgattgctcaagagttggattccactctaattcatcaaactcagaatcatcaagtgaaactataaatgaaataaataattatttggaatgccgttgtgtcactccaaatgatgctgcttggcgattgcagcaatttgacattcaccacacagatccctctatagaacgcctccctgtacatctttccttcaagaataatgttgttttcacagaagatgatgatctttgagagg

SEQ ID NO: 29807 - DNA, 716 bp, Oryza sativa
  unsure (1)..(716): unsure at all n locations
tccttctccccttcaagattaatgttgttttcccaaaagataatgatctttaagaggtcattaatgatccccacaactttaaataaagctgtcctgcttggttacaagacaatatgattaacccttcagcccgccaactaaaatatataaaatttcgtcaatattggacatggcacaataaagaaaaatattgggatggccgtcgtggtgcttctcgcagaattggccgcattgctcatgtcagcccttcacaaggagaagcttactacctacagaagctactgcacattgttaggggcccaagatcctttgctgaaatcagaactgtatcaggtgttgaatatcatacattttgaccagcatgtgaagcattaggtctccttggtgatgaccaagaatggtcaaatgctataaagtatgcagctcaatgggccttctcattccaagtacgccagctttttgccacaatgttactcttttgtgaggtaacaaatcgtattagactttacaatgaacatatgtcatgtatgagtgaggtcatagcatatcgtacgacccgtaacgcttctcaggccatcagctccatcaatacatttgtaacatcatctcgccttcttgagttagacaagctgctaacacccgttgggtatagtnnnnnnnnnnnnnnnnnnnnnnnnnnnnnnnnnnnnganagatctaccntcaaangcgcctca

SEQ ID NO: 29808 - DNA, 12203 bp, Oryza sativa
  unsure (1)..(12203): unsure at all n locations
ccctgacaaaaggggatatgtccttcaaagccaatataggttgggataccgacaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngataagccaaagttggctttttcaattcagctaaagaaaatccattgattggcttatttggcttaaatggattgatgagtattgtatgctccaacatccttgcgggccctacctatatttggctgaaagctctcagcccaataagtaagacgatgggctttggctgaaaagccttggcccaaacagccatccgatgaggcccctagattattatattttagataatctattttagaacggagtgaatatattttgggagaagggaatatctcttatttttctctattagacaggaactcgttgaatcacatcaatattacatcgtacgtacaactttgagtaagaaagtaatataatcaaatcaatgtactacctacatccttaatctatgacgccatcgtaaaaaagaatcagagggtgtacatagcaaataatctccccaaattttttattatgcttttatttatgaaatgaaaatctaccgtggggatattcccgccactgttttccaaaaaaaaaatctccctatagtaatactcttttgagatttccatctcaaaaacaagtacagttttatacgttcatatccaacgtttattatttatcttattaaaagtttttttatgatcaacattaacaacatttactatttgtcttatttaaatttttttatgattaatatttttttgtcattagatgataaaaactattttttttaatttttttcataaattttttaaacaagaccgatagtcaaactttggatacgaatatttgtcattgcacttatgaatacttgtcattgcacttattttaggacagcctactcgcttttattctcccaaagccctgtgggctcacaagtcagggacagcccgtcccctgaggccctgacccttcccccggtatccagaggccgacgaaccagcacgaactccacgcaccaatctcaccacatcaatccacatggcgtcgcgtcgcacgctccccgatttcccccacccaaatttctttcttcgatcaccaccggaaccaaaccaacccaaatcgccaaaacaacatacgatcgcaactaggctgtgctgtgggccaaaaaaatctaaaaagcactcgtgcagcagcagagaatcagagagaaggaagaggaaaaaaaaaccgcagaaaaagaattcgtataatttcctcccaacttttcctcgcgatcccgctgcgaaaagaaaaaaagctaatttaatccgtgctctttgtttttattcctctccgcaggtaaatgaatcatcgccgcggtcgtcgtcgccgtcatcatcatcatcatcatcctcgccacgaggggaacaggaagcgcaggagggatcaagcaggagctgtggattccgcttccgtgcacggtacgactacgatctccagtggctcgagcggttcgtcccggccaatcaaaatatttcctggagattgctacttgctcggttatttattatttgaggggtttgcattgctaatccgcggagggattaagacggggaggagggttggtggatttaggttaaaattccagtggttttccttttttttggttagacagatagattctttttttccggagtggttgactggatttgattttgacgggatgggggtcggctcgcgtgcgattcaccacgcgtttattcccctctcgttctgtctgtattattaatgattcgaagagggggatttgtgcggcggctaaattagggttccatgctctctcgcctccacgcttttgccctagccgtcgccgcacaaatcgagcgcatcctgccgccggtgtcatagcggctcggagtcgcggggttttgggctgcgctcgtcgatttgggtctcctggtatggttgctcgattcgattcggttcggttcgcttggttcgatttggtgcttgtttgttctgattttggctggaaatttcgtgaagggagttgcagttttcagtcacctgaaatattcaattttttcagtcatttttttaagctgttcggtttgctttttggtccgtgcactggtttagtgatctcagcttcatgaacatctttacttgtcccattgtgccatgcagtatgttggtgaggcctgtatgtgaatcgattttggttcaggtgtcagttagttgattgcgatttgtagtttgtatgcttcgcgaagtgctcatcgttatgtcttgcagtttatatgtttgtgcaattttaaaataaaccaaatgcagttattagggaaaccataggtaaaagaaatttttttatgccctggtaaataaagataatcaattcaaaattgcacattgtgttgatatttttgaattgcacattatagtgctatttccactgcaggctaatgcaattattgtactgttggatgttcattcttctcttgtagatggttccagtttgcatttgtcgaatgcagaagcatgttaatttttcttgtatcaaattttacggtggtattggagttgtaaattgaaaattacatacacatgttatattttgcgattggcaatctatcacagtaaagtaatgtttgttcagctagcacagatttacccatacagttttaggaaagaagtatgaaggagtaacaaccaaaagtgttacacaaatatattctttcttcctgggctaaactagcagcaattaaatctcgccggaagagcggaaatgttcctgacacattaagccggtgtttaaagcccacagaacgaggaagccaatcctctggacacaagcaaaagaccaaactacttaccaaactgttctttttttttattattttgtaatgggcccacttggaattgtaaccattttgtttgattcaacatagcatggacaaactgctatcattggatgtgcagatccaaaggttgcaaatgtgactgacacattttaaattttcaggtgactgaaaactagacgaccaggaattgctagttctcagtcacccgaaatatttaacctttcagtcaatctcttaagctgttcagtttgctttttgatccacgcactggttcgggtgatctcagtttcatgaatgatttgctgttgctagtggtgttgcagggttcaatggtggagtgagctgaattggggagatgtgattttaccggttcagccatggctcaaatccaaagcagctcactggtgaactgcacgctgcttgcggtgctatgtgggaaggttacagacaaacagcagaagccacctggtctggtgcccgaggtgaagcgaccacggctttcatatccattcccagagctgatctcgtctgggagattggaggttagtaggcttttgctgtttactggggtgatgcatttcttttgttgtgttatgaaccggctcgggatgcaggtgcatacgctgatcaatcccacagttgatcaattccggaaagcgcaacaggctgtgcagcccaacttgatgtacctccagggtcagcagcttgagaatgaggaagaaattggtacacttgtctggggcgatgctgatgtatctgatccacagatatttagttcactcattagtccaccttttccgaccatagtaagcaccaaactcttagctagcaacaatgttggtcagcgctcttagctttcaattaaatgataactgatactaccataagcttccgtttcattgtgctgttcgattttatttatgtgacagacatttatactccctccgtagaaaatgttgggcaattttcttagggcttctataagaatttgtgggacacacatatttcccgaaacactttttatgggttcttttcctctaataccttgcattaactgttgagatgcatgtcaatactggtgctggcatgcttaagaggcaaaagcaatgcttggtcacgtacttaagaggcaaaaaaatgaacaaatgtggatgaatcagaagttgtataatactctctttggactgataatacttgtcgctttggacaagggcacggtctttaaaaacaactttgaccactattttttattactatatatatatatatatagaaatatcaataaatatatgattttattgaagtactttttaagatcagtctatatatatggtcaccatacttctaagacaaatattttagatgttatttatagtcaaagtttttaaagtttgacaatagccttgtccaaaacgacaagtattatcaacctggagggagtaggatttatctaacctcagtttgattcctcaaacactccacaattaatttaacaatcgtattccgtcaacagcttaaacatgtaatcacaacacaaacgcaacacaacagctccaacttggttcttaaaactgatattccaatattttgtttttttaatgcccataacttgatttacatattccacttatatttgtctgacttgtagctactaacattttattttttaaaaccttatgctccttgtttttctgttttgtttcataaacggttttcttttccaatttttccatggtcgtcttccttctatctatttatcttactgtctaagcttttatacaggtttatttggaagttcctgctggggaaaagcttgctcaatctcttcagttaaaggtagtttgttttgtgatattttcaattagttttttttaaaaaaatttgtgaacaggttgtggattgttccatatgtctttttgccacagttgtgaatctgcttgttgggatgcatatatacttgtaaatatccaaatgattcctcatacttttttttaaaaaaaaaattgctctgatgtgtagcatgagcttagtttccataaacaattactatactcaaactgcatttgtttagtttattttgtctagcataggtgttgttctattgttggaatgtttatatcattatatgcttgtaagatgagcaattgctattcatttttcggcaagatgattgctaacatttacaaattttttttgcagttttactgagcttttttctttcaacaacaattcctactctcctattacttcagaatcttatttgtgattttggaatttgtgtttttgacactttcattcccaggggattccatatgtattatattggagaaattcattttcatcgtatgcagcatctcattttcgccaagccttgatatcagttgttcagaggtatcatattcatcatgtctttgttgtatgtatcgtaagtcccatttagttttgttttttcatccaataatcgagtgttcctttatgtagctcctgcagccatacatgggatgcatttcagcttgcacaagcttcttttcgactgtactgtgcaagaaataatgatgcgcaaagtgttaagcttgggcctcgtttactaggggatgctccaaagataaatatcttccttcctgagaatgaaatggttgaggaagaaggtagctctgaacattttccagccataaagatatatgatgaagatgtgaacatgaagcttcttatttgtggagcaccatgcatcttggtaagcgttagtggtcatgcctaaatttggaatattttcttatatattattgcatttttcttatcccaaccaatacttccatctcttttacaggatgctagtttgttgggctcactggaggatggtttgaatgctctgctcaatattgaagtatgggtccattcttgtacttaccatgtgttgctttatttctgcatagaagtgctgagttctgaatagtataccccaacaatctagttcatggaaatgctagttgattggagtaatgaactatgagtctgttagcttacggattataagtatgcattattgcagccaacaagtattgtgacttgtaggcaacctatactggctggtggggctgggtcccaaagtccatactccatagtgccatggctatggagtagattgatgatacagcttggttgcaatctcattttctgagttgtgaatttgcattctagagtatgttgcacatcctatggtgaccggattcgtggttcaccgccacatcccacgaccctggttcatcatctcagtttgtggttcatggttgatctggttcatcatcccaatcaatggttgagtcacgaatggcatcactgttctctatggtttctggagaaggaatagtattggcagggttggagatataagtgggctgtctggttgacagcccacctagtatcttctttttgctttatgtcctttccacatcttttctttcattatacactttgtgttatgtattttatgcgcaatttacataaaaatagctgtagattgggtaatccaccaaaacaatttacataaaaatagctgtagattgggtaatccaccaaaaacttagtggtggtgatggtgactggtgagtctgccatcccatcacctcctatttagttggtaggatcttctggtttgtcaatttcaatttctggttgatgttggattgcgaattgtatatgtttttttttccaagaaatatatacgactttaaagtttagaacatatatttgttgattattgcaagacactggtattcagctagtaccgttgtatgttaatatttatgcaccatgaattttgtagcaagataatatggcacatactgcctgtttaatgtttgatttttcccctttttttccagattcgagggtgtagactccagaacagagtcaggtaccttcagctgcagtgtggcatatataatatatattcaatatctggcaacctgttgtgtcttataaatactagctcatgtgtgagtcatgttcttttaccacaaatttaataaagctcaaactggtggtatatcgaataaattaactaatcttgatttgtgctgcctataatttaaaggttaactgcggcgatatttccctaaagaaaaaactaaatggtagccagattaaatgcttccatcggtgtcttgtaaactatagtcacaatagagtatttaacactatctttttgtggtcatatttttaagtgatgctgctatccttattttgtagttccacgtcattacttggttgctagagatgtttagttggtttctactctcaacattttctcttttcagtgctgctcctccacctcttcatgctgaaactcttccacatggggtggttacaatgcgttgtgatatcacaacatgcagttcttcacacgtgtcattgcttgtttctggcagtccgcaaacatgttttgatgacaaggtatggtttctgtatttatggagcattttttagtcttcagtttgatatttacagtgtcatatgctgcttcatggaattttgtagcttttggagaaccatattaaaaaggaaattgttgagaagggccagttagttcgtgctgtcttagttagggaggacgacaaaccatcttcagttgagcctttgacttcgatatctgtggcttctggagcttctacttttgaagtctggatgaccctacctaagtgggcaggacaggtttgttttcttcaaaaagttgaagtagtgtgctgaacacaacttggtaatatgtgtaaaaaaatacccactaatttccccatggtcttttgtgtcattttttttggatatcatgttgtccttttgtggacgataaatcctgtcaagtatctcgttcttcctctgcagttgtctgtactttggtttcatcagtaaagctgggaacaccttttgtttgttaaaaaaaatgggctaaaaacacatgtatcaggaaacagaagtggtttggacattttaatacataatatgactaccaagacccctatgctctttaattgtatcaccaatctttcttgacaagtcaaacctcaatgtgtgaactcaaccatatggtgttttataccattgtggattctaattatctttccttacatggttatgttcaatggatcattcatcactaactgaagattgttttctactgtctaggttttgaaatatcttgctccggaaatctcttacaaaagcctggttccacttggaattgcttgtgtaaatggaactccagtttcttcgtttgatagacaagatgtggatcggcttcttttcttttgcaaaaatgaagctattgtaaatggtctatattctcatctgccaagatggtcagcatcccttgttaaggacagactgaagggaactccagagtcaaaatcaagtacttttagtgcaaatggagttggagagtaccagaaacatccaatgaaagggacttccctagtagtcaaaccaaagctgaaatctgcaaaaatgaggcctattccacactcttcgaagcggcagatgcacccttttgtgggtatccctccgtcctttattcatgatgctagtcaagttaagcctagcttgccagcacctccggtaaggcataatgcattacctgttgctccaacaactcaaagaaaattatcatctgggacatcacgtgttgaaccagctgttccgttaaatcctctgccaatgaagaaacatgggtgtgatcggttgcctattggaatttgctctgaagtactctcatttaccatctctcctattcttttttatggttttatgctgaaatgctctctaaagttaaggtcaaacatattttccccttgtcctttgcaggaagacttcttaaaagatgtcatgcaatttctacttcagagggggcacacccgacttgttcctcaaggaggactagccgaatttcctgatgcagtactaaatgcaaaacgccttgatttatataacttgtataaagaggttggtcttcactgctgctattttcatgcattaattatgggcttatcgccttgtggggttaaatatggagagagaaatgctgatttaatcatttatctgatgaaaatgatgattgatcattcaggtggtatccagaggcggattttatgtaggcaatggcataaattggaaaggtcaagtcttttcaaagatgagcaaccatactgttacaaacaaaatgacggtatgcatgtagttgatatttgtttcaatcttgttagatttgctgcagtgaattggttattttctgtggtaccatttatcacacttcagttgttatgctacttagatttactctactatatgggtcagcctgtaagagggacatgttttggcacatagtcagctttgaacgttctattcctggaaaatttgctgcacaggtggagccaggaatcctaagatttatttgtcaagcgacgggtcaggagtgctaatttcattttaaaatcacttaagatacagcttttagcattgaaaatctcagaaattatgggtaggccaagctcctgctcgcgcctccccctctctctgccactgggcctgcctgcaataatttgctgacaaaattcactatggaacactaaatgtggtcttggctagaacgcactctaatgggcttcagaccatctaggattggtgatccatcatgtggttattccttaaatttggtggagtgactccattcttcatttctctacctagtgtgtgcttttagagatgagctgatgatggacaaacacattccattcctccaaacaaataacatatttagaaccatgtcatcaattgtccatcttattcctcaaaccacacaacccatgtattcgtggtatttgctagcagacactctgcccactgaaataatatgcccgctgaatgagaaatatttgaaaatgaccttgctatcttcgtttcttctatttaatttaaataattaaaaggtgggcctattaggcagtgatggggcttaggggtgttacgaaaagccttgatcttggagtcctttgtgccgtacacgagcctctgcggttaatgtacagatagttgctatgagcggttaaccacaaatcatagtgtctgtaacacatttattcttttttgtttccttttgttatcttttatttacggtatgttagctgccatttcatttgcctgtttctgatgtgctaaatgtgttgcaatagggtgttggaaacacgttaaagagacattacgagacatacttgttggaatacgaactttcacatgatgatgtcggtggggaatgctgcttactctgccacaggttcgaggacacgattttagtatggtgctgttgcaactgtttcctgtcggtataatctaacatattccttccaactatttccagtagtgctccaggtgattgggttaactgtgggttgtgcggtgaatgggcgcactttgggtgtgatagacggcaagggctaggcacattcaaggtagaaatatttcctgatctgtatctaacgttttatatcccttccaataatttcattatttaggttgtgcattgatctgggctgctgctgtaacaggactatgcgaagacagatgggttggaatatatctgcccccactgcagcctcgcgaactataagaagaagccaccgcctcccgagagtgctaatggcttcagaatagcatctgcacaacggaatatttaatttttgttactcttttttagcctactgtcccacttttgggtaagacagggctggtagatagcatgttttaaacaatgtagtgtttagctgtattatgtcattaacatcatttatttagtgaaaggttttatattgattgtaatcagtgaagtgacaactcagaaaggctctaattaattgctgggttcaatcgtgtattccattgccatgctggatacctgttgctcatagctaccccttttgcgtaatatgggaacatgggagaagcgatttgtctctgaactttatcaccattgataacttttattcgtgattcattttattcatgtacatcttgcttatggaacatgcttgattcactctagattcagacatctgcctcttgttgaggcatacttcgttacttcttgttgctagttgcttccggagatcaaggatctcacattgctagtgtgttgcagatttttgtcagttcaatgcacaaatgttgataaatatctgttgaagtattcttccatgcataataaatctgccgataagtatatcttcgcgcagtaatgttcaacgatataccgcaaattgataatttgacctgttttgaggcatatcgaaactattattttcctagttagaaagtattgtcaagcagttctcaaattatgttacacaataatttggcactagtgattaatacaaagatctacaacacgattctagaaatagagaggggtgctactcgcttgcttactctattttagaccaagagttaaaaggaaatggagaaaggtgctattcttgcttacttcactctactttaaaccaagtttaggctgagtttggattgcgattctagaaatagagaggggtgctactcgtttgctttactctattttagaccaagagctaaaaggaaatggagagatgtgctactctcacttactttatttactctactttagaccaagtttaggctgatatgagtgtctgagtttggattggaggggtgtacatatgatgaaaatacataagttgtagctaaaaaattttcttgatcgggttactgggcaagctctgtccgtgattctaaattgtgttccacaaacagaccaacaattttcagattgtgttccgcacacaatttgaaccaacaaaaagaaaaaactaacacaaatttcaaattgtgttccgcgcacacaaaaactaacacagaaatttgaataaaaaatgtgcttacacaatgaagtggcacacatacaaaagcacaatgaacgaagtgattaatccctacttccacacacacaaaaacacaacgaagaatctgctacttggtgattaatccacaatacaacacacaatgaagacttgtggggtnccaagcagagtgtcaatcaaaacctcactgggggnggggggataaaaggaagaaataagaggcagtcaccgagtttctaattaaatacagaattaaataaagagagtaacattcagtntaacatagaacacattacattaatgcgaagcgacacggt

SEQ ID NO: 29809 - DNA, 731 bp, Oryza sativa
  unsure (1)..(731): unsure at all n locations
gagcattgaacgggaggaaggggcaaaattagtcatgagacaaaattcatgggggataaatattagcagacgggggaactagctgaaaaccagtgtcttgcaataatcaagaaaagtagggttctaagctttaaagtgggataaatttcctggaaaaaaaaaacatagacatttggcaatccaacatcagccagaaattggagttggctagccagaagatcctaccaactaaaatgggaggtgatgggatgacagactcaccagtcgccatcaaccaccagtaagttttgggtggattacccaatctacagctatttttatgtaaattgttttggtggattacccaatcaacagctatttttatgtaaattgcgcataaaatacataacgcaaagtgtataatgaaagaaaagatgtggaaaggacataaagcaaaaagaagatactaggtgggctgtcanccagacagcccacttatatctccaaccctgccaatactattccttctccagaaaccatagagaacagtgatgccattcgtgactcaaccattgattgggatgatgaaccagatcaaccatgaaccacaaactgagatgatgaaccagggtcgtgggatgtggcggtgaaccacgaatccggtcaccataggatgtgcaacatnnnnnnnnnnnnnnnnnnnnnnnnnnnnnnnnnnnnnnnnnnnnnnnctaantcaaannngtacacac

SEQ ID NO: 29810 - DNA, 1020 bp, Oryza sativa
  unsure (1)..(1020): unsure at all n locations
tgtgggcnntttgaattagatnnnnnnnnnnnnnnnnnnnnnnnnnnnnnnnnnnnnnnnnnnnntcttcactaattttgtactgagatgttagggttggattttatatgggacggagggagtatcttttttgtttaactgtagattccgtatctacgatatatcgagagggtcatttcatttcagtcagtctaatcagcgtgcatgtgcctccctctgcccccgactcccctttccacgtgcacttacaaaaattcaaatcaaattcaaaagagctgcagcgccaacgtacgccctccgtccctattatggattttgagttttttttttattgtctgatcactcgttttattcaaaaaaaattttatacaaatataaaaatgaaaagttgtgcttaaagtactttggataataaagtaagtcaaataaaataaataataattctaatattttttggataagacgagtggtcaaacagtgtaagcaaaaactcaaaatctcttatattatgggacggagggagtagacaggatccatgaggtcaccgtcgtgtcaggcctccgacgtccaccagcatcgagcgcctcgagatgcttgacgacaaccaccggaggccagcagcattgcctccccaactaccagtccgtcacccccgtcacttggagagggtggcagagccgaagcttgcacagaggcagctgcggtagcagtgaagtagcgaaggtggcgatgaacccgacgtcgtctcgagctccctcaatgacattttctcccttcacgctacacagacgaccgccgctttctccacgccgtcaccactttctctaccaggactacaaccattggcctggaggaaagggggtgttagaaaaagggaggagggaaaacaggatggccacgcgaatagatctggtagcatctcgacctcgccctccttcaccgccattgtcgtnnnnnnnnnnnnnnnnnnnnnnnnnnnnnnnnnnnnnnnnnnnngcgcatntacaaaanntggcccag

SEQ ID NO: 29811 - DNA, 725 bp, Oryza sativa
  unsure (1)..(725): unsure at all n locations
ncgcgccatggacgcttgtctnnnnnnnnnnnnnnnnnnnnnnnnnnnnnnnnnnnnnnnnnnnnnnnnnnnnnnnnnnnnnnaacaatagtcatactcatacatgattcagtaaaatgtggtctttttggaaaaaaaaaactattgcagacaatgctaaaaaatagtcgggtgtgctgaatcaactcaccttgctggaacagtccaaaatgctctacaccagggttttgtaggttgagaaagaatctgttggaagctaatggtcatgtcgtccaagcagaacttataaagcctctcactgtcgcagcttgaccatacaagataaacacagtttccttgcaatacaccttctattgaaggacatgagaaagtgtaattttcagagataagaaaggtacggtcgctgccaatgctctccaccctctcccatgacatcaactcaagatccaagcaaaaaacatcaatggcggtgagcaatccatcgttcccaaagcacccgagctcttctatccacaagagaaacaactttccacatgactcgacaacatggtaacaaccacttccacgggcatatttttcttcatccttgatggtacccactcgctgtagttgtatcttaccatccaccatatctatcactacgagattagaacaagcagaacagatcttttctttcgtagttgcacataaaagcagagagatggatgtcattgacgggngaaccn

SEQ ID NO: 29812 - DNA, 722 bp, Oryza sativa
  unsure (1)..(722): unsure at all n locations
tgcggtccnntttgaattgacataccactgctgcaagcccgcgggncgactctagaggatccccccgatgcttacccctgcctcgtttaactagtgcgcaaaaggggatcacactaaagcatacgctttgattattaggcgtaggtttgtaatagtgccaccgcaatagggcctgttcattaaaatacactacatggtgggctgtgggggcatggttctgctagtcgtgcccctggcgattaaggaccggctcgcgggatgccctggaagaacttattgtacttaccacaagccagcgtgtgcaacagctgggcttttagtgtagcttttctttaaccgacctacccaagcgagggtgggcgtaatggacttgggtcaaccagtgtggccctttgatcgggttacagattcaccgtggcatttaacgggggctgcccgttgccttttggggacgggggcggaccctaaggagttgtaccaccggtagagagggttatactaagggtactgtcacggtctctatccggtatttcaagcaggcatgtacacccaccggaacatatcgtggggatattgtttgtgggaacaagtgtacacctttgatcagagtcaaactatccccatagccgcgccccgtgatattgggcggctaccggattcaccaatgatagtgtaacccctagatcagctttatgaaccggcgcaggtttatgtgttggttg

SEQ ID NO: 29813 - DNA, 605 bp, Oryza sativa
  unsure (1)..(605): unsure at all n locations
tgggggncnnnnattgtagatcgtgcttggtacccgcgtgcttttttaaacctcaaaataaactgacacccataccattctctcgagcttcagaactctgtgatttgtttgaaagaagtaataaaaaaaagggaaaggttggtataaaaagcattaagataatgagtgtacaagcaaagcagtgaaaacctgaacaagtggaggaagctgataatgatctcctactagaacaaactttgttgcaagcatcaaaggtcccagagatacctagtgagtaaaatattacaatgtgagaaattataaatggtataggatgcaagactctttagaaaacaattttacagatcattctggtttagcagctttgaccaactaatgtagtcttgaagttaaatgaggaccatcgcgtggatttttgtggcttccttcaagacttgtaccaagcattcctagtttggagcctaccggtaatgtgatctggcctgcctcatccatgatacatgtgtcaaacttcttatgtgctagtaaagggtgataaattcccaaacaagtgactccaacaacttgcacttgcttcattctagctttgacggcatctactgatt

SEQ ID NO: 29814 - DNA, 1229 bp, Oryza sativa
  unsure (1)..(1229): unsure at all n locations
aggccccaatcccggggttaattccattggagatttaaaggttagggcaattctttgaaacattttccagtctttggtttaaaccttgcccaaaaaggattttaagttaatagcccctggtggaatttgggggtcccccaagcttggcccaatttttcgatttggacccaccgtattggtatgggccgccctcaccatgaacaaggtgaaacttctaatgggcaagtaaaggttaataatcccaaccaagtgattccaccaattggccttggtccattagagcttggacggcatcaccgatgggaaatcggtngtggtcaaaaaattaaatatcgaaccacatttcttcattttaaaagcacaagtagaataatgagaaattctaacttgacaagcagtggcctttgacatcaggatgtacagcttcatgccttccaattcgaagaaaatctacaccctatataaatggcattagagcatgttcatattttgatgatttgatttgttgcgctacaatgctcaagccaaacgttgctcattggaacaatgcgataggggaaaagagtttgttcatttgaatagtacagtgagacagggagttatgactgaatttatgaaaggaagtattgcgaacacaaacctcagccttcaacttcataagcaaattatctatagctgaattggtatatgaggttagcaaaatagattcccctctcatcaataatgacttcacggcatgcaccatcgtatatgttttgcctgttccaggcattcctaggataagcgcataatcttttgctgctagaatctgaaagcaacatagtgtacgctttacatagtgacattgaattttcagaagaaaaaaaataatgaactaaagaccaaagatttactttatgcagcgatctctgttggtcattgttcaaatttggcaatgattgtatatatgatagtgccggatcttgacttaggagtcctccactatcaaatctgggagcctatcaacatccaaataaggaaattacagacaacaaaaacagtatggagaaacatagcacgaataggctagtggacgaacagacctcgaggtcaacaatcaacttccttaggtgagagttttgtggattctcagcaaatagttggacaaggttgagtctggcaacagttcaaatacaaactttatttagggtgtacttagagtgactgcggcaacagattgtatcaagcct

SEQ ID NO: 29815 - DNA, 717 bp, Oryza sativa
  unsure (1)..(717): unsure at all n locations
cccgttgttgggggcataggtcttcaacgaccggctcgctttcgtcgccgcagactggtgtcctcgcntgcacggctggcatattatgcccccgttgttgggcgcatacgtcttcaccgaccggctcgcattcgtcgccccgactggttgtcctcgcttgcacggctggcatattatgccgccgttgttgggcgcatacgtcttcacagaccggctcgccttcgtcgccgccgactggtgtcctcgcctgcacggctggcctattatgccgccgttgttgggcgcctacgtcttcaccgaccggctcgccttcgccgccgccgactggtgtcctcgcctgcacggctggcctattatgccgccgttgttgggcgcctacgtcttcaccgaccggcttgccttcgctgccgccgactggtgtcctcgcctgcacggctggcctattatgccgccgttgttgggcgcctacgtcttcaccgaccggcttgcctttgccgccgccgactggtgtttccgcctgcacggctggcctttatgccgccgttgttgggcgtctacgtcttcaccgaccggcttgccttcgccgctgccgattggtgcttccgcctgcacggctggcctattatgctgccattgttgggcgtctacgtcttcannnnnnnnnnnnnnnnnnnnnnnnnnnnnnnnnnnnnnnnaagtctatcaaannngcacaca

SEQ ID NO: 29816 - DNA, 1317 bp, Oryza sativa
  unsure (1)..(1317): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttggtgagggcgagcctggtattcaccgatcttgcacgggtgcggctggagtaaagttcctcgatggctcaccaagcttcagccgccgtcttgcacatggcgacttgaatcagaacatccctcgaaagagatgacaggagatagccaagaacaagttgatcattggcttcctaatcttcgaatgccgggttcggctttgtcacagtcttcccatcgacggtgactgaaatctcggcgtctagagctttcacagcgccggtgaggtagccctggagacgggctccgcgcactgcagcgctaacttgcgctttccacagtgcatgattgcctttccgagtttctctgtaacggaatggccctgagcgaggtttacagctgccgcgcctgaggaagacgacgacggcatgagtggtggaagatagatgcaatctaccgaggtggaaaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 29817 - DNA, 1229 bp, Oryza sativa
  unsure (1)..(1229): unsure at all n locations
ggggncnnnntttgttatcgatattcgtactcggnacccccgtgctcgccgcgctcttcggagcccatcggcaacacgggtcggaggaaaagcgcagtatcaaggagcggaagcaccgttcttggctcgcggcgatcatggcaccctggggcccccggaagaaggatccggccgtcgcgtcgccgccgcggcactcttgccacgtgatcagcaaccgcgggctctcgccggcgatgaggtacgccgacgaaggcggcgaggaggggagctcgccggcggagtcgccatggcgaccttcgccgatgcggaaaaccccctgccggcgcagaccgggaggcgcgactggggccggcggcgtctcgggcttcgccgtctgcatcagcccgctcgttcgtcccagcccggcgcggcaccaccgcgggggaggccacccgccggacgccgccgccttctccggcgagctggggccgtcaccgctccaccgcctttcctccggctcctcgctcccccactgccggtcatggaagctcgccgacggcggccgcttccggtgatcctatcctttattaatttttttcccgcgctccgacattatttatcccttttgggaggcttttcttttttcctttttacctttacgtgtaaactggaaaagaagaattcatcctggccaaccacgagctggcaagctgtcccactgacatgtaggcaccgacgtttgtcaaaggttactgtttgtcagttgaacatgttgcaagccactgtaaaaaaaaaagcttcttgcattatctatgtacaggattactcctagcttttaaattattttcaagatattatttctttcttgtgtttgagattcccaagccaatagatttagttgtgtgtctggcatggagggaatgaagccatgtgagcggaattgaatgtgagcgttatgaattgaagatctgaactctgagaactaagtactcctacttactccctccgtcccaaaaaaaaaaaacaaaccttgggttttcatatccaattttgactgttcgtcttatatgaaatttttttataattcgtatttttaccgctgttagatgataaaatatgattaatattttatgcgtgacttatctttttaatttttttcataatttttttaaataagacggacgnnnnnnnnnnnnnnnnnnnnnnnnnnnnnnnnnnnnnnnnnnttgtatcagcaanccaaagnccag

SEQ ID NO: 29818 - DNA, 1518 bp, Oryza sativa
  unsure (1)..(1518): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactactgtttacttacaaaagattatgcttaaggtggatatgataagcgtctcagagaaaatgttgaataccttgaggagctcaaaagattggcagcgagtgaaggggtttctgaacatgtcaaatttgtgacatcttgttcaacttctgaaaggaacgaacttctctccaactgcctttgtgtgttatacactccaaaggtaaatatctggcatgtcttttgattctcaacaacatgagaattttcccataataaacctgcgtctgacattttgcaggatgaacattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 29819 - DNA, 1296 bp, Oryza sativa
  unsure (1)..(1296): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactcgtctaaaccgaaatatttgaagttgttgaagtagaatgtctgttccgaagcaaagatgaagataatgactcctggagttgactcattggctgattaattgatttcttcagcttgacataaaatttgtcaaattttgagccttatatttgtgtagcccccgactctttggttagttggaaaacaactgaacatagagtcgagaattatagcttcttgtcgtcgagtagtcattgcttgattgaagatatgtgttgaaggtgtccaagtagaaatcctgaatattggagagtcacttgttgtagtaaaatatcatggcattgcatgccgagatgtcgaggttcacaaagacgtcgtggttggtgaagtagtaaaacttgcgaagtagcagcaatagagtttgccagtgccgaagataataaagaagaagtcgctccaccatgatgacaaagtgcaatcgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttactgttggcccactccctgtaaacgcggttcgcccttttggctggggccccatctttattatggagtcttgttcaaattggaaaacattaccccttttgggcttttttttatttataagggttttcgcctttcggccttggttgaaaaagagcgttttaaacaaattacgcggaattttccaaaatttaccctcacatttggtggggggttttttctccgcctggggggggtttccccctatgtggcgcctatccacaccttgttgcgccaattaatcaccccccccccc

SEQ ID NO: 29820 - DNA, 630 bp, Oryza sativa
  unsure (1)..(630): unsure at all n locations
gtgcgtccctttgattgtgatcnacnnnnnnnnnnnnnnnnnnnnnnnnnnnnnnnnnnnnnnnnnnctattgagcgatttgagtagggtatccgaggaaacgttttgtgaaattttgtacgtaatcgatcgacaattcacataggaatatatgcatatcctctacaagtccacatcaaatcagtcatagtacatagtaagtctttaacacaaataggtactgcaactaccatagtaagagagttataagcaacattcacctcagatagagtttagatccttaccagaaacagtctcttcaaagcatcggtttttgtcatgatgtgatgtgaaaacatgaacatcatgaccatggaccgcaagctgacaagccgcatcgactatcaatctctcagcaccacctacacaaaaacatatgttttctttgaacaattgagatctagtacaatgctagaaatgctgccacacttagtccattggtcaatgtcctataacctgctgcaatactgctacaacattttttttctcgaaaatgttcttaaaaatctcacctgcatataataaacaagccgcaagtcctacattcaaatgaaaccgtgcaacggcttccccaaaaaataagccaattcg

SEQ ID NO: 29821 - DNA, 1333 bp, Oryza sativa
  unsure (1)..(1333): unsure at all n locations
gtggcgcccnttgattgatgnnnnnnnnnnnnnnnnnnnnnnnnnnnnnnnnnnnnnnnnnnnnnnnnnttgcatgtcttgtcctttacttgtttaaagaagatactgttacatgttctgcgctaatcatcgtcggcacatccaggtatcaaaatgtaacaatgtaaattttggtcaaattgaaggacaaaagactgttggagttgtggaggtaggcaacatcttgagcttgcaaaactttggaatatgaccttttcatattatgtaacttatatgtaatatctagcaagttcgtttcatgatggtaaactcctgtagtccttgtgattctcagccatcaaaattaggccaacacagaactttcactctccccatgtccttcagtacttgagtgttgacttgcacacctcattcttaatggctttattgaaatgaatttcaccttaggtaatggatattgaggagatggcctgggctccaagatatggtttgaaagggattattgatgcttctattagatcaagggtttcatgcaatggtagttcatacgacagagtaatgcctctggagttcaaaactggtaaaggaactagtggtcaggtaagcatatgctcctggatagtggatccacttgaagatatattatatctttttctggcatgagatatttttgtcaccggggttctggaaactatttatgcaataaattagtgaagtattgcaacaaccaggcttcttgaaagattgtgctgattccataatccatattaattcttacaagtagtcatgctctcaattttttaatcaaaacctgacgagttcattgaggtttatattgcacaggccagaactgttgttttctgtctgttttccataatgtaattactggttgcttacttgaattagattccctgctctattttatccaaaactttaagctttagttacaattgactagaaacctgtcaaccacctagtcatgtccattctgtggcaacaaccaatcaataataatgtcctacaacaactaatcgtaccttaaaaaaacccaatcatagttcattacaaaataataattaatcaataatccggagcctcagttccattctactttcacaaggtcaacatccttcagtagttttgataattaatacatgtcacatgtagcggcatccaaatatatattttgataccttttttgaaatgtgattgtgactattagtgttatctttactttatgtccatttctgaaaagaatattgtgttatttttgnnnnnnnnnnnnnnnnnnnnnnnnnnnnnnnnnnnnnnnnnnnnnatcatnnntacacac

SEQ ID NO: 29822 - DNA, 1272 bp, Oryza sativa
  unsure (1)..(1272): unsure at all n locations
gtgcgcccnntttgaaggtcgnacnnnnnnnnnnnnnnnnnnnnnnnnnnnnnnnnnnnnnnnnnntgcgccatttgcttcggcatctcccagactgacactgtcccctccagcgccagaggctgcagcagaggctgcgccactgctgtgagcgtcctggtcaggcacagagctgctgtcctgtagcgtcgattccagtgccgcctccccatgcacgatgttgccatgcacgttcccatgcatggtattctccatttcctgctcatgtgggggaccattttctccagaaacaacatcatcagcatcagacacaattaaattattactaggtaatggaatattagccactggtgtaactacatgtgtgccccctggactagtcgtattataatttgtcatggaggaaggcaatagaagaatttcagacctaagtcttgctcctgcatttgagtgaagagtagaaaagggaaatatattttcatcaaagataacatctcttaagatgtagacatggcctgatgacacatcaagacatttaaatcctttgtggtgagtactaaaacctaggaacacgcactgtttggaacggaattggagtttatgtgtgtcgaaacatgaattcggcaataataaaacggggtagcgcacgagacctaaaagtggatggatgtggagacaaaggatttagacaggttcaggccctctcaatgagaggtaataccctactcctgtttggggatttgaatccgctgagtgtgtattgatctgacgatcaggttgtctcatgccctctagagggcctcctgcccaccttatatagaatggggggcaggattacaagatagaaacattatccaatacggtatcggtttcctaactctactttacaatcttatcaaaccaggactttaggccgttccgtaatatacaaggaaacgtaatacccaagtcataatctgttacatattccatacatataagttatcccctataactagtcggataaccatgccgtgtgggtatggggtacccataatctccacagtagcccctgagaccttcacagtcgaaaagataatcttctctcgaaccagattactccaaggccgagtacttcaatcatctttgccatggtctcccgagtacttttaccaaatctgaagactgtggagggctgaaaaataaagtcaggtgcatcgactagatgcannnnnnnnnnnnnnnnnnnnnnnnnnnnnnnnnnnnnnnnnnnnnnnnntaatctaaagccct

SEQ ID NO: 29823 - DNA, 628 bp, Oryza sativa
  unsure (1)..(628): unsure at all n locations
gtgcggnnnttttgttgctgtcnnnnnnnnnnnnnnnnnnnnnnnnnnnnnnnnnnnnnnnnnnnnaaaattttttaaatctgaattgaatgttttcaagcttgacttgaaaattttcaaatataaatttaaactttcaaatatagagttgaaagttttcgaatcaaagttgaaaagattcaaatctaagttaaaagtgtttaagagaattaagcactcccgtgacgattttttttccggaaaaaaaaagagagaaacacgaacgggagtttggcttttcttcgtacgtgatgccgaaaacaagtgggcccaccgcttctctacgcgcgcgcgacttaggtaaagggcacgtacgcgctaattagccatccccgaaataatatgctatggaaatctgcattctgcgagcactcgaactcgagtactcgacggctcgatgccatcaaattgatatgggctactgggccgtaagcgattcgcacgcgttatcagatactgggctgtatgaggcccaatccacccgcacatcaactcagctggaatcgtgacgacacgactagcgagagcgagttagcgagcagagatccacggcccgcaacggcggcggcggcggcggcggccgaagccc

SEQ ID NO: 29824 - DNA, 2078 bp, Oryza sativa
  unsure (1)..(2078): unsure at all n locations
atttttttgaagtttgatagaattcagagataaatataatgatatttttaacacaaaatgaatattctattaaaatatatttaatgatatatttaattaaattattttggtatcatatatgttgctattttttttataaatttgatcaaacaaaaaaacataaaggagttttaagagtcaaatatgaaaccgagggagtacaagatattgacatccttagttttgccaatccaataaaggtaagagaatatgttatccacgtgcctctcttaaatcaaattgatccaacatgcctctgcctcatgtaaaatatttttagaacttagtatccctattgtttcacctttttagaacgaaatactgatatatcatttccatagcctaaaaagaaaacttgttcggcaaatatatcatttccatagcctaaaaagaaaacttttttgccgggtcggcggaaggacgtcaaccaaatttctttaagataaaaagagggtaatataatatacatgatattacactgtcgagtcgaggggaaacctcgaaaaagaacgtaaaccaaatttctttaagataaaaagagggtaatacaatatacataaaaaaagagggtaatacaatatacatgatattacagagtcgaggggaaacctcgaaaaagaacaggaaaactatttaaggaggccaaaaacatgctgctactcctcgaaagaaaaaattccggccactcttcagatcagaggacctcctgatgtctgccaccaagtgttctaccaccctttctgttataaaaatctttacgtttcttcctttccaaagcttccagcagatcaacatgaacagagaatcgaaatccttacagcttccagcagatcaacatgaacatagaatcgaaatccttacgtttctttctttccaaagcttccagcagatcaacatacacagagaatcgaaggcggctctgtgcctttgaccgaaaacagagacgcacctgctgccaccattttggaagctgtaggccgagctgacggcaaataccttgtctttaaacacaattattaattcttctctagtgttcctatcccacaagaattattttcttactgtccttacaagttatttccttgcggattctcgatagattttggcactttgccatagacttatacacaccattactggtaccatgtatgaatgcgatcagaattcatgtctatgtgatccctacaccaaaacgcatcagtagtggaatggttttgcagggtgaaacacagcgaagaaaaacgacaatatccaataacatgtcattccaatcttaattaagattcgtacacgccgaatactagcgagaaaagaaaaaggtgtacaaacattcataagaaaaccgtacaactaggctgacaactgacaaagcatgctaaataagctaccgattgagaaaaataaaaattagctacctgacaggccaagccatgcgctggggctacttatttgttcctgatctcttttgttcaggcattgtgatactgattactactagcgcaccggattattggccaacgctgccggtggtgtcggtgcaggaaacactgaatccctgatccctacactctactgggtcaacagctaacagagcttaaaaacacaggattatctagtcggtcatcatcttcaggtcgggatcgtaacggccttgattcccagatagcgaccagctaacaggagcatacgaagaatgcatgggatgacctgaattattgaatgtgctgccattaggtcccatgggactccctgggtcatcggagtggtcgcttgatgatccatcagacggaggactggcagccgtggctgcgccaaagccagctgcgtggttcggcgtcggggcagatgttggctcacgtttcagatgttcttccttgccttttttaccttcagcaatgaaactccccactacaacctggaaaacagaatgtaacagaaggccaaagaaaatgctagtttagggcacaaaccagctgaaannnnnnnnnnnnnnnnnnnnnnnnnnnnnnnnnnnnnnnnnnnnntataaatcaaaccca

SEQ ID NO: 29825 - DNA, 629 bp, Oryza sativa
  unsure (1)..(629): unsure at all n locations
atgcgttccntttgattgatatacnnnnnnnnnnnnnnnnnnnnnnnnnnnnnnnnnnnnnnnnnncgcctcctttgtgggggcatacttaatcaaggacttcgtgggctatctaagtggagataatggatttgaaagaggctactctcttgttcttgtatttgtaggtgcgaaggctattgaaactcttgcttacagacaatggttctttggaagtctacaggtttatttgcgcctaagaacatctctgatatctcaggtataccaaaaggtcctttatttatcaagccagtcaaggcagaaacatacctcaggggagataattaactatgtgagtgttgacatcgagaggattgttaatgttgcatggtatgtgaacatggtcttcatgatgcctatacagattacactagcaacttatattctttggaaaaatcttggtctgggttctttagctggaatagcaacaacagccataataatgctttgcaatattccttttacaagaatccagaaaagattgcacgcaggaattatgaaagcaaaagatgacagaatggacatgacatctgaagttataagaagcatgaagatcttaaaacttcaagcttgggatatccaaaaccttn

SEQ ID NO: 29826 - DNA, 635 bp, Oryza sativa
  unsure (1)..(635): unsure at all n locations
gtgcgccnnnttgaatgactgacnnnnnnnnnnnnnnnnnnnnnnnnnnnnnnnnnnnnnnnnnnttctatgtccctaagcgtgaaaaaaatatcaaaaaaataaaaaaaaattaaaaaaaaattttttggggggggggggcgccagccactctggcgcgctccccctagccacctcagcattgccccgccacgtcggcagggggacggcgccagagaggctgcagttggacgacggcgccagccactctggcgccccaaaaaggaccatttttgggataagtttttccaggggtctatctgcgaaataagttttttaaaaggaccaaaatgtaaatcatatccatcctgtacccacactcgatgagaccgcgcggctgcctggtgcgcgcgagatccctgagcgacacgaacacgtgccgccccacgccttcctccacctcgtccccctccgagtagtagtagcaatactcgggccccggcacgcacggttgctctagaggcaaacccagcagcaaatccttggccatcttggtcgccgacgcggaacgccccggcaagaagggcattatcgcggtgtggaagcccctccgtgtgcttcacccacgggaggcttcacttccggcacaaaaacct

SEQ ID NO: 29827 - DNA, 636 bp, Oryza sativa
  unsure (1)..(636): unsure at all n locations
tgtggtgtccnnattgaatagacagtcnnnnnnnnnnnnnnnnnnnnnnnnnnnnnnnnnnnnnnnnnnnnaacctggccgggtgactgcagagatgataaatggcccttcccatagaggagataacttgtgccgatctcgtgtagtttgaattttcctcaaaacgaggtcgccgactagaaaggcacgggatcgaacattgcgattataataacgtcgcaacccttgtaagtatcgagccgactgaatcaaagctgcttcgcggacttcttccagtcggtgcaagtcatccactcggtcctcctcgtagcgttcttcgcggaaattacgaaagcgcaaagactcgaattcaacttcactcggcaacattgcttctgccccatagacaaggaaaaaaggtgactggcctgtggtccgactgggtgtagtacgcaaagaccaaagtactgatggtagctgttccacccatttgccggcatagggttttagccggtcaaaaactcgcgctttaatcccttgaagtatcatgccattggctcactccacctgtccattgctcatgggatgtgccactgaggcatagcaaatcttaattccaaagtcttcacaaaagtctttaaaaactccgccagtgag

SEQ ID NO: 29828 - DNA, 2325 bp, Oryza sativa
  unsure (1)..(2325): unsure at all n locations
gtgtgtcnttttgttgacagtcnnnnnnnnnnnnnnnnnnnnnnnnnnnnnnnnnnnnnnnnnnnntaaccgccgactgcctttttaaacgggccaaccatgtcgagcccccaaaccgcaaacggccaagacagtgggatggtctgcaactcttgagctggtagatgaatttgtctggcaaaaaactggcaaccttcgcacgtgcgcacaattttgtcggcgtcggacactgcagtaggccaaaaaaaaccctgccggtaagctttgccgacaatggtgcgtgcggcagcatggtttccgcatatcccagaatgtatgtctttcagcaattgtctcccttcctctaaagatacgcagcgttgcagaatccctgaagggcttttcttgtacaactcagcttcatgcataacataaagtttgcttcgtcttgaaatccgctcggcttcatctttgtcttgggggagttcttgagaagtcaagaatcgtatgaggggctctcgccagtcggctgaaaccatagctacgtcatgagtgcccgcaacttgagtagtatctttgtgaggtactgtcggcgtataaaggtgttcgacgaaaacatcggagggcgccacctcgcgcttggatccaaagttggcaagtctgtcggcggcttcattattgtgtcgaagaacgtgactgagctcgagtccatcgaacttgtcttccaatttgcgtacctcttgtcgatatgccatcatgttgtcgtcaaggcaggaccactctttcataacttggttgacgaccagctgtgaatcgcctcgaactattagacgctttatccctagggagatcgcaattcgcagtccatgaaggagcgcctcatactcggcgacgttgtgggacgccgaaaaatgtatccaaagcacatagcttaatctttctccagttggggaaattagaaccactcctgctccagtgcccgaaagtctttttgatccgtcaaaatgcatggtccagtgctccatcttctccgcgggggtatcctcctggcactcggtctattcggtgacaaaatcagctaacgcttgggacttgattgaaattcggggcttgaatgatatgtccaaagacatcaactccaaagcccacttagcaatccgtccgtttgctccgcggttatgcagtatatcaccgagtggaaatgatgtgaccaccgttaccgagtgaccttgaaagtagtgagatagcttcctggtagtaattagaataccatataacagcttctgaacctgagggtacctcgttttggagtcggctaggacctcgctgacaaagtaaatcggtcgctggactttctggacatggccttcttcctcacgctcaacgaccaagactgtgctcacaacctgggaggtggctgatacatacagcaacaacggctcctgcgggtgtggtgaggctaagaccggtggctcggtgaggagtttcttaaaatcttcgaaggccttctgtgcttcgggtccccattggaaatcatctgttttcttcagtagcttaaagaagggcatcccccgctcgccaagtctcgaaacaaatcggctgagcgccgccatgcatccagtcagcttctgaacatctttctgggtacttggcggtttcatgttgaggatagcagtaactttctccgggttggcttggatacccctgtgagacaccataaaaccaagcagcttccctgacggtactccgaaggtgcacttttcagggtttaatttcatcctgaaagcgcggatgctcgcgaaggttcttctagatccgagaataaatcatccctttgttgggcttgacgactacattattcacatatggcttcaccgtgcgggccgatctggttgagaagcatctcttgatcatacgtggataagtgcgtcctgcgtttttagttccgacggcatggggaataacatttcttccaaaggccggaagaaggagattcaacaagcggattcctttatcggattgaggtataccgggtggcatcccaaaaagtggaaatttaaccccggggggagttcttcctcctgttattggggggcccccaagaagttctttggggaaaaatttttgagtaaataaaaaaaaaaaagggccgatggccgttttttcaaaaaaaaaacggtttgccccacccggatgaaggctcttttagaaaccggcccccaacctggtttattccctttgaaggttcttctttttgggaaaaaggggaggtgttaaaggcgggcctctcttcaattgaggggggcaaccctctcttgaaaaccgccctttatagttcccccccaa

SEQ ID NO: 29829 - DNA, 909 bp, Oryza sativa
  unsure (1)..(909): unsure at all n locations
cctctctaggaatacggggcatatcagatggtttccacgcaaagatatctttattgttctgaagaaaggtgatgagcgcgctttcctatttacaatctaactcggcgcctattacagcagttttagtaggattagaaggatctaggggaatcttcttagtcttggcttcgctttctccactttttgaagtcttggtagcgggcacttctccttcgctcgccgtggctgcagccagtcggatatcctctcgggcagacgccatctcgcgggtttgggccatgtcgcaactctccttgtcgcatgtgacggcttgcttgatgtcgctccgtagggataggactcctcggggaccaggcatcttcatcatcatgtaagtgtagtgcgggacggccatgaacttggctaacgccgggcgtccgagtatggcatggtatgctgtctcaaaatcggtgacttcaaagctgatattctctgtgcggaagttttcccgagtgccaaaagtgaccgggagggtgatctggccgagtggagttgcggataatcctggaattactccgtgaaaaggcgcattgcttggttttagcttggagcgaggaatctgcatatcatccaaggtcttggcgaagaggatattgagtgcactgcctccgtcgatgagggttctgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggtaccgagcacgctactcattntcaaannnncgccccaca

SEQ ID NO: 29830 - DNA, 666 bp, Oryza sativa
  unsure (1)..(666): unsure at all n locations
gtgcgtccnnatgaatgacatacnnnnnnnnnnnnnnnnnnnnnnnnnnnnnnnnnnnnnnnnnntgatgaaattaatcgttttttgtggctttctggtttgctattcgatatgtaattgtattctagaagcattcctcggtcgagtctataaagaaatggcattcatcactgctgggcatgtcaagatgtactgcttcagcacgcaatttggatatgtgtggaactggtccaggtggctgtgacggtgtggaggacacccaaagcccatttcggactcctccatcactgtcctataggtgcagtgaggtacatacagttatacgatgaattgttgtgtgaatgctagctaatgtagttccaaatcgtgttgatggagtaatggttttgtgcatgaagcagcagcttaatgggggtgtggtttctgatggaggacctgagcagttgggggcaggggagcacaaaaaggtgaactaagataacactaaatgtcctgggtgccattggtttcatgatattattacatgtaagaactaagttgccaaagaattgatcgacaaaactatgccatttctttttaccaggcactacttgatcttttagatnnnnnnnnnnnnnnnnnnnnnnnnnnnnnnnnnnnnnnnnnnagtaatcaaaannggcacac

SEQ ID NO: 29831 - DNA, 1321 bp, Oryza sativa
  unsure (1)..(1321): unsure at all n locations
aagtggctttgatttacannnnnnnnnnnnnnnnnnnnnnnnnnnnnnnnnnnnnnnnnnnnnccgttactcttctctctcttcctttatctctttaaaatattactcttctctctcttcctttatctctttaaaatatgtttatagttggcttatagcctgctattgtacctactctaaagggtcaaattgccaaaatttgtgcacaaagttaagcactgaaccaaccactggctcacttggcacgccagttttttttaagagagaaaattgtcagataggcaatgtggtgcaagcggttagatcaacgatggacgatcccgattagcccgcctcgcggttcatccggagaatcccaatattctgaccgccaccgtgtccctctacccgccgtcacccctgggcttcgccgccggcgagcgaaccccgccgctccccttccgaatcccgggccgacattgcaagccggtgggcatcgccagttcgccaccgccatctggcttctgccctgaccctcccgctcggatcagcgcgtgttaccgcggcgccggatgaaccgcgaacgccgcctgcctgctcgacggaatgcctgagtggagtgaggcacgctggcgcgtaagtcccctcgctgaaaatctcgctccgttgtattacctttatttgtttttcaagcaattacattcggactatgagtagcttcgctgcattgcatgagttgggggaaaggttcccccacttcagcttgagctcatacttacagtactctacataaattgtgtttcttttctttacttggggatcatcctgaacctaagagctagccaacatcaacggtaggccccttagttggtgtatatttctgtgggttttgtgcgttctttgtcatttgggatcgtgtggagtgcggcccctttctacccaagtgtgttgttgtagtgcgcttggttggcttcatgctgttctcctcgcttttcaaattgtagtgtgccgcactgctaaaagccctttgatctccgtgaatactcctttatgagcctagagaattcagagttctcgttctccagtaatttcaatggtgtgtcgtactctatgattcttcctgctcgtcagataagagcgcacaatttagtggcatgtaaaaaactggcatgtgtttgtcaagggtgtggcttaccttcactgaagacaagaatgagatcactgtcaataactgtgtgaattctatgtgctattgtcagcacggtgcaatccctgaattcatcgcggattgtttcttggataattggggtaccgagatcgatnntcaatnnnnaancgccat

SEQ ID NO: 29832 - DNA, 3100 bp, Oryza sativa
  unsure (1)..(3100): unsure at all n locations
gcgcgccntttgattgatatcacttnnnnnnnnnnnnnnnnnnnnnnnnnnnnnnnnnnnnnaatgtgacatattctaaaacaatgaatctggacagatgtatatccaattcgtagtatgtgtcacatccagtactatattgattttttatgggacggggggagtactcaattctaaaacaagttaatcattgatatatcctaataatataaatctggataaaagaaaatatcattatacatacatgatatgatttcattccaaaataatttaacttatatatagatcacattatattttaggttaagttattttagtacgaaggaagtagatctagaattggtggctaaaacacatcagctccatgcatggccagttggccacagaaaacatggtaataagtgcagggtgtgcagtacacgaaatgaaaccggagcaaatagcaaaatcgatcgtccacacctctttaatcactttagctgctttaatttggttatagtggatgaatatgcatgcatgcgggcgtgtgcagcagcagcagtagtaggtgcttgattgacagtttgagaatgagatccacactctaattaactctgaagctgacagcggaccccatgcttcctgctttccctgacagccgtcttctgcaattatcggagtcgaggtactccctccgtcaaaaaaatagacaaaatctgattttcgtgtccaacgtttgaccgttcgtcttatttaaaaaaattataaaaaaaattaaaaagataagtcacgtataaaatattaatcatgttttatcatctaacaacaatgaaaatactaattataaacaaatttcatatgagacggacagtcaaacgttggcacagaaacccacggtttgtctttttttttggacgaagggattagctacctatatagtcatgctgatgcgtgtcatcgatcagagtttagtggccacataaggtgtgcactctgggaagccaaagagaagagagcagtacatgcatcgccatctcttatactccttccttccgtcccataatataagagattttgagtttttatttgtactctttgatcactcgtcttattcaaaaaaaaattagaattattattttttttgactttctttattatccaaagtattttaagcacaacttttcgttttttatatttgcacaaattttttgaataagacgagtggtcaaacattgcaagcaaaaactcaaaatcccttatattatatgacggagggaatactaatttctaaccctgatttgggtgttactttccacttggcaattcagccaactggcgtacattatactgtgtcttgtcatctgtcactctcctatctcaaaccagaaatcactttgccgtgcatgcaaaggcagagcaactccatgtgtagattcagtaaatcggtagtaacattagtcatcatgtatgatttagcttttcgaacatattgatctgatgtgcatgtcatgtaaatacagtcatcaagacaaatacgacgtcctcgtcttttaataaaggaaataaacctcatgtaagagagtcaagttagtcatcttcttcatttaaaccatcaaagaaacatcagagcaacttccgcacatttcttagataatgaaaaacaaataaacttcgctctctcgctcatacaagtacagccacccttgtattagccatgtcttggcagctactcaatcgactacaatctgcaggttgctagtacacaagaagaaggccaagaattacaaaattaagacaaatggatgggtcaagacaaaattaagacggccaagtacgtcatgtaaaagcgtcaagtcaatagtcctttttttccctaacatattgtcaaaacaccaaaggaattgaagttccacacgaacactagcccatccatgtagattccttggcagccacgctcaacaaatttatactatgcaaagaaagggagggaaaaaaattaattaagacaaatggatgtgtcaaaagttagctgaattcgtgcggcgcaagagagcagatgaccaaacaatgctagtcaactcaagtcatgcagctcccttgttataattaattaatcatcgtattcgtatatatattgatatactgaactaatctgtcgttgttgttgtgtggttgtcatgcatatactgtcatgcagcccaacgtttagtgcgatccgacgcaggcaagcacgttggctactttacaccataaaaaggcagttttttttaaagaggacaataaaaggcagttaagcactgagccagtcattacacacaacgctaatcttcgtcctttctcttgtcctgatctgcaaggaagagtatatacagttctgtgctagctaccactcatcagcctaagtgatcgagagatgtggatcgatttgatccaacattagtgctgtgtttaggccttaggtgcagaatcataatgacggattgcgaaagttagcaccgagtaagcagcagagtcgtttttagctggtggtggctggcgccgccgccgcgcgcgccggtacggtcttcttctccggcaccggtgcggtgatgggttggtgccttggcggaatccaactctgcactgcagtctgctctgcactctggtcgacgcgtgtagaggacaggacggaaggcccaacaagtgagcaggtaggtctcgacaatgtgtttgggcctttagaagtcatgggcccaagcgatcaagttgcgggaagggaaagaagtccatttccagtccctctatagttcaaaatgacaaaactgcaactttaatgagaaaactatcagtttgctgcaacattagcggcatgtttcagtttgctgcaataatagcgtgaaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 29833 - DNA, 1515 bp, Oryza sativa
  unsure (1)..(1515): unsure at all n locations
aggccgccccngtttgacatcgattgannatcctagctcggtaccccggcgcgaggcagcaacctccgcggcgccgcaggcccaggacctgcaggccctctctccgcctcaccaagtcactgcctccgtctccgatgcatatcacatccgtacgtacagaaattttcaggttcgcaacatttttttagcataccatgaattcatgatacgaatgcaatactatctcatctttaggattgtgagggtattatgccattatactctcacgcaggaactctcctccgtttctgtctatttgattcctctatggccgcattcagttgattgactgataccgccatccgccgctgctcgggtgctctgatcatgtgtactgcactactcctgtctgtctcatatggcaaatgtacattgatgttagcactggccactaatcggtaagatctagattcgtttcaattaatatgttgcttttctagctttgtaatttatatgagtttagccattagtatattaattttctcaatcatcaatttgttcttttatcacaccttctagaaagtttaaatggtttgccattttatacattgagtaaatgatttagatgagattgacattcataccatctttagtaactatgcatttcaaacaaattttaagctgatatatatgaagttttcaatatggatattgattttggaatgaagtatttatatatttggtacatatatattgactattatttagatgtttatatcaggggcccctgtttttaattttgtcccgggccaccaaaacctcaggacgggccctgccctctattaagggaattcgtttcattttttgttccactaaaaatgtttcatcgagtgtacttataatgtttcactatgtatggatcaaatgttgcagtgaactgaaacattatttcgctatttgctgaaacattgtttttatataaggtgaaacaacgtctgatttaaacgattgaaacatttccgatttacttagtgaaacaattccgatatatctggtggaacatcgtgcaacatttaaaaataattcaataataagcttaaaaaaattcgttggaatatatccatgtgtggttctgttttgaagatttaattgcaacgaatttaatggtgcaatcggatcatgatttagataaataatttaagagaaaaaatagtttaaagtgtttttgtacacatgtgtggcgctaacgtttttcccccacccacgatcgggcgcccgatttgtagggggatccttttattgttggagttggagggtggttatacttggtttgaaggttacgaattagactttttccttgccggaagcaaagtgcgggccaacactcagaagaattcgaaatgtgagaggcccaaaaactatggatatgggccttgagaagaattcgacatgtcagatatttgggcctttagccannnnnnnnnnnnnnnnnnnnnnnnnnnnnnnnnnnnnnnnngatntacaaatccaagccat

SEQ ID NO: 29834 - DNA, 1228 bp, Oryza sativa
  unsure (1)..(1228): unsure at all n locations
gatgttgagcctgccaacggaagtcaaatggttcaaaaaagggcttcaagtgatttaaaagttaccctagaattattttccatcacaatgtttttatccccttcaaaagtaaagtgttccttttaacatgagaaagttttaaggaatttccatcaccctcttgagaccaaccttcaaaaattttaagttaaaataatagtttccaaaggatttggttttggaataaggattaaaaattggaccatataattgcctatatttagatgttatatcaggggcctggtttttattttgtccgggccaccaaacctcaggaacggccttgccttctattaaggaattcgtttcattttttgttccactaaaaatgtttcatcgagtggacttatatggtttcactatgtatggatcaaatgttgcagtgacctgaaccattatttcgctatttgctgaaacattgtttttatataaggtgaaacaacgtctgatttaaacgattgaaacatttccgatttacttagtgaaacaattccgatatatctggtggaacatcgtgcaacatttaaaaataattcaataataagcttaaaaaaattcgttggaatatatccatgtgtggttctgttttgaagatttaattgcaacgaatttaatggtgcaatcggatcatgatttagataaataatttaagagaaaaaatagtttaaagtgtttttgtacacatgtgtggcgctaacgtttttcccccacccacgatcgggcgcccgatttgtagggggatccttttattgttggagttggagggtggttatacttggtttgaaggttacgaattagactttttccttgccggaagcaaagtgcgggccaacactgagaagaattcgaaatgtgagaggcccaaaaactatggatatgggccttgagaagaattcgacatgtcagatatttgggcctttagccaagatgggctttagctttccaatttcggctcggagcttgggattgaagatgaacagagatgggattaggtaagcatgaaaaaaaaatatttattaatgtactgaagatacaagttggatgattcattctgatatatcaatatatcatgcattacagtggtgagatatcagaaccgacaacacaagtttgatgcttcacttttctgcactnnnnnnnnnnnnnnnnnnnnnnnnnnnnnnnnnnnnatagtataatataaaccaca

SEQ ID NO: 29835 - DNA, 622 bp, Oryza sativa
  unsure (1)..(622): unsure at all n locations
tggcgtcntttattactactnnnnnnnnnnnnnnnnnnnnnnnnnnnnnnnnnnnnnntttcttgtacaccacttgatcagaggaacgcaaaaaatggtcatgagatttgcacaagttccatgagggaacgaaagaaactttgccgtcgtacatgggcttttagaaccgtgtaaggggggcccaatattttatgggccaaatctcacttctggaccaatgctttctcctttcaggcctagttttcaccgggccgtcacgggcccacgtcgcagtctaccccgccgaaatctttaccgcgcgggaactccaatttccaaccccgcccaattcccctccctttcggccattccccttccccttctcggctcctctcctcttctcctcgcctttccaccaccttcccttcccaacccgatcccccattccgccggcgttcggcggcttcgtcgtatcgaaccggctagcgaccggaaagaagaaaaccctagtcctcaacacaaccatggctccacggaagcggacggggcggncngcnggggcaactttcaagaagccgccggcctcgcaggcgtcgcaaccggccagntccgcattctccactttttgagcgccagtcccagg

SEQ ID NO: 29836 - DNA, 831 bp, Oryza sativa
  unsure (1)..(831): unsure at all n locations
atggccnattatgacnnnnnnnnnnnnnnnnnnnnnnnnnnnnnnnnnnnnnnnnnncttcttatgtgtgaaagatgcatcatggcctgaaatcttctcgcgtgtaaaatcagtacagcagttacctgaaaactgttttgcaaatgcagtggatcactatcttgttcttcttttgaggccctggtgtagcagtaggacgactgcattatgactctatgagtcgatgagcagtttagatcgaagcagatatgtacagtagctgctgtgaggcaaatttttcatgatatgtgacggttcctcttactttgaagtcttactttgaagtcaagatgaatctgtgaagtgagttgaccgtgaacccacttaaacaaaattacttaaacaaaattagtgtacccacttaaacaaaattagtgggcaacctatgaattaatccacgggttacttactaaccaacttgacgacgggaaccggccgtgggttgcctatttatttaatttaatctataaagcttcgcgggtgatccacttgtatacctacatcttttatcaggatcctggtgcaagaaataatacggatttgctgttgtgtgcgtacgcgccaacgggtcaactcagcgcgcgtttcggacgttcgcaggctcattagtaaagcacgtgcaggtgccaactcatacaattagtgtgtgattaacgccatatctaacgtgattaacatgagtacgtagcgctatgatctcatacttttttttttcttttttccagtaattagctctattattaacatgaacattttcaaatttaagttgaaagtttcgaattttaagataag

SEQ ID NO: 29837 - DNA, 1141 bp, Oryza sativa
  unsure (1)..(1141): unsure at all n locations
tgtgccccattgatgacactcnnnnnnnnnnnnnnnnnnnnnnnnnnnnnnnnnnnnntctgtcataaatgccgaaagttctagcagagtgacattcactgagaacagtaaaccagcagatactgatgatgagtttgaagcagaaaatgaaacagatgatcaaattcagggtataacaaagcaagagtctgcacatgatgtatcacaggacatcaatgagaaagggaggttaacacaagatgaagagcgagaaaagggaggtattggcaagaaggtttactgggcatacctgagggcagtttatggaggtgccttagtgccagtcacaatcgcagcacagtccttcttccaaatatttcaggtagcaagcaactattggatggcatgggcatctccttcaacatcagcaaccaggccaactgtcggattagggctcatgtttgccgtatacatagcattgtcaattggaagtgccttgtgtgtctttgctcggtccatgcttgtttcactaattgggctactaacatcagaaaagttcttcaagaacatgctccactgcatcatgcgagccccaatgtccttctttgactccacgcctactggaagaattctgaacagggttaagactgacttagtttgtaaaccattttatactgcatcacgtactctctccacccctaaactaataggtgtgtatttatgctttaacaggcctccaatgaccaaagtgttctagatctggaaatagcaaacaagcttggttggtgcgtattttcagtcatacaaattctggggaccattggtgttatgtcccaggttgcctggccagtttttgccatcttcgttccagtaacggtggtctgtttcatgtgtcaggtatgaactcccaacaagaaaaaaaaactttattactagccttttgtactaccatagcaccatgtgcaaaagtcactctgtgcaccacgatgagttccaagaagctataggtacaccttttctccataaattatagcgttcattcacaaaatactgaaaccatatactctgtgtaatgtgcagcgatactacataccaacagcaannnnnnnnnnnnnnnnnnnnnnnnnnnnnnnnnnnnnnnnnagtaatcaaaantacacac

SEQ ID NO: 29838 - DNA, 2724 bp, Oryza sativa
  unsure (1)..(2724): unsure at all n locations
tttaaaatctcaatgccaataaagaaaagagacagtggacgggccgtagaggagtataatggcaacgtttgacgggacatctagaaattataaaaatgaaacacaacgtgacaataaactctaaaaactataaaatccaatttttaaaggttccaagaagaatgaatagaaatagtggtagatcgagcaagcaaataaagaagaagatgacataaggggtagcaactggtgtgactttaaaaaactatataattagaaacacgaggatgataaggtttagtctttcaaagtcttaagacaatgagatatctattttataaattttaagtaatatcataaaaaatatatgattttgtttgggtgctagccgcgcaattgcgcgggccacccagctagttagttttgaagtcatcaatagtgaacaacaaaaatataccacaaaaattaaggcatgtgcttcacatgtgacatatcgcaacaaaccaattgttaaagttaatgactgcagtaaaacaacaaacatgttttacaaaaatatgttgtttttatttctctgttcaggacaaatttgagttaatcgccgaagcaaaacaataacctgcactgcagcaatagtacaaagcaaatctcactcaaacagagaaccccttttacacaagaaaccctttcttttagcaaacatatcttgtttgcatcatcctttcttttatttttgaaaccaaattatactttcatttagcttaaaattcatagaactaggcaaacaaataagcatggaaaactaatccaaatgattcgtttggcagtatgtagccttacccttctaactgagcatcatagcccatttggacattgacattgctcccgacccttgtagcgcaattacctgcatcgaagaaagaggcaacaagtcagaagaccataatgccacaatccatattggcgcgcgcgcgcagacccacccacccacacacacacacacactcttaagctttgaaaaaaaaggaaatgagctgcaaaagaacctggtatcaaatattccatatcgatttcagcatcgaggtgaaagaaatgaattgaaaaggtgctgggaagagcacaaatcaaagcaccgctttccatatgcgcaacgcagtgcatgcatgtacactgctctgatgaatgattgtagtcagactggttcaattcatcaggatactcatctcccaagagagggttatcgaacaaaccagatatctcagcacaaagctctaattcctgaacatagctctgaattgccagtaccctcctcaccttctccctctgctcagtgacaccacacttctcttgcttcgaaatgctgagctcaagcatcttcaccatggcactgaaactgtgcccgagaacgacgatcttgccgagctgatctggggtccagttcaaggtgagcaaattctcaaagaagacgcgatccgcgtagggcatgaagatcagagttggctgttcgaccacaaggcagagcgcaggcgacgcggtgacaacgcagcccagctcctccatggcccggcgctccaccggggccacggtgggatccaccacctcgacggcgccgaccagctcggggaacttgtcccgcaggaggagcagcaaggcgaggcggaaccgcggcgcccagctgtaccccaagccgccgagcctatacgccacgacacggagccgctcgtggccacgcccacggacgcgctccaggccctcgaggcacgcggcatcggaggagaagagcgcggagagcttcgcgaaaagcggcgatgacatggcaagctccatggcgaaccacaagaaggacatgagccgcgcgtggtcgcccatcacgaactcctccttgatcaggttcaaagaacgcggaccacctgggcacgccgcgcgcgcggcacaaggaaacaaagatcgcgaaaccacccaagtttctccggaaaaaatgacggcttccaaaaaaatcccaaacacgcaacacatcatgcaccttttttaaaaaaaaacgtgtaaatatataccatggtccattgaaacaaaatataggaataaaaatattagcagaaaaatattggagtacagctggaaaatatctttaagatctagcaattccttctccccactgcggcacacccctatcaccccaagtttctcaaaaaaaaaacacatcttgcgtcttggaaaaaacaggtcaacatatactatggttcattaaaatgattgtatgcatcccaacacatcttacaaaatatcaatattagaaaaatcgagatatctatatatctactactgtaaaagtaaaatcatcctccttttatgccatcctccaccacccgcatgccttccacccacatttctccagagaaaccaatggcttctagaaaaaatcgaacacacaacacatcatgcacctctagaaaaatgtgtcaatatatacattggtccccatgcgtctctagaagaagagccaacattaacagacccaaaaaattaagcaatctatattgcgaaataaaggggttgtttgcatgctatacaacaatcatttgtcatacttttgtgccacactttagctaagttatggccaataaaatgtaagccacactttagctagcaaataaagagtgtgccacacatttttgagttaatgacgtgtgagaccatagaaagggtaccgagaacgaatgatcaaaaccaannnnnnncaccatc

SEQ ID NO: 29839 - DNA, 598 bp, Oryza sativa
  unsure (1)..(598): unsure at all n locations
tgcgccnnnntttganatcaatgcgtactcgtacccgaattttcaaagctctaccgaaaaacttctctcatcgaaaacacaatcttgcaagcggaatttggaggttttaatatcgccgaacacaatcttgcaagcggaatttggaattttgaattagattaagtaatttcataaagtggtagagtgcattatgtttaacatgctgatcaaagggtagatcaaagtggtagattagtgaaggtgcaaagtagactaagtggtagttcaagtttaattttttttttggttggttgtatcgtgatcctgagagtgaaaaaacatccgagaaataaaacaaaaatgacactgttgcaactccatacagagaagcaggaatggaggcgagggtttgggaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 29840 - DNA, 577 bp, Oryza sativa
acccagccgtataaaaaataaactcaaacggacaaaatatgtgacatgtagaattttccaaaactctatcgaaacggacaaaatatgtcatctattaaaataggcgtaactttctcatacggacttgaaatcaggaaaataatatatgcacggacatctacagaaaaagttacatccaattctccctagctttgccgggttcggtgatattaaatcccccaaattccgcttgcaagattgtgttttcgaggagagaagtttttcggtggagctttggaaaattccacatgccacatatttcgtccgtttgagtttattttttacatggttggttcctgtgagttcctaagggtgaaaaaaatatcaaaaaataaaataaaaataaaaaagttgcacatctctctcctctgcactagttcggagagaagagaggagaggaaaaattctacatgtcacatattacgtctatttgagttcaatttttctatggttggttcttgtgtgtccctaagcgtgaaaaaatatcaaacaaataaaacaaaaataaagggtaccgagctacggtaatcaatgcaaa

SEQ ID NO: 29841 - DNA, 1610 bp, Oryza sativa
  unsure (1)..(1610): unsure at all n locations
cgggaagattttggccggtggaatcatttatttgaacccttaatagggatgggcttcctccccccaaaaaaagatggggttatttattttaacagacctccataaaaaatgatgttagatcggaaaacaaaccagattggtgggggggttttcaggaaaacaatttgggggcccctggtatatagccccgaggcctggcacagttttgcctactcgttagagagacggggnnnngnnnngggtcaggtagaactccaacaaaaaaaaaacctttaataaacccttttggnnnnnacgccctttaaagaaccccttgtaagtaccaccccccagtgggaaaggggacggccccaaaagagcctggcacgtctgtttaaagacggaccaagcattggggcgcctcaaaaagaacattttttggaatagtttttataggggtccactgcgaaaataagtttttcaaaaggaccaatatgtgaaaaatccagggccaagacaggtgccccacttgcgaggtgtgcttcaagcgcgggcataccgcagcagactgttggtatcgcttcgacgaggactacgtcgcagatgaaaagcttgccgctgctgctactaactcatatggtatagatacaaattggtatattgatacaggtgctacagatcatattaccggtgagctagagaaacttaccaccaaggaaaagtacaacggcggcgagcagattcacacggctagcggagcaggtatggatattagtcacattggtcatactattgtgcatacccctagtcgtaacattcatctaaataatgttctttattttcctcaagctaagaaaaatcttatatctgctagtcagttagccgctgataattctgcttttcttgaacttcactcgaaattcttttccataaaggatctggtaacgaaggacattttgcttgaagggaaatgtaggcatggtctctacctgatccctaactcctttggctgatcaaccagcaaacaagcccttggcaccgtcaagctatccttgtccaggtggcatagccgtctaggacatccgtctcttcctattgttaagaaagttattagcaaaaataatctcccatgcttagttgagtcagtcgatcagtctgtgtgtaatgcttgccaagaagcaaagagtcatcagttaccttatgttagatctactagtgtgtctcaatttccccttgaacttgttttttctgatgtttggggccctgccccagagtctgttgggagaaataaatattatgtgagttttattgatgattttagtgctaaaatataagtctcaagtctttgagaagtttaaagaatttcaggttctagttgaacgaatgtttgatagaaagattattgccatgcagactgattgggggggagaatatcaaaaacttaattcctttttttgcaaaaataggaattgatcatcatgtgtcatgtcctcacactcgtcaactgaatgggtcagctgagagaaaacactggcatattgttgaagtgggtctctctcttttatcttatgcatnnnnnnnnnnnnnnnnnnnnnnnnnnnnnnnnngagaataaggatntcaaatcacag

SEQ ID NO: 29842 - DNA, 1167 bp, Oryza sativa
  unsure (1)..(1167): unsure at all n locations
tggggctcnnattgatttcaatgcggtgctccttaccccaaagagaaggggagagatactcgagaaatgagtactccaccttatatctctttttttaggatgattggtggcccacatatcagcattactcagaaaataaaaatgcaacaaattcaactgggaattgtgtcgatgtcaaaatttggagtgattctctaattggttcgcttaaggaaaggagtcgattgatggattgaagttaatcgagagatcaaatttatgtaggaatcgtaaatattacgacatgacaaattaattttatctattaattagacaagatttagaaactttcctttttatctttggtaagtttcatctagtgtccgatgacttgtatatttccttttacttttacttttaggaaacttgtgtcgtgtttcgatcacgacttatatcaatctataagggtataaatatatacacttaggatctatagaaaatatttctatatatcaatacaattatttttggcacaccatcatcttttgttccagcgagttcttagttttgagttgggatgtatcggttttgatctccggcgaggatgttccgtcaacttcgcttgtattggcgtggttaagtccgatattctattcaggttgacgcaaaacgttgcctatttgatatattagttctatctttaactgtattgctgtttagagtcgtatcggcttagatatgacttttttaattagattcgatattctgactaagttgatatttctctaatcgtattgttgttttagataaacatattgtattttttataatattgtataataatgagataatttattgaaccttatttataaaatcttacgtccgtcattaccgcgaaaactagaggcatgacaagaaaatgttttcaatactgtaatagcctcctgaaaagaagtactccactacactactaaagaacagttaactaaatctcgagggagatcaaatcaaactagtcaggatgtgttcatcgccatacccaagactctttgctggtgttctttttttctgaaaataaatatgaagatgaagattaagtttttttaaagtaaaacgagatggtattnnnnnnnnnnnnnnnnnnnnnnnnnnnnnnnnnnnnnnnnnnnnnnnnnaantcaaagcact

SEQ ID NO: 29843 - DNA, 585 bp, Oryza sativa
  unsure (1)..(585): unsure at all n locations
atgcgcgcctnnnnattgatnatcgatatcggtgctccggtaccccactacacttacatgatgatgaagatgcctggtccccgaggagtcctatccctacggagcgacatcaagcaagccgtcacatgcgacaaggagagttgcgacatggcccaaacccgcgagatggcgtctgcccgagaggatatccgactggctgcagccacggcgagcgaaggagaagtgcccgctaccaagacttcaaaaagtggagaaagcgaagccaagactaagaagattcccctagatccttctaatcctactaaaactgctgtaataggcgccgagttagattgtaaataggaaagcgcgctcatcacctttcttcagaacaataaagatatctttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 29844 - DNA, 969 bp, Oryza sativa
  unsure (1)..(969): unsure at all n locations
attgatatccgtctcggtacccctttccggtcgatcggccgcgagtccactccgccggcttgtcctcgccaccgccattgctgatagcaacaacgacttcaccgccggcctgcctccgtcgccgccgactggtgtcatcgcctatacggttggtcggtcacaccaccgttcatgggcgtccatgtcttcaccgaccggctggccttcgccgccgccgactggtgtttccgcctgcacggctggcctattatgccgctgctgttgggcgtctacgacttcaccaccggcctgcctccgtcgccgccgactggtgtcctcgcctatacggtcggttggtcacaccaccgttgatgggcatcgtcatctacaccgccggcctgcctccgtcgccgccgactggtgtccccgcctatacggtcggttggtcacaccaccgttgatgggcatcgtcatctacaccgccggcctgcctccgtcgccgccgagtggtgcctccgcctacacagctggcctattatgccgccgctgttgggcgtctacgacttcaccgccggcctgcctccgtcgccgccgagtggtgcctccgcctacacggctggcctattatgccgccgctgttgggcgtctacaacttcaccaccggcctgcctccgtcgccgccgattggtgcctccgcctacacggctggcctattatgccgccgctgttgggcgtctacgacttcaccgccggcctgcctccgtcgccgccgagtggtgcctccgcctacacggctggcctattatgccgctgctgttgggcgtctacgacttcaccaccggcctgcctccgtcgccgccgactggtgtcctcgcctatacggtcggttgatcccaccaccgttaatgggaatagtcatgtacacccccggcctgcctctgatcaccgcggatgggtgcgagcacgataatgatttcaaannaacccacc

SEQ ID NO: 29845 - DNA, 1093 bp, Oryza sativa
tttatcttaaaattcgaagctcccaccttaaatttgaaaatgttcatgttaataagacagctacagctttggaaaaaaaaaaaaaaagccgccccgatgacagcggtaggtattcatgttaatcacgccagagagggcgttaaccccacactaactgtatattgtgccacgcagaagcggatttaaaaatcaagcaggtctggtgccccaaaaaggaccatttctagaataagtttttttaggggtctatttgcgaaataagttttttaaaaggaccaaaatatgaaaaatccagggccctgtgccgcgcccctggccaccgcgtgcttggccaccaccgcgtccgcgcagcgctcccctgccgctgccgccgttgaagttgttgtgggcgccgtttttgttgccgcgcccgccgccgcgattagcgacgaaagcagcccctccctgaccggtgttgcggtagagatcaaggagagtttcaaagttgaggagttgagagtacagctccccaaccgtgatgggatcggacttggtgcagagagcagagacgatcgggctgaagtcttcatctaaccctgagatgatgtactgcaccatatcctcttcatcaagaggacgaccggcggcagccatctcatcaccaagagctcgcatcttggcaacgtattcagcgaccttcattgttcccttcttcgtgttggtgagggcgagcctggtattcaccgatcttgcacgggtgcggctggagtagagttcctcgatggctcaccaagcttcagccgccgtcttgcacatggcgacttgaatcagaacatccctcgaaagagatgacaggagatagccaagaacaagttgatcattggcttcctaatcttcgaatgccgggttcggctttgtcacagtcttcccatcgacggtgactgaaatctcggcgtctagagctttcacagcgccggtgaggtagccctggagacgggctccgcgcactgcagcgctaacttgcgctttccacagtgcatgattgcctttccgagtttctctgtaacggaatggccctgagcgaggtttacagctgccgcgcctgaggaagaca

SEQ ID NO: 29846 - DNA, 1325 bp, Oryza sativa
  unsure (1)..(1325): unsure at all n locations
atttataaagcacgtgagggtatttacagattttccaccagaggtgcaataaattccgatttgaggatttccaaacccgtgtgaggtaccttgtaagaggggttcgagacattaagagaataattggcttttccacagggaataatgcccttccgaagttttttgtgagaggaatgccctgagagaaggtttacaaactccgcggcccttagagaaaaacaacaccggatataattggtggaagaataaatcaatattacccgggtggaaaaaggttttgaatccatggtgataatatgtaaagggttaacaccttgtcctcgggccggtatttttgttaaaaagtggtaaaaacaagctctacccggggcttaaaatgttcaagtacaaagtattaaggagatagacanaatttgaaaataagaacctatccctacaaccttattcattggataagttattacgggtgtgaccagttgcgccataatggaaggcatgcgcaatgcccaatgcgacccccacgacacggacactgtccaatgcttgtcgcggtggtagcacaccgactgttgagccacgcccgccgaaatggcgccgtcatcctcgatctctccttcatctgtcgcctctccgggaccgcccgacgacagccatcggtggcgtcgccgccggcgcatcggccttcggccctcggcgcgttgcagttcatgacggcggtggaggagatcgcgcgtaggcgggcgacgccggtgctggcgccagcgtggggccgcgacgcaatcccgtgcctgccgtccgccgccgtggacccgctccccgccccgacggagctccgcctccagtacctcaccgtggacatctcgccgccgctgccgccttgctcccctgctcccgcgtcgtctccgccgccacgtcgccggccgccggacctcctctcccacctcgcaccgtcgatctcctccccacctgtcggccggcggcgccgggctacccagagtcaccagagagaagagcgagagagagaaggggaagggagagaagagaggaaagaaatagaggctgactggacaagctgacatgtggggcgcacgtgggtcccacgctgactcattagacacgtaggataaaaccgggatcgaaaccgccaagggacctattgtgaccagttttatatagttaagggatcctatatatctggttttgcggttcgaggacggttttgtatcccgttgacaagttgagggaccttcggtgtactttttnnnnnnnnnnnnnnnnnnnnnnnnnnnnnnnnnnnnnnnnnngatntattaatcaaagcaccg

SEQ ID NO: 29847 - DNA, 856 bp, Oryza sativa
  unsure (1)..(856): unsure at all n locations
atgagacnntnnnnattganatccgatctcggtaccctattatatgaaacttaataaactgcgtcaaagctgtggtcttcttttctgttgttgcacatcgcaagtttaagcctgaaatatgttatttttccatgttgcccatttctcaataatggaagctttattaaaactcagtcaaatacaacaagatgatacattctaattgagcccactcccgacctctgcaagaaatgcacacagccacaaaacatgacctatctagacccccattgccttcttcatgctcttaatttctgtaacatactgttcacctgtctggctatctgggatttttcaaggtgtacacctacggtcattttgatggaaggtgaaggggaattacctcaactgaacagaggatgctggttatacagaactactaacatcgtaagaacattctatgattctgatgcagacatacagtacagttttaatctaatcaaggaggacgccatatgtgggacaccgcagcgaagtgtaaggagtcctagaacatctaccttaggagttaagagaatctatgagattgtatgtataaacatcaggtttctgcaaatactcttatctaaattcctaatgcctgtattgcaaatactataatcgtagaaaaatagttaatgtagacccaaatatgcactatatgatgcatatcacttcaatttcccatcgaacgagcccctattctacggtggtgtggggattaaagaggattagaggggattgagagagaataattccacatcacaataggtgtggaataaatcccctccaatccctatctcgtanggattaactgaaccaggccttaccggggaga

SEQ ID NO: 29848 - DNA, 1223 bp, Oryza sativa
  unsure (1)..(1223): unsure at all n locations
cccaatatgtggtaacccaaccttttttgggtgggaatcccccaaaaatagggggggagcgggtggtttcaacaacccgcaaaaaagccctcaatttccctggcacaaataaaagaggttaaggccaattttgggggaaaaaggtgaaataattccacacaatttttttaaggctgaattgcccaattaggccggggataccagcccttaaaagctaaactttaaaaaagagaggaaattggctgggaatttggaggttgccccctgaacaccttcattttttgggggcccggcatttaattctcaaaacacattgccgcaggcattttatgggaatccttttacngctggacttgtttgtctgctctgcaacatccggattgctcaagatccaatcttcactcttcccgacttgctttcagtgtttgctcaaggaaaagtttcaggtgatagggtggccaaatacctccaggaagaagaattgaaatatgatgcagttattgaaatacccaggaatgacacagaatatgatattgagattgatcatggaatattcagctgggaactcgagacaacatctccaactctgaaagacgtagaactaaaagtaaaaagagggatgaaagtagcaatctgtggaatggtcggatctggaaaatcaagtctattatcatccatacttggggagatgccaaagctagctgggactgtgagggtcagtgggagcaaagcatatgttcctcaaagcgcctggatcctgtctgggaacatcaggacaaacattctgttggaaaatccatatgacaaagaaaagtatgacaagataatacaagcttgtgcgctgactaaagatcttgagttgtttgcaaatggtgatttgacggagattggtgaaagaggaattaacatgagtggtggacagaaacaccgaattcagatagcaaggtcagtatatgaagatgcagacatatacctttttgatgatcctttcagtgcagtggatgctcatactggaagccaacttttcaaggtttgttctgtttgtttaaaactttcaataaatgctcaagtatccaggttatgttttaactccattcttcgtggcattaactccattcttcgtggcataacgttaataaaaaaaagggcaaaacctatttnnnnnnnnnnnnnnnnnnnnnnnnnnnnnnnnnnnnnnnnnattntgtaaattcaaggcactg

SEQ ID NO: 29849 - DNA, 1456 bp, Oryza sativa
  unsure (1)..(1456): unsure at all n locations
agccggcgggcgagccatgatggcggcggcggggcctccttcatggcggtgacccctctcagcgcgggagaggcggcgaccgatcccggcgaggagacggcggatccagcgtcaccttcgccggatttggccatcccctggccagatccggccggagtgggtgctggtggcggaggagaccgcggagcggcgacaccggcgcgacgaggcggcggcgacggcgacggttacggcgcggcgacgcgacgacgacgacttgcacggcagccagcggcggccgccgcgacggtgagatgcgcgcgggcggcggtgctcgcaccgccgggggcgagcgacgcctgcagcgccgccagccctggtggcagcagcccgagcgactgcggcgcgaggctcgcggacggcggtgactggcagcgcggctggtgatgggcaacggtggcggtgccagtggcagccgcggctgcggcctgaggcagcagcggcaacgcctgtcggtgcagaggcagaggcctcagagctcgtcgcatcggcggcgtcagcggctgctgtggcacggtggtgcgttcggcagcagcggctgcggtggcggtgaccacggtcgcaggaggcatgacggcctcggacgactagctgaggacatggcagacggctacatcggaccggcgtggcatcgtttggaagaagggtcggagaccggcttggcatagagtggcgcagccgatgacagcggaggccggctcggcgcgagaggcgcggccgatgaagggaggccagattggcgcaagaggcgcgtcccgtggagaagactggcttggcgcaaaaggcgcggccggcggtgaagaagccaacctcggtgcgagaagaagctaccggtgaatgtggcgcggtctccggcgcatgaagactggccggcgggggacaccggtgcaggggtcccgcatgtcggcatagctgaagaggtggtggagcatcggtgcgtcagccaaggattcgcaggtggtgatcggcaggtgaaaatctagtccggccttggccgggcggacaacgatggttcattccccctcctgagggcgttgtcgtgatgtctcacccttcaagggcggttgccggacgaaagcctagtctcggcttctttgaaccccgacggacggcggcggcggttttttccgtcgcttctcttcttgaagacgtcgtttttggcatcccttagagggcgatcttgtctgtgttcctttgttagtcaagcagcggtcggtcacgcttagcggtggccggtccggtgctagccttctcccgggttgtgtgttggcgccgtcggtgtgcgggtggtggtatatttttttcctttttcctggttacaaccctatagagttgtaatcttgtaattttttcatgatgtggggatccttaaagtaaacctgcaggcatggacgaatacgatntgcaatcaagacat

SEQ ID NO: 29850 - DNA, 578 bp, Oryza sativa
  unsure (1)..(578): unsure at all n locations
tgcgtgntnnnatttgaaatcggatgcggtaccccattctccacttcttcgagcgccagtcccaggcctcctcccagaacgccaagcgccagaaggccgacggcccctcgcagcctcccgcgccgtcgccgcctccgccgccaccgccgctcatcgaggaggagccatcggaggtgtcgccggaggtcaccaagactctggcgccgaagcgggtcaggttttctcctgggatggtaagtattggtcttgcgcttggtccgatttggaatgcattagttggcgtttggatcgactcttaggttcgggggtttcttgtttggtgcggtccagctgattaagcagagccaggacgatgggggtggggaggttgtgacttggaagatctcgccggtgaatgatcgcctgcgcatggtcacttcaaggcagatgactggtatggcgcttcatccgtgctcaaacaatgaggtatatactggagtttctttatgttcttgcgaggtatataccggcgtgcaatgcacgtatgtatgtgcattggagccggtggagacacaacactttcttgagtgatgaaatta

SEQ ID NO: 29851 - DNA, 1301 bp, Oryza sativa
  unsure (1)..(1301): unsure at all n locations
atgtgatttgtannnnnnnnnnnnnnnnnnnnnnnnnnnnnnnnnnnnnnnnnnnnnnaatcgggtggcgtggtgcaaaaagcgagggatcaggagagggatgcgagaaatggaccaaatgggagcttgacttgaagcctgcctgcctatatactaagcggaaggcaatagctcgaatcctagtcggattcgggaagtcaacagcggaaaatgacaggtcgaatcctagtcggattcgcatggaaaaaaagctcgtacggaaacgcgaaaagctcgcatattttgccattgtggtaatgtggtcatttggattagaggtaaacaaactgaagcaaaagtacaaattagttcatcactaaacaagaaaaagaaatgactaagacatcagcatctcgtgactttgcagcaattatgcattcaatttgtaggtttgacacacaatcatccaaatcacatataaatatctatttttaatattacaccgttaactttttaaaatacgtttgatcattcttcttattaaattttttttataattattatttattttagtgtgacttgatttatcattatatattctataaacatgacttactttttatatgtttatacaaaaaattttaaataagacaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 29852 - DNA, 1276 bp, Oryza sativa
  unsure (1)..(1276): unsure at all n locations
atgtggctnnnnnnnnnnnnnnnnnnnnnnnnnnnnnnnnnnnnnnnnnnnnnnnnnatacttattaattatttttgttaaaactacttgctaattaattggagcagaaacagattctctgtgatgaaatagatcttcatagctcagatatgatgaactgaagacagtactcgtttgtcagacagtgatttagttggaactgcacttgtactcgttttctgttccattttagtttcaggagttggcagacggtgcatgacaaagaaagatgtcgtaatgatgccaaactatcacctaaaccacattaagagaaaccataattttgactcccaagtaatctggcacacatgatctttcatttctgaaaaatacattatacatgggagggaagtcagcattaacaagctaaaagcccttgtataggtaaaatataattgggtacagaagatggtgtatagatacaagattacaagaggcaatccaccttgttttttttaccattaattaatcatccgccgtcagtaatatgatgttgagaggtgtgaaacttctaactaaatgacattacaggcaaatttcttatctctataatataatttcatccaaagaaaatatgagaatgcggctggatggatggatgacccaatcacggtcaaatgaaacgctcaaccgctcgcaactaattaatacagacagaggaaaaagaacatgcaagtgaacaaacagaagaagaaatnngaccggacagattaacaattcaagatccaccgtcattctctggncagctctncccaaatctcatttaacaactncaaagatgcatttgccgttttgaaaaattaaaacttcttctgtctncncanaaaaagggagaagaagaagaagaagaggaanaccgaaggggatangcnnngccagtgtgttctctttcattacgttcttgacaagtgcattacaaccaggtcttaagttaattcctgtgaaaatgcaaccttataatcgnccaatagattggctcagtgcacgcccaatgaatgtgtcttgccccaggaaacaaagggattaaaaaggttttagtcttggcaaaatctgaataattgatcaataaaataagctttagtagaaaacaagcttggtaatcaatcacggccaatcttaacctaggttatnatttggtgcgctgcacaggccctttaagtgaagccttggaggacggtacttatttgccgtggaatttggatggggtttaccaccaaacgagcgtgaaattatcaag

SEQ ID NO: 29853 - DNA, 1245 bp, Oryza sativa
  unsure (1)..(1245): unsure at all n locations
atgtggcttgatnnnnnnnnnnnnnnnnnnnnnnnnnnnnnnnnnnnnnnnnnnnnntctttcttcaccctgcagcaatttcccttcttcagtgttatctctaaatacttcttgtctgcaatttatcatatttgtgttttgccatttgctgctgatttccttttctgcatcggactcattgatgcttggtaccttttctgattctgcatgatgctttgacaaatatatgcttgtgccttttgcgttacaaacttgttcgacggcacaaaagtgagccccaaagataactccaaaagccatgttctgttggagttcttgaaatttccctgcttgtgctatccttccattttgcatcacctgcaatattgcttcaaccagtcaagttaaacatactagtttcttttctgggatccttatgagttattgagaggtagtagtatctcctagtgtggatcatgagaactgataggtgtagctactgaaagttatacaaaactaacactaggagatacctctacacctcaagcctgcaaagggctgtaaattctctaaaaggattcccatatgcacagcatgtttttagcagtcatcattatttatcctaatgttcagtacaatcatgtctttagtttttttttcaggggcttaccataataaggtctgcatcaactagaaattcaacttggtgcgtgacgtataacacagttttatcccttaggacccccatcaggcatttctgcaaaaaatgtagggtaccgagctccaaatcgccctataatgagtcggattacaatttactggccggcggtttacaacgcgtgaacttgaaaaacctgggttaccacaattattggcttgaaaaccatccccttttgccaatttggtaataacaaaaggcccgaaccgaccgccttcccaaccattgccaacttgatggcgatggacccccccttaatcgggcatttaaacccgcggtgtggtggtaaccccaagtgacacgttaccttgcaggcccttacgcccggtcttttgtttttttccctcttttttgccacagtgcgggtttccccgtaagatttaaatgggggttcctttaggttccaataaggcttacggcccccgacccaaaaaaactgttgggggatgggcccgagggcgctctccctttacacgttttctcccttgacctgggaccactttttaataggctcttgtccaacgggaaaccctaacctatttgttttt
